United States Patent 10,724,096 (METHODS AND COMPOSITIONS FOR INHIBITING AND TREATING NEUROLOGICAL CONDITIONS) - sequence listing, part 123

SEQ ID NO: 2264 - DNA, 20712 bp, Homo sapiens
taggaaaaatgtcatttattcaaaatatgaaattttattataattgatgtttaatgcaattcactttacgaaggtttttgtggttttccctaaaatttctgttttaatgaaggctcctgatcatcctggatgtcgacaagttttcttcttcatgtgacgtctctgatgcacaataaactgattagtttttctaaaactgattatattcatagggtttcatctcactctaacataaagtttaagctaaactacgtccatttaactaataagccaaatttgtaagagcttaacagactataaacttaactcttgctttaaagcaacaaaaacaaaaccctgatgaagacctggaagtgaattgttcgtttttcagactctagcttccttgaccttgtgctctatggttttgaacacacaggacccaagtttgctgcagaaataacctccaaatccatcttatgaaccaggaagactgtgagggtttttcttttttttttttaagggccaagggtaaatgtaatatttatcattagcaccacatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagcttttccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcgtagggtttctcccccgtatgaactctctgatgtgcactaacatatgacttctcagagaaggttttcccacattcactgcattcatagggtttctcccctgagcgagttctaagatgtgctctgagatgtgatgtcttggagaaagtcttcccacagtcattacattcatagggtttctcccctgtgtgaattctgtgatgtgccctgagggctgaattatcagcaaacgttttcccacattcattacactcatagggtttttccccagtatgaattctctgatgtgcacagaggtgtgttctttgggagaaagttttcccacattggttacattcatagggtttctcccctgtgtgaattctttgatgcactatgagggctgccttatagacaaaagttttcccacatacgttacattcatacggtttttcccctgtgtgaattctctcatgtccactgaggtatgatttctgggagaaagttttcccacacttgctacattcatagggtttctcccctgtgtgaattctccgatgtgtactgaggcgtgtcttctggaaaaaagtttttccacattcactacattcatagagtttctcccctgtgtggatattctgatgtgctctaagggctgaattatgggcaaatgttttctcacattcattacattcatagggtttctcccccgtgtgaattctctgatgtattttgagggctgaattatgggcaaaagttttctcacagtcactacattcatagggttttctacctgtgtgaattctctgatgtgctctcagggctgaattgtaggtgaaagatctcccacattcattacattcatagggtttctcccctgtgtgaattctttgatgtgccttgagaacagaaatatgggcaaaagaccttccacattcattacattcataaggtttctcccccgtgtgaattctatgatgtgctctgagggctgaattatgggcaaaagttttctcacagtcactgcattcatagggcttctcacctgtgtgaattctttgatgtgctctcagggctgagttataggtaaaagatttcccacagtcattacattcatagggtttctcccctgtgtgaactctctgatgtacactgaggtgtgtcttgtgagagaaagttttctcacattcaacacattcatagggtttttcacctgtgtgaattctctgatgtgctctgagatgtgatgtcttggagaaagttttcccacattcaatacattcatagggtttctcccccatgagaattctctgatgtcctttgagatgtgatgtcttcccatattcactgccaccacagagttccatctctgcatctgttttctggtgtcctatgaggggtgacttgtaagatctcccacagccattgttatcacaaggtttctcttttgtgtgaattctcagatgtttactgaggtttgaattctgacagaaagctttcccacattcattacattcataaagtttgaatcccacataagttccaggatgctgaataggatgtgaacttgaacaaaaggattttgcacattcctcatattggtaagttttctctcctgagtggggcctctgatgctgaatgaggtgtgctttccggtaaaaggattttctgcatttcccatgttcatcagaaaggtagaatttatcttctgtgtgaattctctgatgtgctgtaaagtctaatttctggtagagggcatctgtacattcattatgttcaccaaatttatctccagcttgtgttttctgatgtactatatgggctgagctctggctaaaattttcttcacatttattgctttcaaaagcactccatcctgtaatagttctctgagattgagtgaggggtgacttcctactgaaattaatccccctttcattacactcatagtgtgtcatagccatgtgaactttattgtattcaacagcggtggttttgtcacaggatgtcccatattcattaagatcagagcatttcccccttgtgtcagttctcatgtggttaaataaagtgattttatcaaagttttttctaaattcatcatccttacaggacttttctcctgttagaaaactctgaggtgtaatacaaattgtcttatcatataaaccttgtccagatccatcacattcaaaagattcctccaaagtttgaaatttccaatgctgatctttcttataactgaaagctttagcattttcaccatgttcataagatttctcttcagcatgagctttctcatgcttaatatcaagctgcagtttctcacacacattcatgtattcagtcttctttcttgaatattttctttcacttataattaattgagaagcaactggcaaattcattctgtgtgagtcacatttacaggatattttttctgaaagctctggagctatttccagattaaatggtttttctaaaactttctgtccttctttactcaatgttttgtcagcatcactgatgaatatttcttgccacagaggtttttcttgtttttcccggatccctttgatgtgatcaactttaaaataccctaaaatgagaaaaattgaaaatatagtataaatcttacatttctcatggagaagaacttatactcatattttgattttggttttggtttttgaaatagggtattgctctgtcacccaggctggagtgcagtggcatgatcatagctcactgcagccttgaactcctaggctcaagtgatcctcccacttcagcctccctactagatgggactacagggatatgccaccatgtcctgttaattttttttatatttagtggagagagggtcttgctacattgcccaggctgatcttaaactcctgagctcaagcgatcctcctgccttgacctcccaaagtgctgggattgcaggcatgagccactgtgcccggcccctgttttgttatgtattttattctattgtttctggtcatgtttccaaatattaaatacttcatgcacacagacagactctctcctcatccatgctgtttataaaacaggtattatttccggggccagtcaaggtggagtagtaacccctttcctcccacatcttccctcttacaattaaaaatccctacagaaaaaacaaaacaacaaaaaaagattaacaaatatacaaatatacgaatactacaaaatggaaagaaagtggacttcaggacttaagaaatgacacagtatggaattccaaggctattctatatcctagactgggtgctgaagaaacctacaatcctgcactgacaggcacagacaaaaagagcacaaagaaaagcctgcttcttccagccagaggtctgagaaaatggtggtctaacagaacaggaaacacttttgatgttttctcatgctcaggccaaaccaaaatgatacaatcctgtggttccatggaggctgagcagggagctaatgttccctgccgtagatacacaggatctgcatgctcttatatgttttcttccatgagccatgaagaatcctgagaaagttccattcttaggatatgctgggagatggtcacagcagccactaccaaaattctgcctagaaccaaattattatctaatttatggaacaaatgtcttaatctgcaagggcaagaatataataagttgttttagggcactgacaggaactcatagcagctatgggaaggaaacaagaaaaaaagaagcacagaagtaagaggagaggcaggaatacacagtagacccaatactcaagcagaagagataagataaagtagcacttgcaataaccatggcttcaaacctgaagacacaatgcattcaacagctgaattcacattcttctgaaatgcacatggaacaatcatcaaaacagactatattctagactgtaagacaaaccttcagaaatatagaagaaataaattatacagaggatgatcttgggccacagagaaattataccagaaatcagtaaacacaaatttatctggagaaatacaaaagaactgtaagttacacattcctaattaacccatgggtgaaagaattctcaaatgagatattttgaagtgaatgtaaacaaaacaacttagaatacagaaatttgtggatacagctaaggcagtacacagagataaatttggggcttaaatttttttggccagacgcggtggctcacgcctgtaatcccatcactttgagaggctgaggtgtgtggatcacaaggtcaggagtttgagaccagcctgaccaacatggtgaaaccccttctctactaaaaatacaaaagttagccgagtgtggtggtgcacacctgtaatcccagctactcaggaggctggggcaggagaattgcttgaactcgggatgtggaggtgcagtgagccacggtactccagcctgggtgacagagtgagactctgtctttaaaaaaattatatttgaaaagaaagatctccagtcagatgcttgtttcccccttaggaaactagataaagacaggacattaagttgaaagaaagtagaaggatgacaaaaaagtcaaaccaaaagcttaattttttaaaaagtttttttaatgataaaaaccatcagagagaaaaaaagagaagacacaaattaccaataccaaaaattcaagagaggactaactactaacagacattcaagagataataaaacaacaataacaataactctgtcttagttcgggctactacaacaaattaccatagactaaatggcttaaagaataaacatttatttttcccagtgcaggagactggaagtctgagattagggtgccaacatgactgtgttcttgtgaagacctcttctggtttacagaccactcacttcttgttatatccttacatggtgaaaagtgaagtagctagctctgacaccgttttgtaacagcattctagtctctctcttttttttttttttaactataaaagcaaactaactttatttggacaatctaagtggaaagaagaggcaggtgaatgtgtattgtaaccacagagaatatattctatgtcaaatgttaaaacataatggcagaataatctaaaagactttttttctaaaggagctgtcagtgaaaaggatatttacgacaacatattaacttacttcattatgatggaggatatgttaactgaatgtctaatttactcaaattttaactatgtttgcatatgtaaataaggcttaagaatgtaatgaaatcttcctctatatatgtgtatgtgtgtgtgtgtgtgtgtgtgtgtgtgtgtgtgtgtgtgcaattccaaagaacaacttctggaccaaatagttttaactagtaaattttaccaaacatccaaggaagaaataataccaatcctacacaatgtcttctagaaaataaaagatggaatatttcccaaatcattttataaggcctgcctcatcctcatagcaagattaggcaaatactattcaagaaaagaagctttcagaccaatatctcccataacataaatgcaaaaatgtcccaaaaagtacactgaaatatataaacatagataatgtatcagtgaaatttacctcaaaaatgccaaacagttactacactgcaatactataaaaactatagtttttatgctgcatttcaggtcaatgtaatctcctatcattagtctgaagaactaaaatcacacactacatcaatgccaaaaattttaacaaaattcaaaatccatttattaatttaataaaagtaatctataaaaagcctataactaacattatactcaagagagactgaatgtcttccctctaagatcaggaaaaagacaaagatgcccactaccagtagctttacacaagattgcactggaaggaccagccagtgcaaaaaggtaagaataaaaacacaaagatacagagtaaatttacacagaaagtttaaaatcaaaaaagttccttgaactaataagtgtttttagcaagggcagaatctaaggccaatatacaaatctatgcctacaaacatacaatgatgaattggaattttaaatcacagaaacaatattacagcaccaaaacaaaattaaaaacaaaaattaaaaaagcctcgttatctgtgttctaaaaactaaaagacattgatgaaagaaatcaaagaaacagtaaataaatcagtagggatattttgtgtatggactggaagactgtacgttgttaagatgtcaattctcctaagttctacagattcaatgccactccagtttaaatgccaacatgtttcctttgtaaagattatgaacctcatttaaaaatttatacacaagatgaaaactggagaagtacttgacttcaaaacttaataagctagagtaatcaagttaatgtggtattggcataaggaaagacatgtagatgaatgaaaaggaatattaaactacaaaaatagacccccaaatgtacagccatctgttttctaagaaaggtggaaatgctgttcagtggagaagtaacagtcttttcaaaaagtgatgctggaataactggactccctgttccaaaaacatttaacttgacacataactcatactttctatagaatttaacacaaaatggattatcaactaagtgtaaaaactgaagctgtaaaatttctagaagaaaataggattcctaaatctgttactttgagtttcaaggtttctagatagaacaacaaaagcaggttctgtaaaagaaaactagtaagttggactttatcaaaattaatattcagttttagtgagcctcctctgaagttatactagcgggagtgaggtgcagcatcactgcctgctacgtggggaaggaagtccagttccccactgatctgaccccctgggggtggaagaggaggcttctacttttttttttttttccttccttttgagacagtttctctcgtcacccaggctggaatggagtggcgcaatcttggctcactgcaacctctgcctcccgagttcaagcgattctcctgcctcagcctcctgagtacctgggattacaggcacctgccaccacgcctggctaatttttgtacttttggtagagatggggttttgcaacgttggtcaggctggtcttgaattcctgacctcaggtgatccacccgcctcggcctcccaaaatgctaggattacaggtgtgagccaccgtgcctagctgaggcttctacattaaccctgggcatgggtgaaagatcaggagccccacaaggactctgataacactaaccaccttgtattttgtcaggtgccaagacccctagtgcatcttcattcttctttccacccttcagtagtgtgatctcagctcaccataacctccacctcccagattcaagcaattctcgtgcctcagcctcccaagcagctgggattacaggcacgagccaccatgattggctaatttttttgtatttttagtagagacagggttttgccatgttggctaggctcgttaaactcctggcctcaagtggtctgcctgcctcggcctcccaaggttctgagattacaagtgtgagccactgtgcctggctagatattgcattctttacaaactgaaggtttgtggcaaccctgagttgggcaagtctgttggtgccatttttccaacagcaagtgctcactttgtgtttgactcagcagtttttagcaaacaaatattttaattaaggcatgcatactgttttttagacatgttattgcacatctaaaagactaaagtatagtgtaaacataaaacttttataagccctaggaaaacaaacattgtgtgtaacttgctttattgtgaaatttgcttcattgtagtggtctggaacagaaactgcaatatctctgaggcatgcttctatatacagatatttagctgcacttagtgggtagagtagaaaggaatacatttactccatccttcccctgggtaatgcattctgtattttattaaatccttccctaagaagagtcattaacctattctatatgatcttctagaatatttctacttttgttttgataattaggtcttaagccaactgaattcgactttttgttttgttttgatctatatggatacctcaagatcctttcctcattgttctccagtgtcatctatctaagatgtctatcaagtatatgttttttcttttgtcttttttttttttttttttgagatggggtcttgctctgtcgcccaggctggagtgcagtggtgcaatctcggctcaatgcaagctctgcctcctgggttcacgccattctcctgcctcagcttcccaagtagctgggactacaggcacctgccatcacgcctggctgatttttttgtattttcagtagagacgggtctccatctcctgaccttgtgatccacccaccttggcctcccaaagtgctgggattacaggcatgagccaccacgcctggcctcatgtttttttctttaactttctactctgtttcactaatttactaaatcatcccaccccccagctccatgctacttagctacacagcactttacataaagcctcaatatctggtagagcagcaaatcctcctgtatcactcgtttttatgaatgggattgtgtttggtatagcgttatctctttacagatgtatcctgacttgaatttattatataggtgtttcctctcttttttctttgatagggttagctgaagtttaattcattttatttttcttgtaagaaacattccatttctgttttccattttatttttaattttacttttaaattcttctgttttcactattgtatttttgatgctgttcttgcttaattaatgagactacgaacttccttctgtccactactttagctatacctgatggtttctaacttgcagttacaattatttcattacagaaatcaaatccaaaattgcattacacttttttgtatattgtttaaaagagatactaaaattttttcaagtggatttttttcattttattattaatttctggatttaccaaactaggttcagagaatactgtttgtgtttattctaatttgttagatttattgaggttttctctttagactaatagtatactctattttatcattattcaattaaaacatgaaagttttgttttttgcattagcatacatatacacaaatgtatggttcactttaatacaaatgtaatttatagcctctctaggcatatttatttaatgtccactgtacctactgtttaatcagatgagacattatgatgtcctaattctaatgagttttaagttcttagaactccattattttatgttttagaaacattgatattatattatttggtgcagtcattcaaatccttaaaggttttcatttccctgtgctcttgaatgagagcttttcctactttaatgaatttcttgcctgaattcaaatctgaatgatatagaacatgaaatctacattattttatctttattgactcaacaactttactgattttttttttttttttaattttttgggactgagtctcgctcttttgcccaggccggagtgcagtggtgctatctcggctcactgcaagctctgcctcctgggttcacgccattctcctgcctcagcctcccaagtagctgagactacaggtgcctggctaattttctgtatttttagtagagacagggtttcaccgtgttagccaggatggtctccatctcctgacctcgtgatctgtctgccttggcctcccaaagtgctgggattacaggcatgagccaccacgcctggcccaactttactgatcttttataatgatctttctatgttacttatttagggatatcctttttagacaatcaatatgatccaataatttacatttagtgactcagcaacatacttgatctaaattatgtcactctttatgtgatgctatttgttggtatggcttcaaacaaaaaccttaattgtgcttcacttctaataagatgattttacttttttattctaaaaatgacattgaaaactataactttttaagatttctggaatcatttattcgtacaaagcctaataggcatataaaaagatgcctgatatcattggtgaccagggaaattgttatagacttatttgtgtccttcccaaattcttatcttgaagccctaacccccagtgtaactgtatttgcagacaaggccttcaaggaggcaaaaagggtaaaaatgaggtcacagggaaggaccctaatccagtagtactgatatctttataagaagcggaagaaacaccagagtattctctctctcccactgcatgtgcacagaggaaaggccacatgaacacacagcaagaaagtggctgtcttcaagccaggaagagacgcttcaccagaaaccaacttattagtactttcattttagactcccagcctccagaatcatgagaatttctgttgtttaaactacccagcctatggtattttattatgatagccctagctgactaatacagaaatgtacatcaaaaccacagtgagatatcacttcacatccactggggtggctagaatcaaaaagtcaaacaataacaagcactggtgaggatgtggagaaatcagaacccccatatgctgttgttaggaacggaaaaatgctgcatttagaaaaacagtctggtggttcctcaaacagataaagacacagataccatatgacccagcagtttcactcctaggaatatacacaagagaaataaaaccaattgtccatgcagaaacctgtaaataaatgtttatattagcattatttgtaggtggaatcccaaatatctactgactgataaatggacaaacaggtggtacatccatacaacgggacattatttggccataaaaagaatgaaacatgtattttatatcagttgtaaacattatgctaggcaaaataaaccaatcacaaaagaccacatatatgatccaatttatacaaaatgtctaaaataggcatatttatagacacagaagtagactgtggttacctagggctgcagagggcaggggggatgggacagtgataactaaagggtacaggtatgtttgaggtgatgaaaattaactgtggtgatgtctgcatatacagtcatcccctggtatccatggggaattggttccaggattctcttaaataccaaaatccacaaatgcccaagtccttgatacaaaatggcatagtatttgcatataacctatgcacatcctcttgtatactttaaatcatcaccatattaattatgctacctaatacaatgtaaatgccatgtacatagttgttatactatattgttcagggaatagtgacaggaaaaaaatgtctatacatgttgaatgaaagtgcaatatttcttccctgaatagttttgatctgtggttgcttgaagtcactgacctgtacactttaaaggagtgaattgtaggcatgtgaattatatctcaataaagctgttccaaaaaaactttcaaaggtgctctccctctaaagactaagtacccccagggggctccttctgttaatgcccactcacctgggtacctctggttcaggaattcatcttctaaagaccatggctcttctcctttctccaacttggagatcaccttaggtttagtaatgcaatatcctgtaaacaaaataattgacatggaccagattcacaggcttttggatttccaaagggaaaaaaagatatggcagcaaagcattaactgagggtgttcatttgaaatttttaatgggaaagtaatgacatgttgcttttgtttctgtaaaggtttcaactacttcaaaccttttaatccaaagccctttaatctctataaagggtccatgtgttttgatactttttaaaaagggacatatattctcgagagagccccatggtaagctatgctcacccactgagatgaggtggctgtagttctccagcatcacatctctgtacagcgtcctctcgacagggcccaggtgctgccactcctcccgggtgaattccacagtcacgtcctggaatgacactgatgcctgtaacaacatttatcacaacaaatataacaatggtttgttcaagggttcagaattgggtgacacagaaaatatctttgagagctactactaaaatgaatggttataaaggcctattttagacccaaaattgtcttaacatatgtaactcaaaacattttttaacttgccataatttctctatgtatttatgaattctaggtttttgtaagacaaaaaaaaatcaatgtaaaacaacttccttccaaccacctccttccttcttccacatctccgcaaattatccggggtagtctctaggacattcacaccctccctggacatcatcactgtaaattctgggggctaaggaagagatatatgtgaagtctggagataccctgaccaaactttatatagggtagagcaggtgaagagcagagaacagctataatagttgtaaccaaagagactggcacaaaagaacacttcctacactgaggtcacagcaatggatgtaagaatagggatataatcacagaagagaagcaacacccatttaatacaatactttcttgtacagctactcaatctagctgtatgagaagctccttttaaaaaaattttgtttttaattgacagaaagacaaatatttcaaattatagtcacttatatgtggaacctaaaaagttcaaactcatagatgtagacagtagaatggtggttaccagaggctgggggtgaggggtgaggaatggggaagcattggtccaagggcacagagtttcagttacataagaggaatagtttttgagctattgcacaggatgatgactagaatgaaaaataaagtaatgtatatttcaaaataagcagctgcttggtggtgccaaaactggtatctgggaaagaagaaaacgtgttagaagattcagtgagagttctgttcatgttgatacgtagctagaactgttcgttcaaccaggatacatatgattttagagcacagaaggtaagatggggatgaagataagcatttaggagttactagcaatttaggtggtgagtaaaattagcagagacagacagctccttgagcacacagggattgaagaaagaaaagaaccaaaaacaacacctgaggaaccacaaagcagaaaaagtacaggccacaaagccagagatgttttccaaaaaataataacagaatcaggagggggcagagtcttagaaattgagaaaagagaaagtttccacaacaagaagacttcaaattcaaattagcaagtgatgacggtgaagatactgaagatccaagaaaattccttcttccataaaagcaatgagaaaccggcaaaaactgcagaatcaactttttcagaactctagaagctaccaaaggcttacagcaatctgcggaacattgatatgagaaaaacagctgcatcacagtaagaacaatgatcttgtgtcatttcaacctgccctatatccatccctctcactcccactcggcattagctttgagaaacatctgaaacaacaggagaatccagcggcctggtatccactggatgaggcagactgggtcacaggttggccaaagcctcactcccagaaaatcctcattatctgacctaatctgtggttccctggaagagctgacttgaaaggctgattgaattaagtcagagttccccagtgtgaaaagccttattcttgaaggcatttgccaaaaacattcaaaggcaattgtttaactcagcagctaactgaggcggtggataacacctgacataaataacagcctaattgaaaagctttttagaaaggaaaaactggagaatgggatgttcataaagcttttgaaaagctcctatagattctagagactctaggtcacctacatgcatagagctgagcatatgcccagggctgtgattatgctctggaaagatgtgagaaggccctaaactgtcaccctgggtgaccctaaggtttggggtgaactggaagtgaaggaagtgaaggttaacatggggttataaattgcctggatgtctgttgaaggaatgccccagcactcatgaggctctttggcaaagactgagagccttacttaaggtttcaggcatttaagaaaatttctgcagacttctgcagccacacatgacaataaacacaggctctactgaatcaattaaaaagtcactagacaaatttcaacaacaactcctgcaaatcaagaaagttttctagagttgccaccttatttaaaatgtatagttttcaacaaaaaatgcaaaacaagaaaagaaacaacaagtaagacccatatgcaggaaaaaagtacaatcaatagaaactactcacgaggaagcaggcattggacttaaacagacgatgactttaaatcaactatgttacatatggtcaaagacttagaggaaatgatatgtaaggaccaaaggaaagtattagaataatatctcaccagataaaggatataaataaacagaaactataaaaagggaccaaatagaaactttaaagttggaaagtacaaaactaaaacaaatattttaccaaaaacacctgttcaacagcaggtctgaacgggtagaatgaagcaactggacaacatgcccactgagattatgcagtgagaaacagaaggaaaaataacaagaaatgaacagttggacagcatcaagcttatcaacatatgccaaatagactaacagaatagagacagaaagggtctaaaacaatatcagaagtagtaatggccaaaaaaccccacaaatctgaaataaatgataaatctacatgcccaaaatgcttcacaaactttaagtaggataaacttggagaaagaaatccacactcgctgggagcagtggctcacacctgtaatctcaacactttaggaggtaggcagatcacttgaggccaagagttcaagaccagcctggccaacatggtaaaaccccatctctactaaaaatactaaaattagccagacatggtggtgaatgtctggaatcccagctacttaggaggctgaggcacaaggattgcttgaacccggaaggtggaggttacagtgagccgagatcatgccactgcactccagcctgggtgacagagcgagagactgtctcaaaaaaaaaaaaaaaaaaaaaaaaagaaaagaaaaagagaaaagaaaaaagaaaagataaatccacacctggacatgagaatcagagtgttaaaaagacagacaatcggaaagctgtaacagagaaacaagtcatcatattacaggctgatttataatgagaaactatggaggacagagggcaatgggatgacatattcaaagtgctgaaacaaagactgtcaaccaataacctctatatccaggaaaaatagagaaactggaattttcccaggtaaacaaaacctgagataattcatcacaggcaagactgcctataagaaataataaagggaatggttcagcaaaactatggagatagaggagtaggttagtggttgtttggggctcagagggaatcaagtggtagttacagtgtacacagcttctttctaagggaataaaaatgttctaaaattgactgcagtgatattagtacattatctgagaatgtactaaaaaaatcactgaattctacactttaaatgggtacatggtaagatacatgaattgaatctcaaaaaaagcagttttaaaaaaagaaaaaaacaagggaagacaaaatcatttggagacaacagagaagactaaagagccaaggacagaaactgaggctgagccgagtgacaggacaaggaaggtggctccatgaagacatcagccggggaaggaccagtgaggggcaagtatcactaacggaaatgttccaggacagagtgagacattgaggcaagtgctgcggaaaagccaagcaagttaaggaaaagaccacatccactggatttgattatactatgggtagggacactggaggtcccaggcaagtggcaagaaaaaatcaaggcatcccatggagagttgacgttaaatgctaagtgtggaaatatctgaaagagaacaattttggaccatctgctgagcaacctgaatatcatgggtactcaaaatatttatggagagtgattttaaagacattcagttgattcatcagaaaaatgttaaattcaacccttgcactggagtacttgaaaaatagtactgaacgtgttcaaatttagcattacaatttctacttctattgaggaagtaatattctgttatttggcaatttattaactaagtcacctacttgaagaacaataaatacattttgttatctttatgtttatattccatgataaatcagttggctttatctttctcatcaatgtaaacctttaagtattgtctgtctgacactccaccatgactgtcaataacctcagaaataaatctgaagcttaatttggtaaatttgtaatatcggaggatctgcatctatccacatgccactttgctctgctattcatctgcatttctacatcttctaggaatgtgtctgatccatctctatttctacttttccatgttaatgtacggacacataaacccttacaaaacctattgtaaaataaaccggtttttaaaaacctaactcacctgagacatgttcattttctgctgctcctggaagagtgtagaggactgtggaggttcagctggggaggaggaaagagcagtggggtcatgagagacctggtctgcctctcagttcttacagagatggtccctgacatgagatggttcgacttgataatggttttactgcgacataaccccactgtaatcaaggagcatgtaatcctattcatgtgcctaaaaaaaaaaatcatcgcactcagctggagaaaaggattcccaatgcagaatgtccctttgactcttgaaaagggacaagaaggaccactcaaagatagccacacctgaatatgtgcatctctgatacgattatgtgcgcttaaacttacattttcactgagtaaagtaatactgttttttgttgatttactaataattatgttgatttattaacaattatgttcccttttgactaagaaaaaagtaaaaataaaacaaaggattaagcaagttcaggtacacagagatgaagctgtttaccttcattaaagctaatgtcaaagaactactcagccgggcatggtggatcatgcctgtaatcccagcagtttgggaggccgaggggggtgaactgctggaggccaagagttcaagaccagcctggtcaacatggcgaaatcctgtctctactaaaaatagaaaaaaataaaaaataaataaatttaaaaataattttttttaaaaaagaactactcaggctgacttaatcaagttcttactgcctttacacccagaattagcacttccacggaaaaaataaagatgggatgttttatgcaaggaatttcaggcccaatatttttgggcttccaatataggaaattcttcctctactacccggaaagaggcagcattagtatcactctaaatgccacatgtggtgatgaacacggtgtgagagggactcacaatgtggaagaagtgaaggcagaaaggaaactaggctgccgtttgggatctggacagctgattacatcttccctggatatcatgacctaaccagccctccagtaaagtgtctttttccacccagcttgatagtcactcatccctctcaacccctgggaattgccttctgcaagttagtccacagcaaagtcacacggtctgtgatggcttctggatgtggcaacatcacaaaatctgatgcatatatagggagtcaacaactgcctctggggaagcaatcaggacctgctcctttctagaatcttctgcctctgctctgacgctctagaagaggtctcggtcatatgggctgttcttctatggcagtagtccctaggactccctcttgactgcctcataggagctgctttgctccagaggggctgggacttaggcctgagaaacaaactcaattgaaaccttcacctaataccctaaacctgactcttgagattcactagaaatgtgctatccagcactgcagccatcagccacatagaaccattgaacacctgaagtttggccagtgctacaagtcgaatatttaggaaggaatgagttaagtaaaataaagcagtaaaactgactttgcctgcctcttctttttactgtagctactgaaaaattctaaacttttttttcttttttgagacagagtctcactctgtcactcaggctggagtgcagtggtgcaatcttggctcactgcagcgtccgcctcgggttcgagcgattctcctgcctcagcctcccaagtagctgggattacaggagtgcaccaccacgcccggctaatttttttatttttgtagagatgggcttttgccatgatggccaggctggtctcgaactcctggcctcaagtgatccactggcctaggcctcccaaagtgctgggattacaggcatgagccaccgcacctggccaaaaattctgatttatatttgtgttttgccttatctttctattggacagcacagcaccagaatatcaatctgtgcctttgaggagacagcgggaacagtacaagaggattcaggagcctcagcctgaatcagagacccgacaaatcgcagaatgtatctaccacttggtgagattctgtccacatttacttcacaatcatctacacagatctggtgacaggccactctgcataagcgctctgaaggctttaggcaggtactggcaagtctgggtttcaggcagacagcatgttagaacgagcaggacagggagtcacatctctcagcatttgcatctcacctactagtgtgtgccctggggtacccatccccatgaactttcgtccatttttttaaaatggaacgtttataccaaagaggtcgttgtgagggtcaggtgaaataccaaacgatgagaataagtgtctcataattgtgagagcagcttacatttcacatagtgactattacagacacttaacaaaatgctttacaggtgacaacttatttaattttcagaataggaacacgagttactagtaacctcctcctgttcgccgtcaacctcatccacgcacatttcctcttcccggcccgcaaccccgcggggcccggcagcccctacacctgcggacaggactcggcctgggcccgcgcactgggccggggaggagaggggagggccatcctggggactcctgagactgcctgctgctgtcctccgcacacaagcccgcccgtccccaggttcctgggccgcgcggagccctgtcaccgacgctctcaccccaggtgcgcagcctcggctcccgcgcagacctaaagactcggacaccgtgtccctttcaggcccgggagggcagacggcaggaggtggggctgggtttacacatgc

SEQ ID NO: 2265 - DNA, 34987 bp, Homo sapiens
agatcaagatgcgctttaactgagaagcccccaaggcagaggctgagaatcagaagacatttcagcagagtgagtggggctccaggcagggtggggatggggcagcctcctcagtgcccagatctggaagggtcattccctgggtaccatacagcgaggaggtgactgagggattgtttggggaaggagccccggctgggagtggaagtcccggctttcttgttatggtgcagtcctgtgttgctgtgtgacacaggcacatacaccttctctctgggcctcagtttccttacctgtaagttggttgttgggaggaccagcggtagagcagagatggcagggatgcactgggctgggctgtcagcagaccatgggggtgggacgaggagagagctgaagaccaccggcagtggaccacagggggaggcatgcaggccagagacgggtcagctgccggcttgctggagtcattcctcccacgcagtcccctcctgaggggctggagctggggctggagggtttcagcagtcagggctggagataagagtctgtgctggagctagagggaactgggctagagaatcaggaggacagacagggtgaggggacttcgggctaccttcatgctgtctgttagagataaagataggagtacaaaggggaatttttgggtgaggtacacgggtgaaatgagttttcagggcctcatcctgtgtgttcaccttctgtgtgtgtgtgtgtgtgtgtgtgtgtgtgcatgcgtgcatgtatgtgtgtgtgccggtcctggacagtcacagcttaagttagcagcaagagaacttgaggttaaaggtatagcacgcaaatatgaggctggagccactgagtagaggctgagggcatctccacagtccaaagctgggctgcagacagggaaggtcagcaggagcactggagggtctggcctggggttggggtcctggggccagcatgggtggggtggggctccagggcgtcgcctcattggctgagcaccgctcctccctccctgttccttggctgggttaagggagtggcactagcaggagctgccccagggcttctcccctggggacaaagatctgatggaagtgtggggccaagttctgtgtcctccagccctagtgacctctctttggctcctcagcatctacaaatctgaaggacaaaacatggttcaagcatctgggcacaggcggtaagtaccccaccctcttctcaccctccagccccctgtcctccacccagcccacttcagtgccctccctgctccatcctcagcctctcccttggggcagctgtcccccctcgacctcctcctccccacccacccactcgcctctgaggtcccagaagaaaagcatcttccacctgttgcctgggctgggtcctggggtgaggggaggctcagaaatacttggatgagggtcaaggcatgcaggtggccttcaactcaactgcactcagcacctctcaccctctcaggctcagctgtctttggggtgaaaaagagccagtccttgcaatggccaaggccctgcctatgtagtccttgttagctttctggcctccccactccagccccctgctctccctcctccagccacactgagtttcttttctggtttttttttttcttttctttttttttttttttgagatggaatccagttctgttgcccaggctggagtgcaatggcaagatcttggttcactgcaacctccttctcccgggttcaagcgattctcttgcctcagcctcctgagtagctgggattacaggattacaggcacacactaccatgcccagctaattagttgtttgttttttttttttttttttttgtatttttagtagaaatggggtttcgccatgttcgccaggctgttcttgaactcctgacctcaggtgatccacccacctcggcctcccaaaagattgggattacaggtgtgagccactgcacctggcctcacactgactttctttgctttcttcaaacatgctgagagtcctctggtgactattccctccatctgagaggctttctgcagttaacatacagcccactctcatctccttcatggctttgctccaaggccaccttctcaacaaggattactctgactgccctatttgaaatcacaccccatctccagcccctgcactcccaattcccctctccttgctctgttttttcccataggagctggtaccttcgcttatacaaatgtacttacttattacatttcattgctgtcagctccacgcaagcagggatatttgcctgttgtacacttggacggagagaatgaatagtgcccctctgttgacatcattgcctctagcctacgtctctttccagggctttagatcctgtttctagagacccactggtgtctcacaggcaactcagctcctagatggaaacagcctcctccgccccccacaagtccactcctcctgtgctcttggctcagtcaggggtccccttctcttcagttgctcaagccagaagtcaaggtcatgtccttgatacttccctcttccccatgcctcacatccagtcaccaatctcctaaaatatctagaatgtgcacagcttccaccattctttctaccaccaccctactcccccatggccatgtcaggccaccacccgcccattcttcaaaactcccttcaggcctcacctcccatgcctcccctgagttcccccagtcccaggctgcttctctctggtggtgttgccattacccatctcttctattaaacagagtgacccaagagtggagagtgggttttgactttgtatccctggtgcttgactcataagtaggtgctcaacaaaaattttttctttttttgagatggagtcttgttctgttgcccatgctggagtgcagtggcatgatctcagctcactgcaacttctgcttcttgggctcaagcgattctcacatctcagcccccaccccagctgggattacaggtgcctgccaccacgcccagctaattttttttttatttttagtggaaatggggttctgccatgttgtccaggctggtcttgaacttctgacctcaagtgatccacctgcctcggcctcctgaagtgttgggattacaggcatgagtcaccatgcctggccaacaaatgtttgttgaatgaagaaatgttggttagcaggttgaattgttggctcgtggttagttggatagtttatggttgactggttgattagataattcaatgagttaatagctggttaacaggagaatcagttagttggtttttgataggttagtcaaagggttaataagccaccgggcatgttggctcatgcctgaaatccctgcaccttgggaggctgaggctggaggattgcttgagtccaggagtttgggaccagcttgggtaacatggcaaaaccccatctctacaaaaaataggaaaaaatagccggtcatggtggcatgctcctgtagtcccaactacttgggaggctgaggtgggaggatcacttgaaccctgggaagtctaggcttcagtgagctgtgactgtgccactgcacttcagcctgggcgacagagtgagaccctgtctcaaaaaaaaaaagaaaaagaaaaagaaaagaaacaggcgttagtgagttgttagctatttagttccttggttaacagattacttaggggatctggttggctgtcagtttcttgctttgtaggctggctttcttgggcccctcttcttagtctgtaccctctccttgagctctctcatctatgcccatggctcagatgaccatctgtgatttgctgtcctccaaatgtgtctgtaagtgagaccacatgaccagctgcctcctcactggccatcccacccaagtgtctagcaggctcctcacactcaacatgtccagaaagggcctccttgtccattcttccacagcttctctgctgtgccccacgctagtcattccgctgccctagccaggacctgagggcatcgctgagctgccccgctcccttccctctctaaccgaacaccaagcctgtcagcttgactgtgttcttgtggccattggcactgccatccttgtggctcagactgccaccacttctccacccatctgtggagaagctgatgctcaccctgcctccactccacttcctccatcctggcctccacaggggaggcagctctcctgctgaaaccctccacttggcccatggccctctggtagagttcagactccctaatgtgggccatgaggccttctgccacctggccctggcccctctctgcccatctcatgccacctccactcctccgtggccagcccattcctgcacattggatactgccttagctgcaggcctttgcacatgccagtcctacgcccagagtgatccctgcctccctggaggctcctttaccctccagccttcttttcttgacctgaatttccctttctctgggagcctcctaccccctcctctaggccattcacttcctccacatgccccacagtgcccactctttcagctggggcaatgctcatcacactgcatagtaattgctcaattgattgcttttcttcccacaggctggattgtaccagtgtcttttactgcagtgactgaacattctaggcacagtagattcaagaaatcttgagttcattggctggttggtggttatctgttgcttactgtgtcttgcctgctgtgtggtgatgaggaaggagccaggcttccaggattctcttggtgttcttgtctttccgctctgtccacttctctctcctcttctgtggttacctccagcatgggaggtggggttggatgggagccagtggagggtcacctcgccctgctagggagagcagcagcattcctcagggctcctaaattcccctgacctcacagcagcaaaaagtaagcagagggaatgagagacgtccaggcatggaataaaacatcttccacttttcagctgagaccctctgttcatggctcacccatcccagtccttgctctattccttactccagagaaacaaaaccagggatgagtagatggagggggatgcagagttgcgcggatattccactggcccccatccaactccagctcccatgcagcatcgtataggggtctcattatcccatgaccagcctcctcagccctgaagaagagaccctatcaatgcaagcagcagcccaaagacagtcctgggaaggtaccatagaggcaggggagaggtagacagagcagggagccaagaacaccaagggaatcctggaagcctggctcctttctcatcagcacagagcaggcaacaaccagccaaggaaccaaagatttattgaatctactatgcctactatgttcaggcactgcagtgaagcaaactggtatgatcccagcccttaggaagaaaaaccgttaattaattaagctttttttttttttcttttttgagacagggtgtcgctctgtcacccacgctggagtgcagtggtgtgatctcagctcactgcaacctctgccttctgggctcaggcaatcctctcacatcagcctccccattagctgggaccacaggcgtacaccacaacacctgactaatttttgtattttttttttttttgtagagatgaggttttgtcatactgcccaggctggtcttgaactcctgggctcaagcgatcagctcgcctcagcaagtgctgggattacaggcgtgagacactgtgcctggcctaactgagcaattactatgcagtgtgatgagcattgccccagctgaaagagtgggcaccgtggggcatgtggaagaagtgaatggcctagaggagagggtaggaggctctcccagagaaagggaaatttaggtcaagaaaagaaggctggcgggtaaaggagcctctggggaggcagggaaccattctcggtgtaggactggcatgtgcaaaggcctgcagctaaggcagtacgtgatatgcaaggatgggctggccagaggagttgaggggctggtgtcagcttccgggcatgcagacagtgagatagcagagtgactaaggccacacttagaggtatctgtatccctcttcttcctctttttttttttttttttttttgagatggagtctcgcacttgttgcccaggctggagtgcagtggcaagatctcggctcaccacaacctccatctcccatgttcaagtgattctcctgcctcagcctccgaagtagctgggattacaggcatgcgccaccatgcctggctaattttgtattttttagtagagatagggtttctctatgttggtcaggctggtctcgaactcctgacctcaggtgatctgcccactttggcctcccaaagtgctgggattataggcgtgagctaccgggcccagcccctcttcttcctctttatcctccagtcccaccccgccaccttccccaaactccagtcctatacctctccctatacgcagatttggaacctgttactcacctgtttcatctacctttccatctaaccgtgcacttaactaaatataaatcaagtgccaggccctttggcaagctctgaggatctagttgggagtaagacagattccccagttttcacccattcaacaaatacttattgcacatctactatgtgcctggcatggtgctgggcactaaagatacaccaggaagtagatccagtccttccttttctccctcccgctctcttggtcattcattcattcattcactcactctctcacaaacctctgtttgcactgacctggttgcacagcctggtgcattttgctgaccccttcatttttgacagaacctggcgcatgtttcagtgctcagtgctgtttacagagctcggcagcagactttgtcacacttcatgctgtttgtagagtgcctcactgttgccaggccctggcctgtgaccccaaagttctggctctagcagataggcagacagacagatggacagacatagactactgagctctactttccagcctgctctctcccaccctactttttcccagaggcttgttggcaccgtggattgcactttcagctccccacctgtccgtctgcaaagtggcctcattggtgtgccatttttactggtccagtcccaactacaaggggcatggcttggccatctaccccagttcctctccatgtccccatggctctcaagtgtctccaattccagctgtcccagctgccccgggcaagaggaggtgtgtgtggcaagtctgctgggttacctattaactcagctgtgagttgaagagccgatgggcagcaggcagacttgagtctcctttctgtccatgagctcgggccactgtatcaggtccacccgtggctccaaaatggtctcctggtccgtgatagcaaagatccaggaaatatgatgcgaggaagatgagaggaagatggcgcgagagttcctggccgagttcatgagcacatatgtcatgatggtgagtgggcgggcagcacgaagtgggtgggctctgccagggccttccatgaccccctccccattctgaccccatgggtcacattgtccattccttgcctctgagctgggagcctggggaagcagcgaggaaagtaaggggggggggggctttctcatcaagtctttttggacagaaagggctcataatatgtgggggtcaaatgaaaccatgcactggggtatccggggcaaggctggaaatggggagaagggaaacccagagtaaagagattgaagaggcccaggtgcagtggctcatgcctgtaattccagcactttgggaggcttaggcaagtggatcacctgaggtcaggagttcgaaaccagcctggccaacatggtgaaaccccgtctctactaaaaacacaaaaattagctgggcatggtggcggacacctgtaacctcagttattcaggaggctgaggcaggagaatcgcttgagcccaggaggtggaggttgcagtgagctgagatcacaccattgcactccagcctgggtgacaggagcaaaactctgtctcaaaaaaaaaaaaaaagaaaagaaaaaagagagagagattgaagagaaacttgatgatcaggctctgataatgaatccagagggcaatgggcgatgttgaaggctggcaagcaggggagtgacatgatcagatttggattttaaaggtaattttgggtgcagtgtggagcataagcaggacaggcaaggctggcaagaaggaaccagttaagaggctgtttttgatctgggacagagagagggtgatgactgatctggggttggagaagaaagcacatgtttgagagggctgtggaagatggaatcggggagactctgccagcagaacatgtgggcaaagcgccgatgagctgttctggagcacggggcccagcacagggtgagaggcaagatgcctgtagggaaatccaggagatagttaaacacaggcaagggtctggagctcaggagaggcttggtctggaaggaaaaagttgaagttcatcacaacacaggtggtggttgtcaacactgtctagaaggagtgtacagaaagagaaaaggatggtttgaggacagagccctgaggaatgaagaggggcacgcaaaggagcctgagaaggaatggtcagagaggtgggaggagaaccagagccgactgcatgacagaggggggcagtggttccaccaggaagaagccatcagcggcatgggcagcggcagatgggccacgcaaggtgagcactggcaaggggccttagggtttgccaatgtggaggttgctggtaaccttgacaagggctcttctttagtgtgtgattgggacagaatccagactgcaggtgggatgtgaggttgctccctctccacctgcttcagccctgccacttaccccagtgagcctctgcccttaacatgactgtagccatgtttattgcatcttatgcagggtccagggtctagagaaagaaggggcagcctctgggaagggaggcaaaggcagccaggtgcatgctagaggaaggtggggtgagagaggctgttcgtgtgtgtggtggggcccatggagctcaagggagagaggaaattggaacaccaggtttcttagcctgaccctgccactgagtgaccagttgccttgggcaggtctctccctggcttaaagcctgacttctcacttatatcgtgtagaattaggccttcgtgggctttggagctgtgtttgaatcctagctctgttatcttctagctgtgcgactatccacaagtatcttaactgttcacaaatttagctttcttgtttttgagacagggtctcactctgtctcctaggatggagtgcagtggtacgatctcagctcactgcagcccccacctcccatactcaagtgactctcttgcctcagcctcttgagtagctgggactacaggcatgtgccactgtgctcagctaatttttctatttttagtagagatggggtttcaccatgttggccagactggtctcgaactcccgaattcaggtgaccttcctgcctcggcctcccaaagtgctgggattgctggcgtgagtcacctctcccagcccacaactttagcttccttattggttaacaggaggacttgtgtgaagaaggccaagtctcagcacccagtgtggtacccatgtattggtcccttgttattaggacgggtgctctagctgctgtctcctctctgtctctggccctcccctactcctctcttacctccccacctgctttggctcctgagctgtgaggacagcagttggatcctgtccctccttaatccagggcaaagtaattcacttaccacaagacattccagccccatgagggctgttaacccttggagcctcggaggcaggagggtgcatcctctgagagctgttagggaaataggcaccgcccacatgcttgatacctgcccacatctgtgttcctcttccttttgttgagattttcattgagcacctaatgcatcccgggctctgtgatgctaagccccttacgtgcagcatcttcccaaatcctcgcaatagccctgtgaagtaggtactattattatcccagtttcacagatgggaaaactgaggctccttgagactaagccttttgcccaaggtcacactttaagtcaagattaaatccagtgcagtctaatatcacagtcttttttgtttttgtttttgtttttttgagatacagtcttgctttgtcacagtggtgcaatctcggctcactgcaacctctacctcctgggttcaagcgattcttgcatctcagcctctggagtagctggaattacaggtgcatgccaccatgcccagccaatttttgtatttttaggaaagacaaggtttcaccatgttgtcaaggctggtcttgaactcctgacttcaagtgatcctcccacctcggcctcccaaagtgctgggattacaggcatgagtcaccgtgcccagcccaatatcacagtcttgacccttaacctctatgctctgtaccttagcttaaatattgccagcttttaaagactcgcttgttaatgctcccccagccagggtaaagtcctcactttcaggtagttcaagatgcctctctcggcctcagtttccccatttatagagtgggagaaaaattcttgctgtgcagatttgttgtgaggattgaagacagtagcacttgtaaaagaactttgtgaggcgtaagcctaaatcggatattgtggtgttgttatttttagttgccaggctgtgccaagaagtgagggcttttttttttttttgtaaatatatatataggaatctcagtgagtcaccagggtgaagttttgccaaaaaagctagtgtgaccttggccccatttattgcagccaggacaagggaagtggactgatccgtgttgcagcttccaggtgtgttgcccttggagctggcctcctggctgtgggggagagttggatgggctgggccacattcactgatcagggagaggaggggctggagccatccgggccctggaaaaccagccatacacatgagacacggggcaagggttgtagatcacatgctacgggggccaagagagcggcaactcagggcggtggggactttggctggctgcagagtgccaatctgtgcaaggctgtagagctgctgccactccagctgactgttgccatggagggtggaatgcaggccagtgttgcttgagctgctcatttttcaagagagacggaaacttctgttcttcaaaaccaagttatctaaacaaaatctgtgcgctggatgaattaggtgcatgagttgccagttggcaaccctgacacaaggaatcatgtggggttcattcattcacccagtattttattttatttattttatttttttgagacagagtctcaccctgttgcccaggctggagtgcagtggtgtgatctcagctcactgctctgcctcccgggttcaagtgattctcctgcctcagcctgccgagtagctgggattacaggcatgtgccaccacacctggctaattttttgtatctttagtagagacggggtttcaccatgttggctaagcaggtctcaaactcctgacctcatgatcggcctgcctcggtctcccaaagtgctgggattacaggcgtgagccaccacacctggcctatgctcatccagtatttttagcacatggtattggaatgcgggaaaggccatgggggcccctctgttttcagaccctccatgcctcctccagtccctctacctcttgaccctgccagcctgtcaacctgtcctgacctcactcccccctgcacccccatctgttcctgtcctctcctgctgtatcttatcctggatctgaagccagcctagctctgggctcccctgctcctgtcctggggcttctgagggacccagtgggccctgctcagctgcctctcccccaccatatctgggctatttcacattttctcagacttccccaaagctgctctgtactctttttttttttaaatcagcaaatggcttgatctgctgcttgataggtaaaataatcaacacttcctatgttcagctcaccctcttgtccctcttaccaccagacccattaaccacccgtgtatccacatatcaccccttggctggggtggggtcctctccttcctggaggacacctccacttctgcaccaatccagctgtccagcctattcaggtactttactctgtcctttttctctgtcctttatcttcagcccatccctctctcagcctataaacatactgaagtttctccactgaaaacaacacaaaatgaaacatccctcccttcaccctgtcagccccttcacgggatcatgttctctcttccccgctcctcaggcgaattctcgaagaggagtctacactggtgcctttcaactcttttttttttctttttttgagatggagtcttgctctgtcgcccaggctggagtgcagtggtgtgatctcagatcactgcaagctccacctcctgggttcaagcaattctcctgtctcagcctcctgagtagccgggattacaggcaagcaccaccacgcctggctaatttttgtattattagtagagacggggttttgtcatgctggtcttgaactcctgacctaaagtgatccatccacctcggccttccaaagtgctgggattacaggcatgagccaccgcacccggcctggtctgccttcttaccttgtaccctctcctggggccttctcctctgtcggctttgactttggcccttatgtctacaattcttcaggttttctcctttatcaactctagaacagagttctccaggggaaatacaatacaagccatctgtataatttaattttttctagtatccacattaaaaaggtaaaaagcaacaggtgaaattaattttaataattaacccatatagccaaaatcctatttcaagatgcaatcaatgtaaaattattaggatattctggccaggcatggtggctcacacctgtaatcccagcactctgggaggctgaggtgagaggattgcttaaggccaggagctcgagaccagcccgggcaacatagtgaaacctcatctctacacaaaataaattgaaaaacttagctgggatagggctcaatggctcatgcctgtaatcccagcactttgggaggccaaggcaggctgatcatctgaggtcaggtgtttgagaccagtctggccaacatcgtgaaaccctgtctctactaaaaatacaaaaaaatagttgggcatggtggcatgcacctataatctcaactactcgggaggctaaggcaggagaatcacttgaacccgggagttggaggttgcagtgagccgagattgcgccattgcactccggcttgggcgacagagcaagactgtctcaaaaaaaaaaaaaaaaaattggctgcgtgccgaggcacatgcccatagtcccaactacttgagaggctgaggtgggagtatcacttgagcccaggagatggaggctgcaatgagccctgatcatggcactgcactccagcctgggtgatagagcaaaaccctatctcaagcatcaaacaaacaaacaaataaaacagaggcacaagaaagcaaggcatgcatggagcagcgcagttgtttggtttgaggccatctggcacaggtaactgcctggatttaatcctggctcaccatgtacaggctgtgtgaccttggacaagccattcaagttctctaagcttcagattacccatctgtcaagtgggggagaataatagtgcttaactatcatttgcaacatctgagtttctggctcggccaacggggatggggaacatagagtgaggagcaggtgtgctgtgagatggcgaaccttcaacagagcctgagacgtccgcggaacaccaggagagttgcagtggggatttgcaaataggcatctggctcccccacggagatgacgggaatttcagcgcatcaggcatagctgagactgtctacgtggtaaaaccatgcctgaaaagacctttggaaaatcaggaggttgctggagcccttggagagagctttggtgtctgtgacatgtggaaatggaagccagattgaggagggggtgcgagggaaggggtgaagcagctggccagtgtgttctctcctgcagcctgactgaaacagggagggggcaaccaggaacccacagctggagaaggacactgggcaggggtgggacagtttgctgggaaggatgagactccagtgtgtgggaaccgatcaatgggaggatggaaggtatgggggagacggaggcctctgcagagggagaggatagcacaggagccagggctgaagggaacagtggctctagactgagggtaatgggcctgaaggtaggccccttcccctgtgaaggcagcattatctgaggagccgtgagggatgggcaagaagcagcagcttgggaatgccgcctgaggtcagtggaaatgaagctgagggcaagacagttaggggcccactgttccagcattgtgggaattgcggtggagtgtgtgtgtgtagggaggggttcctggcagagtcaggcatggatggatttggaggtcccttgaagaaacttccttcaggtcagcctgaagtgtgagggactctgagggggtgcaatgcatgccagccatcccctcctcgcagccctgcctcaccccaaaacttcaggtgggcctggggctgaggtgcttggatgtttgtagtaagagcttctaactctgccgctccacccggctctcagtggctcaggtctgagaggcctcagcaggggcaaggagaggaggcagtgaggagggaaggctctggaggaagagggcatggcagagggtcttcgaggcaacgccagggaggcccagggcatgagggtgaggagctagaactgagctctgagccctcctctgaggttggggcttctgggcaggcagcccccttagaggccctcccttgtaggtattcggccttggttccgtggcccatatgcttctaaataaaacatttgggagctaccttggtgtcaacttgggttttggcttcggagtcaccatgggagtgcacatggcaggccgcacctctggtgagtgagcccaggccctgccggaccgggcaagaccaggtgtccccaacaggctctttcctgcccgcctcagccagctcctttgccagcacagccagtgcctcagcctggccaccgggcgggaggaagtctcctctgaaccccgtgcctatgacgtgtctgccccagattcttcctggcccccccgacctaccattttcactggctgggtcatcttaggcaagccatcgcctctgtgttcctcagtttccttaagagtgaaaggaagacggtggcccctgcctcacggggtggttgtgagggctcaaggagagaactctgtcacggagcatgctgtcatacacactagccatcgttgttctcatactgtttgtcactgttgtttgttctgctctcactccctgacacacttgcctgctgcccgcaggagcccacatgaacgcagctgtgagcctcactaactgtgcactgggccgtgtgccctggaggaagtttccagtctatgtgctggggcagttcctgggctccttcctggcagctgccaccatctacagtctcttctacagtgagcgtcctgcccgggtgtccgcctctggcctcagctgcctcctatgaaatatgggcagattggacctcagtgtcctgatttgtaaaaaatagctgggagaaaaaagccttggaggtctcccaccctctaacctataacctaatttccgggaccctggtggggcttagctggggacaggttcgcatgatagtctgtgtctccacagcggccattctccacttttcgggtggagagctgatggtgaccggtcccgttgctacagttggcatttttgccacctaccttcctgatcacatgacattgtggcggggcttcctgaatgaggtcagtggtccaggatgagtacccctccccctgccctccacccctcaggacggagccagcagggagtccctccggatagacaggacaagaactctggatggagactgtaccaagatgtgtctctgctggtgggcttgggtctggggcactgccgaggtcctgtggcttggggaggggcccaggtgagcttccacagcatctgctcctcaggagtggctgaccgggatgctccagctgtgtctcttcgccatcgtggaccaggagaacaacccagcactgccaggaacacacgcactggtgataggcatcctcgtggtcatcatcagggtgtaccatggcatgaacacaggatatgccatcaatccgtcccgggacctgcccccccgcatcttcaccttcattgctggttggggcaaactggtcttcaggtactgcccctgcccaggcccattcctttgagattttctgtggggcccctgtgtgttgaggtgtggggggtgatgtgaggggcagcacaggagggtcctgcagagcccccaggtggcctggggagcaggagtgagtcccaacatttccccaggccagtacagatacagatcctgcacctgcactgagtgtcaaccctgtccctgaatcgggctgaggctgaccagggccccgggttgggggtgtttcctgggttagcctgaggatgactcctctgctcaaccagtcttggcccgaggtggatgagggtgctgtcctgggcatcagccccctcagccggcctctgcctcttgcctgcagcgatggggagaacttgtggtgggtgccagtggtggcaccacttctgggtgcctctctaggtggcatcatctacctggtcttcattggctccaccatcccacgggagcccctgaaattggaggactctgtggcatatgaagaccacgggataaccgtattgcccaagatgggatctcatgaacccatgatctctccccttaccctcatctccgtgagccctgccaacagatcttcagtccaccctgccccacccttacatgaatccatggccctagagcacttctaagcagagattatttgtgatcccatcccttccccaataaagagaagcttgtcccacagcagtacccccacttcctgggggcctcctgtggctgggcttccctcctgggttcttccaggagctctagggctatgtcttagcccaaggtgtagaggtgaggcacctcaagtctttcatgccctgggaactggggtgccccagggggagaatggggaagagctgacctgcgccctcagtaggaacaaggtaagatgaaagaatgacagaaacagaatgagggattttcaggcaagggggaaggaagggcagttttggtgaaaggactgtagctgactggtggggggctggctttggaaatactttgaggggatcctgagactggactctagactctcccctggttgttcccttccccgagttctggccggttcttggaccagacaaggcatggcccaagaaggtagatcagaattttttagcctttttttcattagtgccttccctagtattcttccagattttttttcttaatcacatgaaattttaataccacagatatactatacatctgtttatgttctgtatatgttctgtgctttatacgtaaaaaagagtaagattttttttcacctccccttttaagaatcagttttaattcccttgagaatgcttgttatagattgaaggctggtaaggggttgggctcctctttcttcttcctggtgccagagtgctcccacatgaaggaataggaaaggaagatgcaaagagggaaatccttcgaacacatgaagacacaggaagaggcctcttagggctccaagggctccagggaagcagctgcagaggttgggtggggtgaggggccaggatccactgaccctggggccaggcaggaatcactctgttgcctggggctcagaaggcagtatcacccatggttcctgtcattgctcatgtattttgcctttcaacaattattgtgcacctactgtgtgcaggccctgcctggacactggggatgcgcagtggatgcactgggctctgcctttgagggttgcagtttaatgggtgacaggtaattataaggaagaaggtgagtgcagagtgggaggcttggaggctgtggggcttggggtgggggagctcacatccagcctctgggccaaggccaggaggcttcccagaggaggagacagagcagggtattgtggtggggggtgtcctttttggggctgggattgcactttacagtttgaggggatgggcagaggaggctgggcttcattctggaggtggggacatggtgaggtgaggtttagaaagcacacctgagccgcagtgtgtaggatgctggaaatggtggagatgggcctgcgaagagagtgctgggaagtgatgacccaggagcagcagccgggcacctaacaatgggtcagcaccgtgggcgtggagacaagggccgggattgatcaatacccgagaagtacaatgtacaggacttgggctccatttggatggagtgggtgagggaggagtcagaaatggcttccggtttccagcttgggcctggggattggagatgtccccactgagagtagggcacaagtgaggaaattgtttggagaggaagatgataagttacatcatggatgtgctgagtctgagttgcctatgggacttggaatggggggtggcaaaaggtgtgtgatcttgagcaagatattcaactcttctgggccttggtcttctcatttgtaaaacggtgataagaatattacttcccatttgtgttgctgtgaatattaaatgcgctaccacatgtaaaatgttgagaatcgtttctagctcagagtaagtgctcaataaacaccattatgccttttatatggtctggagctcagaagtggaagacagggttttgtgaagtcatggctttgtggatgtagctagattgtggagtaatggcaggagggtcgggggcatggcacaaggtaggtggtcaagagacactggacacaacccaaatgtccatccacaggggaacagatacatacactgctgcgcaattgcacataatagaatcctctacaatagcaaaaattaaggcacaacagacacctgcaacaacacagaaaaattctggaggcataaaaagtaatacagtagctgggtgtggtggttcacacctgtaatcccagcactttgggaggccaaggtgggtggatcacgaggtcaagagatcaagaccatcctggccaacatggtgaaaccctgtctctactaaaaatacaaaaattagccgggtgttatggcacacacctgtagtcccagctactcgggaggttgaggtgcgagaactgcttaaacctgggaggcggaggttgcagtgagccaagatcacatcactgcattccagcctggcgacagagcgagactcggtctcaaaaaaaaaaaaaaaaaaaaagcctggtgtagttgggcacctgtaatcccagctgctcaaaaggctgaggcaggagagaatcccttgaacccgggaggcggaggttgcagtgaatggagattgtgccactgcactccagcctgggtgacagagtgagactgcgtctcaaaaaaaaaaaaaaaaagtaatacggtagactatatacagtgtgacacaaacttgtagctgaaaaataagcaaaaacacattctttgatatatatatatgtatgtaagaaaactactttagaaaaagaaataattcctacaggcagatggggaagaacacaggagtagtacaagctattaataattttctagttttggagttggacatttgtgagtttattatatgattgtgcttgataacatataaatgtgatacatattgtttgtatgagatatatatatatatatatatacccacacacagatagatgattgctgacaaggagtttctaaagatcatatatatatttttaggtaaaatagaataacattctgcttctggtcttcataataaaagagaaatcaggactaagaaatcaagtgtttattatatagagttttaatttttattcttttatttattgatttatcttctttaggcatgtgcagagatgaactcactaattgttcaaaataaacaatttgaattcaaagcaaagtatatttttggaatatcaattatcacttattgcagataaatgataatataaaacaccaactttggaatttatttgttttacttctgtgactctcagccttctttttaaaatatagtgtatgttttaggtaagttcagacagcagccagcactacatttggtttaaaatccagctttataatgacttcatctttcaaccagccaaagggtagttaccttgtgtctgccatcgtgcatatgctctcagctcctgactgagaaaacatgcctgcaagcacttccctgcctgagattatattaaaaatccatacctgtgctagcagcatgagttcaagttgattattgttctagatctgtgacttcccattcatcctcctaaagatataaatgattgcttttcaatagaccacatacttaggaatgattatgaaggcaaggtttagtaacaataatatacatagtactctaatgggattgaattggaacacccacattaaactctcttaaaatatatggagcagaacacatgagagaaagcaaaagaacaagtgcacacagcagagctgcgagttgcatactctgtgcatgctaataccatcgcaacaacatcactaaggcttctgggtaacgtttgccacatcatattgtgacgtgcatttgtttttatattttaccctaaaaggcaaaataactctccatgtgatgaaagaaggagcacacacaaaaaaaaccctctcagaaatattaaaatggttgcaggtaattcaaatggtatactgttttaaaaggtacttgtctaacactttaagttggaaaagcatcttggaagtcattagattcatatttacattacttgaattgtgaccctagcttgacatttccatggtgggagacatattttatttaggaggcagcagtctatttagtttttgagagcttaatcgatagatggttcagattttctactgaaccaaaatctaaatgcctacccattggttttcgtagccaacgtcaatatccaactgctctttcatacaacatggcttcaaaggctatgtaactaacatcatgccactgcacctatgtctttttaaagccaagtacctctagtgcccctcattatagctcatatttcaaggtatctttcagcaacaatgaattgcattaatcaaactcactttttttgcgtgtgcttcactttatagctcttcacaaataacacatttttcacaaattgaaggtttgtggcaatcttgcatcaagcaagtctattcattctatttttccaacaacgtgctcaccttgtgtctctatttgacattttagtaattatcacaacatttcacattttaaaattattattattattttaaatattttaacttttaggttcatgggaacgtgtggaggtttgttctttaggtaaattcgtgactcaggggtttgatgtacagattattttgtcacctgagtagtaagcatagtacccaacaatttttttttccctgaacctcacccatctctcatcctcctccctcaagcacaccctagtgtctattgtgctgctctttcagtcaatgtgttctcattatttagctcccagtgataagtgaaaatagggagtattgggttttctgatcctgtgttactttgctaaggataatggcctccaagctccatccatgttgccgcaaaggacagatctcattcttttttatggctgcatagtaattcatggtgtatatgtaccgtactttctttttccagtctaccactgatgggaatttaagttgattcctgggtatctattacctaaattacatataaaagcagaaaagaaaaatgacaagtagaacatgaaagttaaacagtatcttttcaggttcaatgacataaatattcttattatctaaaggtataaagtctaatgttttatttcctatagtgcttttatagcaaaacacttttcagaattagataaaccagattgaggccccagtcttactacctattagctaggtaaacttgagctttgggattttcagattcagatcttgcaggcaaataagatttatttgatattacttgaggatgacaatgtctatcttgcagattattatggtaatgagtttatttatgtggattgttttaggatattttaaaactatgtacagacctaaaaaaatcctcataatctttgcagaactgggaaggcatacaggcataatacaactgtaagagttactgtttctcatgcttttgttttctaactgctctggccactgttttagaaggaagggtgaatatatgtaaatattcctgaaaaaataaagttttagaatattaaattattacatatttcattcagaattttttgaaaggtaaaaccaatgattgaacgtagttcatgggatgatctggtccatattcatctaccatgatttaacaaattttttttctcatctattgatgaggaaaaaattaaggggaaatgtagaaatgtaaggtaaatgatctgcaaagaaatacacacaggaggtatgtgggaatgtaacagtgtaggtccgcaggcaaactaggtgaaggaggaaggtgaggaagaaaggaatttaagacttactctttctgttttcttctcaattttaaagcctgatggaatataattttctctacagtaaatgttgaatgaaaatcagttttgtatgtgttaataatgacttcaccaagagcatttgaagctctgtctatcatattttgatgctcaaaataaaacattgtttttatagcttaatagtctcatacagtcaattattgcctcccctccagactgacactttgaacattattattaacactgctgtccttaaaccatcatcggcctgcagtgcagacaatttattgatagctaataaaacagtgttcagatgctgcctgagtgcaggattcagaattgtcataccaatgcataaccacatttgatcttttggaacaagttccattacttaaaaattatggtttcattttcttatttttatatctagattttaacattatatgcatgcctatataagcattaaatatgttattcagttatgtgtgagtgtaactgaaatttcttgtaaagtgtatgtacagtttaatataagacagattattgattaggaaatagttaacaattaataatagacattggccaacctcaattactaaaccagaaaataagtttatttatttattgtattatttttttattatactttaagttttagagtacatgtgcacaatgtgcagtttatttaaatgtattgactgttttttagtcactacacaaatcatctaaaagaaaatacctcagatgaaacctgcagatccactaactagttatcagtttatcaagactgatcgtgtccactcccttcagaaatcacatggatttgtgcattatgcagatcttttttggtcttccccatcttttcccatcctgaactagaagtagaagcctattgcatttttatctggtactttcttttgcatttagtagaaatacatacacatactacccgaggctactccgcagtacattaaaatttccttttgctttccagtaatttcaaatatctcaactaaatatctcagttgaaaaatcaaagttttaattcttatccatctttcaacataaaaacttttaatattgattataatgtgttgcctgcacttttgttttttttttgttttgttttgagacggagtttcactgtgttgcccaggctggaatgcagtggctagatctcagctcattgaaatgtcccgagtttaagcaattctcctgccttagcctcctcagtagctgggattacaggcaagcaccaccatgccctgctaatttttgtatttttagtagagatggggtttcaccatgttggccaggctggtctcaaactcctgacctcaggtgatcctcccgtctcgggcttccaaagtgctggggttacaggcgtgagccaccctgtctggcccagcactcttaatagatatataaatcttactctattaattgaactaagaacatctttataattttccaaatatcatttataattattaaatattaaaacacatttattctgcttagcaaactttgcatctcctcagaatgcctaaatattttgccatatgaaggttccagtggaagtttcagacaatacattttgatggcaaatggtgaattttcctattgagaaatatgttgattacaagaaataagagagacagtagattttcaaaaccttttcaaactatttcagatgaatattcagaattattttacttatagattgcactcttctaaggcacttacatattctgacaactatgtgtttttgaagcaaattttgactgaattaataaatgacagcacagatcaaaatttaaaaacttacaaaattctcaatagatttcacaattgtgcaaagtcccatgctttcttttaatattgtatacttactatacttttaaggggtactttttaacagttgatttattatcaaataaactttctataatttgacagaacaacataaattcttgtttttctcctttctacctagaacatacatatgatagttgagaaagacacatattctgatcatgaagaaataaacacaagttaaatatgactaagcagaaagatggaaggaccaggaacggtgatgctaacttggaaccacgatgcaggctctaaactcctctacaatcatcctcccttgtgagaaaaatacgtaagtcacttttaaaataaatagaaacctgaacacacttcttagctggtttaagtattttaaaaacattgatgaattaaacacagaaatatggggaaatctcattacttaccttaaattttgaaattttctttacagatcatgagttacttaatgctctttcactcctgagtttacattgtaaattaaagttatgtcagctttaaaaaataaccaattaaaaatgatctaaatttatactttaattttaacgaatagtattatctcttattatttacctctgataaagtccaaatgtttgtaggcctatagctctggttatatacaatgaaatatctttctcatgagtgtagaatatctagattatatttaatgcatttactttttgaggaaaaggaaacccttaataaaatagcttcaaatatttggttttaaaaaatgagaaaacaaatacattacaggacttttggatttatcaccaacatgtgaagggctcagaagttgtcattcctggccttacaataataataataataaaagctatacaaattgaaaatcaatgacatttccacagtgggagacatattttatttaggagacagcagtctatttagtttttgagagcttaatcgatagatagttcaggttttctagtgaaccaaaatctaaatgcctacccattggttttggtagccaacatcaatatccaactgctctttcacacaacatgacttcaaaggctatgtaactaacatcatgtcactgcacctatgtctttttaaagccaagtacctctagtgcccctcattatagctcatatttcaaggttttctgttcctgcattagtttgctgaggataatggctttcagctccatccatgtccctgcaaaggacttgatctcatttccttttatggctgcatagtattccatgttgtatatgtaccacattttatttacccagtctatcattgatgggcatttgggttgatttcatgtattagctattgtgaatagtgctgcaatgaacacacacatgcatgtatctttataataaaatgatttatattcctttgggtacatacctagtaatgggattgctgggtcaaatggtatttctggttctaggacttcgaggaattgccacagtcttccacaatagttgaactaatttacattcctaccaacagtgtaaaagcattcctatttctctgcagcctcaacagtatcagttgtttcttgactttttaataatcaccattctgactagtgtgagatggtatctcattgtggttttgatttgcatttctctaatgattagtgatgttgaactttttttttgcatgtttgttggccacataaatgtcttcttttgagaagtgcctgttcatgtcctttgcccactgtttaataggattgtctgtttttttcttgtaaatttgtttaagttccctgtaaattctggatattagacctttgtcggatggataaatagcaaatttttctcccattctgtaggttgtctgttcactgtgatgatagtttcttttgctgagcagaagctctttagtttaattagaccccatttgttaatttctgcttttgttgctattgtttttggcatttttgtcatgaaatctttgcctatgcctatgtcctgaatggtattgcctagattttcttctagggtttttatagttttggattttacacttaagtctttaacctatcttgagctaatttttgtataacgtgtaaggaagggggtccagtttcaattttctgcatatggctaaagttcttccatagttcttccagcaccattaattaaatagaaaatcctttccccattacttgtgtttgtcaggtttgttgaagatcagatggttgtagctgtgtggtcttatttctgagttctcaattctgttctattggtctatgagtctgtttttgcaccaccactatgctgttttgtttacatgctggtttggtagccttgtagtgtagtttgaagtaaggtagcatgatccccccagctttgctatttttgcttaatattatcttggctctacagactcttttttgtccatatgaattttaaaacagattattctaattctgtgaaaaatgtcaatgttagtataaggggaatagcattgaatctataaattactttgggtagtatggccattttaatcatattggttctttctatcacttcccttcttagctgtattcctaggtattttattctctgtaacaattgtggaattggagttctttcatgatttggctctctgcttgtctgttgttagtgtgcaggaatccttgtgattttcacacattgattttttatcctgagattttgctgacaatggggttgagacaatggggttttctagataaaggatcatgtcatctgcagagacaatttggcttcctctcttcctatttgaataccatttgtttctttctcttgcttaattgttctggccagaacttccaataatatgttgaataggagtggtaagaaagagcatccttgtcatgtgcctcttttcaatgaaaatgctcacagctttttcccattcagtatgatatgggttgttagtttgtcataaatggctcttaatattttgaggtatggtccttcaatacctagtttattgagagtttttaaaatgaagggatgttgaattttaacatgaagtgttgttgaaaggccttttctgcatctattgagataattatgaggtttttatctttagttctgtttatgtaatggattacatttattgatttgcatatgttgaaacagccttgtatcccggggatgaagccaacttgattgtggtggataagcttttggatgtgctgctggatttggcttgccagtattttattgaggatttttgcatcgatgttcatcagggatattggcctgaagttgtcttgttttgttgtatctctcccaggctttggtatcaggatgatgctggcctcataacatgaattagggaggagtctctcctcttcaatcatttggaatagtttcagaagaaatagcactggctcctctttgtacatctggtagaattccaccataattccatctggtcctggtctttcattggttggtaggctatatattactgccttaatttcagaacttgttattggtctattcagggattcaacttcttcctggttcaatcttgggagtttatgtgtccaggaatttatccatttcttctagattttctaatttatttgcatagaggtgtttatagtattctctgatggttgtttgtatttctgtaaactcagtgttcatatcccctttatcattttttattgtgtctatttgatcttctctcttttcttattagtgtagctaaaagtctattttgttaatttttttcaaaaaaacagttcctggatttgttgattttttgaagggtttttcctgtctcaatctcctttagttttgctctgatcttacttatttcttgccttctgctagctttggggtttgtttgttcttggttctctagttctttaaactgtgatgttaggatgttgacttgagatatttctgatgtggatatttagtgctatacatttcctcaatgctgttttagctgtatcccagagattctgggacattgtctctttgttctcattagtttcaaataacttcttgacttctgccttaatttcattttttacccagtagtcattcagaagcaggatgttacatttctatgtagttgtgtggttttgagtgagtttcttaattttgagttctaatttgattgtactgtggtctgagagactatcaagattttagttattttgcatttgcagaggagtgttttacttccaattatgtgatcgattttagagtaagtgccatgtagctccaagatgaatgtatattctgttgtttttgaatggagagttctgtagatacttatcaggtccacttgatctacagctgtttgagtcctgaatatccttgttaactttctgtcttgataatttgtctaatattgacagtggggtgttaaagtctcccactattattatgtgagagtctaaatgtctttgtagttctctaggaacttgttttatgaatctgggtcctctagaattgggtgcatgtgtatttaggatagttacctcttcttgatgaactgaatacttaaccattatgtaattcccttctttgtctttttttatctttgttgatttaaagcctgttttctcaaacactagaattgcaacccctccttttcctgctttccgtttgcttggtaaattttcctccatctctttattttgagcctatgtgtgtctttgcatatgagatggttcacctgaatacagcacactggtgggtcttgactatccagtttgccagtctttgtcttttaattgggacattcagtccatttacatttaaggttaatattcttatgtgtgaatttggtcctgtgattatgatgctatctggttattttgcagacttgttaatgttgttgcttcataatattattggtctgtgtactttactgtgtttttgtagtggccggtaatggtttttcccttccatattcagtgcttcctttaggagctcttgcaaggcagtcttggttgtgatgaattccctgagtatttgcttgtctgagaaggattttatttcttctttgctcatgaagcttagtttggccagatatgaaattctgagctggaaattcttttctttaagactgttgacatgaagtccttgcccatgcctatgtcctgaatggtaatgcctaggttttcttctagggtttttatggttttaggtctaacgtttaactctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcgttatttctgagggctctgttctgttccattgatctatatatctgttttggtaccagtaccatgctgttttggttactgtagccttctagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgagattgattcttcctacccatgagcatggaatgttcttccatttgtttgtatcctcttttatttctttgagcagtagtttgtagttctccttgaagaggtccttcacatcccttgtaagttggattcctaggtattttattctctttgaagcagttgtgaatgggagttcactcatgatttgtctctctgtttgtctctttttggtgtataagaatgcttgtgatttttgtacattgattttgtatcctgagactttgctgaagttgctcatcagcttaaggagattttgggctgagacaatggggttttctagatatacaatcatgtcgtctgcaaacagagacaatttgacttcctcttttcctaattgaataccctttatttccttctcctgcctaattgccctggccagaacttccaaaactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgaaagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattatctttttttgttgtgtctctgcctggctttggtatcagaatgatgctggcctcataaaatgagttaaagcaatggaaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcggaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaagtggaaataccatttgacccagccattccattactgggtatatacccaaaggactataaatcatgctgctataaagacacatgcacacgtatgtttattgcggcattattcacaatagcaaagacttggaaccaactcaaatgtccaacaatgatagactggattcagaaaatgtggcacatatacatcatggaatactatgcagccataaaaaatgatgagttcatgtcctttgtagggacatggatgaaattggaaatcatcattctcagtaaactatcgcaagaacaaacaaccaaacactgcatattctcactcataggtgggaattgaacaatgagatcacatggacacaggaagggcaatatcacactctggggactgttgtggggtggggggaggggggagggatagcattgggagatatacctaatgctagatgatgagttagtgggtgcagcgcaccagcatggcacatgtatacatatgtaactaacctgaacaatgtgcacatgtaccctaaaacttaaagtataaaaaaaaaagactgttgaatattagcccccaatttcttctggcttatggggtttctgctgaggagtccactgttattctgatggacttccttttctaggtgacgtggctcttaacaattttccttcattttgaccttggagatactgacaattatgtgttttgggttgatcttctcatggatcttactgaagtcctctgaatttcctgaatttgaatgttggcctgtcttgctgggttggggaaattctcctgaatgatttcctgaagtatgttttccaacttggtttcattctcctcatttctttcaggtaccccaatcagttgtaggtttggtctttttacataattccatagttctctgattatttttcattccttttcagttttttctctaatcttatctgcctgtcttattccagcaagatagtctttgagctctgagattctttcctctgcttggtctattcagttatttatgcttgtggttgcattgtgaagttctggtgttgtgtttttcaggtccatcaggtcatttatgttcctctataaactggttattctggtttacagttcctataatgttttcatggttattagcgtctttgaattgttttagaatatactttagctcagcaaaatttgttattacccaccttctgaagaatacttctatcagttcatccacctcaagcctccacccagttctgtgcccttgctggagaggtgttgcaatcatttggaggagaagaggcattctggctttttgagttttcagcatttttgcattgattctttctcatcttcatgagcttatctatcttcgatctttgaggctgctgatctttggaaggggtttttgtggggccatttttgtggatgtttttgttgttgttgttttctgtttgtttgtttttctttcaacagtcagacccctcttccttagggctgccgcagtttgctgggggtccactccagaccctattcacttggtccctcccctacctggaggtgtcaccagtggaagctgcagaacagcaaggatggctgcctgctccttcttttttgagctccatcccagaggggcactgatgtgatgccagcaggaacactcctgtataaggtgcctggagacccctgttggtggtctcaatcagttagggagtatgtacaggatcggggaccacttaacaaagcactctggctgccccttggcagagagggtgcactgcactggagggaatctcccttgtccagaatgtccagacccttcagagccagcaggcaggaaagactaagtctgctgaaccgcagagactgtggctgtccctccccacaggagttctgcccaggaagatcagagttctgtccataaacctctggctggagttggtgaaattcccacaagggggccccacccaatgagtagggatggatccaggttccacctaaaaaagcagtctggccatgatctgccacagctgctgtgctcccggtctaaacctccctgtctccccagcaccaccaggggaaaacagccaactgatgccacagtgatagcaaccaccccttcccctgggaactcagtcatcttagacagtctccagtctgctgtcactggccacagcctgagcggtgatgagagtctgcacagctctgtgcttggcacccaaggccctggtggtgtggactcacaaggggatctcttgatctgtgagttgcacagatccatggaaaaagcatggttcctcaggaaagggagcacaatcactcactgcctcccttgactgggggtgggagtgccccttgccccatgcagctcccaagtgaggcattgctccaccctgcttttccttgctccctgtgggtcaggccaatcaccttgtcactcccagtgagagaatctggatacctcagatgaaggtgcagaattcactcgccatttttgttcttctagatgggagtcacagaccacagctgcttctaattggccatcttggcacctcctcatttaaccttcttttctcatctaaaggggataaaggatgaaactgtcccaaagaaaagtttataaaccaattaagggagaaaataaaattcaactaggcttgcagaataatcagtggcaatcatgaaatccacttcccaatttggcctacttccttgtagctagttacttcttactcccccaagatagtgtagcccttgtcacaagaatgtgttccttttcttttctatagataagatctaaggcacatgagatgatatgctttctgtttgagtttctcctttatgttacgcatactgataaaattgttgatgccagttgatctgaaggtcccagcaaggagccgactcacagaagaatgcagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaa

SEQ ID NO: 2266 - DNA, 43121 bp, Homo sapiens
ataaaaattatgagctaattattaatataaatattcaaagtaaactataaataccagtgggaaaactaaaccaaatatagttttgctaagttttaccacatttatcctaaattatgattttataacaagtaggtgcctttaaaacattacatggtcataaaaacacgtaatttgacatattttcagatttgttaatatgaataataacaaagctataccaactaaaatacataaaaagctagttaaagcaaggtattacaagacacagcaatacacttcaattcatctggggaatctagaattaagtgtcgaagaaaatcacttaattaaattttaatttgaaaatactcacttcaggtgtaaacatttccatttataactacattatggtcttaacatgtggcaacataaagacattaaaattactatttcagcaatacagaactatctaccttaaaatatgactctgtgcctaataaaatttcataggtgacacaatgtcttttctcaaagtaaatcatctctcacctctatcttttatttcctagaaatgaggcatgtttctaagccgatatagtaaacacatttttcctttttttattaaaacagctttgttgaaatataatttacatactatagaatgtatctgttttaagttaaaagatttttagtacatttactgagttgtgcagccatctctacaatccaactttagagcatttccatcactgtaagattcctcatgcccattagcagtcactaccagcttccagccccagccccttgcaaacatgaatctactttttgtccctatacatttatcttttctggatgcttcatgtaaatggaattatacagtatggtaaacacacttttaatctagatttttatattcaactaagttcaacatgtatccagaaccaaatgtttaaattgtctttctagaagtttgaaaatatttatcttccttgatacttactactccttctgttttctctctctcatactgaaagagactttcttttaaatgatcacattcattcattagcttcttacttttctcttctagcacgaggtctttctttccactctcaataaagcctctttggatattagttactatctctttatgatcctctttctgatgaacgtcatctagttgctgtacaagccacgcattttcacgttggaggtgacatatcctctcttctacacagttccactttccagtggaattattcactttagcttctgcattttgatacatctctttcatttcctgtgtttgctgctgtgtttggcttaggtcgttttgtacagtttctaaagccaatgacttttttctgagactatctcttgtcttacggaacttatcttttaaggcattgaatttaatttgtgtttcagaaagttgttcagtaagaaactcattctcatcttttactttggaaatagcagaactcatttctacttgtacagaaacatctcgtgttctctctaaagcaagttttaggtttctttctgttttcacactttcactgtgtttgcttatagcagcagccagtctagactgataagattcaatgtcagcttccagtcttttcttgctttctttttccttcaacagttcggcattgagccttgtattctcagccttgagataattaagctcttgttgataccggaatgctgtttctgttatcatttcctcattgagttttatatacttttcaagggcagcatttgtttctttaacaattttaatgtccttaagatatttattttctttttccaagttgtcatttttcattgtacatatttcctgtctgagtatagcaatatctgccttcaaaatgcaattttcatccatcagacctttcatttcttcatgattatgaaaatcctaaataaaacaaaagaaagttttagctagtactcaataaaataacatatcatgattacctctgaagttaaagaataacctgcacatccgtaccactaaaaagtttaccataagtggatatccacctggagaaaaagttgaagcaaaactttgaaccttatagagcataaattccagaaagttcagaaatgtatttagagtcaatgaatttataaaagtaaacacacacacacacacaccagagaatttttaagaatatcagaattggaaaagcctttccctgaattacaacaaactcaaaagcataaattaaagcattaacaaatttgactaaattaagatatatcaaaaaattgcatttacactttgatacctaacccatacaccaccctatagtaagaacttttgttcacacatatttggacagataaaatttcccagagttattacagttctgtttcactgataacattctatttcagtttgactcttttaacacttttatagtcagttataagaattacattcactaaatcataaactagacattatactagtcactcctatatacattcattgatgaactcatctagttaccataattttgaaaaagaaatgttaaaaatataagcaagctacaggattttccccaggacttctgactctacttctagttctccaacagatcacagttacttctgtggtgtaaatacatcaatacgaaagaaaacttttatttcaaaatgccaatagtaaataagataaaatttatagagctcttcttagaatatcatgagattatttgcgattgcaataatttctgcttcctctttataatattaggtgcagtaatcaatatgaaataggggaaagtacaaggaaaaattttacctggaacaaaatttttatcaataggttatcactaagtataaattatggcatattattgttttcaaaagctctttgtaataaaataatatcctatgtggatgccaagatttataataaatattaataattgtacctgtaagtgtcatcattcatttttaaaaatgagataacatttatggttttagacctaaacaatatatattaaatcaagtggatattataagtaacagtgataagataaagtttaaaatatagaatttttaccaaagattgatttacccgatttggagtatttcttgcagtctttgatttcatctctagtgactgaacagttggttcaagttgttttgcttcaacttctttcttatattgtttctctttcctttctaattcttctctattttttttgtacagcatattaacatttgttttttcttcattttcttgttttaaggtgcatctgcagataaagacatttgtcttaaaattcattttgttaaaaaataaggagttcatcctgttatctacctctgcagatgttgtttattatcctaataaaatttctatgttctggattatttttcctttgcagttctcagatatttaatttctcacttcaacatcttcaaatgaatgcatatacttgaaaagtagtaaggaaagaatattctgctaaagtttttgttactagtcactctaatatatattataaaaaaggataccagagataattcagtaaagttacaggttcaaaattacctttttaaatcacacagtcataattactccctaattagaaaagatcatttacaatcaactaaatttttaaagttactatttattgacaagcgtataagttcactagaaataaattttcatctttatgaaatattgcaggtgtttctccaaatgatttacagagtgagatgacaccttcagatgtctctcacacaaactatatctgcagatgactgtcatccaaaactaggctgaaaagtctaacatctgtttccccacactttttatatttctttcttaatactttcaattcaccttcttattacatatattttatatattcattaacctattgttcattatgtgtaatatataattaatgcatgttaattatatattaataagtgtgtgtatgtttacaccagttatgttttcctgtgaaatctagtcccagaagtggagttgttgagttaaagggatgtcaggctatttgaaattttgatacacagcactaagttacccttcagaaataatttactaatttcctataccaacagtgtatgagaatgcctttttcctcacatttgccaacactaataattactttttaaatatcagcatgactttacaaaatatatcttattttatgttaatttgcttttttctgaataccaggcagggctaaatacccctggtaaaaatataaaacttgttaatcataaggaatattagtccaattttcaattagtttatagcacaatgacaattatctcctgtgaaatactgctataggcggccaggcacggtggctcgctcctgtaaacccagcactttgggaggccgaggtgggcagaacacgtgaagtcaggagttcgagacgagcttggctaacatggtgaaatcctatttttactaaaaatacaaaaaattagccgggcatggtggcacatgcctgtaatcccagctactagggagactgagtcagaagaatcgcttgaacccaggaggcagaggctgcagtgagctgagatcacaccattgaactccagcttgggcagcaagagagaaactccatctcaaaaaaacaaaaacaaacaaaaaaaacccaaaaccaaacaaacaaacaaaaaaacactgctataggcttacctatcatgctcttccttcagcttcttgggaaattgctgaggatacgttttcccaatctttctttgttgggttaatctgccagcagcagcagaagatgtactatcacatatattttctgaaagttgtattttttcacttttgtttgtattatttccttctttgacctttaataaaagatgaataataattgttattattttattcaataaaaagaactttttccctgatttttattacttgattcaggttaactatcaccactttaatgataaaagtattttgtgcttactttaattttatcattatacataattattataattataagatactcttattttatcatcgaaatttttgtcaaatctgctcatttctgtttgagggaatagaagaattttccaaaatttcaaaaagggctcttctccattttgtgcttttattcccatccactctttgctatctggtataaatttttatgctatctggctggcagaaacagagaaataaaaagacacaggcataatatatgtcttctgtctttactacctggattttacatgaaatagccagattaagaagatgtgaccttgtaggccttcaggaacagtaaagaagttttcccttttctgtactgagctactcttttccccactgccttttatctctcttttttttttttttgaatcctgtgatatcaaaaaagtaaaggttctctttgaattatgggaaccaacgtttgccacaacaaaagaagcagagtgaaactgctgagtttctagtgcagaattctggaaaatgagatgcttcccagatttcacattcaattaccacaaaagtttataggtggaaaacatatggtacagttacctactttaaccccattatctactgataatgggagtcaaaccaaccaagacatattaaatgtttcatccagagctcttgaggtggcattcactagcatttcatggcaccatataacatgatacaattccatattgctgaattacataaattaccagataaatttatcaaattagatatattaaaagtctaacttgagcaaagcaatttaatgcctcagagggtggaaaaaggcctcatctgcttttactttgaaagaagaaaatctctagatttttgtctatctttagaacacaatgtacagaactcaactttctactaaagagtcaaaggctaaatttttggctaagaaattatgcttcttatatgataaaaatcatacatgccaaaacttaccatactttattaaacaacataacgtaaggtctgattcaacagaaatattgcagagtggtgattttttaaaatatgtgtaagtatatgtttgttttcaaaaatattggaaataaccatgatgggactgtaagttcaaacagtttgagctaagcagataaacttgcatgcatgaaaacacattaaacagactcatttggctgggaatattcgttgcaactctcaaggctagacgtgtttttgtggcttgtctcagtcattgcttccctcccattgtattcccattctatcattaaataaatgtaaattatctctaaatgaatacaagaaaaaagaatctagaatctagagcttgtttctttagcaatttctttatgttgatctggttcagaaggtcacatggtatgtggcttaattagtttcccagctcatacgccacttggaagactgatagtgagacataggttgattaatgaacaaacattatgagaacattctccagaaccattatttagatagcagaactaatctactttgacacataattacacatttagataaccccactgtaactgtacacatgagattttcttgaatagaaaatttgactaaatcaaataattgataaagaggaaaaagaagcagcaagtgaacctctgtctttttgaagttggacttgcttttctccaaagccaggaactcaacttgtaacatgcctacctcattctttttttaattattattatactttaagttctggtacatgtgcacaacatgcaggtttgttacatatctattcatgtgccatgttggtgaccttggaatatcttcccataagtcttctagctatatttttgatgttctctcactatgtggtaaagaataactcacattttataattcaagattcatgcttctgtagttgttagcactgggattgccatatagtggctgctggaataaacgctgtattggttttctgtttttataagtatctgtagcagcagaaatactgtggctttctatctgaatcatatgcttcatttctttggggtgggtaaacaacaaatcaaaaagactttctggatctctagactgaggccaatgcctaatgtccaatttccaattagtggtatctgggtttacattttttgccatttgcatgtcaaactcttaatcatctttcatttcaatcataattactgggttccttaattttttggtttcagtatcattacaaaaattttcatcatctgtgttagaaacaagctatgtgtctggtttgctatcatttttatagtctgatttattttcatttaaatgaagcttagaagatgactggtaactgtatttcagggacctggagtatgaatggaataaaaagacatttgacatgggcttcctctgttcaggcgctgcctggaatgccacagagttagaccctccagatgcatcttcctcctcacaatcagggacctgattcatcagattagagggcactccttttttgttcgtccctctttagagttactatgtaggagctcttcctcagggcaagcagtaattctggagttttcaaaactttcaccaatattcagcttgaacttgtttgtaatgaattttaaagaaagtcgtgaatatacagacagattattccctttatcacaattcttacccagttctggttcttgagacttttttttttttttggcaggtgcaaaatggaaaacaaatttgcttgttttgtttctcagatgccttttctgtcagagtgcatgttttaaaattagctttaatcaagtataaacaaaaatactagaaaataattaaaatttaactgtgaaacttaatctatgtgttgccactcttaaattatgggattgtaactaaaaagtgaaaaataatttgccttggcttaacataggacagaaatatgaactggcaagctgaacgcttagcatttgtttggattaaacttaatgcattatgtgtaaaatctaccagaaatgaattcaaagctgataggtagtattataaaatcttcctctcttacaaagattttacctcagcataccagaaaaagtgagcccctacagtacgtgtatatttctgaagattaactacagactaggcaaacactgaattattaagagccaaactgaacaccaataagaaagggaagcaaaattttaaattctaattcaaataatatactatgatagtgttatgtatctagatggattatctgcttatatccacttctaatatattttaagttccactagtgatagtggatggattttttaaattttagtaacatttactatgtatttatgtcaaaataaagttattgtttgtaccctgacaccaaaggtcccattccacaaggtaggattctcttaataggcaactgggttgacttttatgaccccactcactccctgaacacagacacagaagtcaaatggtgaccacaaaacagaataaatctttaacctcggcactggtgaccagcaatataaaactgcaacatttgaaccattggcaatgatgactcctttaacactagtttaactcagtggccatcattgttaaattgttcacaatttctattccttaataatatgacccaatatttcatgttaccttctgtattatgagtaaggttataacaataaaagagcaagataattctgaaaatgtcttgcctcaattccaagggtaaagacagctatgagttactagagatagtaagaattaccagaataactaatagttactagagatagtaagaatatcttaagtttcataactggttaagatgttttaaaaattaaatataaaattatgatctatcggattctaaaggtatagtctaaaaggtcatgtcatttggactatgctttgttactgaagcaaaaaaacaaaacccaatattaaacaagaaacttgaattttcatatacctgtggttgcttcttttcacttctttcatgcctttcttgctcttcctctgaagccactggtaaggcttgttctgttgacaaattcattggtttagttcaaatgaactaagaacagttagataaagactataatctatataaaaataaatagagaataacatttctttgtattttatattttgagagtttcaatgaagcttaatgtttactgaaatatttagttctttaagaaatacttctaatcatccaaaatttcaacaaaccacttggggagacattagatatcaccaggttcaagccatatgaaatctcagggtcactcacaaattgttccacccaacataaatcaacaaaactgttagaaacaaaacaaaattttgaaatacagtcaaaatatacaatgtaacactttactatacttcataacagtatctttttaacaagacactaattgagttggcagttactaataatttgcaaaattattgttgtttataccttaattagtgtgcaccccattttttacatcgcaaatgttttcccctactattctgaaaaatttattttcatcttttaagactcagaaagtaggctgggcataatagctcacatctgtaatcccagcactttggaaggccaaaatgggggaactgctcaaggccaggagtttaagaccagcctgggaaccatagataaccttgactctacaaaaaattggacaggtatggtgatatgtgcttgtagtcccagctactcaagaagcttaggtgagaagatccctcgagcccaggagtttgaggttgcagtgagtctcgatcacaccattgcactccaccctgggtaatagagtaagaacttgtctccaacaacagaaaaagaaaaaaaaaggctcagaatgctgtgtgaagtcttccttgattctagctgtctttctccacacacacaggtgtctgcttcattggagttccttagtactttgtcaacttttccagcgtcactttaccacctgaactgcacatcatgtctttacatgttgatcccctttgctgttagactgtagaggacaatcttttgaatcatctttgtataaacagtcttaattttgctaaataattacttattgagttcctgctaagtgttaggcactggggtataaggaaggaaaataaaagctgtcagggatggctttcctaaagatcatgcatgagctgagacttagagagtaaggttagccagattaagtgaggcagagggcaggaaagggtgagcacatgccaggcagcaacaagagagggagagaagcctccaagagagtatgtatttctctgcaaaagaggaatggtgagggggccattaccagcagctcagtaattccagagaaaaaggcagatggggaaagggctacagatggagatttgggcagaaatcagtttccttttcttttctttttttgggacaaggtcttactctgtctcccagactggagtgcagtggcatgatcttggctcactgcaacccggcctcccaggttcaagtaattctcctgcctcagcctcccaagtagctgagattacaggcatgtgccattaccacctgctaatttttgtattctattagagatggggtttcaccttgttggccaggctggtcttgaactcctgacctcaaatgatccacctgcctcagcgtcccaaagtgctgggattatagacacgagccaccatgcccaacccagaaatcagtttctgaaatccttatataaaactttaagatgcttggacataggtattcaggagtggttcacagatctatttgcattagagataattaactctaattattgtgaggagcataaaattctgaggcatataaatcaatgaacaaagataaaatataaggcagtgttgcaaagatgatgcaggcctgaggagatgttttcagaaatatttaggacataagtatcagtggccattgtaagcatgaatttttattgaatgaataaatgtatatatctgggtccctggagaaatacactctgctcattactttacaaattttatcaaatgagaagtagaataatatacataaactgtttcagttacttgtatttactttacactttttctgtttcagttttactgtgccaaggaaatgcatttgggttttgtggtggttgttgctgttgctgttgttgttgttgttgttgttgttgttgttgttgagatggagtttcactcttgctgcccaggctgaagtgcagtggtgcaatctcagctcaccgcaactgctgcctcccaggttcaagtgattctcctgcctcagcctcccgagtagctggaattacaggtatgtgccaccatgcccagctaattttgtgtttttagtagagatgtgtttctccatgttggtcaggctggtctcaaactcccaacctcaggttatctgcccgcctcagcctcccaaagtgctgggattacaggcacgagccaccgcgcccagccacatatggggattttgttttaaaagttctgtttcctggatctaccaagctcatgagaaaatagaagcaaacaagtcatttgcataggtaagaaactttggatttatactttgtcatcactactctagaagattatcatcatgttttgtaaaataaaatgttaattctagacataaggggaaagagaaattaaaactataggggtgaaaaaatattgcataatttattactgttgacctgaccatatgactgattaagggcactgaatttaacttgtatgtgaagtagaccccatattagctgcagttaatcaatagaccaggtattctagcagaattaaatttgatgctcctgtgttatctttaaatgatacagctcttctgaaaacccatactcatagtgcatgattatccattaagacaaggtgatggaatgtgtgaatacagctcaggagacaccacaaggcaaatgctcaatggttcccattaatattggggaaatcaacattataatacagaaaaccataggcattatttaatatttggttttggaaggtatttttagtgacactgcatagagttgtacctaataattgcaaaattacagatgtaaaaataaaacaaaggcacattgtgtttgagtaggaaatctgtagacgtctagctggttttctattccaggcccaaaattctaaatataatcatggtacccgcacacaaatttatgttaaataccaacttcaatgaaattactctttctcctcattctctttgttatttatatgttgctttccttaagggaagaatacaaatgccttgctaagaagcattttgtttggttgtaggctgcataaagggagtaaacacaaagtacatttgaccacagaatgactttttaaaagccagaactatggtagcatgaagccaactgaggtaatctagaataaaattttctatgtttgtttcccttctttgctctctttctactctaataactgcgattcacagaggtaatgaagagtataattccctgataaaaacacagctccaagattaatcctttctttaactatgaagttcgtgtgtccaaagtcttgtagttgctgatttttgatcacgaatggtgatacagatatttatcatcaactcacaacttcccaaatctttgaaaagtcttactattgatggttcaactagtagaaacataatctaaaatatctgaaaataaagtttttattagaatgtaaatagtaatacaaattgtaataaggtgtaaaagttctttcttcactgaagcaggaccatgatgtcctctaccccacaaacacactactccctcatggtctaatgtatcttaaaagtcctgtaattgctattaactcagacaagtttacttaacttgttctaagcttctgttatttactacaatttactttatcactcaacaatctctattatatatgttgttttccatgagaaatttttttattaataattaggattcttcagggataagaaaatatttgaataactaagtttgtgcataaacacattaaggtcaaatacccatgacaatattgtgtgtttctctgtactagagacaaaaacttcaaaaaaatttttaatgaatatacattaaaaactgctttcattaaactgagatgatcttccctcaatgcatgaataccttcagaattcacatagaccaaagaattgtataaaatataatagccttaaaaatcttatttgtacctggcacagtggctcctgcctgtaatcccagcatactggcaagctgaggcaggcagatcacctgagatcaggagtttgagagcagcctggccaacatggtgaaaccccatctctactaaaaatagagaatttagcagggtatggtagcacatgcaggtagtatcagctactcgagggcctgaggcaggagaattgcttgaacccgagaggcagaggtggtaatgagtcaagaccgagccactgcactgcagccttggtgacagagcaagactctgtctcaaaaacacaaacaaacaaacaaaacacctaattgttcccacataagtctatattcacacaagatctgaagagtacacaacaccgtgagacaggacagacataaattttaaaagttatattcccagtttctgtaaaaataaaacggttgaatttaagcttttaagacaagtcaaggaaaagagcaaaaaatgcaaaagtgaaacttgaaaggtcattttcccatcaagggctcatgatccactggacattcacaaactatattgttcaaaacattagttctgaattttgatctgagtatccctggagttgcagtttcattcaaagatgtccaagaggtcaaataagacaatatcatttgctattttcagttttcttttctgagaacagcacaacaaacttcttcagagaaatgaattgtcctaacttcataggctaaaggctcatgagtcacagttctaagggcatttataaaatatggtggtgcatgcttgtattctgaacttttcaactttaaactctcatatagtaaatattaatagatacaaactgattaaagaaaagcccacttaatctgacattatttttatttttctttctttcttcatttatcagcaacaggagagtctaactaaatgtggtaaagtggtataagggaatacaatgaaaagtgtaaaatgaattaaaccagagataatcatatcaatgtggatacatctggaaaatataatacaaaatacaccaaagaaagtggcagaaaggtatgtaaagtgtataaccactcacataccattttgggacacaaataaaaaattctgcatattatttctgagcatcacaatatagttaaagatttcaaaagggcattgaaatgaaaaacaaccaacttatgatgtcggtagcctctatgcaatcatgttttaaaaaccttaacaccaaaaagtctcaaaatcaccattttaaaagactgtgtctaccagttataaatgaatcattactttcctcatttttaatagtcaaagatgccacaaacacacacatacacacagctatatatacacctacacacacagtcttgctcattagaacatctgattggcttcagatcatcagtgtaataacactagcagcaagcctctaaagttaaaacagaatctgacatgttaataagtaaagctttcctctaggtaaagttcagaactccaagtagcacttaactcattggaaatatcttagagtctcaaaattcactgctttgaatccctgacaggtataaaaattttatactgaaaacttcatgctattcaaaacattaaaagagaaacatctgagttaaagcttacatttttaaaatcttttttatgcttctaaatttatttttattcaaatatggataccaacaataacatttatgtcaatgccttccattcaattttgaacaaatagaattaggaataagaataatgtgagtacttccaatcattgaatgtacttatttccagtattccattaaatgtacctgctctcaatgtctgtacattctttctttgtactgctcctttcacagcaggatcttctacttcagtgctaggctgaatgggttttaaaagaaaatgattcataaatcatatatattttatacaacatggagttagtgattcaaaaatatacataattaattaccttcaaggaaggatgttttgcaggaggccctacaaagcaaaggggatatgtcatcaattatatgtaagtatgacagggccaaccaaacattcatgcagtggtactatcgagctgaattctcatgcctggctataaaaataattacttaaggttttgagggttcttcttggcatcttttcattgcctaggacggcaacatgacagaaacataatgaggaaaataggaatataggattcctaaaatgcacagtttacatttcagtagtgagattatgtttcaaatgcctatacctaaaatagaaaagcatggatatcaccgtgaacatgtggactgatgaggagaaaagggaccattaaacagaggagcaaatcaaacctgagggaatcgacgtcaaagctgatggtgaatgtacagagtattttaactcaacacagcagaggcattgctgccagcatgccacaaacaaattccccttgtcttgtcactgaggaaatacacagttgggatgacagttcaggtgaatgtgtgattcacctctcatcaaagaaagtgttctacattgatcagctagtatacacacttatgaaatgacagctaatcaaactactcatttttcccatgatcacatgggctactgcagcacctacatttctcctatcccctcatttggccttgagttagagctccttgatccactcatgcaaggatcacataaaataaaccatgtcgaataagcttccgatatcaaaatatttatcaaaaaagaaaacactgaattaccacagacttgctggatatgaatacatatttatatttcaaaatcagtgcagtatttattgaaaaagagaattttggtattcacagaatgaattttgtaatatcaaaaaaaattagccaaagcatctatatgcaacttaatcacatcttattcactcatgtcagtgaaacttctctctctgaggcctgacagttatcaagtgaaatgagctgctgtggtttaccccaactctagcactccctcctgcctccagtactctccacagcaataacctcttttgtgagactgggcatatgctgaagcaactggaagtgagttgtctcaagtttacttggcttcaactcccaagaccccagcaaatgtctttctttcctccctccgtgtcctttcacaatccctcttcctttgaaaaagtgatttttagaactgtcatcctgatgcttcccttcctaactgctttttatggataattgtgaccacttttttcatctgtattcagcagtagtatacacctgtaatctctctgttttcatctcattctccttcccctgtggctagaatcatgctcagaaataaaaggaaattaatgctttccctggattctgttattttttaaattgctctccaatggttctttttccagagttctctaaaggaaggctattcccttgctattcagagctgtgtccaaggaccagcaccaaaaatcacctgagtactcatgagaaatgcagactcccatacctgctgaatcagaatgtgcaccttccagaagctcttcaactcattcatgacaatttgaatgccctgttctacactgatgtgcttccatattggtttcccctaattgcccttttggcctagcctcaatttcttccctattatgtccctcaatttaatactacattataagccataatgtttctaatgaacttttaatcaggcaataacttcttgaattaatttcttctccataaatcacccaacactattcaattatgttaatttggcctatatgatactatcctatgaggttacaacattttctataaaaacaaattatagccatacatggctgaccatctttggtgatgttcatctatggtagataaaacacaggtctgtgtggtgaggtgcctcaatccttaatgcctccccagtagcgaggatgacagcaagagaaggaaaatgttactgtaattctctgacacattttggtactggaagctcactttatcttctttcctgtttctaacaccatgttcttccttcttctacagatcaatttgcctttactatcctctcttacttacctctgcatatgcttttttatttattccatgtacaatccgctctcctcattctttctttctctttattcatttcctcttccctctctcctgacttgcctcaggtcttagagtatcttaaaatggaactcacaattcagctcctttagtggtactcccaatagaatcaactgctgacccttggttagagacacaacttatcaccatttcacttctcctttacttattatacagttaataggacactttctttagctattacactctattagtgctcatattttcaaagaaacattccatcaaatgactttttttgttttgttttttctgagacggagtctcgctctgtcgcccagggtggaatgcagtggtggtatctccgctcactgcaagctccgcctcccgggttcaagccattctcctgcctcagcctcctgagtagctgggactacaggcgcccacaacaccacctggctagttttttgtatttttagtagagatggggtttcaccatgttatccaggatggtctggatctcctgacctcgtgatccgcccgcctcggcctcccaaagtgctgggattacaggcgtgagccaccgcacccggcctccatcaaaagactttttaaataaaatacggttctcaccttctccttgtccattgactattctgtttcctttttcatgcgaagatccaggtaaaggctctgacactttctcggggacacactgctaaggtaatatcaagaattagtttccattttaaaattataatgagttgcatcaagagtttcttatcaatctctttttatgaaactgggtctcactctgtcaacccagggctagaatgcaggggcctgattatggctcactgttgtctcaaactcctgacctcaagcaatcttcccacctcaacttcctgaatagctggaactacaggtgtgtcccttcatgccatgctaatgtttttattgttatctttgcagagacaaggcctcattatactgcccaggctggtctcaaactcctgagctcaagtaaatcttccacttctgccccccaaagtgttgagataagcagtgtgcaccaccacacccagccctaatcaatttctttaaatcaatctcaatgttgcccaggcatggtggctcacacctgtaatctcagccctttgcaaggccaaggtgggtggattgcttgagttcaggagtttgagaccagcctgggcaacataatgagaacacatctctactcaaaaaataccaaaaggagtcaggcatgatggtgtgcgcctgtagtcccagctgcttgggaagctgatgtgggaggatcacttgagcctgagaggtggatactgcagtgagccaagatcatgccactacactgcagcatgggcaacagagcaagaccctgactccccaaaaatttcaatttaaaatatgagaatgaagagagatacaaacaaaaaacaagcctaattggtcaatgaaatatgagcttaagccaagaaagaaaagagacaacatgaagtacaataaagtacatggggaaatagatctataacagagccttttgctctttcatatccctgataatactaattaatatttatgctacaattagttttttgtaagtacttctgtgatatagcttattactataagacattcaattagctaaatatggtcatcgaccactacctgaaagaacattattataacacagagagaaaactagaactttcaatcaactttccacccagaaaaaaattggtcaccagaattctaaagagtaacgtatggcagacacatgaaaaaatgctcatcatcactggccatcagagaaatgcaaatcaaaaccacaatgagataccatctcacaccagttacaatgacgatcattaaaaagtcaggaacccacaggtgctggagaggatgtggagaaataggagtacttttacactgttggtgggactgtaaactagttcatcctttgaggaagacagtatggtgattcctcaaggatctagaactagaaataccatttgacccagccatcccattactgggtatatacccaaaggattataagtcatgctgctataaagacacatgcacacgtatgtttattgcggcactatttacaatagcaaagacttggaaccaacccaaatgtccatcaatgatagactggattaagacaatgtggcacatatacaccatggaatactatgcagccataaaaaaggatgagttcatgtcctttgtagggacatggatgaagctggaaaccatcattctgagcaaactatcgcaaggacaaaaaaccaaacactgcatgttctcactcataggtggaaattgaacaatgagaacacttggacacaggatggggaacatcacacactggggcctgtcgtggggcggacaaggggggagggatagcattaggagatatacctaatgtaaatgatgagttaatgggtgcagcacaccaacatggcacgtgtatacacatgtaacaaacccacacattgtgcacatgtaccctagaacttacagtataagaataataaagagtaatgtatggcttgaaaacgtatatttaatagaacatgagttagagctaataaaaagcttaagaaatgttaatctaaaatctcaatgttaagattccagttgaatgatactagaaaatatattgtaaccctatttgctactgatgacctatttctattttatttcctttttaattatggcataatttctcaacataacatatcaaaacttatacacccttaaatattaaaaaatacaatgtaagcaatattttaaatacaatatttaattattagatacattaggtttattatattacttataacattccattatataaaaattcatttgtctatttattcagattaaacaactattaaggctgaatgtcttatgcctgtaacccagcactttgagaggctgaggcaggcagaacacttgagcccaacagttaaagaccagcctgggcaacaaggcaaaaccctgtctctacaaaactcagctgagcatggtgacacaggtctatggtgacatagctctattgtttaaactacttggatggctgaggtgtgaggatcacctgagcccaggaaatggagattggagtgagccaagatctcaccagtgccctccagcctgggggacagagtgaaaccccatctcaaaaaacaacaactaaaatgcttcttacatggaagactgtattctaggtactccaggatacacacaaatatgtttactgacctccagtagcttacggtatgcaggagcttccaatgattatttaaacaactaaatagaaaaccttctgaaattcaaaatttcagaatatgatatgaggactttgagtggctattttattttttaagatgtagtcttgctctgtcacccaggctggagtgcaatggtgcgatcttggctcactgcaacctccgcctcccgggttcaagcgattctcccaccttggcctcctgagcagctggggttacaggcatgcaccatcacgcctggttaatttttctgcttttgttttgttttgttttgttttggttttggttttttttagagacagggtttcaccacgttggccaggctgatcttgaactcctgacctcaggtgatctaccgacctcggcctccaaaactgctgggattacaggtgagtctccacacctggtgaagtaaatattttaaataaactacaatgacaaaattatgaggataaagtcttaccatccattggtattaagagtctctgcttctagaactggttatttgcagcaaaatacatgttattcaattagatgaagtgccttatataaactcttcatggacaactcataaaccacacaaaaattcctttgcaatacacattttgagaacataaatttaaatttctatatttccacaatttatatttttaaatcagatacgatgttgcccaggctgttctcaaactcctgggttcaagcaatcttcctgcctcaaattcccaagtagcagggactacaggtgtacaccaccacactcagttatttttctacaatttttatttttttttgtctcactacagaaccaataatataagtagaaaaacaatctctcgtaaaaacaatatgataccaaaataataagtttccaagaacaaaagctatatgctatgtgctgaatattcttgccactaaaaatcaccaggaggatcccatgattactgcaaataatttgatccactgaagatttatacaggcataaatattaagaaagtcacactcgtatgatttaaaagtcaaagtattagtatttatccaaataaaccttaagcaaatttcatatttcctctattggagaaagcatttcctaatgtgattttcctgtcactactaattttccagttcattttttttcagctcccaccctgtcacagtacttatcaatctttgttagttaccaaagttaaacacattttttgaatcaactagccatatgtatgtttttctctgaccaactttccattaccaccataaaacaatgataggtaaaccactgctaaatttgaaaagtaaatactatgcaaaagtacattcagagtgagaaaattaattttacaagagaccactttaccttagtagcaacattcaagtctttgtcatccgatgcaggcaatgaatccacacgcagttcatggaaaatgcttgagagcaaaaacacacaacgaaaatgagcaagttgatttctttacaatttttttaactgccagtttatatccagcttccccctcaaaaaaggaaaccataatctagggaaaggtcagcaatctatatattaaatagtgattcttgatataattaaaatatgtcctcttctaaaaatagattttagttacctatttctgcctccacttgtctaaatctataaaatattcaatgaaaactaaccttgagctttataacaaatagtgacagtcaataaattggcagagcctgacaatgatttgccctcacaaattatctgtcctgaagctgaacttaaaattcaattaatggatgacataaattttgttacctaaactggaagaaaactaacaacctaaaacaaggtagaaagatccactgtctcttttccatgatctgtctctggataaaagactaatctgcatcacttcaatatggcagtcttgattcctcagcatggaacccacttaggaaggtcctattgctttcctttgccctaaatcagtacaggaaagcccctacaatatttgaaatgtatgaaagctaaatgtacagaagtcaaataacaaaggtgtatgttcttattgagaatacttttcccagaaagattgaaatattaacaattataaaatcccattattttcaccctataggtcctaccttattcaggtccacataaactagcaagcccttaaaacttttcataggcactcagacacccaaggagagagactgtcagaaaaaaacagagtcctggtaggtgtacctctatttccctaagtactctctaagtatctgtcttcctatgggctcccacttccagattccacttctgcagggctccacagaagtctccaatctttaaatcttcagtctatgaaagcacagattcctgaaaggatggcctcaaatgaccaggactaggagctctctatatccctgctcctgaaaaacaagctaactggagtctccatcacctgcccccagctagacacactaccaactacccaactgaactccatgactgatttgccagccaatcatgcccctgaaccagcccacatggacatgggaaggacatcagtgaatcgggaaaagaggcagaggtgaggagacacctgtactgggccacagatctatgtagttcagcaatctccagccccttagtactccaggggctctaagccacccctttctaagtcaggatggaagtagatgacaccacatttctatctgctgcagacgctcctcccagtgtctcaaaatgttttagcatctttcagtaaaaatcttcaagtttgtcagtccttgatttaaaaaaaagcagcaaactttttagagctcccttgaaccttctattttaatgtgccttcgtagataattcccaacatcttgtgtccttcatttttataatttatctttatcaaacttgtcataaaccccaatattttgatctcttatagaagagtctgtactcctatccaatccagtgttgtttatcttcaaacttggacttcccctgctcattccattcttatctacttccattgggttccccagctaattccattctcattctacccacagactcactcccgtttgtattattaaaacacacgccaataggatataaaaagaagcaagagtactgggctttaacatgagttcaaatctcatttctgccaattcctatgtctaaaaaaaagcatcctaaactctttgagcctcacattctctatctagagaatcatttgaccagaatgttcaacacaggtaaaaatactagaaggtattttaattcattccaagattccttaaaattctgtaattctatgtcctcttgattctgtctatagaaaaacttagaatacatagccagcagagtttgaaaaaataatagaacaaaagaaataccaagaaaagcagagaagaaagttttaaaaaatgaaggcaagattatagaaaagtcacggaaaaagcaacaagactaaaaaatgtattatggaagtaagcagaaatacttgcctaaatggaaaaccaaactgggaagtcaaataatttgtctctaagacttgcctaaacttgcttttgtaaaacttacacccctatggcaaagctaagtaagatctgccctagagcctttgatggtaaaaataagatactggttaccactgaaattgtcaaatttattaggacaaactcttggactaaccacattctaatgataaacttaaatgagagttcaaggtatttaaactctcattaatttagacattaatcaaattaatcaatctgactaatctgattcagacctataccttgatccaagggctgcacagatatctgtcaatctatgctgaggagcaagagacaggatttggaaggcaggcaggctgatggtcaaactgtaggccagctactttgttaactatgggatcatgaggcaattaatcagctctaatccatagttgtttatttaataaacagtaggttataggaacacagatgttgtgatggctttatgagatgataaacgcatagaacatattaggatgtctagcccagaatacaacactcaacagatattcgtttcttccatctatattttcttagttaacataattttttaaatctataaaatcctacctgactgcagattcatcagaacttccaacatctattaaagaaaaaggtaaaatgcattttaaatcaataacaaatgtacagaatattaaaagcataagaatgcacagtgatgcatccctctaatccaaactacttgggaggctgaggcaggaggatcacttgaggagcccagaagtttgagaccagcttgggaaacatagtaagactctaccttcataaaaaaattgtgcacacttgtatgtatgctttagatcctgttttttgttgttgttgtttttgttttgttttggtttggttttttaaagcataagactgatgctttgttacaaagcattcctttgagagcatgcctgggaccttattagaattaacattcgttatacatattggtaggtaattaatgcagtaagaactcttccctttgtatttattagatgcaaagaagaataaatttattaaaatttggtatctacaagtgaactgcagtatgcaagtcatcttagccaaaccctatgaggttgagtaaaaatggtattgttagcagaacaggtgtgatgagtcaccagtgtcaaagagcatgatttctggaccaaaatatgaggcgccattaaaacagagtacacagtagtaccccttatccactatacgtgcagaaagacatacttgacacatttttctctactgtcacaccacagcaacaatcatcaacaaagaaggcttctgtgaccaaatgtgtggagggtttttccccaccaacaagcaagcaatcattcctgctgatgacacaattcaattctcacaccttatctgctggtaacatcagattcaatttaatttataaattaaactttagcatagatatgtatgtatagggaaaaacagtttgtgattcagtactattcatggtttcatgcatccacttgggggtcttggaatgtatctcccacagttaagggggagctactgcacttattttgttataacacaacacagcctctctagctcttcagttcaaactgctcagtttagaataaaacaccctaacaccagatgtcagcaaaacataggaatccgaccagaaacaggaatccttgcaaagactttccagccgctagtggaaaagagctcaaaagagatcaatgtattactctggctactactctttggggaaggtgctgggtggtttacttagttgtagctatttgctctgccctacatatagcaaggcccaaattcacctgccattttacctcccacagaaaaaccactggaaagatcactcctttaagagcttatacgctaggaaccacacctcacattcagagagaagctgaagaaacaccagggaggtgtggcaggctgctggacagtactatatgatgtgaaaaatatatagaaagaaaaccatcaatgcccttttactaccagaatgttccagtgcttgcccttctccctagtaggggaaaaaaattctttttcacctcacagaaagcaaaactctcttgctatccctcatgacagaatctagttgtaggtgagtcacatcatcataatacaggctgttgtcaacctcatccctcaaaggaagaggatcagtgaggaacctatgtacttacctatagcattcactgtctggtcttatttccaaccgaaggtaagtatgaaagactttgtgattccagttttataaagtacaaccccttgcacttgtccccttccattgctagagaatctatctggacccacctcacagagcaagatgctccagtttgtgctgtgtggtacagcatggtgtccttttcctcaaccctttctattatgtgcacatatctatacaaatcatgttttctaagtatgtaaagcatatgtcatcagaatatatcattctttacaatgataaagaagcaaaagaaaaacaaaaggacaaagaacatcttaaatgactacattcaactgccatggagctttaattttttaactattcaaaaagatatccactgtattattccaactatgtgactcttctgaaaaaagtaaaactatgaagacagagtaaacatcaatggttgccacgagttactagggagaaagggaaagatgaacaggcatagcacagagaatttttagggctgtgaaactgttctgtcgataatattacagtaatagatacatgtcatgtcattatacacttgtccaaattcacagaacgtacagcatcaagagtgaagcctgatgtaaactatgaactttgaatgattataatgtgtcaatgtaagttcatcagttgtaacaaatgtaccactctctggtggaaaatagtaataatgggggaggctatgcatgtgtgggaggcatgggatatatgagaaatctctgtaccttcctctcaattttgctgtgaacctaaaactgctctaagaaataaggttattgatttaaaaaaagatattcagctgggctcagtggctcatgcctgtcatctcagcactttgggaggcaaagatgggtggatcacctgaggtcaggagttcaagaccggcctggccaacatggcaaaacctcgtctctaataaaaatacaaaaattagctgggcatggtggctggcacctgtaatttcagctactcaggaggctgaggcaggagaatcgcttgagcctagaaggtggaggttgcagttaactgagatcgcaccactgcactgcagcctgggagacagagtgagactccatctcaaaaaacaaaaagatattcactgtctatgcatcccaggatctccagaacaattacaataaataaataaataaataaataaataaataaatggctgggggcagtggctcatgcctgtaatcccagcactttgagaggccgaggtaggtggatcacctgaggtcaggagttcgagaccagcctgactaacatggtgaaaccccatctctactaaatacaaaaaattagccaggcatgattgtgcatgcctgtagttccaggtacctaggaggctgaggcaggagaatcatttgaaactgggaggtggaggttgcaatgagccaagattatgtcattgtactgcagcctgggcaacaagagcaaaactccgtctcaaaaaaataagtaaataaaataaaaaataaagatattcactgaacctgttactatgatatatttaagcaagacacggtgaccctaaaaattagagatcattgaagaccaaagtaacaacatgtggtcattacttctcaaattgaactatataaaatatataaaataaataaatttaattgcatgcttaggtaagaaaatattgataaaaataattgaatattttatcttatttcataattctaaacagggatttagcacaatatgaaaactagactattcatgtaatcaaaataaaagacaatttttattctaatgttaactcagaaattattttgcttatttaatttaacaattttactgaaaggttaatgagataaataggacagattataattacctaacattgctatggtaacttatatacaaatagctgttcatcaccaaaagtcaaaaaagtaacaagcactgcaacttaagatggattatacaacagaaattagtaccaagttaccttatcttataatattatgttattaaaatgaaattttaaaacaacaccaaaaattaagttggggttacaagtgttgtgcagaaaagatttcatatagcaggcaagaggctgccatccttagaaaggcctgcatgcaaggctggcccttggctggtgtttaggaaattggaaatgggagggtttccaccattccctgagaagagtggctcactgtgtctaaagtgcttatagaaacagtgtatttactctaaacagctgctttccttgtaagagtctggaatttgggtacatgtgagggagagtaacctccatagaaaaacttgggcacttagtctctaatgaaactctggtactggtagacatcactgcacatatgttgtcaaaatgtgagcctgggagaattaagcagatcccgggaactccacaggacagaactcctggaggcttgtgccttgtttcctccagaattgaccacatgcacctttttcctctactaattttgcttgtccccttccttgttatcaattaaagatctgagtatgactatttgttgagtcctgtgagtccttctaatgaaccaccaaacctggggtggtcttgggaaaccttgacacaaattcattgtgtaagatttgtattaagttgatatgatacgtgtaactgtaatcagatggttatttcacagaataactttacctaatctgtttttcttttctttttttgccttgatatttgacttggagattctcgtatttctatatctatccaattgaataaagccatagaaggaataaatgaaaaaataatgtcagaaaataatgtgaaatgagcagcaatcctcttttatctgaataaaaaatagagaatctgggtgattgacaatatgttctacaatatgaatgtttctagaaaaaaaatgaaaaagtggtcaattttctgcaactcaactgggcttcattcctttttataataattttgaaggccaggtgcagtggctcacacttgtaaatccgagcattttgggaggttgaggcaggaggatcacttgagcccggaagttccagaccggcctcggcaatatagtgagacctcatctattaaacaaacaaacaaacaaaaatcccttaaaaagaaaattagccaagtgtggtagtgcatgcctgtagtccaagctacttgggaggctaaggtgaaaggatcatttaaggccagcaagcagaagttgcagtgagccaagatgacaccactgcacaccagtactgacaacagagggagaccctgtattaaaaataaataaacaaataaataattgtgtatcaggccagatgtaaccacacaaaactgtagtcccagctactcaggaggatgaagtaggaggactgcttgagcccaggagttcaaggctacagtgagctatgattgcaccaatgaatagacactgtattctagcctaggcaacatagagagaccccatctcctatgataataataattgattaattgtgcatcattcaagtaaattgtgtaactggagaaaaacatatgactattgaatatactattatagtctactactgaccatagagttcctgtttacttgcttctaatctttttcttcatttctcataaaactgaaaacatgatttaaacccattaaaggcagttcatcacaaaacaagtcaaaaagtcaaaagaattgcatccaaacagtaggatgcgttatccaccgctctctgtgaacagttggatttggtcattaagaatcagcaggacttttaactttgtgtctgtgtgcacaggtgtgtgcacatgtgcacgtgtgtatgtgtatgtatgtaaactatgacagataaaatcattttgcttgtgtacgaatatgtaatataacttgtgcttctcacaaaggaattgcttttccgtctcctgtgctcagtagctgtcttcaaaaaataatctcctatttgtatgggtgcacactggttcagttctacagttcttattgccatttatttatggtaccagaaagggattgctgagttcctggttctaaagatagttactttcttagtgacacaaatcaatatgtaatacagttcacccttgaacagcaagggtttcaactgcagggattcacttatatgcagattttcttctgcctctgcaacagagagacagcaagatccacctctcctcttcctcctcagcctaatcaacctgaagatcatgaagacctttgtcaggactacttatgctttatgaaaagtcaatatgtttctcctgatgatttcctttctaacagcttcatttctctagcttattttattgtgcgaacacagtatataataatgcagcaaaaacaaaataggtgttcatcaactgtttatgttatcaggaaggcttccagtcaattgtgggctattagtagctaaggtgaaggaatcaaaagttatactcagattttcaactgcacagggatcagagtccctcacccccacattattcatgggtcaactgtagttatttgtttactaaatataaacaatttattataaaaatgaaatcgaagatccatttgtataacaagtccaatttgttataatgtgactatagaggaaacatacaacatactaacttaaaaatcttttttcttatttatgcaaaaatattatataggattttagggatcataattaaataaatgaatgttttcagacaataatgtttgagattgtaaattagctacaactaccttcttaaataaatctgaatttcaaactaaagaagttaaattttaaaaattaatttacatatgtatatacatatatacacattcaatttacacatatttttaaactggtcttttttgactgaaactaccttaatcttacatcttactttgtattttcttatcaagagtaggaccaccaagacaagtaagaaattcacaatcagaagtcttacctgatttctcctttttaagtatcttctttttatgttccaaaatttgttgttgaattctatgtatacaaaagtaataaataaaattgccatttttataatgaaataaaaaatattcaccaaacatattaaattccaaaacactttcaagcaatatcagacctaatatcagaattttaatgtcccatacacttcaaatttgtaaaccttacaagcttattaagcttataattaaagaagaaaagaaagtgaagtactcataaatggaggaagcacagctcagtaaatgaactctagttagctggatatcatgcaaagtgtcctgcactcagagtaagtccttgctctgtaaccaaaatacctcgctctgtaggtattttgtcttcagacaagttgcttctcttaggctccatggtttcttctaaaaaacaaggattctgctaccttacttcactaggttgtttggaagatgtaatgagattacatgtttatatgttcagagaaatagtaaagcaatggaataatttattcttgaactttattgctgaaaccattttggaatcccaaataatgctcggtgtgtgtttttctgtaagttctaatactcaaatgttgcagttttcagaaaatgttattaagtgctaattttggttattacttgtattcattgtggcttgtaattcagggcattttacctaattcataacttattactaaatttctatatatataaatttagtgagctcatcactgagctcatcaatcacaccaagggcagaaaactaataggtgtcaaaacctggcttggacaactaccactccttctctacctcctcaaactctgagccagcagatctgtgcttggctgctggatctccatggtcctctccaactaacagacaagacaaaaccctgctttgattgtttttcagttccatgaaggaaatacaagttgacattttctcatttccaagacatgtactaacaacatgtaacatccccttattactcagctctgttcccatttcagagatcaccatacatcaatagtttcatagcgataatcacaatttcaatattgcgtgtcacctgttttggttttgctcacactgcttccttggagctactcaacaaatagtcaaatggcctacctgggactaggcaaaatatggaatgttttctgaatttgtgtgccatccctaggcagtagccatgcttatctgctctgtattgatccaattttaaaatatgtgctgttgaaataagtacaaagccctgtttgatacatggatattcatgagtcatggatgaggcttagctctattaaatccaactcacttacttcagattcagagaattttattgaatggcttcctgtgaggtagaattttaaaatatattgaaaacttgaggaagagctgcaagtagcccaggagattttcatgattatagagacacattacttgaggggccaactgcaagctggttcccactactcagtggaaagataacatggaacattccgctatctaaccaaagctgctgcacaggatataaaaaagcctcaaggtacagatctgatagcaaaagagacagggaactctgatctcttcctgcaacattatttgaacatccctgactattgagaacaatcccaactaatattggttaaaggaaagacaaacatggctctcaaaggataacataccacgaaggcctaggcaaagtctagctaagacgtgggctccaaataaggtttttagtgtagggtgagcatcaacttgctcaatatttgtgtggataaagctaggaggcctagctgccagagcagggtgctgggaacaatgactgagcacaagtacataaactaataaacaccgtagctttgacctctatatatgaatcaccatgaaaactgaggggtctgaatcagtgaaggcatcctggtggcaaaggtcaatcattatcagattgcaggaccagttataatggcaataatacagcaagtgagtccatggaaacaacagaatgattagaatggccttttttccccttcttctgacttgtaaagaaagattgccttccttggacttaggaaaccccttagcttcttggaaaattcaaagaaggaagacacaggagagagccccaggggacaatacatgattttctgttaaactggacattacaagactcaataactaattagaaaagtcaggccaggcatggtggctagcactttcagaggccgaggcagggggattacttgacctcaaaagttcaagaccagccagggcaacagagtgagaccttgtctctacaaaaaaaaaaaaaaaaaaaaaaaaggaaaggaaaggaaaagaaatcaaagacatggctctttttatcccatgcatggggattatacttagaataaaatgaataacattgagatccctagggataaatgtctcaaaaatccagaaaaaatctcgcactctacttctaactaatctagacttctgcttgatttctggctaaaaggtagactaactcttcgctatttcaaactatctgaaccaaactatgaactctcacctaatgcataagatggagtagttgcaattattttaaacttcaatttagcattaactggccttttaacataaacacttactttgtcaaatgatgagaaatagcataatcttctgcatctcgtccacacatgtcttgagcgaagacatcaatattttgcttaagaaggatattgacaatacctggtgagtcatagtatacagcaagcatgagagctgacctaaaacaacaaagaaataactccactcaagaactttaataaagacttttttaaaaagctagtttgatacactttaccagtttaatatccgcctgtcagtatagatgtaataactatttgcatgtactagcttgggtctataagcatctagggtgctcaagtgttcatctttgtaaattgtcaccaaggctaaaagaaagggacaacagggaagcctcttgtcccactggggtaagacataatacaagttgctaacttatagtcctttgatggccaagaaactgtgctgaggtcacttatctaaagtaggcaaagatttagatgaagatttccccattgctttcctagtcaaatcagctaggggtcagataagagttatctgcaggctgaaaacaacaacaacaacaataataataatgacaatgctagtagtcataaactaaaagtccacactttgaaaatgaataaaacttgtcaggtgcagtgtctcatgcctgtaatcccagcactttgggaagccaaggagagcagatcacgaggtcaagagatcaagaccatcctggccaacatggtgaaatcccatctctactaaaaatacaaaaattagctgggcatggtggcgtgcacctgtagtcccagctacttgggaggtcgaggcaggagaatcgcttgaacctgggaggtggagaatgcagtgagctgagatcacaccactgcactccagcctggcaacagagcaagactccatctcaaaaaaaaaaaaaattaataaaactaatacaaaaccctttagctaataaaagattacagtacgaaaaacatctgattataaataccaaactctgtatattataagagaagatgaatcctactatatactattctttatgttactcagtccaaatatttgcttgtctacctgattattcatggtgatatttttcattatatgccaataattatgttaatcttcttattaatatttctgacttgagtgaccactctagaatactcaggttttatttttaaaaaaagaactactgtaccgtctcagcctatcaacggcatgtgaacttgctttccttttcaataaaaattccaccattttctctttcttgcaaattatagcaaataaaagtggggtattattgtcctataaaacagcagaaaaaattaataattcacaaaattacatatttctcaactgaactgaaaatcttctccaggatgctttgaacttcaacatacaatatagaaaggaagtaaatgaaaagcagtcccttcattctcactcctctgtgctttctgatgtgctgtgctttgccttgcaaacaaccctcctctgtctccctggattaactgtggtcattgccaaaactcactttaaacatttactagtcccaagaatccttgctttgatcacagcacttatcatggtacattgtagtcatttcattgtttcccactgaaaccaagagcttcttgaggcaagggcctaaaaccctaagacacagtagcaaatattttaagttttttacattaattaatgatctaaattactatctctaaagcagtgtctcttaaactatattccaaagaatatttgctttatcagaagtattataccgcaagagaaagactccatgaccatctgtatttgagaagtattacaaaactgtattttatgtccaataatcaagaaatctctttaatttcacctaatcccctttcacaatactatttgtggcaaacattaacatttgaggaattaagagtttcagagatacagttgccagagcttcccaatacaggtggcagttccctctgggtggtacaaacttgcttgattcacttttatcaatggtgtcaggatcccagatgccaatgtcaggcactcctgctccaaatgggtcaccatggaaatgagctttgaattaagagagattggcttcaaatgcatttattttccttattattaaatagtccatgggtttttcccctaatacaagagaagagatttttatctttactgttagaaagctcagtatattctgtgtaagagagataggtttaaaaaacttaagaacaaatattttaaaaaccaaaactcagtaagaaatactattctcaattataatggtaatcccgggaccctagtgcagctctactttttaaatccatttttactggcttccacttaaatggctacttaaaattattttttattttagacaaaatataaatcagaaataaaaacataatggcttatcaatagaagttctcatactgatccacatggattatttctggcataatacaagccaataagtcacttgcatccttaaggaagagcactgaggagaaggatgtactgtctgcaatattcataaattatccaactataaccaggaataacctaaaaaggcttctaggcattcttatgggcagagaattatttgtggtatatataaagaaaagagttaaaaacttctaaactctaaaattcaactccataactgagggatttatatactctatagactatatattataaacaaatacatgctgacttaaaaaccttgaaatttttatcaaaatatactataacataggagttgtaaactcagatacttacaaggacaaaggaaggttgcctgagtaagggaagtactaaggtgggcacagtagcaaactggagaatacctgccttctataaaggggcaacttctgcacagcagaccaaagaatgatagaaactcaggggacaccagatttgattttttaggatatgcctgaagtccacatttcttcacgagtcttctaaattttacatgttgattcaacttatagaggcaaacaaacaaatctgtgtaccacattagaatacagcccttgttttttttatattcgctattaatgtgttactaaatggttgtgtataatccaagtattttcatgtaaaatattttctttctctggtatcatatgttctaccaaaaaatcaggctctcatatataataaaaattgctaaaaagactcacaatacctgcttcaagaatttttccaacatgtattcatttaaaatatgtttgtatataattttcccagattgttaaccaaatagataattggttcacaagactgctaaaactaaattattaaaagaattcctatctatattcttattaacttcatggatttcagtgtttaaaactgacattttgggtatgctaaagttctataaacttaacaaacatactgagatagttcataacaaaacttcaactaaaaaaaatagtttaggatttgctactattctaattgagaaagccaaacttgtaatgaacatttgttgacacataatcacctgcgtggtgacaaagggacatgaaatcatgaaagggtcagcctctacctattgaaagattactcataagcaaatttctgaagactctctgaatggtagtgaatgattcatggtgggaagcaaaacatgttattctgtaagctgagagatattgccaatgatattacctttcacttcccagtcacagatgtagagaaagacagataagtcaggctaatataattgaaaaggagaactttgaaggaagtggcaactatcaaatgccaactcttctagagatttcttacatttttgagatacagaaatttatatattgcacttatctattctggggtttttaatcaagagtgtatcccaaccttgaaggttttttgtttttttgtggggtttttttttggctattattgttgttagagacaagagtctcactatgttgctcaagctggattcaaactcttaggctcaagctgggactacaggaatacaccactgtgcccagcttcaagaaaacatttttaaacacgttcaggccttaataggtctattacatcaaaatcttcaggggaaagcctacaattgtagatttttaacaaaatgtcctcaggtcactgtaatgcacaattctgagaatcagtgcagcagacaatcacttcagtctcacctctcacccacatggctaattcctttatcagttggagatgtggccaaaaagagaaaagagtaagagatagtgtcatttattaaaactccagttaagtttcctggctacgggtagaacagggacaagtaaactcaaaatcccacttgattttgctatttacaagctccttatctcccaccttcccactaagacattctagatttgagaggaggctttaggttcttatctaagtggctgtttctgccaggatgagcaataagtcagttaataatttgttccaccttctgctgaagtgtttctcacttcgtcaccacatattcactgccaatctggtttcctcagagtcctcctaaaattcatctctaggcaagttgcaattcattctttttcaaaccaaaaattattagacccaaagctaaacagcaccttgtctcaacacataaaacaaacttaaaaacaaaaaaaaacctcttcctggcattttccctcattatctaatatccaagtgacctgcatatttctgattgctctctttctcccctcccatttttccctcttaagccttgccactgaaagatgatacatcagtttttcagaaaattagcagcaacagcaacatgtccctttattgtaagttgctttagttttgtttgagttttaagataaagcctaattccggggaatattttctttcctgtgttgttttacactaattaagaaaaaaaaaaaaaaaagaataagcctgtgtagaaaaaaagttgaaaaggttttacctttaacaaattcacaaatattttccaaagtgcattttataaagctgtgccctttaatgcttctttaaaaatatcaatatttaaaataaaatcttagacaattaagttatttcaaaataacttaatttgtatttgcattcagggaatggttgagcttccaaatataaaaaattgacccttacctatgtcaatgttaaaacaaatattttggaaagaaagttgattgacctataccttgtccagtgcttcaatatgtgcaccatgggaaagcagtttttctgccagtgaggtgctctcactatacacggcataatggagagcagtgttgccgtagatatccttaaggtttggattggcgccatgttccagcagaataacggcacaagcctcttcctggcaatggacagcctgtccgtgttagaccaagaaacagattgtaaattccaagaattcaaaatacacattccacaggtttcaccaactagttatatgtaaatgagatcaatttattttaattctatatatgtaaatcaaatccatgtcatgctaaaagagttggctctaatatacctgtatcaaaggcgttctgttttctttgtcacagacatcaatctggcattttctgttaaccaggagagtgaccacttgcacatggccactggcacaggccaagtgtagagcagttctatgagagtaagaggattttttaagaaactgtagtacaatatctcaaaacatacaatcattcatgtaatgtaaaaactgaatagcatgtttttcctctgccttcaaaacaaataaattttttgaagaaagtacaatacttactagctcttattgctcactgccttaatgaaaacagcagcctatttgagtagaaagagctcagtctttggattcggttcaactagggcttgagtcctactttaagccttgacacttaccaactattgcttagcctttctgtacctcaacttcctcattaataaagatgacaatagtagctatctcataggacaccatcgtgatgcttaaatgagaagctatgtaaagtatgtagaacagttcctacgacaactcaataattgtaagatttttgttttttgagacaaagtctcactcttttgcccaggctggagtgcaatggtgtaactatacctggaactcctgggtcaaatgatcctccatccccagcctcctgagtagctgggactacagatgagcaccagcatgcccagctatttatttaaaaatttttgtagagtaagaatctcactttgttgcccaggctggtctcaaactcctggcatcaagcaatcctctcaccccagcctcccaaagttctgggattacaggtgtgagccactgcacccagccagatattataattattactattactactacttaacaaaaccattttaattaggtagaatgatacaattatacctactttgcaagatgacttaacgagtaggtcacattttaacacctctgacattggaatgccacttataattcatgatttgttataactataattggtagcattttaaaaattatcttattgatatataaaatatcggggcatcacgcaatccatgagaccttacattaagtagaatatggtatactcagcaggtctagggcagttctaggcatgtaactgaaacttaaatacattttagttcttaaaggtactatggggaaagagcactgaaataacaataatgcattttttaaacaaattaattctttgattttcaaacaacttgaaaccaaaggaaactcatgattcaaatgaatacatatggctcattgtattcaatatttatacttagaaaatatatgcaaatacgactttccaatgattaatattagtatttaagactgataaactttcgaaagagcagttaaaggttatcttctactattttctaacttcagaaatgcttttgtttgaaaggtgggagataaagtttcaaggagattaagtcccaatattcctattttaaatctctcagcttgtgcaggcggggcaggtaaacatgaagtgtttaaggatggacgggtcctgagagatgatagaatatgtctgctacatagcaggtactcaggttatgcttgatccataaatggaatgaaagaatggataaatacagttggggagttcattatttttaaataaactcctataaagcaatatttttgcaatagtaattatttatatgtgttgttttatttttaaagaacacaattaaaatgaaatgattatgtttgcataaatggaatgagtatataagcaaaacatatgtacataataaaatatatagataataaaatctggaaacagataaaaacattccttttttacttctgaagaggctaaaagctcaaagaagataacaacacacacaataatgataaaaaatagaaagtgagaaattattttcatcagcgcaagattcatattcctctcttcccaaggattagtccattaataataaacttttactagaagttttgtactcactgcagcaatcacagataagaaaaaggaaaaaaactttacttaaaatacaaatgctcagaaattacaaattttatattttgtacatatttttgctaaaacaagaccatagtatgtttgtgtatgtataatttaactaattttttctccttgctagctataacaaaatacatctttgcacatcaacgtacttctgtatctactgccaccttcagtggtcacatattattccatcctatggatgcaactgaaatttatttataggatccattctatgggttctctttaaagtaagtactgtgaaaaataaagtgcatgtatctttatttcctaagggtattttagtataatggaattggtgggtaaagggcatacacattttttaaatgtagtacttaccattttcaaatgagtactttgaaaagtaatcagcaacttcaagcagcagtataaaacatcctcacaaatattgtggatagaaaactgtttcattcctcttttagtttaaattcttataccagaaatgcgaaggattttttcctatgtatataagtaacttgtagatctggaaaaaggtactttgcccacttttagagtgtttgatgatttgatttgaaagaatttcctgtaaaatgaagaggtacttttcatctaatgtgtatatataactgatatatataacatattatatgtgttatatatgtatacatatcagtaatatatatatatcttatgatatataataaacaacataggccaggcgcggtggctcacacctgtaatcctagcgctttgggaggcggaggcgggcagatgacttgaggtcaggagttcgagaccagcctggccaacgtggtgaaactaaatatacaaaaattagccaggcatgctggcacctgcctgcaatcccagctacttgggaggctgaggtaggaaaattgcttgaacccggcaggcagaggttgcagtgagccaagattgtgccattggacaccagcctgggcaaagaagcgagactccgactcaaaaaaaaaaaaaaagaatataatgaattccctataaaatgaaaacatacttttcatctgaaaaaatatatatatataatatagtaaatatttttcaagtaagctctcttatctgagaacttttcgcccactgaaacaactcacggttatttttgataggggaacaagtactctcattaggcacctcctataatgtatataaaccatgttttaaacgtgtacgttaaaaataacaacgctgtatatgcttaactttgtgagttaaatcactcaaattctccaactgctccagccagggaattatgagggatggaaaacagatgagagtccgtttggctccgccgctccgagggtgcccggcgccctgcacggccccgtcccagggtctgcggggaagccgggcctgggggccccctcccacccccggctgagcccccgctacctgtgctgcttgtccagggcgtccaggtctccgctcctgcgcgccaggcagcgctccacctccgcggcgtcgcctttgacagctgccctgtggatcttctgcagttcggagtcccggattcggtatccggaacccgtgtagacgtggtctatggagccctgggccgtctggcccctgcggctcccgaagccgaataacttcatattggtgacttcttctcagacccccaaccaccggctcttgagcgagggcagctccctgtcaccttttcaccacccccctccccgaccccggccgacccagccccaaatcccc

SEQ ID NO: 2267 - DNA, 43574 bp, Homo sapiens
attcaccttcttttaatcacatgtacacatttttatttattactgaattcagtgagggatgcagaatatgttctcttcctgccaaattggtattctcttacttacacaacagattcattccaacattcaatcatctcagaagctcaactcagcctcaaagttcctaacatattcaatcacctgttcaaatccttccaacagattcctatctcagaataaaagtaaaattccaatggcctttgaggccctaggtaaaaaggcctctacctccctctctgacttcaaagctcctacaactccctcctgtaattactccattcccactgtatgtgaagcctgccacccctcagtctgaaaatggagatgtagtgcctaactcgtaaatcacagacagctacaagtatctttgtactgaacaaaattatattccaatgacagtcattgagccttgcaataaaaattatgagctaattattaatataaatattcaaagtaaactataaataccagtgggaaaactaaaccaaatatagttttgctaagttttaccacatttatcctaaattatgattttataacaagtaggtgcctttaaaacattacatggtcataaaaacacgtaatttgacatattttcagatttgttaatatgaataataacaaagctataccaactaaaatacataaaaagctagttaaagcaaggtattacaagacacagcaatacacttcaattcatctggggaatctagaattaagtgtcgaagaaaatcacttaattaaattttaatttgaaaatactcacttcaggtgtaaacatttccatttataactacattatggtcttaacatgtggcaacataaagacattaaaattactatttcagcaatacagaactatctaccttaaaatatgactctgtgcctaataaaatttcataggtgacacaatgtcttttctcaaagtaaatcatctctcacctctatcttttatttcctagaaatgaggcatgtttctaagccgatatagtaaacacatttttcctttttttattaaaacagctttgttgaaatataatttacatactatagaatgtatctgttttaagttaaaagatttttagtacatttactgagttgtgcagccatctctacaatccaactttagagcatttccatcactgtaagattcctcatgcccattagcagtcactaccagcttccagccccagccccttgcaaacatgaatctactttttgtccctatacatttatcttttctggatgcttcatgtaaatggaattatacagtatggtaaacacacttttaatctagatttttatattcaactaagttcaacatgtatccagaaccaaatgtttaaattgtctttctagaagtttgaaaatatttatcttccttgatacttactactccttctgttttctctctctcatactgaaagagactttcttttaaatgatcacattcattcattagcttcttacttttctcttctagcacgaggtctttctttccactctcaataaagcctctttggatattagttactatctctttatgatcctctttctgatgaacgtcatctagttgctgtacaagccacgcattttcacgttggaggtgacatatcctctcttctacacagttccactttccagtggaattattcactttagcttctgcattttgatacatctctttcatttcctgtgtttgctgctgtgtttggcttaggtcgttttgtacagtttctaaagccaatgacttttttctgagactatctcttgtcttacggaacttatcttttaaggcattgaatttaatttgtgtttcagaaagttgttcagtaagaaactcattctcatcttttactttggaaatagcagaactcatttctacttgtacagaaacatctcgtgttctctctaaagcaagttttaggtttctttctgttttcacactttcactgtgtttgcttatagcagcagccagtctagactgataagattcaatgtcagcttccagtcttttcttgctttctttttccttcaacagttcggcattgagccttgtattctcagccttgagataattaagctcttgttgataccggaatgctgtttctgttatcatttcctcattgagttttatatacttttcaagggcagcatttgtttctttaacaattttaatgtccttaagatatttattttctttttccaagttgtcatttttcattgtacatatttcctgtctgagtatagcaatatctgccttcaaaatgcaattttcatccatcagacctttcatttcttcatgattatgaaaatcctaaataaaacaaaagaaagttttagctagtactcaataaaataacatatcatgattacctctgaagttaaagaataacctgcacatccgtaccactaaaaagtttaccataagtggatatccacctggagaaaaagttgaagcaaaactttgaaccttatagagcataaattccagaaagttcagaaatgtatttagagtcaatgaatttataaaagtaaacacacacacacacacaccagagaatttttaagaatatcagaattggaaaagcctttccctgaattacaacaaactcaaaagcataaattaaagcattaacaaatttgactaaattaagatatatcaaaaaattgcatttacactttgatacctaacccatacaccaccctatagtaagaacttttgttcacacatatttggacagataaaatttcccagagttattacagttctgtttcactgataacattctatttcagtttgactcttttaacacttttatagtcagttataagaattacattcactaaatcataaactagacattatactagtcactcctatatacattcattgatgaactcatctagttaccataattttgaaaaagaaatgttaaaaatataagcaagctacaggattttccccaggacttctgactctacttctagttctccaacagatcacagttacttctgtggtgtaaatacatcaatacgaaagaaaacttttatttcaaaatgccaatagtaaataagataaaatttatagagctcttcttagaatatcatgagattatttgcgattgcaataatttctgcttcctctttataatattaggtgcagtaatcaatatgaaataggggaaagtacaaggaaaaattttacctggaacaaaatttttatcaataggttatcactaagtataaattatggcatattattgttttcaaaagctctttgtaataaaataatatcctatgtggatgccaagatttataataaatattaataattgtacctgtaagtgtcatcattcatttttaaaaatgagataacatttatggttttagacctaaacaatatatattaaatcaagtggatattataagtaacagtgataagataaagtttaaaatatagaatttttaccaaagattgatttacccgatttggagtatttcttgcagtctttgatttcatctctagtgactgaacagttggttcaagttgttttgcttcaacttctttcttatattgtttctctttcctttctaattcttctctattttttttgtacagcatattaacatttgttttttcttcattttcttgttttaaggtgcatctgcagataaagacatttgtcttaaaattcattttgttaaaaaataaggagttcatcctgttatctacctctgcagatgttgtttattatcctaataaaatttctatgttctggattatttttcctttgcagttctcagatatttaatttctcacttcaacatcttcaaatgaatgcatatacttgaaaagtagtaaggaaagaatattctgctaaagtttttgttactagtcactctaatatatattataaaaaaggataccagagataattcagtaaagttacaggttcaaaattacctttttaaatcacacagtcataattactccctaattagaaaagatcatttacaatcaactaaatttttaaagttactatttattgacaagcgtataagttcactagaaataaattttcatctttatgaaatattgcaggtgtttctccaaatgatttacagagtgagatgacaccttcagatgtctctcacacaaactatatctgcagatgactgtcatccaaaactaggctgaaaagtctaacatctgtttccccacactttttatatttctttcttaatactttcaattcaccttcttattacatatattttatatattcattaacctattgttcattatgtgtaatatataattaatgcatgttaattatatattaataagtgtgtgtatgtttacaccagttatgttttcctgtgaaatctagtcccagaagtggagttgttgagttaaagggatgtcaggctatttgaaattttgatacacagcactaagttacccttcagaaataatttactaatttcctataccaacagtgtatgagaatgcctttttcctcacatttgccaacactaataattactttttaaatatcagcatgactttacaaaatatatcttattttatgttaatttgcttttttctgaataccaggcagggctaaatacccctggtaaaaatataaaacttgttaatcataaggaatattagtccaattttcaattagtttatagcacaatgacaattatctcctgtgaaatactgctataggcggccaggcacggtggctcgctcctgtaaacccagcactttgggaggccgaggtgggcagaacacgtgaagtcaggagttcgagacgagcttggctaacatggtgaaatcctatttttactaaaaatacaaaaaattagccgggcatggtggcacatgcctgtaatcccagctactagggagactgagtcagaagaatcgcttgaacccaggaggcagaggctgcagtgagctgagatcacaccattgaactccagcttgggcagcaagagagaaactccatctcaaaaaaacaaaaacaaacaaaaaaaacccaaaaccaaacaaacaaacaaaaaaacactgctataggcttacctatcatgctcttccttcagcttcttgggaaattgctgaggatacgttttcccaatctttctttgttgggttaatctgccagcagcagcagaagatgtactatcacatatattttctgaaagttgtattttttcacttttgtttgtattatttccttctttgacctttaataaaagatgaataataattgttattattttattcaataaaaagaactttttccctgatttttattacttgattcaggttaactatcaccactttaatgataaaagtattttgtgcttactttaattttatcattatacataattattataattataagatactcttattttatcatcgaaatttttgtcaaatctgctcatttctgtttgagggaatagaagaattttccaaaatttcaaaaagggctcttctccattttgtgcttttattcccatccactctttgctatctggtataaatttttatgctatctggctggcagaaacagagaaataaaaagacacaggcataatatatgtcttctgtctttactacctggattttacatgaaatagccagattaagaagatgtgaccttgtaggccttcaggaacagtaaagaagttttcccttttctgtactgagctactcttttccccactgccttttatctctcttttttttttttttgaatcctgtgatatcaaaaaagtaaaggttctctttgaattatgggaaccaacgtttgccacaacaaaagaagcagagtgaaactgctgagtttctagtgcagaattctggaaaatgagatgcttcccagatttcacattcaattaccacaaaagtttataggtggaaaacatatggtacagttacctactttaaccccattatctactgataatgggagtcaaaccaaccaagacatattaaatgtttcatccagagctcttgaggtggcattcactagcatttcatggcaccatataacatgatacaattccatattgctgaattacataaattaccagataaatttatcaaattagatatattaaaagtctaacttgagcaaagcaatttaatgcctcagagggtggaaaaaggcctcatctgcttttactttgaaagaagaaaatctctagatttttgtctatctttagaacacaatgtacagaactcaactttctactaaagagtcaaaggctaaatttttggctaagaaattatgcttcttatatgataaaaatcatacatgccaaaacttaccatactttattaaacaacataacgtaaggtctgattcaacagaaatattgcagagtggtgattttttaaaatatgtgtaagtatatgtttgttttcaaaaatattggaaataaccatgatgggactgtaagttcaaacagtttgagctaagcagataaacttgcatgcatgaaaacacattaaacagactcatttggctgggaatattcgttgcaactctcaaggctagacgtgtttttgtggcttgtctcagtcattgcttccctcccattgtattcccattctatcattaaataaatgtaaattatctctaaatgaatacaagaaaaaagaatctagaatctagagcttgtttctttagcaatttctttatgttgatctggttcagaaggtcacatggtatgtggcttaattagtttcccagctcatacgccacttggaagactgatagtgagacataggttgattaatgaacaaacattatgagaacattctccagaaccattatttagatagcagaactaatctactttgacacataattacacatttagataaccccactgtaactgtacacatgagattttcttgaatagaaaatttgactaaatcaaataattgataaagaggaaaaagaagcagcaagtgaacctctgtctttttgaagttggacttgcttttctccaaagccaggaactcaacttgtaacatgcctacctcattctttttttaattattattatactttaagttctggtacatgtgcacaacatgcaggtttgttacatatctattcatgtgccatgttggtgaccttggaatatcttcccataagtcttctagctatatttttgatgttctctcactatgtggtaaagaataactcacattttataattcaagattcatgcttctgtagttgttagcactgggattgccatatagtggctgctggaataaacgctgtattggttttctgtttttataagtatctgtagcagcagaaatactgtggctttctatctgaatcatatgcttcatttctttggggtgggtaaacaacaaatcaaaaagactttctggatctctagactgaggccaatgcctaatgtccaatttccaattagtggtatctgggtttacattttttgccatttgcatgtcaaactcttaatcatctttcatttcaatcataattactgggttccttaattttttggtttcagtatcattacaaaaattttcatcatctgtgttagaaacaagctatgtgtctggtttgctatcatttttatagtctgatttattttcatttaaatgaagcttagaagatgactggtaactgtatttcagggacctggagtatgaatggaataaaaagacatttgacatgggcttcctctgttcaggcgctgcctggaatgccacagagttagaccctccagatgcatcttcctcctcacaatcagggacctgattcatcagattagagggcactccttttttgttcgtccctctttagagttactatgtaggagctcttcctcagggcaagcagtaattctggagttttcaaaactttcaccaatattcagcttgaacttgtttgtaatgaattttaaagaaagtcgtgaatatacagacagattattccctttatcacaattcttacccagttctggttcttgagacttttttttttttttggcaggtgcaaaatggaaaacaaatttgcttgttttgtttctcagatgccttttctgtcagagtgcatgttttaaaattagctttaatcaagtataaacaaaaatactagaaaataattaaaatttaactgtgaaacttaatctatgtgttgccactcttaaattatgggattgtaactaaaaagtgaaaaataatttgccttggcttaacataggacagaaatatgaactggcaagctgaacgcttagcatttgtttggattaaacttaatgcattatgtgtaaaatctaccagaaatgaattcaaagctgataggtagtattataaaatcttcctctcttacaaagattttacctcagcataccagaaaaagtgagcccctacagtacgtgtatatttctgaagattaactacagactaggcaaacactgaattattaagagccaaactgaacaccaataagaaagggaagcaaaattttaaattctaattcaaataatatactatgatagtgttatgtatctagatggattatctgcttatatccacttctaatatattttaagttccactagtgatagtggatggattttttaaattttagtaacatttactatgtatttatgtcaaaataaagttattgtttgtaccctgacaccaaaggtcccattccacaaggtaggattctcttaataggcaactgggttgacttttatgaccccactcactccctgaacacagacacagaagtcaaatggtgaccacaaaacagaataaatctttaacctcggcactggtgaccagcaatataaaactgcaacatttgaaccattggcaatgatgactcctttaacactagtttaactcagtggccatcattgttaaattgttcacaatttctattccttaataatatgacccaatatttcatgttaccttctgtattatgagtaaggttataacaataaaagagcaagataattctgaaaatgtcttgcctcaattccaagggtaaagacagctatgagttactagagatagtaagaattaccagaataactaatagttactagagatagtaagaatatcttaagtttcataactggttaagatgttttaaaaattaaatataaaattatgatctatcggattctaaaggtatagtctaaaaggtcatgtcatttggactatgctttgttactgaagcaaaaaaacaaaacccaatattaaacaagaaacttgaattttcatatacctgtggttgcttcttttcacttctttcatgcctttcttgctcttcctctgaagccactggtaaggcttgttctgttgacaaattcattggtttagttcaaatgaactaagaacagttagataaagactataatctatataaaaataaatagagaataacatttctttgtattttatattttgagagtttcaatgaagcttaatgtttactgaaatatttagttctttaagaaatacttctaatcatccaaaatttcaacaaaccacttggggagacattagatatcaccaggttcaagccatatgaaatctcagggtcactcacaaattgttccacccaacataaatcaacaaaactgttagaaacaaaacaaaattttgaaatacagtcaaaatatacaatgtaacactttactatacttcataacagtatctttttaacaagacactaattgagttggcagttactaataatttgcaaaattattgttgtttataccttaattagtgtgcaccccattttttacatcgcaaatgttttcccctactattctgaaaaatttattttcatcttttaagactcagaaagtaggctgggcataatagctcacatctgtaatcccagcactttggaaggccaaaatgggggaactgctcaaggccaggagtttaagaccagcctgggaaccatagataaccttgactctacaaaaaattggacaggtatggtgatatgtgcttgtagtcccagctactcaagaagcttaggtgagaagatccctcgagcccaggagtttgaggttgcagtgagtctcgatcacaccattgcactccaccctgggtaatagagtaagaacttgtctccaacaacagaaaaagaaaaaaaaaggctcagaatgctgtgtgaagtcttccttgattctagctgtctttctccacacacacaggtgtctgcttcattggagttccttagtactttgtcaacttttccagcgtcactttaccacctgaactgcacatcatgtctttacatgttgatcccctttgctgttagactgtagaggacaatcttttgaatcatctttgtataaacagtcttaattttgctaaataattacttattgagttcctgctaagtgttaggcactggggtataaggaaggaaaataaaagctgtcagggatggctttcctaaagatcatgcatgagctgagacttagagagtaaggttagccagattaagtgaggcagagggcaggaaagggtgagcacatgccaggcagcaacaagagagggagagaagcctccaagagagtatgtatttctctgcaaaagaggaatggtgagggggccattaccagcagctcagtaattccagagaaaaaggcagatggggaaagggctacagatggagatttgggcagaaatcagtttccttttcttttctttttttgggacaaggtcttactctgtctcccagactggagtgcagtggcatgatcttggctcactgcaacccggcctcccaggttcaagtaattctcctgcctcagcctcccaagtagctgagattacaggcatgtgccattaccacctgctaatttttgtattctattagagatggggtttcaccttgttggccaggctggtcttgaactcctgacctcaaatgatccacctgcctcagcgtcccaaagtgctgggattatagacacgagccaccatgcccaacccagaaatcagtttctgaaatccttatataaaactttaagatgcttggacataggtattcaggagtggttcacagatctatttgcattagagataattaactctaattattgtgaggagcataaaattctgaggcatataaatcaatgaacaaagataaaatataaggcagtgttgcaaagatgatgcaggcctgaggagatgttttcagaaatatttaggacataagtatcagtggccattgtaagcatgaatttttattgaatgaataaatgtatatatctgggtccctggagaaatacactctgctcattactttacaaattttatcaaatgagaagtagaataatatacataaactgtttcagttacttgtatttactttacactttttctgtttcagttttactgtgccaaggaaatgcatttgggttttgtggtggttgttgctgttgctgttgttgttgttgttgttgttgttgttgttgttgagatggagtttcactcttgctgcccaggctgaagtgcagtggtgcaatctcagctcaccgcaactgctgcctcccaggttcaagtgattctcctgcctcagcctcccgagtagctggaattacaggtatgtgccaccatgcccagctaattttgtgtttttagtagagatgtgtttctccatgttggtcaggctggtctcaaactcccaacctcaggttatctgcccgcctcagcctcccaaagtgctgggattacaggcacgagccaccgcgcccagccacatatggggattttgttttaaaagttctgtttcctggatctaccaagctcatgagaaaatagaagcaaacaagtcatttgcataggtaagaaactttggatttatactttgtcatcactactctagaagattatcatcatgttttgtaaaataaaatgttaattctagacataaggggaaagagaaattaaaactataggggtgaaaaaatattgcataatttattactgttgacctgaccatatgactgattaagggcactgaatttaacttgtatgtgaagtagaccccatattagctgcagttaatcaatagaccaggtattctagcagaattaaatttgatgctcctgtgttatctttaaatgatacagctcttctgaaaacccatactcatagtgcatgattatccattaagacaaggtgatggaatgtgtgaatacagctcaggagacaccacaaggcaaatgctcaatggttcccattaatattggggaaatcaacattataatacagaaaaccataggcattatttaatatttggttttggaaggtatttttagtgacactgcatagagttgtacctaataattgcaaaattacagatgtaaaaataaaacaaaggcacattgtgtttgagtaggaaatctgtagacgtctagctggttttctattccaggcccaaaattctaaatataatcatggtacccgcacacaaatttatgttaaataccaacttcaatgaaattactctttctcctcattctctttgttatttatatgttgctttccttaagggaagaatacaaatgccttgctaagaagcattttgtttggttgtaggctgcataaagggagtaaacacaaagtacatttgaccacagaatgactttttaaaagccagaactatggtagcatgaagccaactgaggtaatctagaataaaattttctatgtttgtttcccttctttgctctctttctactctaataactgcgattcacagaggtaatgaagagtataattccctgataaaaacacagctccaagattaatcctttctttaactatgaagttcgtgtgtccaaagtcttgtagttgctgatttttgatcacgaatggtgatacagatatttatcatcaactcacaacttcccaaatctttgaaaagtcttactattgatggttcaactagtagaaacataatctaaaatatctgaaaataaagtttttattagaatgtaaatagtaatacaaattgtaataaggtgtaaaagttctttcttcactgaagcaggaccatgatgtcctctaccccacaaacacactactccctcatggtctaatgtatcttaaaagtcctgtaattgctattaactcagacaagtttacttaacttgttctaagcttctgttatttactacaatttactttatcactcaacaatctctattatatatgttgttttccatgagaaatttttttattaataattaggattcttcagggataagaaaatatttgaataactaagtttgtgcataaacacattaaggtcaaatacccatgacaatattgtgtgtttctctgtactagagacaaaaacttcaaaaaaatttttaatgaatatacattaaaaactgctttcattaaactgagatgatcttccctcaatgcatgaataccttcagaattcacatagaccaaagaattgtataaaatataatagccttaaaaatcttatttgtacctggcacagtggctcctgcctgtaatcccagcatactggcaagctgaggcaggcagatcacctgagatcaggagtttgagagcagcctggccaacatggtgaaaccccatctctactaaaaatagagaatttagcagggtatggtagcacatgcaggtagtatcagctactcgagggcctgaggcaggagaattgcttgaacccgagaggcagaggtggtaatgagtcaagaccgagccactgcactgcagccttggtgacagagcaagactctgtctcaaaaacacaaacaaacaaacaaaacacctaattgttcccacataagtctatattcacacaagatctgaagagtacacaacaccgtgagacaggacagacataaattttaaaagttatattcccagtttctgtaaaaataaaacggttgaatttaagcttttaagacaagtcaaggaaaagagcaaaaaatgcaaaagtgaaacttgaaaggtcattttcccatcaagggctcatgatccactggacattcacaaactatattgttcaaaacattagttctgaattttgatctgagtatccctggagttgcagtttcattcaaagatgtccaagaggtcaaataagacaatatcatttgctattttcagttttcttttctgagaacagcacaacaaacttcttcagagaaatgaattgtcctaacttcataggctaaaggctcatgagtcacagttctaagggcatttataaaatatggtggtgcatgcttgtattctgaacttttcaactttaaactctcatatagtaaatattaatagatacaaactgattaaagaaaagcccacttaatctgacattatttttatttttctttctttcttcatttatcagcaacaggagagtctaactaaatgtggtaaagtggtataagggaatacaatgaaaagtgtaaaatgaattaaaccagagataatcatatcaatgtggatacatctggaaaatataatacaaaatacaccaaagaaagtggcagaaaggtatgtaaagtgtataaccactcacataccattttgggacacaaataaaaaattctgcatattatttctgagcatcacaatatagttaaagatttcaaaagggcattgaaatgaaaaacaaccaacttatgatgtcggtagcctctatgcaatcatgttttaaaaaccttaacaccaaaaagtctcaaaatcaccattttaaaagactgtgtctaccagttataaatgaatcattactttcctcatttttaatagtcaaagatgccacaaacacacacatacacacagctatatatacacctacacacacagtcttgctcattagaacatctgattggcttcagatcatcagtgtaataacactagcagcaagcctctaaagttaaaacagaatctgacatgttaataagtaaagctttcctctaggtaaagttcagaactccaagtagcacttaactcattggaaatatcttagagtctcaaaattcactgctttgaatccctgacaggtataaaaattttatactgaaaacttcatgctattcaaaacattaaaagagaaacatctgagttaaagcttacatttttaaaatcttttttatgcttctaaatttatttttattcaaatatggataccaacaataacatttatgtcaatgccttccattcaattttgaacaaatagaattaggaataagaataatgtgagtacttccaatcattgaatgtacttatttccagtattccattaaatgtacctgctctcaatgtctgtacattctttctttgtactgctcctttcacagcaggatcttctacttcagtgctaggctgaatgggttttaaaagaaaatgattcataaatcatatatattttatacaacatggagttagtgattcaaaaatatacataattaattaccttcaaggaaggatgttttgcaggaggccctacaaagcaaaggggatatgtcatcaattatatgtaagtatgacagggccaaccaaacattcatgcagtggtactatcgagctgaattctcatgcctggctataaaaataattacttaaggttttgagggttcttcttggcatcttttcattgcctaggacggcaacatgacagaaacataatgaggaaaataggaatataggattcctaaaatgcacagtttacatttcagtagtgagattatgtttcaaatgcctatacctaaaatagaaaagcatggatatcaccgtgaacatgtggactgatgaggagaaaagggaccattaaacagaggagcaaatcaaacctgagggaatcgacgtcaaagctgatggtgaatgtacagagtattttaactcaacacagcagaggcattgctgccagcatgccacaaacaaattccccttgtcttgtcactgaggaaatacacagttgggatgacagttcaggtgaatgtgtgattcacctctcatcaaagaaagtgttctacattgatcagctagtatacacacttatgaaatgacagctaatcaaactactcatttttcccatgatcacatgggctactgcagcacctacatttctcctatcccctcatttggccttgagttagagctccttgatccactcatgcaaggatcacataaaataaaccatgtcgaataagcttccgatatcaaaatatttatcaaaaaagaaaacactgaattaccacagacttgctggatatgaatacatatttatatttcaaaatcagtgcagtatttattgaaaaagagaattttggtattcacagaatgaattttgtaatatcaaaaaaaattagccaaagcatctatatgcaacttaatcacatcttattcactcatgtcagtgaaacttctctctctgaggcctgacagttatcaagtgaaatgagctgctgtggtttaccccaactctagcactccctcctgcctccagtactctccacagcaataacctcttttgtgagactgggcatatgctgaagcaactggaagtgagttgtctcaagtttacttggcttcaactcccaagaccccagcaaatgtctttctttcctccctccgtgtcctttcacaatccctcttcctttgaaaaagtgatttttagaactgtcatcctgatgcttcccttcctaactgctttttatggataattgtgaccacttttttcatctgtattcagcagtagtatacacctgtaatctctctgttttcatctcattctccttcccctgtggctagaatcatgctcagaaataaaaggaaattaatgctttccctggattctgttattttttaaattgctctccaatggttctttttccagagttctctaaaggaaggctattcccttgctattcagagctgtgtccaaggaccagcaccaaaaatcacctgagtactcatgagaaatgcagactcccatacctgctgaatcagaatgtgcaccttccagaagctcttcaactcattcatgacaatttgaatgccctgttctacactgatgtgcttccatattggtttcccctaattgcccttttggcctagcctcaatttcttccctattatgtccctcaatttaatactacattataagccataatgtttctaatgaacttttaatcaggcaataacttcttgaattaatttcttctccataaatcacccaacactattcaattatgttaatttggcctatatgatactatcctatgaggttacaacattttctataaaaacaaattatagccatacatggctgaccatctttggtgatgttcatctatggtagataaaacacaggtctgtgtggtgaggtgcctcaatccttaatgcctccccagtagcgaggatgacagcaagagaaggaaaatgttactgtaattctctgacacattttggtactggaagctcactttatcttctttcctgtttctaacaccatgttcttccttcttctacagatcaatttgcctttactatcctctcttacttacctctgcatatgcttttttatttattccatgtacaatccgctctcctcattctttctttctctttattcatttcctcttccctctctcctgacttgcctcaggtcttagagtatcttaaaatggaactcacaattcagctcctttagtggtactcccaatagaatcaactgctgacccttggttagagacacaacttatcaccatttcacttctcctttacttattatacagttaataggacactttctttagctattacactctattagtgctcatattttcaaagaaacattccatcaaatgactttttttgttttgttttttctgagacggagtctcgctctgtcgcccagggtggaatgcagtggtggtatctccgctcactgcaagctccgcctcccgggttcaagccattctcctgcctcagcctcctgagtagctgggactacaggcgcccacaacaccacctggctagttttttgtatttttagtagagatggggtttcaccatgttatccaggatggtctggatctcctgacctcgtgatccgcccgcctcggcctcccaaagtgctgggattacaggcgtgagccaccgcacccggcctccatcaaaagactttttaaataaaatacggttctcaccttctccttgtccattgactattctgtttcctttttcatgcgaagatccaggtaaaggctctgacactttctcggggacacactgctaaggtaatatcaagaattagtttccattttaaaattataatgagttgcatcaagagtttcttatcaatctctttttatgaaactgggtctcactctgtcaacccagggctagaatgcaggggcctgattatggctcactgttgtctcaaactcctgacctcaagcaatcttcccacctcaacttcctgaatagctggaactacaggtgtgtcccttcatgccatgctaatgtttttattgttatctttgcagagacaaggcctcattatactgcccaggctggtctcaaactcctgagctcaagtaaatcttccacttctgccccccaaagtgttgagataagcagtgtgcaccaccacacccagccctaatcaatttctttaaatcaatctcaatgttgcccaggcatggtggctcacacctgtaatctcagccctttgcaaggccaaggtgggtggattgcttgagttcaggagtttgagaccagcctgggcaacataatgagaacacatctctactcaaaaaataccaaaaggagtcaggcatgatggtgtgcgcctgtagtcccagctgcttgggaagctgatgtgggaggatcacttgagcctgagaggtggatactgcagtgagccaagatcatgccactacactgcagcatgggcaacagagcaagaccctgactccccaaaaatttcaatttaaaatatgagaatgaagagagatacaaacaaaaaacaagcctaattggtcaatgaaatatgagcttaagccaagaaagaaaagagacaacatgaagtacaataaagtacatggggaaatagatctataacagagccttttgctctttcatatccctgataatactaattaatatttatgctacaattagttttttgtaagtacttctgtgatatagcttattactataagacattcaattagctaaatatggtcatcgaccactacctgaaagaacattattataacacagagagaaaactagaactttcaatcaactttccacccagaaaaaaattggtcaccagaattctaaagagtaacgtatggcagacacatgaaaaaatgctcatcatcactggccatcagagaaatgcaaatcaaaaccacaatgagataccatctcacaccagttacaatgacgatcattaaaaagtcaggaacccacaggtgctggagaggatgtggagaaataggagtacttttacactgttggtgggactgtaaactagttcatcctttgaggaagacagtatggtgattcctcaaggatctagaactagaaataccatttgacccagccatcccattactgggtatatacccaaaggattataagtcatgctgctataaagacacatgcacacgtatgtttattgcggcactatttacaatagcaaagacttggaaccaacccaaatgtccatcaatgatagactggattaagacaatgtggcacatatacaccatggaatactatgcagccataaaaaaggatgagttcatgtcctttgtagggacatggatgaagctggaaaccatcattctgagcaaactatcgcaaggacaaaaaaccaaacactgcatgttctcactcataggtggaaattgaacaatgagaacacttggacacaggatggggaacatcacacactggggcctgtcgtggggcggacaaggggggagggatagcattaggagatatacctaatgtaaatgatgagttaatgggtgcagcacaccaacatggcacgtgtatacacatgtaacaaacccacacattgtgcacatgtaccctagaacttacagtataagaataataaagagtaatgtatggcttgaaaacgtatatttaatagaacatgagttagagctaataaaaagcttaagaaatgttaatctaaaatctcaatgttaagattccagttgaatgatactagaaaatatattgtaaccctatttgctactgatgacctatttctattttatttcctttttaattatggcataatttctcaacataacatatcaaaacttatacacccttaaatattaaaaaatacaatgtaagcaatattttaaatacaatatttaattattagatacattaggtttattatattacttataacattccattatataaaaattcatttgtctatttattcagattaaacaactattaaggctgaatgtcttatgcctgtaacccagcactttgagaggctgaggcaggcagaacacttgagcccaacagttaaagaccagcctgggcaacaaggcaaaaccctgtctctacaaaactcagctgagcatggtgacacaggtctatggtgacatagctctattgtttaaactacttggatggctgaggtgtgaggatcacctgagcccaggaaatggagattggagtgagccaagatctcaccagtgccctccagcctgggggacagagtgaaaccccatctcaaaaaacaacaactaaaatgcttcttacatggaagactgtattctaggtactccaggatacacacaaatatgtttactgacctccagtagcttacggtatgcaggagcttccaatgattatttaaacaactaaatagaaaaccttctgaaattcaaaatttcagaatatgatatgaggactttgagtggctattttattttttaagatgtagtcttgctctgtcacccaggctggagtgcaatggtgcgatcttggctcactgcaacctccgcctcccgggttcaagcgattctcccaccttggcctcctgagcagctggggttacaggcatgcaccatcacgcctggttaatttttctgcttttgttttgttttgttttgttttggttttggttttttttagagacagggtttcaccacgttggccaggctgatcttgaactcctgacctcaggtgatctaccgacctcggcctccaaaactgctgggattacaggtgagtctccacacctggtgaagtaaatattttaaataaactacaatgacaaaattatgaggataaagtcttaccatccattggtattaagagtctctgcttctagaactggttatttgcagcaaaatacatgttattcaattagatgaagtgccttatataaactcttcatggacaactcataaaccacacaaaaattcctttgcaatacacattttgagaacataaatttaaatttctatatttccacaatttatatttttaaatcagatacgatgttgcccaggctgttctcaaactcctgggttcaagcaatcttcctgcctcaaattcccaagtagcagggactacaggtgtacaccaccacactcagttatttttctacaatttttatttttttttgtctcactacagaaccaataatataagtagaaaaacaatctctcgtaaaaacaatatgataccaaaataataagtttccaagaacaaaagctatatgctatgtgctgaatattcttgccactaaaaatcaccaggaggatcccatgattactgcaaataatttgatccactgaagatttatacaggcataaatattaagaaagtcacactcgtatgatttaaaagtcaaagtattagtatttatccaaataaaccttaagcaaatttcatatttcctctattggagaaagcatttcctaatgtgattttcctgtcactactaattttccagttcattttttttcagctcccaccctgtcacagtacttatcaatctttgttagttaccaaagttaaacacattttttgaatcaactagccatatgtatgtttttctctgaccaactttccattaccaccataaaacaatgataggtaaaccactgctaaatttgaaaagtaaatactatgcaaaagtacattcagagtgagaaaattaattttacaagagaccactttaccttagtagcaacattcaagtctttgtcatccgatgcaggcaatgaatccacacgcagttcatggaaaatgcttgagagcaaaaacacacaacgaaaatgagcaagttgatttctttacaatttttttaactgccagtttatatccagcttccccctcaaaaaaggaaaccataatctagggaaaggtcagcaatctatatattaaatagtgattcttgatataattaaaatatgtcctcttctaaaaatagattttagttacctatttctgcctccacttgtctaaatctataaaatattcaatgaaaactaaccttgagctttataacaaatagtgacagtcaataaattggcagagcctgacaatgatttgccctcacaaattatctgtcctgaagctgaacttaaaattcaattaatggatgacataaattttgttacctaaactggaagaaaactaacaacctaaaacaaggtagaaagatccactgtctcttttccatgatctgtctctggataaaagactaatctgcatcacttcaatatggcagtcttgattcctcagcatggaacccacttaggaaggtcctattgctttcctttgccctaaatcagtacaggaaagcccctacaatatttgaaatgtatgaaagctaaatgtacagaagtcaaataacaaaggtgtatgttcttattgagaatacttttcccagaaagattgaaatattaacaattataaaatcccattattttcaccctataggtcctaccttattcaggtccacataaactagcaagcccttaaaacttttcataggcactcagacacccaaggagagagactgtcagaaaaaaacagagtcctggtaggtgtacctctatttccctaagtactctctaagtatctgtcttcctatgggctcccacttccagattccacttctgcagggctccacagaagtctccaatctttaaatcttcagtctatgaaagcacagattcctgaaaggatggcctcaaatgaccaggactaggagctctctatatccctgctcctgaaaaacaagctaactggagtctccatcacctgcccccagctagacacactaccaactacccaactgaactccatgactgatttgccagccaatcatgcccctgaaccagcccacatggacatgggaaggacatcagtgaatcgggaaaagaggcagaggtgaggagacacctgtactgggccacagatctatgtagttcagcaatctccagccccttagtactccaggggctctaagccacccctttctaagtcaggatggaagtagatgacaccacatttctatctgctgcagacgctcctcccagtgtctcaaaatgttttagcatctttcagtaaaaatcttcaagtttgtcagtccttgatttaaaaaaaagcagcaaactttttagagctcccttgaaccttctattttaatgtgccttcgtagataattcccaacatcttgtgtccttcatttttataatttatctttatcaaacttgtcataaaccccaatattttgatctcttatagaagagtctgtactcctatccaatccagtgttgtttatcttcaaacttggacttcccctgctcattccattcttatctacttccattgggttccccagctaattccattctcattctacccacagactcactcccgtttgtattattaaaacacacgccaataggatataaaaagaagcaagagtactgggctttaacatgagttcaaatctcatttctgccaattcctatgtctaaaaaaaagcatcctaaactctttgagcctcacattctctatctagagaatcatttgaccagaatgttcaacacaggtaaaaatactagaaggtattttaattcattccaagattccttaaaattctgtaattctatgtcctcttgattctgtctatagaaaaacttagaatacatagccagcagagtttgaaaaaataatagaacaaaagaaataccaagaaaagcagagaagaaagttttaaaaaatgaaggcaagattatagaaaagtcacggaaaaagcaacaagactaaaaaatgtattatggaagtaagcagaaatacttgcctaaatggaaaaccaaactgggaagtcaaataatttgtctctaagacttgcctaaacttgcttttgtaaaacttacacccctatggcaaagctaagtaagatctgccctagagcctttgatggtaaaaataagatactggttaccactgaaattgtcaaatttattaggacaaactcttggactaaccacattctaatgataaacttaaatgagagttcaaggtatttaaactctcattaatttagacattaatcaaattaatcaatctgactaatctgattcagacctataccttgatccaagggctgcacagatatctgtcaatctatgctgaggagcaagagacaggatttggaaggcaggcaggctgatggtcaaactgtaggccagctactttgttaactatgggatcatgaggcaattaatcagctctaatccatagttgtttatttaataaacagtaggttataggaacacagatgttgtgatggctttatgagatgataaacgcatagaacatattaggatgtctagcccagaatacaacactcaacagatattcgtttcttccatctatattttcttagttaacataattttttaaatctataaaatcctacctgactgcagattcatcagaacttccaacatctattaaagaaaaaggtaaaatgcattttaaatcaataacaaatgtacagaatattaaaagcataagaatgcacagtgatgcatccctctaatccaaactacttgggaggctgaggcaggaggatcacttgaggagcccagaagtttgagaccagcttgggaaacatagtaagactctaccttcataaaaaaattgtgcacacttgtatgtatgctttagatcctgttttttgttgttgttgtttttgttttgttttggtttggttttttaaagcataagactgatgctttgttacaaagcattcctttgagagcatgcctgggaccttattagaattaacattcgttatacatattggtaggtaattaatgcagtaagaactcttccctttgtatttattagatgcaaagaagaataaatttattaaaatttggtatctacaagtgaactgcagtatgcaagtcatcttagccaaaccctatgaggttgagtaaaaatggtattgttagcagaacaggtgtgatgagtcaccagtgtcaaagagcatgatttctggaccaaaatatgaggcgccattaaaacagagtacacagtagtaccccttatccactatacgtgcagaaagacatacttgacacatttttctctactgtcacaccacagcaacaatcatcaacaaagaaggcttctgtgaccaaatgtgtggagggtttttccccaccaacaagcaagcaatcattcctgctgatgacacaattcaattctcacaccttatctgctggtaacatcagattcaatttaatttataaattaaactttagcatagatatgtatgtatagggaaaaacagtttgtgattcagtactattcatggtttcatgcatccacttgggggtcttggaatgtatctcccacagttaagggggagctactgcacttattttgttataacacaacacagcctctctagctcttcagttcaaactgctcagtttagaataaaacaccctaacaccagatgtcagcaaaacataggaatccgaccagaaacaggaatccttgcaaagactttccagccgctagtggaaaagagctcaaaagagatcaatgtattactctggctactactctttggggaaggtgctgggtggtttacttagttgtagctatttgctctgccctacatatagcaaggcccaaattcacctgccattttacctcccacagaaaaaccactggaaagatcactcctttaagagcttatacgctaggaaccacacctcacattcagagagaagctgaagaaacaccagggaggtgtggcaggctgctggacagtactatatgatgtgaaaaatatatagaaagaaaaccatcaatgcccttttactaccagaatgttccagtgcttgcccttctccctagtaggggaaaaaaattctttttcacctcacagaaagcaaaactctcttgctatccctcatgacagaatctagttgtaggtgagtcacatcatcataatacaggctgttgtcaacctcatccctcaaaggaagaggatcagtgaggaacctatgtacttacctatagcattcactgtctggtcttatttccaaccgaaggtaagtatgaaagactttgtgattccagttttataaagtacaaccccttgcacttgtccccttccattgctagagaatctatctggacccacctcacagagcaagatgctccagtttgtgctgtgtggtacagcatggtgtccttttcctcaaccctttctattatgtgcacatatctatacaaatcatgttttctaagtatgtaaagcatatgtcatcagaatatatcattctttacaatgataaagaagcaaaagaaaaacaaaaggacaaagaacatcttaaatgactacattcaactgccatggagctttaattttttaactattcaaaaagatatccactgtattattccaactatgtgactcttctgaaaaaagtaaaactatgaagacagagtaaacatcaatggttgccacgagttactagggagaaagggaaagatgaacaggcatagcacagagaatttttagggctgtgaaactgttctgtcgataatattacagtaatagatacatgtcatgtcattatacacttgtccaaattcacagaacgtacagcatcaagagtgaagcctgatgtaaactatgaactttgaatgattataatgtgtcaatgtaagttcatcagttgtaacaaatgtaccactctctggtggaaaatagtaataatgggggaggctatgcatgtgtgggaggcatgggatatatgagaaatctctgtaccttcctctcaattttgctgtgaacctaaaactgctctaagaaataaggttattgatttaaaaaaagatattcagctgggctcagtggctcatgcctgtcatctcagcactttgggaggcaaagatgggtggatcacctgaggtcaggagttcaagaccggcctggccaacatggcaaaacctcgtctctaataaaaatacaaaaattagctgggcatggtggctggcacctgtaatttcagctactcaggaggctgaggcaggagaatcgcttgagcctagaaggtggaggttgcagttaactgagatcgcaccactgcactgcagcctgggagacagagtgagactccatctcaaaaaacaaaaagatattcactgtctatgcatcccaggatctccagaacaattacaataaataaataaataaataaataaataaataaatggctgggggcagtggctcatgcctgtaatcccagcactttgagaggccgaggtaggtggatcacctgaggtcaggagttcgagaccagcctgactaacatggtgaaaccccatctctactaaatacaaaaaattagccaggcatgattgtgcatgcctgtagttccaggtacctaggaggctgaggcaggagaatcatttgaaactgggaggtggaggttgcaatgagccaagattatgtcattgtactgcagcctgggcaacaagagcaaaactccgtctcaaaaaaataagtaaataaaataaaaaataaagatattcactgaacctgttactatgatatatttaagcaagacacggtgaccctaaaaattagagatcattgaagaccaaagtaacaacatgtggtcattacttctcaaattgaactatataaaatatataaaataaataaatttaattgcatgcttaggtaagaaaatattgataaaaataattgaatattttatcttatttcataattctaaacagggatttagcacaatatgaaaactagactattcatgtaatcaaaataaaagacaatttttattctaatgttaactcagaaattattttgcttatttaatttaacaattttactgaaaggttaatgagataaataggacagattataattacctaacattgctatggtaacttatatacaaatagctgttcatcaccaaaagtcaaaaaagtaacaagcactgcaacttaagatggattatacaacagaaattagtaccaagttaccttatcttataatattatgttattaaaatgaaattttaaaacaacaccaaaaattaagttggggttacaagtgttgtgcagaaaagatttcatatagcaggcaagaggctgccatccttagaaaggcctgcatgcaaggctggcccttggctggtgtttaggaaattggaaatgggagggtttccaccattccctgagaagagtggctcactgtgtctaaagtgcttatagaaacagtgtatttactctaaacagctgctttccttgtaagagtctggaatttgggtacatgtgagggagagtaacctccatagaaaaacttgggcacttagtctctaatgaaactctggtactggtagacatcactgcacatatgttgtcaaaatgtgagcctgggagaattaagcagatcccgggaactccacaggacagaactcctggaggcttgtgccttgtttcctccagaattgaccacatgcacctttttcctctactaattttgcttgtccccttccttgttatcaattaaagatctgagtatgactatttgttgagtcctgtgagtccttctaatgaaccaccaaacctggggtggtcttgggaaaccttgacacaaattcattgtgtaagatttgtattaagttgatatgatacgtgtaactgtaatcagatggttatttcacagaataactttacctaatctgtttttcttttctttttttgccttgatatttgacttggagattctcgtatttctatatctatccaattgaataaagccatagaaggaataaatgaaaaaataatgtcagaaaataatgtgaaatgagcagcaatcctcttttatctgaataaaaaatagagaatctgggtgattgacaatatgttctacaatatgaatgtttctagaaaaaaaatgaaaaagtggtcaattttctgcaactcaactgggcttcattcctttttataataattttgaaggccaggtgcagtggctcacacttgtaaatccgagcattttgggaggttgaggcaggaggatcacttgagcccggaagttccagaccggcctcggcaatatagtgagacctcatctattaaacaaacaaacaaacaaaaatcccttaaaaagaaaattagccaagtgtggtagtgcatgcctgtagtccaagctacttgggaggctaaggtgaaaggatcatttaaggccagcaagcagaagttgcagtgagccaagatgacaccactgcacaccagtactgacaacagagggagaccctgtattaaaaataaataaacaaataaataattgtgtatcaggccagatgtaaccacacaaaactgtagtcccagctactcaggaggatgaagtaggaggactgcttgagcccaggagttcaaggctacagtgagctatgattgcaccaatgaatagacactgtattctagcctaggcaacatagagagaccccatctcctatgataataataattgattaattgtgcatcattcaagtaaattgtgtaactggagaaaaacatatgactattgaatatactattatagtctactactgaccatagagttcctgtttacttgcttctaatctttttcttcatttctcataaaactgaaaacatgatttaaacccattaaaggcagttcatcacaaaacaagtcaaaaagtcaaaagaattgcatccaaacagtaggatgcgttatccaccgctctctgtgaacagttggatttggtcattaagaatcagcaggacttttaactttgtgtctgtgtgcacaggtgtgtgcacatgtgcacgtgtgtatgtgtatgtatgtaaactatgacagataaaatcattttgcttgtgtacgaatatgtaatataacttgtgcttctcacaaaggaattgcttttccgtctcctgtgctcagtagctgtcttcaaaaaataatctcctatttgtatgggtgcacactggttcagttctacagttcttattgccatttatttatggtaccagaaagggattgctgagttcctggttctaaagatagttactttcttagtgacacaaatcaatatgtaatacagttcacccttgaacagcaagggtttcaactgcagggattcacttatatgcagattttcttctgcctctgcaacagagagacagcaagatccacctctcctcttcctcctcagcctaatcaacctgaagatcatgaagacctttgtcaggactacttatgctttatgaaaagtcaatatgtttctcctgatgatttcctttctaacagcttcatttctctagcttattttattgtgcgaacacagtatataataatgcagcaaaaacaaaataggtgttcatcaactgtttatgttatcaggaaggcttccagtcaattgtgggctattagtagctaaggtgaaggaatcaaaagttatactcagattttcaactgcacagggatcagagtccctcacccccacattattcatgggtcaactgtagttatttgtttactaaatataaacaatttattataaaaatgaaatcgaagatccatttgtataacaagtccaatttgttataatgtgactatagaggaaacatacaacatactaacttaaaaatcttttttcttatttatgcaaaaatattatataggattttagggatcataattaaataaatgaatgttttcagacaataatgtttgagattgtaaattagctacaactaccttcttaaataaatctgaatttcaaactaaagaagttaaattttaaaaattaatttacatatgtatatacatatatacacattcaatttacacatatttttaaactggtcttttttgactgaaactaccttaatcttacatcttactttgtattttcttatcaagagtaggaccaccaagacaagtaagaaattcacaatcagaagtcttacctgatttctcctttttaagtatcttctttttatgttccaaaatttgttgttgaattctatgtatacaaaagtaataaataaaattgccatttttataatgaaataaaaaatattcaccaaacatattaaattccaaaacactttcaagcaatatcagacctaatatcagaattttaatgtcccatacacttcaaatttgtaaaccttacaagcttattaagcttataattaaagaagaaaagaaagtgaagtactcataaatggaggaagcacagctcagtaaatgaactctagttagctggatatcatgcaaagtgtcctgcactcagagtaagtccttgctctgtaaccaaaatacctcgctctgtaggtattttgtcttcagacaagttgcttctcttaggctccatggtttcttctaaaaaacaaggattctgctaccttacttcactaggttgtttggaagatgtaatgagattacatgtttatatgttcagagaaatagtaaagcaatggaataatttattcttgaactttattgctgaaaccattttggaatcccaaataatgctcggtgtgtgtttttctgtaagttctaatactcaaatgttgcagttttcagaaaatgttattaagtgctaattttggttattacttgtattcattgtggcttgtaattcagggcattttacctaattcataacttattactaaatttctatatatataaatttagtgagctcatcactgagctcatcaatcacaccaagggcagaaaactaataggtgtcaaaacctggcttggacaactaccactccttctctacctcctcaaactctgagccagcagatctgtgcttggctgctggatctccatggtcctctccaactaacagacaagacaaaaccctgctttgattgtttttcagttccatgaaggaaatacaagttgacattttctcatttccaagacatgtactaacaacatgtaacatccccttattactcagctctgttcccatttcagagatcaccatacatcaatagtttcatagcgataatcacaatttcaatattgcgtgtcacctgttttggttttgctcacactgcttccttggagctactcaacaaatagtcaaatggcctacctgggactaggcaaaatatggaatgttttctgaatttgtgtgccatccctaggcagtagccatgcttatctgctctgtattgatccaattttaaaatatgtgctgttgaaataagtacaaagccctgtttgatacatggatattcatgagtcatggatgaggcttagctctattaaatccaactcacttacttcagattcagagaattttattgaatggcttcctgtgaggtagaattttaaaatatattgaaaacttgaggaagagctgcaagtagcccaggagattttcatgattatagagacacattacttgaggggccaactgcaagctggttcccactactcagtggaaagataacatggaacattccgctatctaaccaaagctgctgcacaggatataaaaaagcctcaaggtacagatctgatagcaaaagagacagggaactctgatctcttcctgcaacattatttgaacatccctgactattgagaacaatcccaactaatattggttaaaggaaagacaaacatggctctcaaaggataacataccacgaaggcctaggcaaagtctagctaagacgtgggctccaaataaggtttttagtgtagggtgagcatcaacttgctcaatatttgtgtggataaagctaggaggcctagctgccagagcagggtgctgggaacaatgactgagcacaagtacataaactaataaacaccgtagctttgacctctatatatgaatcaccatgaaaactgaggggtctgaatcagtgaaggcatcctggtggcaaaggtcaatcattatcagattgcaggaccagttataatggcaataatacagcaagtgagtccatggaaacaacagaatgattagaatggccttttttccccttcttctgacttgtaaagaaagattgccttccttggacttaggaaaccccttagcttcttggaaaattcaaagaaggaagacacaggagagagccccaggggacaatacatgattttctgttaaactggacattacaagactcaataactaattagaaaagtcaggccaggcatggtggctagcactttcagaggccgaggcagggggattacttgacctcaaaagttcaagaccagccagggcaacagagtgagaccttgtctctacaaaaaaaaaaaaaaaaaaaaaaaaggaaaggaaaggaaaagaaatcaaagacatggctctttttatcccatgcatggggattatacttagaataaaatgaataacattgagatccctagggataaatgtctcaaaaatccagaaaaaatctcgcactctacttctaactaatctagacttctgcttgatttctggctaaaaggtagactaactcttcgctatttcaaactatctgaaccaaactatgaactctcacctaatgcataagatggagtagttgcaattattttaaacttcaatttagcattaactggccttttaacataaacacttactttgtcaaatgatgagaaatagcataatcttctgcatctcgtccacacatgtcttgagcgaagacatcaatattttgcttaagaaggatattgacaatacctggtgagtcatagtatacagcaagcatgagagctgacctaaaacaacaaagaaataactccactcaagaactttaataaagacttttttaaaaagctagtttgatacactttaccagtttaatatccgcctgtcagtatagatgtaataactatttgcatgtactagcttgggtctataagcatctagggtgctcaagtgttcatctttgtaaattgtcaccaaggctaaaagaaagggacaacagggaagcctcttgtcccactggggtaagacataatacaagttgctaacttatagtcctttgatggccaagaaactgtgctgaggtcacttatctaaagtaggcaaagatttagatgaagatttccccattgctttcctagtcaaatcagctaggggtcagataagagttatctgcaggctgaaaacaacaacaacaacaataataataatgacaatgctagtagtcataaactaaaagtccacactttgaaaatgaataaaacttgtcaggtgcagtgtctcatgcctgtaatcccagcactttgggaagccaaggagagcagatcacgaggtcaagagatcaagaccatcctggccaacatggtgaaatcccatctctactaaaaatacaaaaattagctgggcatggtggcgtgcacctgtagtcccagctacttgggaggtcgaggcaggagaatcgcttgaacctgggaggtggagaatgcagtgagctgagatcacaccactgcactccagcctggcaacagagcaagactccatctcaaaaaaaaaaaaaattaataaaactaatacaaaaccctttagctaataaaagattacagtacgaaaaacatctgattataaataccaaactctgtatattataagagaagatgaatcctactatatactattctttatgttactcagtccaaatatttgcttgtctacctgattattcatggtgatatttttcattatatgccaataattatgttaatcttcttattaatatttctgacttgagtgaccactctagaatactcaggttttatttttaaaaaaagaactactgtaccgtctcagcctatcaacggcatgtgaacttgctttccttttcaataaaaattccaccattttctctttcttgcaaattatagcaaataaaagtggggtattattgtcctataaaacagcagaaaaaattaataattcacaaaattacatatttctcaactgaactgaaaatcttctccaggatgctttgaacttcaacatacaatatagaaaggaagtaaatgaaaagcagtcccttcattctcactcctctgtgctttctgatgtgctgtgctttgccttgcaaacaaccctcctctgtctccctggattaactgtggtcattgccaaaactcactttaaacatttactagtcccaagaatccttgctttgatcacagcacttatcatggtacattgtagtcatttcattgtttcccactgaaaccaagagcttcttgaggcaagggcctaaaaccctaagacacagtagcaaatattttaagttttttacattaattaatgatctaaattactatctctaaagcagtgtctcttaaactatattccaaagaatatttgctttatcagaagtattataccgcaagagaaagactccatgaccatctgtatttgagaagtattacaaaactgtattttatgtccaataatcaagaaatctctttaatttcacctaatcccctttcacaatactatttgtggcaaacattaacatttgaggaattaagagtttcagagatacagttgccagagcttcccaatacaggtggcagttccctctgggtggtacaaacttgcttgattcacttttatcaatggtgtcaggatcccagatgccaatgtcaggcactcctgctccaaatgggtcaccatggaaatgagctttgaattaagagagattggcttcaaatgcatttattttccttattattaaatagtccatgggtttttcccctaatacaagagaagagatttttatctttactgttagaaagctcagtatattctgtgtaagagagataggtttaaaaaacttaagaacaaatattttaaaaaccaaaactcagtaagaaatactattctcaattataatggtaatcccgggaccctagtgcagctctactttttaaatccatttttactggcttccacttaaatggctacttaaaattattttttattttagacaaaatataaatcagaaataaaaacataatggcttatcaatagaagttctcatactgatccacatggattatttctggcataatacaagccaataagtcacttgcatccttaaggaagagcactgaggagaaggatgtactgtctgcaatattcataaattatccaactataaccaggaataacctaaaaaggcttctaggcattcttatgggcagagaattatttgtggtatatataaagaaaagagttaaaaacttctaaactctaaaattcaactccataactgagggatttatatactctatagactatatattataaacaaatacatgctgacttaaaaaccttgaaatttttatcaaaatatactataacataggagttgtaaactcagatacttacaaggacaaaggaaggttgcctgagtaagggaagtactaaggtgggcacagtagcaaactggagaatacctgccttctataaaggggcaacttctgcacagcagaccaaagaatgatagaaactcaggggacaccagatttgattttttaggatatgcctgaagtccacatttcttcacgagtcttctaaattttacatgttgattcaacttatagaggcaaacaaacaaatctgtgtaccacattagaatacagcccttgttttttttatattcgctattaatgtgttactaaatggttgtgtataatccaagtattttcatgtaaaatattttctttctctggtatcatatgttctaccaaaaaatcaggctctcatatataataaaaattgctaaaaagactcacaatacctgcttcaagaatttttccaacatgtattcatttaaaatatgtttgtatataattttcccagattgttaaccaaatagataattggttcacaagactgctaaaactaaattattaaaagaattcctatctatattcttattaacttcatggatttcagtgtttaaaactgacattttgggtatgctaaagttctataaacttaacaaacatactgagatagttcataacaaaacttcaactaaaaaaaatagtttaggatttgctactattctaattgagaaagccaaacttgtaatgaacatttgttgacacataatcacctgcgtggtgacaaagggacatgaaatcatgaaagggtcagcctctacctattgaaagattactcataagcaaatttctgaagactctctgaatggtagtgaatgattcatggtgggaagcaaaacatgttattctgtaagctgagagatattgccaatgatattacctttcacttcccagtcacagatgtagagaaagacagataagtcaggctaatataattgaaaaggagaactttgaaggaagtggcaactatcaaatgccaactcttctagagatttcttacatttttgagatacagaaatttatatattgcacttatctattctggggtttttaatcaagagtgtatcccaaccttgaaggttttttgtttttttgtggggtttttttttggctattattgttgttagagacaagagtctcactatgttgctcaagctggattcaaactcttaggctcaagctgggactacaggaatacaccactgtgcccagcttcaagaaaacatttttaaacacgttcaggccttaataggtctattacatcaaaatcttcaggggaaagcctacaattgtagatttttaacaaaatgtcctcaggtcactgtaatgcacaattctgagaatcagtgcagcagacaatcacttcagtctcacctctcacccacatggctaattcctttatcagttggagatgtggccaaaaagagaaaagagtaagagatagtgtcatttattaaaactccagttaagtttcctggctacgggtagaacagggacaagtaaactcaaaatcccacttgattttgctatttacaagctccttatctcccaccttcccactaagacattctagatttgagaggaggctttaggttcttatctaagtggctgtttctgccaggatgagcaataagtcagttaataatttgttccaccttctgctgaagtgtttctcacttcgtcaccacatattcactgccaatctggtttcctcagagtcctcctaaaattcatctctaggcaagttgcaattcattctttttcaaaccaaaaattattagacccaaagctaaacagcaccttgtctcaacacataaaacaaacttaaaaacaaaaaaaaacctcttcctggcattttccctcattatctaatatccaagtgacctgcatatttctgattgctctctttctcccctcccatttttccctcttaagccttgccactgaaagatgatacatcagtttttcagaaaattagcagcaacagcaacatgtccctttattgtaagttgctttagttttgtttgagttttaagataaagcctaattccggggaatattttctttcctgtgttgttttacactaattaagaaaaaaaaaaaaaaaagaataagcctgtgtagaaaaaaagttgaaaaggttttacctttaacaaattcacaaatattttccaaagtgcattttataaagctgtgccctttaatgcttctttaaaaatatcaatatttaaaataaaatcttagacaattaagttatttcaaaataacttaatttgtatttgcattcagggaatggttgagcttccaaatataaaaaattgacccttacctatgtcaatgttaaaacaaatattttggaaagaaagttgattgacctataccttgtccagtgcttcaatatgtgcaccatgggaaagcagtttttctgccagtgaggtgctctcactatacacggcataatggagagcagtgttgccgtagatatccttaaggtttggattggcgccatgttccagcagaataacggcacaagcctcttcctggcaatggacagcctgtccgtgttagaccaagaaacagattgtaaattccaagaattcaaaatacacattccacaggtttcaccaactagttatatgtaaatgagatcaatttattttaattctatatatgtaaatcaaatccatgtcatgctaaaagagttggctctaatatacctgtatcaaaggcgttctgttttctttgtcacagacatcaatctggcattttctgttaaccaggagagtgaccacttgcacatggccactggcacaggccaagtgtagagcagttctatgagagtaagaggattttttaagaaactgtagtacaatatctcaaaacatacaatcattcatgtaatgtaaaaactgaatagcatgtttttcctctgccttcaaaacaaataaattttttgaagaaagtacaatacttactagctcttattgctcactgccttaatgaaaacagcagcctatttgagtagaaagagctcagtctttggattcggttcaactagggcttgagtcctactttaagccttgacacttaccaactattgcttagcctttctgtacctcaacttcctcattaataaagatgacaatagtagctatctcataggacaccatcgtgatgcttaaatgagaagctatgtaaagtatgtagaacagttcctacgacaactcaataattgtaagatttttgttttttgagacaaagtctcactcttttgcccaggctggagtgcaatggtgtaactatacctggaactcctgggtcaaatgatcctccatccccagcctcctgagtagctgggactacagatgagcaccagcatgcccagctatttatttaaaaatttttgtagagtaagaatctcactttgttgcccaggctggtctcaaactcctggcatcaagcaatcctctcaccccagcctcccaaagttctgggattacaggtgtgagccactgcacccagccagatattataattattactattactactacttaacaaaaccattttaattaggtagaatgatacaattatacctactttgcaagatgacttaacgagtaggtcacattttaacacctctgacattggaatgccacttataattcatgatttgttataactataattggtagcattttaaaaattatcttattgatatataaaatatcggggcatcacgcaatccatgagaccttacattaagtagaatatggtatactcagcaggtctagggcagttctaggcatgtaactgaaacttaaatacattttagttcttaaaggtactatggggaaagagcactgaaataacaataatgcattttttaaacaaattaattctttgattttcaaacaacttgaaaccaaaggaaactcatgattcaaatgaatacatatggctcattgtattcaatatttatacttagaaaatatatgcaaatacgactttccaatgattaatattagtatttaagactgataaactttcgaaagagcagttaaaggttatcttctactattttctaacttcagaaatgcttttgtttgaaaggtgggagataaagtttcaaggagattaagtcccaatattcctattttaaatctctcagcttgtgcaggcggggcaggtaaacatgaagtgtttaaggatggacgggtcctgagagatgatagaatatgtctgctacatagcaggtactcaggttatgcttgatccataaatggaatgaaagaatggataaatacagttggggagttcattatttttaaataaactcctataaagcaatatttttgcaatagtaattatttatatgtgttgttttatttttaaagaacacaattaaaatgaaatgattatgtttgcataaatggaatgagtatataagcaaaacatatgtacataataaaatatatagataataaaatctggaaacagataaaaacattccttttttacttctgaagaggctaaaagctcaaagaagataacaacacacacaataatgataaaaaatagaaagtgagaaattattttcatcagcgcaagattcatattcctctcttcccaaggattagtccattaataataaacttttactagaagttttgtactcactgcagcaatcacagataagaaaaaggaaaaaaactttacttaaaatacaaatgctcagaaattacaaattttatattttgtacatatttttgctaaaacaagaccatagtatgtttgtgtatgtataatttaactaattttttctccttgctagctataacaaaatacatctttgcacatcaacgtacttctgtatctactgccaccttcagtggtcacatattattccatcctatggatgcaactgaaatttatttataggatccattctatgggttctctttaaagtaagtactgtgaaaaataaagtgcatgtatctttatttcctaagggtattttagtataatggaattggtgggtaaagggcatacacattttttaaatgtagtacttaccattttcaaatgagtactttgaaaagtaatcagcaacttcaagcagcagtataaaacatcctcacaaatattgtggatagaaaactgtttcattcctcttttagtttaaattcttataccagaaatgcgaaggattttttcctatgtatataagtaacttgtagatctggaaaaaggtactttgcccacttttagagtgtttgatgatttgatttgaaagaatttcctgtaaaatgaagaggtacttttcatctaatgtgtatatataactgatatatataacatattatatgtgttatatatgtatacatatcagtaatatatatatatcttatgatatataataaacaacataggccaggcgcggtggctcacacctgtaatcctagcgctttgggaggcggaggcgggcagatgacttgaggtcaggagttcgagaccagcctggccaacgtggtgaaactaaatatacaaaaattagccaggcatgctggcacctgcctgcaatcccagctacttgggaggctgaggtaggaaaattgcttgaacccggcaggcagaggttgcagtgagccaagattgtgccattggacaccagcctgggcaaagaagcgagactccgactcaaaaaaaaaaaaaaagaatataatgaattccctataaaatgaaaacatacttttcatctgaaaaaatatatatatataatatagtaaatatttttcaagtaagctctcttatctgagaacttttcgcccactgaaacaactcacggttatttttgataggggaacaagtactctcattaggcacctcctataatgtatataaaccatgttttaaacgtgtacgttaaaaataacaacgctgtatatgcttaactttgtgagttaaatcactcaaattctccaactgctccagccagggaattatgagggatggaaaacagatgagagtccgtttggctccgccgctccgagggtgcccggcgccctgcacggccccgtcccagggtctgcggggaagccgggcctgggggccccctcccacccccggctgagcccccgctacctgtgctgcttgtccagggcgtccaggtctccgctcctgcgcgccaggcagcgctccacctccgcggcgtcgcctttgacagctgccctgtggatcttctgcagttcggagtcccggattcggtatccggaacccgtgtagacgtggtctatggagccctgggccgtctggcccctgcggctcccgaagccgaataacttcatattggtgacttcttctcagacccccaaccaccggctcttgagcgagggcagctccctgtcaccttttcaccacccccctccccgaccccggccgacccagccccaaatcccc

SEQ ID NO: 2268 - DNA, 3372 bp, Homo sapiens
tttattcaaaatatgaaattttattataattgatgtttaatgcaattcactttacgaaggtttttgtggttttccctaaaatttctgttttaatgaaggctcctgatcatcctggatgtcaacaagttttcttcttcatgtgacgtctctgatgcacaataaactgattagtttttctaaaactgattatattcatagggtttcatctcactctaacataaagtttaagctaaactacgtccatttaactaataagccaaatttgtaagagcttaacagactataaacttaactcttgctttaaagcaacaaaaacaaaaccctgatgaagacctggaagtgaattgttcgtttttcagactctagcttccttgaccttgtgctttatggttttgaacacacaggacccaagtttgctgcagaaataacctccaaatccatattatgaaccaggaagactgtgagggtttttcttttttttttttaagggccaagagtaaatgtaatatatatcattagcaccatatcccatggtcagccccacctgaataaacggcatattgggatttttccacaaactatgagcctaatgaaaaaggaaatggataagggaaacaagttcccagcctatgtcacatgagtttctgcactacgtgttatgtggtaaggtatgcattccctcaggacttcccaaatccattacatgctagggttttctctctggtatgcattctggtgtgatgtaccctaagagctgccttacggacaaaagttttcccacattcatcacattcatagggtttctcccctgtgtgaattctctggtgtactctgagagttgaattttgggcaaaagctttcccgcattcattacactcatagggtttctcccctgtgtgaattctctggtgtgcactaaggtgtgatttctgggagaacgttttcccacaatcattacattcataggatttctcccctgtgtgaattctttgatgtactctgagggttgaattatgggcaaatggcttcccacatacattacattcatagggtttctcccccgtatgaactctctgatgtgcactaacatatgacttctcagagaaggttttcccacattcactgcattcatagggcttctcccctgagcgagttctaagatgtgctctgagatgtgatgtcttggagaaagtcttcccacagtcattacattcatagggtttctcccctgtgtgaattctgtgatgtgccctgagggctgaattatcagcaaacgttttcccacattcattacactcatagggtttttccccagtatgaattctctgatgtgcacagaggtgtgttctttgggagaaagttttcccacattcgttacattcatagggtttctcccctgtgtgaattctttgatgcactatgagggctgccttatagacaaaagttttcccacatacgttacattcatacggtttttcccctgtgtgaattctctcatgtccactgaggtatgatttctgggagaaagttttcccacacttgctacattcatagggtttctcccctgtgtgaattctccgatgtgtactgaggcgtgtcttctggaaaaaagtttttccacattcactacattcatagagtttctcccctgtgtggatattctgatgtgctctaagggctgaattatgggcaaatgttttctcacattcattacatttatagggtttctcccccgtgtgaattctctgatgtattttgagggctgaattatgggcaaaagttttctcacagtcactacattcatagggttttctacctgtgtgaattctctgatgtgctctcagggctgaattgtaggtgaaagatctcccacattcattacattcatagggtttctcccttgtgtgaattctttgatgtgccttgagaacagaaatatgggcaaaagaccttccacattcattacattcataaggtttctcccccgtgtgaattctatgatgtgctctgagggctgaattatgggcaaaagttttctcacagtcactgcattcatagggcttctcacctgtgtgaattctttgatgtgctctcagggctgagttataggtaaaagatttcccacagtcattacattcatagggtttctcccctgtgtgaactctctgatgtacactgaggtgtgtcttgtgagagaaagttttctcacattcaacacattcatagggtttttcacctgtgtgaattctctgatgtgctctgagatgtgatgtcttggagaaagttttcccacattcaatacattcatagggtttctcccccatgagaattctctgatgtcctttgagatgtgatgtcttcccatattcactgccaccacagagttccatctctgcatctgttttctggtgtcctatgaggggtgacttgtaagatctcccacagccattgttatcacaaggtttctcttttgtgtgaattctcagatgtttactgaggtttgaattctgacagaaagctttcccacattcattacattcataaagtttgaatcccacataagttccaggatgctgaataggatgtgaacttgaacaaaaggattttgcacattcctcatattggtaagttttctctcctgagtggggcctctcatgctgaatgaggtgtgctttccagtaaaaggattttctgcatttcccatgttcatcagaaaggtagaatttctgatgtgctgtaaagtctgtgtgaattctctgatgtgctgtaaagtctaatttctggtagagggcatctgtacattcattatgttcaccaaatttatctccagcttgtgttttctgatgtactatatgggctgagctctggctaaaattttcttcacatttattgctttcaaaagcactccatcctgtaatagttctctgagattgagtgaggggtgacttcctactgaaattaatccccctttcattacactcatagtgtgtcatagccatgtgaactttattgtattcaacagcggtggttttgtcacaggatgtcccatattcattaagatcagagcatttcccccttttgtcagttctcatgtggttaaataaagtggttttatcaaagtttttttctaaattcatcatccttacaggacttttctcctgttagaaaactctgaggtgtaatacaaattgtcttatcatataaaccttgtccagatccatcacattcaaaagattcctccaaagtttgaaatttccaatgctgacctttcttataactgaaagctttagcattttcaccatgttcataagatttctcttcagcatgagctttctcatgcttaatatcaagctgcagtttctcacacacatt

SEQ ID NO: 2269 - DNA, 6259 bp, Homo sapiens
cagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggtaaggaaccctcagtcccaacccacagagcttgattctctcctttctttttattattagttccacttttccaaatccagtggagagccttctatgatgggaagtctcagaagagaccagaacatcatccttccagggagaggcagggcagccaggggttggtaggggtagatagtgtactgggatttccatcccaagctctcagtccatctgtgggggagcacaggaggcatcaaggcaaaatcaaaccagtggactcagcaccagtaccagtcatgagactggggaggtctctgtccgagaccaggccctgagccctggctcatcagcccctttctggtgcaggtggctcagggcccagcctcccctgtgtggggtgatctggggcctgtgctgggcccctgagggcctcccaccagggcctggtgtctcctctggtctcctgggaagcagaatcctacctgatagctcagcagtgcctgcgggcctgaacttgggtgttcctggagcagaggaacagggactgaaggtgtccgtggtggacctcatattgaaaatccctctgtgtgtgtgtgtgtgtgtgtgtgtgtgtgtatttttattttatttgtgtgtgttattttcattttattttattttattttattttattttattttattttattttattttattttattttattttttgagatggagtctcgctctgtggtgcaggttgcagtgaaatggagtgatatcggctcactgcaacctctgcttcctgagttcaagcgattctcctgtcttagagtcctgaatagctggggattacaggcgcccaccaccatgcctgcctaatttttgtatttttagtagacacggggtttcaccatggccaggctggtctcaaactcctgacctcaggtgatcaacccaccttggcctcccaaagtgcttggattataggcgtgagccaccacgcccagccccctcttgctgtttttctaagaagaaaagcagtttatcatccatttaaacaagagtgggaggaagcacacagagctccctgagcaagacagagagagccatgcggttcctgagtgcagcatgctgcggctgggctggggcagagagggagagccggtcctagcttctcaccctttcttgtctcccattgtcatcttgtctctccgcgtcatcttgtctccgtacgtcatcgtgtctcccagtgtccagtagggcggaggcggaggcccagaggcaggatgaaaaaccacagtctgagaggtaaggctctgccagagcacactagagttaatttgatctcatctgtcccggagggaactgactctgaagaagtcagttgaagaagcctgaggtgggggctcctaggaaggaaatcagaaccccgggtccttctcagattccatgcgggaatgaagccatggtgggccagggactgggcgttacccagcagggggcagtgtgtgtgtcctggggagaccaatgcctgcctggatgcggaggggggtgagggggcctcccgctccctgggaacagcagtccaactctgctaaggctgattcctctttgagaccacctcagtcctttctccccacagggcagttgtgaggactgtgggggtggggggtccgtgtgtggaagccctttgtgaatgaaaaagccctgtcctccatgcattgctattaacgtcggggtcatgtggctttggacacagatgggtggggcccagggtctaattccccatggtcctccctaaagaaacagccactcagcctcctgtgagaacccaggcccctccctcactgccctaacccagtctcctgatttccagctggtagagagtgcccgagaggcctgcaggagacttcggacctgctttcacaactgcagaggtgaggcacttccccttccctgcatccttcctaccagggctgggacgtgaccccagggccacaggcagcctggagctgacctgggatggggagaccaggggtacagaggatgggagtaaaaccctggggcgaggggtagcaggagaactgggcaatcagggtgtggggtggtggaggggctgtggcccgagcacccactctgccctccggccccaccggctcctggctgcagctcgtgtctcctgtctcctgcagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctgctgggaacatgcgggcttcccaggagctacatgaccttatggcagccagaaggagcaaactggtgcacgaggagcccagaaacccaaactgtcaaggctcatgcaagaaccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatataccacaatatatatggttttttattca

SEQ ID NO: 2270 - DNA, 6262 bp, Homo sapiens
cagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggtaaggaaccctcagtcccaacccacagagcttgattctctcctttctttttattattagttccacttttccaaatccagtggagagccttctatgatgggaagtctcagaagagaccagaacatcatccttccagggagaggcagggcagccaggggttggtaggggtagatagtgtactgggatttccatcccaagctctcagtccatctgtgggggagcacaggaggcatcaaggcaaaatcaaaccagtggactcagcaccagtaccagtcatgagactggggaggtctctgtccgagaccaggccctgagccctggctcatcagcccctttctggtgcaggtggctcagggcccagcctcccctgtgtggggtgatctggggcctgtgctgggcccctgagggcctcccaccagggcctggtgtctcctctggtctcctgggaagcagaatcctacctgatagctcagcagtgcctgcgggcctgaacttgggtgttcctggagcagaggaacagggactgaaggtgtccgtggtggacctcatattgaaaatccctctgtgtgtgtgtgtgtgtgtgtgtgtgtgtgtatttttattttatttgtgtgtgttattttcattttattttattttattttattttattttattttattttattttattttattttattttattttttgagatggagtctcgctctgtggtgcaggttgcagtgaaatggagtgatatcggctcactgcaacctctgcttcctgagttcaagcgattctcctgtcttagagtcctgaatagctggggattacaggcgcccaccaccatgcctgcctaatttttgtatttttagtagacacggggtttcaccatggccaggctggtctcaaactcctgacctcaggtgatcaacccaccttggcctcccaaagtgcttggattataggcgtgagccaccacgcccagccccctcttgctgtttttctaagaagaaaagcagtttatcatccatttaaacaagagtgggaggaagcacacagagctccctgagcaagacagagagagccatgcggttcctgagtgcagcatgctgcggctgggctggggcagagagggagagccggtcctagcttctcaccctttcttgtctcccattgtcatcttgtctctccgcgtcatcttgtctccgtacgtcatcgtgtctcccagtgtccagtagggcggaggcggaggcccagaggcaggatgaaaaaccacagtctgagaggtaaggctctgccagagcacactagagttaatttgatctcatctgtcccggagggaactgactctgaagaagtcagttgaagaagcctgaggtgggggctcctaggaaggaaatcagaaccccgggtccttctcagattccatgcgggaatgaagccatggtgggccagggactgggcgttacccagcagggggcagtgtgtgtgtcctggggagaccaatgcctgcctggatgcggaggggggtgagggggcctcccgctccctgggaacagcagtccaactctgctaaggctgattcctctttgagaccacctcagtcctttctccccacagggcagttgtgaggactgtgggggtggggggtccgtgtgtggaagccctttgtgaatgaaaaagccctgtcctccatgcattgctattaacgtcggggtcatgtggctttggacacagatgggtggggcccagggtctaattccccatggtcctccctaaagaaacagccactcagcctcctgtgagaacccaggcccctccctcactgccctaacccagtctcctgatttccagctggtagagagtgcccgagaggcctgcaggagacttcggacctgctttcacaactgcagaggtgaggcacttccccttccctgcatccttcctaccagggctgggacgtgaccccagggccacaggcagcctggagctgacctgggatggggagaccaggggtacagaggatgggagtaaaaccctggggcgaggggtagcaggagaactgggcaatcagggtgtggggtggtggaggggctgtggcccgagcacccactctgccctccggccccaccggctcctggctgcagctcgtgtctcctgtctcctgcagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctgctgggaacatgcgggcttcccaggagctacatgaccttatggcagccagaaggagcaaactggtgcacgaggagcccagaaacccaaactgtcaaggctcatgcaagaaccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatataccacaatatatatggttttttattcataa

SEQ ID NO: 2271 - DNA, 7042 bp, Homo sapiens
agctgccattgcggattttgccagcttcagccagtttagtcctaagaaggaacttctgaccccagacatcctgttttctaaaactaagcagttaaagctgaatgggaatttagctctgtcacataggcatttgttgggcaacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggctgtcctggaggagacgtggagacagctcagaggctgtcccagagaagacgtggaaagagctcagaggctgtcccagagaagacgtggagagctcagaggatgtcccagagaagacgtggagagagttcagaggctgtcccggagaagacgtggaaagagctcagaaactcagagactgtcccggagaagacatggaaacagctcagacgctgtctgcaagaagatgtggagagagttcagaggctgtcgttactgctgcacttggctgtttttctttggataattattgcaatcaattttagtaattcaggtgttaaatcacagtcaagcacctatttacctagtggtgagttcctttatgttgtgagttcaatgtcatttgtggggactgtggtccagggaggtgttgggaggatgaagttttttctgagtgactttgcaaacataaaaagtcatctaataaagatgctagaaaagcaaatatcctaacttcctagtcagaaaaatgtccaacaccatgtttatttaagaatttttcacaaaaaaaaacagtggtgggagaaaattacacatctgggcccagcaagtaagactttcccttcacaattgtgctgtgggatcccaggcctcggggggctactgccgtcaccgtccccaggctgtgggcccctttgtcagctgctcttctgaaggcaggtctcctgtccatgccttcccctttgctgtccggatggagattggagacgcagcatcatatacagctgacaggtgttaaccttattagctaattctgtttcacgggacacgatttatacactccatggaaatgcttctcactgcctttttttaccacttcaaggtagaagtaggtaatagtgctaaagtcatcttactagaataacaaagtccatggtttgttgtccctaaaaatatttgtattagtttactagggctgccataacaaaataccacagactgagtggcttaagtaacataaatttctttctttctttctttctttctttctttatttattattattatactttaagttttagggtacatgtgcacaatgtgcaggttagttacatatgtatacctgtgccatgctggtatgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcatttttaagaaaatgtggcacatatacaccatggaatactatgcagccataaaaaatttcttttctcacagttttggaggctggaagtccaaggtcaaggaatcagcacatttggtctcttctgaggcctctctctttcccttgccaatggccaccttcttactgtgtcctcacatgattgtcctgtggtctgtgtgtggtctctgtccacatctccttgtcttacaaggaaatcagtcttactgattagggcccacccatataacctaattttacctcaattacctctttataggtcctctttccaaatacagccccattctgaggtactagaggtgaggacttcaacataaatttgaggcaacacaattctgtccatgacaattgtccaccttagttttatggtgaaccaaggctgtgaaaaagacttgacttggggccgggcatggtggctcacgcctgtaatccctacactttaggaggccaaggtgggtgcataacccaaggtcaggagttcaagaccagcctggccaacatgatgaaaccccatctctactaaaaatacaaaaagaatgagctgggcttggtggcgggtgcctgtaatcccagctactcaggtggctgagacgggagaattgcttgaacccgggaagcgaaggttgcagtgagccgagactgcaccactgcactcaagcctggacaacaagagcgaaattctgtctaaaaaaaaaaaaaaaaaaaaaagacttgactgaaggcagtgacctaagagtgaagcgataacagctggcaactgttctgcaagaaggtgcaaagcccctgcaggcctgggaaggtgcagagcctgcacctcagatttgactcctctcatagaatcatggaatttaagtgaacctcttccagtattagggaatcttgaatggaaactctaatatcttaatccccagtgtaacaaacttttactacattgttctcatgatgacaaatgtctcatcagaaaatggcttaaaagtataatttttatgaaagcagactggcttatttaaaacaaacataatctgaaaactgtaatccaaaaagtagacatccatatatatatatatatatatatatatatatatatatatattcattcattctctttgctttgaaactttcactgaatgacctttgcccattttatcggtcaccatattttagtggtgctgtgcagtgacttttgtagagtaatatctctcaaagtgtgcaatgatcaatattgtgttgtcaaaagattctgtagtcaaagaagtttggaaaactttaattttttgattaagcaaagcaagaagtctgagtttcatttattggtttactatgaaaagtgttagaggctttatgatgtgcaagaaggacatgtgtcataatatttctcaaacctatttgacttccaatacttgcttttttgttttttcttcttttgtggagaaatttcaaaaactttggaaaatactttttaagtgagattcaggagtttgataagcaagatgacaaatactaaaaatatacactccaaatatagacacaatgaatactaaataaactcactgtttttagtcaacattattcaaggatatccaaagtttttcatggcataaaatgctctttttcttttcagtaatatgatacatgtgatattcctggaaacttaaaaaaaaaaatcatcatttatgtgctctcttgtcagtttcatgctgtatttttgatgtagaagaaagaatttggtatcttctcaggaatacattgtcacataaaaatatgtaaactccttcagataaattctcaccttctgcagaatgagtcaaacagcagggggagaagctgaatctagtgttcgcagtgagtgacctgtcttcctcaacactgtcatctcatccattgtcttggatgctcaagaaacggaactatataaatgtggcttctggccttcatatattacagtgccaaagcttcaaagaaccagtttttatttaatacttactttgtttctttgcattttttttcaaaaatacaatatgttgttattaactatagtgaccatgttgtgcggtagatctcttcttgaatatttcccctctcctaaatgaaattttgaatcctttgataaacatccccactccccaccccaagtccagctcctggtaaccaccagtctactctctacttctatgagtttagctttttcagattcgacataaaagtgaaatcatatggtctttctgtgcctggcttgtttcatttaacataatgtcctccaggttcatccacgttgtcacaaataataagatttcattattttttatggctgaatagtatttcattgtgtatatatactactttttaaaattcattcatccactgatggacacttacattgtttccacatcttgggctaatatataaataagatttaatgtatatggtgttgcagatatctcttcgacatacggatttcatttcctttggatatatacccagtagtgggattgctggttcatatggtagttcatttttaatttttgaaggaacctccatgctattttccatgatgcctttccttcaagtcttctccaacacttgttatattttgtcattttataataaccatcctaacacgtatggggtgatatctcaaagtgtttttaatttgcctttctctaatgattagtaatattgagcattttttatatgcctgttggcctgtatgtcttcttttgaaaaatgtctatttggatcatttgtccatttcttattgagttatttttggttgtctcttcactctgctagcacctattttgtataagacaataatgctcttacattttcaaaatatacagaagataaaaaacatatagtaagtatgatacttgaattgtagtgagacatttaaaattttccaggaaacaattactgtgttttatggttataaggaagaaacatgtacatcattttggggaagaaaaagagaaattatggagtgataagtttaaattgagaaaataccaacaaatacaatatacgagagaggctctaggcatttcatttacaaaaatattgtccagtttttgtatgtgtgatgtgtgcttgttccctctttccatatctatctctgtctgtctttctgctatggtttgaatgtatcctccaaaagttcgtagattggaaacttaatccctcttctctcatgaatagatttatgtcagtcctgccctcatgaatggattaatgtcactagcatagtagtgggttccttatcataagcccttttgctcttgctctctcactatgtgatgccccctgccatgttgttaggcagcaagaaggccttctccagaggccagcatcatgctcttggcattcctaggcctcagagctaaatacatttattttctttataaatcactcagtctgtggtattctgttatagcaacaaaaatattaagacactcttcctatttcccctactctccttcctccagcctctttcttacacacaaaatgttactgaaataccaggagttcaatctaggttctgttacttgcacacagaaagccaatcactgagacaatgaatattgccaaggaagaaggctttaattgcatgctacagctaaggatatgggatatcagtctcaattccatctcctcaaccagccgaaattaggggattatatagcaaggaagaaatgtaactatgagcaggaaaacaggaactagggagggctaaggaagcaatcatgacaaataaggaatctggcatctggcatctcattgtctcgacacagtggtctgatgaatttcacttctttgatactttttgagagagctgagagtccatttcctgaggaagaaactcagagaaaacaaatgtaagtttcaagcttcaagaccagaaggatttgtttctatgtttatatttttaaaatctgtctgtggatctattgggtgcatttcaaaaacacatacagaggaaatcccaggcgctgtgctagaattgggaatacaatggtgagttcaaagaggaataattttcctattctcatgaagctaatagtataggatagagaaagcaaacactaatcaaagaaccacacaagcataagattgcaactacaactaaaaaccataaccattcagttaagctaaggaggccaccattgtcacccttctcttaacctttaataatgtattttacaggtaaaatccttaagtaagtcatatttggttgggaagatcaaagaaatcacccagtctcccacatccgaaattgtgcagtccggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctctactaaaaatacaaaaattagccaggcgtggtggcaggcgcctgtaatcccagctacttgggaggctgaggcagaagaatcacttgaacctgagaggcagaggttgcaataagccaagattgtgccattgcactccagcctgggagacaaagcgagactccatctcaaaaaaaaaaaaaaaaaaaaaagaatgactaaaattaagaagattgatgattccaaatattagtaaagatgtagaacaactagaactcccacatattgctgatgaaaatgaagaataatacattactttggaaaatactttggtactgatttaccatatgaccccaaaatctcacttgtagaaatttatacaggaaaaatgaaaacatatgctcacagaaagcttgtatacacatgcttatggcaataaatttatttatagttgcctaccaacaagtgatgaacaaatatattttagtatcttgatactactttctagctagaaaaggaatactactaagcaaaaatagaggatgaagtagtaatatacataacatagatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaaactttttatgggtaatggaaatattttatatcttgattgtggcaccaattatacaactatatgtacacatttgtcaaaattctaattgtattatacacaacatgagtgactttaactgtctataaattatatctcaataaaattggtcttaaaagat

SEQ ID NO: 2272 - DNA, 6248 bp, Homo sapiens
cagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaaggtaaggaaccctcagtcccaacccacagagcttgattctctcctttctttttattattagttccacttttccaaatccagtggagagccttctatgatgggaagtctcagaagagaccagaacatcatccttccagggagaggcagggcagccaggggttggtaggggtagatagtgtactgggatttccatcccaagctctcagtccatctgtgggggagcacaggaggcatcaaggcaaaatcaaaccagtggactcagcaccagtaccagtcatgagactggggaggtctctgtccgagaccaggccctgagccctggctcatcagcccctttctggtgcaggtggctcagggcccagcctcccctgtgtggggtgatctggggcctgtgctgggcccctgagggcctcccaccagggcctggtgtctcctctggtctcctgggaagcagaatcctacctgatagctcagcagtgcctgcgggcctgaacttgggtgttcctggagcagaggaacagggactgaaggtgtccgtggtggacctcatattgaaaatccctctgtgtgtgtgtgtgtgtgtgtgtgtgtgtgtgtgtatttttattttatttgtgtgtgttatttttattttattttattttattttattttattttattttattttattttattttttgagatggagtctcgctctgtggtgcaggttgcagtgaaatggagtgatatcggctcactgcaacctctgcttcctgagttcaagcgattctcctgtcttagagtcctgaatagctggggattacaggcgcccaccaccatgcctgcctaatttttgtatttttagtagacacggggtttcaccatggccaggctggtctcaaactcctgacctcaggtgatcaacccaccttggcctcccaaagtgcttggattataggcgtgagccaccacgcccagccccctcttgctgtttttctaagaagaaaagcagtttatcatccatttaaacaagagtgggaggaagcacacagagctccctgagcaagacagagagagccatgcggttcctgagtgcagcatgctgcggctgggctggggcagagagggagagccggtcctagcttcttaccctttcttgtctcccattgtcatcttgtctctccgcgtcatcttgtctccgtacgtcatcgtgtctcccagtgtccagtagggcggaggcggaggcccagaggcaggatgaaaaaccacagtctgagaggtaaggctctgccagagcacactagggttaatttgatctcatctgtcccgaagggaactgactctgaagaagtcagttgaagaagcctgaggtgggggctcctaggaaggaaatcagaaccccgggtccttctcagattccatgcgggaatgaagccatggtgggccagggactgggcgttacccagcagggggcagtgtgtgtgtcctggggagaccaatgcctgcctggatgcggaggggggtgagggggcctcccgctccctgggaacagctgtccaactctgctaaggctgattcctctttgagaccacctcagtcctttctccccacagggcagttgtgaggactgtgggggtggggggtccgtgtgtggaagccctttgtgaatgaaaaagccctgtcctccatgccttgctattaacgtcggggtcatgtggctttggacacagatgggtggggtccagggtctaattccccatggtcctccctaaagaaacagccactcagcctcctgtgagaacccaggcccctccctcactgccctaacccagtctcctgatttccagctggtagagagtgccggagaggcctggaggagacttcggacctgctttcacaactgcagaggtgaggcacttccccttccctgcatccttcctaccagggctgggacgtgaccccagggccacaggcagcctggagctgacctgggatggggagaccaggggtacagaggatgggagtaaaaccctggggcgaggggtagcaggagaattgggcaatcagggtgtggggtggtggaggggctgtggcccgagcacccactctgccctccggccccaccggctcctggctgcagctcgtgcctcctgtctcctgcagcctcctggggccacaccttgacaaaggtgactttggtcagctctccggtccagaccccccaggtgaggtgggcgaaagagcacctgatggagcctcccagtcctctcatgagcctatggaagatgctgctcccattctctccctgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcaggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaaaccaaactgtcaaggctcatgcaagagccaaaggccaatgtttccccctattcacaagagtgagaagtttaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattca

SEQ ID NO: 2273 - DNA, 7157 bp, Homo sapiens
agctgccattgcggattttgccagcttcagccagtttagtcctaagaaggaacttctgaccccagacatcctgttttctaaaactaagcagttaaagctgaatgggaatttagctctgtcacataggcattggttgggcaacaaaagcagggtagggctccagctaagccacgtaggcactacgatgggcaacagaaaggttggtttctgggcaattcagagaaaccaaggacagctacccccagaactcagagtagccaactgggctgctcacaggagatgccttaactgaaaggtgatcagactccacaggagacccagagaagatgtggagggagctcagaggttgtcctggaggagacgtggagacagctcagaggctgtcccggagaagacgtggaaagagctcagaggctgtcccagagaagacgtggagagctcagaggatgtcccaaacaagagagagctcagaggctgtcccagagaagacgtggagagagttcagaggctgtcccggagaagacgtggaaagagctcagaaactcagagactgtcccggagaagacatggaaacagctcagacgctgtctgcaagaagacgtgcagagagttcagaggctgtcccggagaagacatggagagagctcaaaggctgtccacaagaagatgtggagagagttcagaggctgtcgttactgctgcacttggctgtttttctttggataattattgccatcaattttagtaattcaggtgttaaatcacagtcaagcacctatttacctagtggtgagttcctttatgttgtgagttcaatgtcatttgtggggactgtggtccagggaggtgttgggaggatgaagttttttctgagtgactttgcaaacataaaaagtcacctaataaagatgctagaaaagcaaatatcctaacttcctagtcagaaaaatgtccaacaccatgtttatttaggggcaaaattatgtattcagaagaatttttcacaaaaaaacagtggtgggagaaaattacacatctgggcccaacaagtaagactttcccttcacaattgtgctgtgggatcccaggcctcggggggctactgccgtcaccatccccaggctgtgggcccctttgtcagctgctcttctgaaggcaggtctcctgtccatgccttcccctttgttgtccggatggagattggagacgcagcatcatatacagctgacaggtgttaaccttattagctaattctgtttcacgggacacgatttatacactccatggaaatgcttctcactgcctttttttaccacttcaaggtagaagtaggtaatagtgctaaagtcatcttactagaataacaaagtccatggtttgttgtccctaaaaatatttgtattagtttactagggctgccataacaaaataccacagactgagtggcttaagtaacataaatttctttttttctttctttctttctttgtttatttattattattatactttaagttttagggtacatgtgcacaatgtgcaggttagttacatatgtatacctgtgccatgctggtgtgctgcacccactaactcgtcatctagcattaggtatatctcccaatgctatccctccccccttcccccaccccacaacagtccccagagtgtgatgttccccttcctatgtccatgtgttctcactgttcgattcccacctatgagtgagaatatgtggtgtttggttttttgttcttgcgatagtttactgagaatgatgatttccaatttcatccatgtccctacaaaggacatgaactcatcatttttaagaaaatgtggcacatatacaccatggaatactatgcagccataaaaaatttcttttctcacagttttggaggctggaagtccaagatcaaggaatcagcacatttggtctcttctgaggcctctctccttcccttgccaatggccaccttcttactgtgtcctcacatgattgtcctgtggtctgtgtgtggtctctgtccacatctccttgtcttacaaggaaatcagtcttactgattagggcccacccatataacctaattttacctcaattacctctttataggtcctctttccaaatacagccccattctgaggtactagaggtgaggacttcaacataaatttgaggcaacacaattctgtccatgacaattgtccaccttagttttatggtgaaccaaggctgtgaaaaagacttgacttggggccgggcatggtggctcacgcctgtaatccctacactttaggaggccaaggtgggtgcataacccaaggtcaggagttcaagaccagcctggccaacatgatgaaaccccatctctactaaaaatacaaaaagaatgagctgggcttggtggcgggtgcctgtaatcccagctactcaggtggctgagacgggagaattgcttgaacccgggaagcgaaggttgcagtgagccgagactgcaccactgcactcaagcctggacaacaagagcgaaattctgtctaaaaaaaaaaaaaaaaaaaaaaagacttgactgaaggcagtgacctaagagtgaagcgataacagctggcaactgttccgcaagaaggtgcaaagcccctgcaggcctgggaaggtgcagagcctgcacctcagatttgactcctctcatagaatcatggaatttaagtgaacctcttccagtattagggaatcttgaatggaaactctaatatcttaatccccagtgtaacaaacttttactacattgttctcatgatgacaaatgtctcatcagaaaatggcttaaaagtataattattatgaaagcagactggcttatttaaaacaaacataatctgaaaactgtaatccaaaaagtagacatccatatatatatatatatatatatatatatatatatatatatatatattcattcattctctttgctttgaaactttcactgaatgacctttgtccgttttatcagtcaccatattttagtggtgctgtgcagtgacttttgtagagtaatatctctcaaagtgtgcagtgatcaatattgtgttgtcaaaagattctgtagtcaaagaagtttggaaaactttaattttttgattaagcaaagcaagaagtctgagtttcatttattggtttactatgaaaagtgttagaggctttatgatgtgcaagaaggacatgtgtcataatatttctcaaacctatttgacttccaatacttgcttttttgttttttcttcttttgtggagaaatttcaaaaactttggaaaatactttttaagtgagattcaggagtttgataagcaagatgacaaatactaaaaatatacactccaaatatagacacaatgaatactaaataaactcactgtttttagtcaacattattcaaggatatccaaagtttttcatggcataaaatgctctttttcttttcagtaatatgatacatgtgatattcctggaaacttaaaaaaaaatcatcatttatgtgctctcttgtcagtttcatgctgtatttttgatgtagaagaaagaatttggtatcttctcaggaatacattgtcacataaaaatatgtaaactccttcagataaattctcacctgcagaatgagtcaaacagcagggggagaagctgaatctagtgttcgcagtgagtgacctgtcttcctcaacactgtcatctcatctattgtcttggatgctcaagaaacggaactatataaatgtggcttctggccttcatatattacagtgccaaagcttcaaagaaccagtttttatttaatacttactttgtttctttgcattttttttcaaaaatacaatatgttgttattaactatagtgaccatgttgtgcagtagatctcttcttgaatatttcccctctcctaaatgaaattttgaatcctttgataaacatccccactccccaccccaagtccagcccctggtaaccaccagtctactctctacttctatgagtttagctttttcagattcgacataaaagtgaaatcatatggtctttctgtgcctggcttgtttcatttaacataatgtcctccaggttcatccatgttgtcacaaataacaagatttcattattttttatggctgaatagtatttcattgtgtatatatactactttttaaaattcatccatccattgatggacacttacattgtttccacatcttgggctaatatataaataagatttaatgtatatggtgttgcagatatctcttcgacatacggatttcatttcctttggatatatacccagtagtgggattgctggttcatatggtagttcatttttaatttttgaaggaacctccatgctattttccatgatgcctttccttcaaatcttctccaacacttgttatattttgtcattttataataaccatcctaacacgtatggggtgatatctcaaagtgtttttaatttgcctttctctaatgattagtaatattgagcattttttatatgcctgttggcctgtatgtcttcttttgaaaaatgtctatttggatcatttgtccatttcttattgagttatttttggttgtctcttcactctgctagcacctattttgtataagacaataatgctcttacattttcaaaatatacagaagataaaaaacatatagtaagtatgatacttgaattgtagtgagacgtttaaaattttccaggaaacaattactgtgttttatggttataaggaagaaacatgtacatcattttggggaagaaaaagagaaattatggagtgataagtttaaattgagaaaatatcaacaaatacaatatacgagagaggctctaggcatttcatttacaaaaatattgtccagtttttgtatgtgtgatgtgtgcttgttccctctttccatatctatctctgtctgtctttctgctatggtttgaatgtatcctccaaaagttcatagattggaaacttaatccctcttctctcatgaatagatttatgtcagtcctgccctcatgaatggattaatgtcactagcatagtagtgggttccttatcataagcccttttgctcttgctctctcactatgtgatgccccctgccatgttgttaggcagcaagaaggccttctccagaggccagcatcatgctcttggcattcctaggcctcagagctaaatacatttattttctttataaatcactcagtctgtggtattctgttatagcaacaaaaatattaagacactcttcctatttcccctactctccttcctccagcctctttcttacacacaaaatgttactgaaataccaggagttcaatctaggttctgttacttgcacacagaaagccaatcacttagacaatgaatattgccaaggaagaaggctttaattgcatgctacagctaaggatatgggatatcagtctcaattccatctcctcaaccagccgaaattaggggattatatagcaaggaagaaatgtaactatgagcaggaaaacaggaactagggagggctaaggaagcaatcatgacaaataaggaatctggcatctggcatctcattgtctcgacacagtggtctgatgaatttcacttctttgatactttttgagagagctgagagtccatttcctgaggaagaaactcagagaaaacaaatgtaagtttcaagcttcaagaccagaaggatttgtttctatgtttatatttttaaaatctgtctgtggatctattgggtgcatttcaaaaacacatacagaggaaatcccaggcgctgtgctagaattgggaatacaatggtgagttcaaagaggaataattttcctattctcatgaagctaatagtataggatagagaaagcaaacactaatcaaagaaccacacaagcataagattgcaactacaactaaaaaccataaccattcagttaagctaaggaggccaccattgtcacccttctcttaacctttaataatgtattttacaggtaaaatccttaagtaagtcatatttggttgggaagatcaaagaaatcacccagtctcccacatccgaaattgtgcagtctggactgtcaggaacaaaagtgaaagagagacgtcatcaaggccgggcgcggtggctcatgcctgtaatcccagcactttggaaggccaaggagggcggatcatgaggtcaggagttcaagaccagcctggccaatatggtgaaaccctgtctctactaaaaatacaaaaattagccaggcgtggtggcaggcgcctgtaatcccagctacttgggaggctgaggcagaagaatcacttgaacctgagaggcagaggttgcaataagccaagattgtgccattgcactccagcctgggagacaaagcgagactccatctcaaaaaaaaaaaaaaaaaaagaatgactaaaattaagaagattgatgattccaaatattagtaaagatgtagaacaactagaactcccacatattgctgatgaaaatgaagaataatacattactttggaaaatactttggtactgatttaccatatgaccccaaaatctcacttgtagaaatttatacaggaaaaatgaaaacatatgctcacagaaagcttgtatacacatgcttatggcaataaatttatttatagttgcctaccaacaagtgatgaacaaatatattttagtatcttgatactactttctagctagaaaaggaatactactaagcaaaaatagaggatgaagtagtaatatacataacatagatgaatttaaaaacaccatgctgattgaaagaaaacaattatcaaatacacagtgtaatattctattcacagaaagtttgaaaacaaaaaactatagtctctgaaagaaaaccattggttgcaggaaggtggggattcattggccacaaaagggactgaggaaactttttatgggtaatggaaatattttatatcttgattgtggcaccaattatacaactgtatgtacacatctgtcaaaattctaattgtattatacacaacatgagtgactttaactgtctataaattatatctcaataaaattggtcttaaaagat

SEQ ID NO: 2274 - DNA, 6259 bp, Homo sapiens
cttatgaataaaaaaccatatatattgtggaatattaaatgttctgcatgtactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgtctgtctctgttgggacaaccctggctcttgagagtggcttgttgactgctggctgcatagctcagtattctgccgtgttctgagtagaagaggtgcctgtggttgcagggaaacccacagactggggcttgaaacttctgtttgtgctgatttaccttcgaggcatggcgcgcatggcaaagtgacattttcttgtccagcatttgtccaactgccgtcatgagaccctgagcttcagcactgctgctgtacacacgtgatctgttttttactgttttttggctctcagcagtgactggtgctggcttgctttttttctttgaaaaaatccactgaaaaatttgcttgatgttttctccaaaggggcttactgaaggaggctgtttctttgatggcagtagctggacgccttcatcctgatgggtgtcttctgttttcctgactggggtaagttgaggagtcctcaatccttcaagcctttcttcatgtttttctaagttgggtttcctagacttctcactcttgtgaatagggggaaacattggcctttggctcttgcatgagccttgacagtttgggtttctgggctcctcgtgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcagcacaaacttgaggctgggtctctgactttgtggccattccaggctcaaattcattaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctggatgctgcctgtgaggctgtacgtgaggggcttagatggccacctgccctcctgtccagctggaggaggcttcaagggttcatgatcattccaagatgggattcctcgcggtgccctctggaactgcttccatgcaggtgaggaggccagaagactctctggcatgtgatcagatgctttggtcaacacctgctttctcagacttgccattggtggctttctaaggaacatgtccacctcaacttctgagccagccccagattcacaggtggctgaggagggaccagcaagctgtgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccaactcctcagaagtcacccccagaaccttccgtgggaagcttttcatatccctggatagattttgtggggtctcacccagaatttgccccagatgtgggcacgggtccctctctagctggaacttcaccttctgtgcctccttgctgctttcacctgtggacatggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtctcctcaacaaaggccattcagggtgctgagtttcaggtagggagagagcttgcactttattctgcgatgcagggcaagctactccagtgttctgaatcagggatggaaaagcaggagataggactgggaaagaagattgaagatgggcctgagcctcggcctgagccataggtgtgggccggaattggggtgtggatgaaataaagggttggcactcgggccccagatgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgccagagcctaggatctgagagcttctgaggtccgggcagctgtttcgagttctctcccatgttccagaagggttttgggtttgtggtgtcctgctcagcatccaatgatttagccaaattccgcaaagaatttaagtgcttttctggggtcattcgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagatgatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaaatgccactgagtcacagtgagatggagttatcagtgtggagtcccgcaggggaggagcagtgaagccttttggaggaggcagagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcacccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccaccccacaccctgattgcccaattctcctgctacccctcgccccagggttttactcccatcctctgtccccctggtctccccatcccaggtcagctccaggctgcctgtggccctggggtcacgtcccagccctggtaggaaggatgcagggaaggggaagtgcctcacctctgcagttgtgaaagcaggtccgaagtctcctccaggcctctccggcactctctaccagctggaaatcaggagactgggttagggcagtgagggaggggcctgggttctcacaggaggctgagtggctgtttctttagggaggaccatggggaattagaccctggaccccacccatctgtgtccaaagccacatgaccccgacgttaatagcaaggcatggaggacaaggctttttcattcacaaagggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttcccttcgggacagatgagatcaaattaaccctagtgtgctctggcagagccttacctctcagactgtggtttttcatcctgcctctgggcctccgcctccgccctactggacactgggagacacgatgacgtacggagacaagatgacgcggagagacaagatgacaatgggagacaagaaagggtgagaagctaggaccggctctccctctctgccccagcccagccgcagcatgctgcactcaggaaccgcatggctctctctgtcttgctcagggagctctgtgtgcttcctcccactcttgtttaaatggatgataaactgcttttcttcttagaaaaacagcaagagggggctgggcgtggtagctcacgcctataatccaagcactttgggaggccaaggtgggttgatcacctgaggtcaggagtttgagaccagcctggccatggtgaaaccccgtgtctactaaaaatacaaaaattaggcaggcatggtggtgggcgcctgtaatccccagctattcaggactctaagacaggagaatcgcttgaactcaggaagcagaggttgcagtgagccgatatcactccatttcactgcaacctgcaccacagagcgagactccatctcaaaaaataaaataaaataaaataaaataaaataaaataaaataaaataaaataaaaataacacacacaaataaaataaaaatacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcaggggcccagcacaggccccagatcaccccacacaggggaggctgggccctgagccacctgcaccagaaaggggctgatgagccagggctcagggcctggtctcggacagagacctccccagtctcatgactggtactggtgctgagtccactggtttgattttgccttgatgcctcctgtgctcccccacagatggactgagagcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggttgggactgagggttccttacctttctcttcccaggcgatggtgagggtgggtcatcacaacggaagtaagataagtaggggagtaatacgaagaagaaccccagggcaaacaccaaagtgaggaagatatccaacacccatggtgtggaactgggggcgtttagcgatgaggcactaagtaattttaaaggaaagggaagattctccatgtgaataggcgcgttgctttcaagcaact

SEQ ID NO: 2275 - DNA, 6256 bp, Homo sapiens
atgaataaaaaaccatatatattgtggaatattaaatgttctgcatgtactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgtctgtctctgttgggacaaccctggctcttgagagtggcttgttgactgctggctgcatagctcagtattctgccgtgttctgagtagaagaggtgcctgtggttgcagggaaacccacagactggggcttgaaacttctgtttgtgctgatttaccttcgaggcatggcgcgcatggcaaagtgacattttcttgtccagcatttgtccaactgccgtcatgagaccctgagcttcagcactgctgctgtacacacgtgatctgttttttactgttttttggctctcagcagtgactggtgctggcttgctttttttctttgaaaaaatccactgaaaaatttgcttgatgttttctccaaaggggcttactgaaggaggctgtttctttgatggcagtagctggacgccttcatcctgatgggtgtcttctgttttcctgactggggtaagttgaggagtcctcaatccttcaagcctttcttcatgtttttctaagttgggtttcctagacttctcactcttgtgaatagggggaaacattggcctttggctcttgcatgagccttgacagtttgggtttctgggctcctcgtgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcagcacaaacttgaggctgggtctctgactttgtggccattccaggctcaaattcattaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctggatgctgcctgtgaggctgtacgtgaggggcttagatggccacctgccctcctgtccagctggaggaggcttcaagggttcatgatcattccaagatgggattcctcgcggtgccctctggaactgcttccatgcaggtgaggaggccagaagactctctggcatgtgatcagatgctttggtcaacacctgctttctcagacttgccattggtggctttctaaggaacatgtccacctcaacttctgagccagccccagattcacaggtggctgaggagggaccagcaagctgtgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccaactcctcagaagtcacccccagaaccttccgtgggaagcttttcatatccctggatagattttgtggggtctcacccagaatttgccccagatgtgggcacgggtccctctctagctggaacttcaccttctgtgcctccttgctgctttcacctgtggacatggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtctcctcaacaaaggccattcagggtgctgagtttcaggtagggagagagcttgcactttattctgcgatgcagggcaagctactccagtgttctgaatcagggatggaaaagcaggagataggactgggaaagaagattgaagatgggcctgagcctcggcctgagccataggtgtgggccggaattggggtgtggatgaaataaagggttggcactcgggccccagatgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgccagagcctaggatctgagagcttctgaggtccgggcagctgtttcgagttctctcccatgttccagaagggttttgggtttgtggtgtcctgctcagcatccaatgatttagccaaattccgcaaagaatttaagtgcttttctggggtcattcgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagatgatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaaatgccactgagtcacagtgagatggagttatcagtgtggagtcccgcaggggaggagcagtgaagccttttggaggaggcagagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcacccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccaccccacaccctgattgcccaattctcctgctacccctcgccccagggttttactcccatcctctgtccccctggtctccccatcccaggtcagctccaggctgcctgtggccctggggtcacgtcccagccctggtaggaaggatgcagggaaggggaagtgcctcacctctgcagttgtgaaagcaggtccgaagtctcctccaggcctctccggcactctctaccagctggaaatcaggagactgggttagggcagtgagggaggggcctgggttctcacaggaggctgagtggctgtttctttagggaggaccatggggaattagaccctggaccccacccatctgtgtccaaagccacatgaccccgacgttaatagcaaggcatggaggacaaggctttttcattcacaaagggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttcccttcgggacagatgagatcaaattaaccctagtgtgctctggcagagccttacctctcagactgtggtttttcatcctgcctctgggcctccgcctccgccctactggacactgggagacacgatgacgtacggagacaagatgacgcggagagacaagatgacaatgggagacaagaaagggtgagaagctaggaccggctctccctctctgccccagcccagccgcagcatgctgcactcaggaaccgcatggctctctctgtcttgctcagggagctctgtgtgcttcctcccactcttgtttaaatggatgataaactgcttttcttcttagaaaaacagcaagagggggctgggcgtggtagctcacgcctataatccaagcactttgggaggccaaggtgggttgatcacctgaggtcaggagtttgagaccagcctggccatggtgaaaccccgtgtctactaaaaatacaaaaattaggcaggcatggtggtgggcgcctgtaatccccagctattcaggactctaagacaggagaatcgcttgaactcaggaagcagaggttgcagtgagccgatatcactccatttcactgcaacctgcaccacagagcgagactccatctcaaaaaataaaataaaataaaataaaataaaataaaataaaataaaataaaataaaaataacacacacaaataaaataaaaatacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcaggggcccagcacaggccccagatcaccccacacaggggaggctgggccctgagccacctgcaccagaaaggggctgatgagccagggctcagggcctggtctcggacagagacctccccagtctcatgactggtactggtgctgagtccactggtttgattttgccttgatgcctcctgtgctcccccacagatggactgagagcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggttgggactgagggttccttacctttctcttcccaggcgatggtgagggtgggtcatcacaacggaagtaagataagtaggggagtaatacgaagaagaaccccagggcaaacaccaaagtgaggaagatatccaacacccatggtgtggaactgggggcgtttagcgatgaggcactaagtaattttaaaggaaagggaagattctccatgtgaataggcgcgttgctttcaagcaact

SEQ ID NO: 2276 - DNA, 6292 bp, Homo sapiens
cttatgaataaaaaaccatatatattgtggaatattaaatgttctgcatgtactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgtctgtctctgttgggacaaccctggctcttgagagtggcttgttgactgctggctgcatagctcagtattctgccgtgttctgagtagaagaggtgcctgtggttgcagggaaacccacagactggggcttgaaacttctgtttgtgctgatttaccttcgaggcatggcgcgcatggcaaagtgacattttcttgtccagcatttgtccaactgccgtcatgagaccctgagcttcagcactgctgctgtacacacgtgatctgttttttactgttttttggctctcagcagtgactggtgctggcttgctttttttctttgaaaaaatccactgaaaaatttgcttgatgttttctccaaaggggcttactgaaggaggctgtttctttgatggcagtagctggacgccttcatcctgatgggtgtcttctgttttcctgactggggtaagttgaggagtcctcaatccttcaagcctttcttcatgtttttctaagttgggtttcctagacttctcactcttgtgaatagggggaaacattggcctttggctcttgcatgagccttgacagtttgggtttctgggctcctcgtgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcagcacaaacttgaggctgggtctctgactttgtggccattccaggctcaaattcattaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctggatgctgcctgtgaggctgtacgtgaggggcttagatggccacctgccctcctgtccagctggaggaggcttcaagggttcatgatcattccaagatgggattcctcgcggtgccctctggaactgcttccatgcaggtgaggaggccagaagactctctggcatgtgatcagatgctttggtcaacacctgctttctcagacttgccattggtggctttctaaggaacatgtccacctcaacttctgagccagccccagattcacaggtggctgaggagggaccagcaagctgtgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccaactcctcagaagtcacccccagaaccttccgtgggaagcttttcatatccctggatagattttgtggggtctcacccagaatttgccccagatgtgggcacgggtccctctctagctggaacttcaccttctgtgcctccttgctgctttcacctgtggacatggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtctcctcaacaaaggccattcagggtgctgagtttcaggtagggagagagcttgcactttattctgcgatgcagggcaagctactccagtgttctgaatcagggatggaaaagcaggagataggactgggaaagaagattgaagatgggcctgagcctcggcctgagccataggtgtgggccggaattggggtgtggatgaaataaagggttggcactcgggccccagatgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgccagagcctaggatctgagagcttctgaggtccgggcagctgtttcgagttctctcccatgttccagaagggttttgggtttgtggtgtcctgctcagcatccaatgatttagccaaattccgcaaagaatttaagtgcttttctggggtcattcgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagatgatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaaatgccactgagtcacagtgagatggagttatcagtgtggagtcccgcaggggaggagcagtgaagccttttggaggaggcagagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcacccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccaccccacaccctgattgcccaattctcctgctacccctcgccccagggttttactcccatcctctgtccccctggtctccccatcccaggtcagctccaggctgcctgtggccctggggtcacgtcccagccctggtaggaaggatgcagggaaggggaagtgcctcacctctgcagttgtgaaagcaggtccgaagtctcctccaggcctctccggcactctctaccagctggaaatcaggagactgggttagggcagtgagggaggggcctgggttctcacaggaggctgagtggctgtttctttagggaggaccatggggaattagaccctggaccccacccatctgtgtccaaagccacatgaccccgacgttaatagcaaggcatggaggacaaggctttttcattcacaaagggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttcccttcgggacagatgagatcaaattaaccctagtgtgctctggcagagccttacctctcagactgtggtttttcatcctgcctctgggcctccgcctccgccctactggacactgggagacacgatgacgtacggagacaagatgacgcggagagacaagatgacaatgggagacaagaaagggtgagaagctaggaccggctctccctctctgccccagcccagccgcagcatgctgcactcaggaaccgcatggctctctctgtcttgctcagggagctctgtgtgcttcctcccactcttgtttaaatggatgataaactgcttttcttcttagaaaaacagcaagagggggctgggcgtggtagctcacgcctataatccaagcactttgggaggccaaggtgggttgatcacctgaggtcaggagtttgagaccagcctggccatggtgaaaccccgtgtctactaaaaatacaaaaattaggcaggcatggtggtgggcgcctgtaatccccagctattcaggactctaagacaggagaatcgcttgaactcaggaagcagaggttgcagtgagccgatatcactccatttcactgcaacctgcaccacagagcgagactccatctcaaaaaataaaataaaataaaataaaataaaataaaataaaataaaataaaataaaaataacacacacaaataaaataaaaatacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcaggggcccagcacaggccccagatcaccccacacaggggaggctgggccctgagccacctgcaccagaaaggggctgatgagccagggctcagggcctggtctcggacagagacctccccagtctcatgactggtactggtgctgagtccactggtttgattttgccttgatgcctcctgtgctcccccacagatggactgagagcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggttgggactgagggttccttacctttctcttcccaggcgatggtgagggtgggtcatcacaacggaagtaagataagtaggggagtaatacgaagaagaaccccagggcaaacaccaaagtgaggaagatatccaacacccatggtgtggaactgggggcgtttagcgatgaggcactaagtaattttaaaggaaagggaagattctccatgtgaataggcgcgttgctttcaagcaactgagctctgggcatccccgtggagactagggact

SEQ ID NO: 2277 - DNA, 60784 bp, Homo sapiens
ctgaaatagttacacatgaagttttaatgagctatttcatattaagatacatattgagaattcaaaccagagagtccagttaattgatattttcccaactctgttttagggtgatcatagaaatgatatccacaagttagtcacagtggcctgcatccattttgatatatcagtgatgtattttgattggccagtgatcacccatactgactgttaaatatttttgttatcactcctatgcatggtgaatttgagttctggttttctttagccttgtgttatttatgtgtaaagttggattatggaaggcaaagaatctctcgtgtgtcattcacgctcaagtaaatggcagtggggtagggatgtaaatgaaactgcgtgataagccctgcaagtcattctgatgtatcaattttgcttactggtgtttaattgcagacattgtcatattaatgcaaccactaatacattatggagtaagatgcaaaaatcacatgagtcttaagagaaaagaaatgtgctttctatggtgggccccttttgtattattctctaacttcttattttatacctctactattagagaaatttcagtagaaaatcgtgaggggcaccgttttagagtttttgttgttataggtatgcttttactacagctaggtccccttgtacatctttatgttctttggcagtctagagaaccagaagagcaaactctatgagatagaaactctaagaatttatttacctccagcatcccttctcttctttcattaaattgaatttgtggccaactcaaagactgacaatttatactatggtttttatgtttttatattataatttatattacggcttatgtcaaaatgttttgttcactgctttgaaagtatcttttgtttacttttgttatttcatattttaattttttcctttctaattgttagaaactcatgtattttatctttcaaagaaaattttttaaaaggcttactctgcttatatgtatattttgcacaaagctttccattcataaacaaaaggtgaataggaatcagaattgaaaactacgtaatttcttttctccttttgagtcaaatcatcacagtatagattagtcattgtgtatgaagtgcattgccaatacatagtcacatttgtgtagaaatgtaaaggctatatctcaatacaaatcaaaaaccaaaaaatgcagaagaccattagctaataatactaataatctagtatagaaagcatgtgccaactgatctagactcttgtgacagttgtatatctacccagctgcatgacctgaggtgtatcaaaatcttgatttcctagactacaaatgagtaaaagggatggaggccccttacagttttaagattctagaattctaagtgtgtgtaactagagcaaattttattttctaaaatttgcataataaatttaaaaataggagaaaaacaaataattaaagtacatatttctagaaatcttttttaggtgacttatactaccaggaatggatttaccactaaatattggttttgcctaattcagcattgctatgtaatttgatggaagtataactccatagacaaagagatttggtcctaacatagcttgtattttatatgtatatacactatttctatttaaatttctgtgtagtcatgttttacccttttaaaatgaagattagttttattatgtattttcttttgtctataaacattcaatgaattcacactgaaaactgattatgaacagatagtctgctaggcactaaggaaacacatacgaaaaactaagtcctcctctgccctcaatatgctcacaagactacagttactgaagcctgacctcaaaacctagctagcaaagtccttgaatcaggtgatagttcagaataccattcgtgctctctcccaagagtatatctgaggaagggcagttctttctagttttctacatcctggtcgtataggtcaaccacaggaaaattaaatgaatctattgttttggtgacctagccttttcatataactctcatctataaatgtattaccaaatactatttatgtaaagggacttgtatgacaaatattttgaaattaaaaccacaatggttagcatagcttttaaattagatagatgttgacctcccattggtaaacatataaagtgctaccaagatctgccaatgacagactttggaagtggaaattcatctttgtaataatcctgttatctgtaggctgacctcaaaccttcataacattcagggccccttattcctaactgtatcttctattttgggcattgtgctcttgccatctaacaggaaaacaactttcagtgctgccaccttttgaacaggagagatttctagagattagaaaattactaaatttaaatatacatagttttaaaatatgatacttttctacccatgcattcaaatatattctaactttaaaatcctgtaaatacttatatttgtaatgattttacttatatgatccaattaattggcaagaatatgtggtgaaagattttttacatgtttgtattgttctgtgtgagacatctattgtaagcattgcttcaggccctcatttttgtctgccttccaggatttgctggcccaagtgctgtgtgctagcttagtgtcagtcacaaaggggagggaaacttgcagttgagccagacagttttgttattcctttaaaattaaaagcatatgaaacagatacagcttattaaggttttttttataaataacataaacttaaataacaaaacaataagttcaaaaacaacttaatatagagtttaatgcagtaaccataggaaaaaagcgtgattatttgtgggaagaacattattaaaagccatattcccaaatatgaattatacaaagatagattatgttacttgaaaaaaacttaaagatttctcaattttactttgaggaattataaaatgttatttagtggcaagtaagatgaagtacagtattatcatcaatcactgttgctatcttatatacaagatttttggaaacatccttttagcaataccctttccacttgagcagcattagaaattttgttcttgttaataggtataagcatgttctaatcctgtacttttgttaaattatctattttattgactttcataatagatttttttgagaatattctttttttctgattagagtttaagtagattataatttttcactagaaagcatttaaaatgctgctcattttccatagttagtgtggcttgattatctgacaaatcctgccagcagcctgtaggtctgatataccttatataacatcatctgcattattattattatagcagccattttataagcagataggaatatttaaataatcattatcagataatcaaatctaacatactcttaagggtaaattaatttaagaaaaaaattactattactaacatcatgattgtacaaccagttttacaattttgtacaacctttagttactaaatctgatttttgtgtatacttttcaaatgtctctttaatgcagtgtcttaaaacaaacataaatgcgcaagtccagcttgatcagtttttcagtagttttccagcctttcttgattactagaaaataaaaggaaagaaaattttgagaagaaagaaaacagtccacttaaagaaatctccctgctggaactggttctttatataccatatgcaattaagttattgccataggaagaaagtgggctgttttttgttctttctttgttttttttcctcttacaggaatccccttttgatttaaggccacaaacatttcccctccgttgtttgtccatttagctgctgcatatgtgttgtaatggttttccagaattagatctttgaagttacaatcttcattgcattccttctgttgaaacaaacaaacaaacaaacaaacaaacatgatccaaatgattttgagagaggctcaattaaacgaagagtaagcaggtaatatttggtagaattgaaacatacacaactttttttaaccctcagattgagcaggcctaatgtggtttattagctagacttatgtagtatatttgcattaaaaggtatcttaaatttgaaatagaaacaccacataatacacagctagttatgaaatatgtgtagctttttggaagttcatgtcaactattctttaaaattaggacctatttccccctaagtaacaggcctcatattactattcccacatcactcattctttaaccactggaaatttgctataattagcagaacctctgcctccctcaggtgagagacttgtttcacaacttttctttatttacttctacattgtcttcaatggtaatggaagataaaaggttaatttgtttgttcatccatgcaaccatttgttcattcagttaaacctgtatcattatacaattagcctgttccaggcattatgctgagctgtgggaatataaaggaaagccaattatattttattacagtgagatgaactgttacatattttgcattgtagtgaagtgggaacaatgtgaataattacagttcaaagcccatgattgtcagattgatattgatgaatgaactaaacatttcaagattttttcccaagaattctcatgtcagcaatgtgcaaattgagtgaactttaacaaaaagagctttaatactggcaaatggaaattttggattttaaatatctaaaatgcacatggaattttagagctggcaggatccttagaggtcagctaattcaactcattttacagatgaagaaaccaaaatccaaagaacaagccatttgtccaaagtcacacagaaaacattttttcttaatgtttgagtataaagtgttttaataaaatcattaaattatacagttggagataaattaagtccatttttacttttcagaatggtgagatatttcaacaaaagagttttaaaaattaagcctaagctatcaattatcaatacctttgcatagagttttccttcctcgttcgttgcaagatagaattcactttccacccctttgattgccacaatcccaactgctactgtcctgatttccatgatatctgcaaggaatcacagaaagacatgtcaagtattcgttcagctttgcaaatgatccacgaatggccgtttgttcttatttctgttttaatcggaagtttttaaaatttttaatgtgattatttactcagcccaagaccccgacccacaacagatacacacaaacaccagaatagtcattatataagggaagtgcaaactgacggttttttattttgtagaaaatatgtctgtatcaaataaatagttacatatttgagttcagctttttattctctagaattaaatttctaatttactataataataatagctaatgtttattgaactcataccacatgccaaggattattgcattgctcttatgtattaactcatttactcataaccacagattgaggcaggtagtcttgttatcccagttttacagatcaggaaactgaagcacagagaaactaagacatttgtccaaattcttatacctgataagtagcagaactggaatttgaacccagacattctggctcttaatcattatataattacttttctatttggataaactttatcttaaaaattattgccaacagaatagctcttgaatatactgaaagtgaagaaaattctaattaaagtaattgtaaatgatggtaaacagagcctactgccttaaaaaaaaaagattgttttaaactgatagtattttgatacatgaaaagaccatttaaaacaaaattatgaatcctgtttatataatacttcataactttatatctttgtaattaacttttaaatctttgttgaaatagtatttacaaaacatgtttacacaagaatgataacttactattttcctttattatatatatcttccttaaatcctgtgttttaatgacacaataaagtaaaatctcaagaaatttattaaaatgatgtaaaaattttagtgtacttttatgcaatttgctattaattacattttctacatgaaggtacagtcctgagacattcttttacctaagtctaacacagtgcaaagaaaagtcgaagtgtcaattatctgtgtgattgggccttcaaaagctatcttctaaaatattgacttaaagaaaaaactaattgttttgccccataccttcacttcattctcttatttatttttttgacttcatttttgctacctggataataaaatttctattcatgtcattgggatttaatgtagcctagctaatatttctcatttgcctcacatatatgttgcatacagaagcccttttcccaatatactatacttaacactagtcagagctcgtccagttgagtttcacagctactcatccagaaattgggttttattaagaaaatgtaaatgaatggatattaatctttttatatatttattaagcattatcacaaccctactgtgcatacaaccctactgtggttttaggacacaaattaagaaaaacagccctggtttctgacaccagaagttaaaacctaatagaaagagcagacacgtccatatattttgaagaattttgaagaacacaggcctgaataggccagataaaattttaataattgcttacaagcacatgaaggattatgatgttgatgcattcatgaaatgttcaacaggtcttcactgagagccaattttatgctaggctcaattcacagacaagccttgcccttttagagcactctatttggtaactacagcttcattgcattaaaggaagcacaaagggaaataacatgcagaagaatactattaggttaaatttgtacgaatacaatgaaaaatactgaagaagttcattgattcagcatatttgcaatacctccaaaatggaatgaatgtatcagttaggtcggtgcaagagtaattgtggcttttgccattacttatatgacaaaaactgtaattacctttgcaccaaactaatatttaaaagacatatggaatagttggtttctaaagatcttagcattgtaaaatatcattaaaaagtcaatattttcttttccttcaagtctctttactcctgccattcctccctttatttaatatattttcttttagataaaaagagaatgctgatgcacaagcttagagtgtctttcttgatcagttattagggactagaatctgtaatgtttgctggcttttcttttacagaacaattgtaaaacataaatgttgactgatagagttattattaattatgataggcagacatcttccctttttggtcctgtcatgacaataagttcatattgtcccactcccaaaacattttcctctatcccctgcctgtctattacccactgtttctatactgcactttacaagaggtgatggctggatgtggtagctcacacctgtaatcccagcactttaggaggccgagtcaggcagatcacttgaggtcaggagttcaatactaacctggccaacatggcgaaaccccgtttctactaaaaatacaaaaaattatccgggtgtggtggcgggtgcctgtaatcccagctactcaggaggctgaggcaggagaattgcttgaacccagaaggcagaggctgcagtgagccaaaacggtgccactgccctctagcctaggcaacagagtgagactctgtctcaccaaaaaaaaaaaaaaaaaattagttgggcatggtggtgaattcctataattctagctacttgagaggctgaggcaggagaatcacttgaacttgggaggcagaggttgcaatgagccgaggtcacaccacagcactccactctgggtggagtgaggctctgtctcaaaataatagttaaataaataaataaaaataaggtggtgaacatttttaatcttatccctccacatattagggttaaggataccaaaaattcttcgtaaagattctacatttggctgagatgagaacagacttatattcttaattgcttgacatatttaaaaaataccattcacactgggaaatcaacatatctaaaagacaattgcttggggagagcattaagcagtgttggcagaatcagtaccttatcgaccctattttctagtctattttgttccatgtcctacgaccctcttttattcaagaaaagctcaagaataaagaaattaacattatcactcttttgttcagttgcagtgtggggagtgatgttcctttcaatatgcacaaatatttatagaagtgttaaatatgggctgggcgcagtggctcacgcctgtaatcccagcacgttgggaggccaacgcgggcggatcacctgaggtcaggagttcaagaccagcctggcaaatatggtgaaaccccatctctactaaaaatacaaaaattagccaggcatgatggtgggtgtctgtaatcccagttactcaggaggctgagtcaggagaatcatttgaacctgggaggcggaggttgcagtgagccgagatttcaccattgcactccagcctggacaacaagagctagactctatctcaccaaaaaaaaaaaaaaaaaaaaattattaactatgaaatcctacccctccaaatcagaagccacgaagttgctcagaaaacataatagaaaaatatgtaatatgcagatattaagttagttaccaatataagttaattatacttggtttttttgtctacagtgtatccgttgcctcatataaaacaaatagaagaggctgtctttctttgtggatttccatttgtgcttaagagaagtttgttcacataaatagcactcagtaaatttattcccagagatttaaagcatattacatagatgcatccaattgttgacataatgtccatgataacataatgacagagttcaaaaatataaatgaaaaagagagagagaatcagctcatgcaatagaacatgaaaaaccaggcaatatgtcaagcacattgaccattttgccttgttagcaatattgtcaacaatagcataaatttattatttaggatgtcacccttacacactagagactatgccctaaatagcttccctattttttatcgtctggttcaataattcatgaatttatctaaactttttgtctgtttattatttaaacctgtgtcacacttggaatgaaaagtggggaactttgatctaaattgcaattactttttaaaaaaattctctaaagtctttcagaattttaggtgtccctctaatcttgtatttcagaagttgatactaattctttttttaattaccaatagctttgtgattttaaagtgctttaactttcctgtttgaaaaattactttttagtgtctcactacacagaatccatggccaccaatctcagcatcattaatatttctttttcctgaaactgttaaagccttatatttaaagttttgaaggggtatatattaatatggctgtgctagcatgatagctaaatattttcaagttgcaaaaaaaagtggaggcagcggtttgatagttagccagtcagaacatttaatcttgtccttgatcaaatataccctcttcggcatgttaaaactaagaactagtatcaacaaagaaaaaaacatttaaatttaaatacattttatgattttctgtcaagcctggattgttgagtgggaaatcttaaccattatatatttatattatgtttaaggctatagattccattcattttacatcactaaaatacaccgacatatacatatatgcaaaaaatatatcaatatatccaacatatacaaaaaacactgaaaacacaacaataggaaaaaaaaactagttaaaaagtgggcaaaatctggacacctcactaaagatacacgaagggcaaataagcagacgaaaagatgctcaatatcatagatcatcaaggaattgcaacatggatgcagccggaggccattatcctaagcaaattaacacaggaacagaaaaataactactgcatgttttcacttataactgggagctaaacactgggtacttagggacataaagatggcaacaactgacactggggactactggcggggagtagatgagggaagggttgaaaaaccattaggtactatgggcagtacctgggtgatgggagcaatcatacctcaaacctcagtatcacacaatatacccaggtaacagacctgcacatgaaccccctgaatctaaaataaaagttgaaattatttaaaaaggaattgcaaattaaaacaacaacaatgagatacctctatacaactattagcatgactaaactccaaaaaactgacagtgctgtatgctggcaaggatgcaaagcaaccaaaactctttcattactagtgggaacgcaaaatggtgcagtcacatgggaagacagtttggcagtttcttaaaaactaaacatgctatataatccagcagtcatgcccccaggtatttgcccaattgaattgaaaacttacgttcacacaaaaacctgaacatgactatttatagaagctttattcatatcatcaaaaaccagatgcaaccaacatatccaataggtaaatggataaacaaactatggtacacttatacattggaatattatttagcaataaaaaggtattgagctgtgaagccacaaaaagacaaggggaaccttaagtacatattgctaagtgaaagaaaccagtctgaaaaagccacatactgtatgattccagccatatgacattctggcaaaggcaaaactttagaggcggtaagatcagtggttgcaagggccttgaggagagcagaagaaggatgaaaagctgaatcacaggggatttttaaatcagtgaaactattctgcgtaatactgtaatagtggatagacgatatacatttgtcagaactcatagaactatacaaagcaaagcggggacgttagtataaattgatggtataaataaatattggctcatctattgtaataaatgtgccacattaatgcaagatatttataatggaggaactgtggggggaaatggagattgtttgtgggactctattatccgctcaatttttttttttttttttgagacggagtctcgctctgtcgcccaggctggagtgcagtggcgcgatctcggctcactaaaagctccgcctcccgggttcacgccattctcctgcctcagcctccccagcagctgggactacaggcgcccgcctccacgctcagctaattttttgtatttttagtagagacgaggtttcaccgtgttagccaggatggtctcgatcttctgacctcgtgatccgcccacctcagcctcccaaagtctgggattacaagcgtgagccaccgcgcccggccctttcttttattttaataaaataactacctaatttatgacagtaggaaagtaggatctggtgttctctgagcttctttgatttgtgggcaggtgtctgttgctgaattttaaaagttctcagccatcccttttttcttttcacattctgggtgaatgcagttttcatagaaggtgctagatttgtgcaaccctaaagataggtgactcctctgactcacagatccctgggagcctctcccgaacagagtttctttatccacacaccccacttcccacacccactcttccacataggtgttctggccaccagtaatctctgaaggatggaagatgaagagacatgacttttacctgagtctctactcctcccaagagaatgaatgttcctggaaacttaaccaacagaaaatcaggggatatcaatatatgtaagcactcattactcatgtaatggaggccttggcaaaatgtgacacgtaaatttctgctcagggagagtagaaaataggcacagagactagagagactggtaaagaatgaagcctcaaaggtgattgagttgtgttaaaggaacgtcttgatcaggctttgctttatttttctcttgtggagtatgaaactgggtgttacaattaaatatatttcttgatttcctaaaatgttataggctgtttccaatttttgttatttttggagtttcttaaatcgaaatttgattcaggataattaaaaaatataatgttaatgttaagatggaaggtaggtcaaaaggcaatcatgttaaacaagaggagaattggagataagaccttgaacacgaaagtattcttaaattcttgactattatgatacagtttgcataaacaactgagatttcttcagaaaactatagtgaaatgggacactacaaatcaaatataaatttaaaaatgaacacatttattcaatacatatccatagattattctggattaaatgtacacattttaagaataaagttttaaatttgaaaatgaaagactgtttcccatctaaacagaccgttggcttcaagatacttacaactgtgttaaatcatcttccattggttatagttgattatggcatgggcatccccaaatctggctgacccatactacgtttttcctaaatctcttttttcttctgtatcttgctaggctgctggttcatcctcccaatttcctgtatttaaaaccccagtgccatgtttgaccttgtcctttctcttctactgttcacatcttctgtctctcacattcattccaacctacacatcccagtggcctattcctatttaagcacccaaccccctctctcctgaatgaatgcagaaaactttctcatctctggactcatagcaccacagctatttttacacatgactgtcagatgtgtggagttcttgaaccatagttctgtggtgtcatcattcattttaaaaattttgattggctccctattacctagaaaataaactttagtatcctttgctcaacatgtgaggccctccacaatctaatttcacacactccaaaaccttatttctacctactctcttccaaggaccctgaaccccacattccaggcaaatccagtcattgaacacttacataggccatcagaagtcactgcaaaaccaatccggtctgactcctatgttgtttagtgctctatcccctttgtctgaaatggctttccctccacctctatttttatttactggcaccttccacagctttcaacattcagtttgtcatgaaggcagctgttatagactggactagaagactgtgaactgaattggtggtttccaaatcagtatcacacttgattcccacctccagaaattttgatagagggggcctggagtagagccaatgagtcttacacacacacacagacacacacacacacacacaccccaaaacaaacacacacttaccctaatgactatctaggtgccagccctagcctagaccaggctggtggaacatgctggattaaaaacaacaggacactgagaaagtatttgctacacagacatatgggatttgaccatgtgttatttacagataacctaactcattggagtaaaacctatcttaaattggcatatggtataggatatgttgtagcattttattagtgaacatttgtaaggttttatttgtgaaagctaataagactgcatttgtgaccatcacaaggaaaacagataaaactgtatttgtgaccatctcaaggaaggtgtgtcctatgccatgctcacctgccaagctggctgcagtcccttcctctcctgacttcactttgcccctaaaggtatctctgttattatactcatggctttccattttctaatactgtgtactgatcatttcaacacatgccttattctctaaacagactgaaagattcattaagtatctgaaaagcaaatgctgatgaacttgcctaaaataaaaagcatgaaccatgcaagtttctaacatagattgtagcagccaccccacatgactgcaatcgcctccccattgatctcccggctgacacattctatgtatttgtaactcagcaaccagagtgatcctttaaaaattatcagagagcaccactcctcttagtaaagcactaccccaccccagtcacgtagctttctgattcacaggagtaaaagccaaagtccttataatggcctaaaaatcgtacataatctgttccttttcagatttcattcactaccatcttcccccttctctctctgttccagttacaacagcttgccccctcaaacacaactagtatgttcctgccccagggcctttgcacctgctttttcctcttagagcaacaagtttgctccagatatctgaaaagctgactatctcgccaccttcagatgtgtgttctaatgtctctttatcaatgagagcttctttgtccaccctgggcatcttcttgcccttccttgctttattcttccccatggcacttactcacattggacactaaacacttgtttccttagctaggcattcttctcctaccctcacaacagtaggaatgtcctaaggttttgagaagactcccgtgctaggtttccagactcctgtcctctcacatttggtgctcatgcacctcttggtcattagtgcactccagaggttaggacctagagtacgtggctgtccttcagaggagggaaagggattgcttgggagcagagaagggagctttggcctcgcagtgcaggacccctgtgcccacaggcctctgtgtgttgacagcaatgctcttggtgtccacctgcactgccctctggtgttcagtcaaaatcaagcaaatggttacgaactgctataggggattgttaccaggtcctgagtctgtgttggaaacacaaacccagaagcaaacaaatctgcccaacacccctgacacgtgggtttcacagaaaatactgaggtcagagtagcatgttaaatgacaccacagtgacaacacaatcataaaaatctacactgtggactctgtcctagtttctttaatgaattgcatggaaaaaaaaagatggaaggggaagaataagaatgaagaatgctttagagactctgcaatccatcgtaatatccgtacaaggattctgcttttttaaaaaaagaaaaatggtgtgaaaaaatatgtaagactggccaggcagcgtggctcacacctgtaatcccaacactttgggaggccgaggtgggtgggtcacttgaggtcaggagatcaatcctggccaagcctgaccaacatgccaatatggtgaaaccccgtctctactaaaaatacaaaaagttaaccaggcatggtggtgggcacctgtaatcccagctaattggaagctgaggcagaagaatcgcttgagcccaggaggtgggggttgcagtgagccgagatcttgccactgcactccagcctgggtgacagggcgagactctatctcaaaaaaaaaaaaaaaagtaagacaatcagggaaattggaacagcgactggattttggttaaaagtaagtaattctggctaattttttagatgtattattttaaaaaggggatccttaccctttggaggtggatactaaaatattcatggatgaaatgataggatgccagaaatgctcttcaattaatctatgtcagggaagtgggatcagaggaatcaggactgtctaaaactgaagctgggtattaggtcaatgagttaattatactattcattcattatgctatttatttccttttgtatattctttaaatttttcataataatagtaataaagatatgttgaacatggtaaagatggaaaatgtacagagacagaagaaatattcttattttttatttcatacaattctatagtttcacattttgttttgttttactgtatttatgcattaattctataactgtaaaacatggtattaataattaaactgaccttatgaaaatttttggagagtgaaaactttgaaactcatgtgctaggtacatcattaaaatttatcattcaggtgacacctgatgactcacatctataatcccagtaatttgggagatgaagataggaggctcccttaagcccaggagtttgagaccagccctggctatatagtgagagcctgtttctacaaaaaaaaaaaattatttttaattagccaggcatggtggcactcacctgtagttccagctactcaggaggctaaggtcagaggatagcttgagcatgaaagttcaagactgtagtgagccatggtcatgccactgcactccagcctgggcaacagggtaaaaccatgtcttaataaacaaacaaataaatacataaatacataaataaataataaagtattccattcaacatttttaccttagtaatgctcaacatttggtttctacttatttccttttatgttgtattttctagaccaaattcacatatagtataaagcagaagaaactaatgattaaattcattgttcgtaattgtattcagtttcctattttcatcaacatttgtttacaaattttttttttcttttttgagacagagtctcgctctgtcacccaggctggagtgcactggcgggatagctcactgaaagctccgcctcccaggttcatgccattctcctgcctcagcctccggagtagctgggactacaggtgcccgccaccatgcctggataattttttgtatttttagtagagacggggtttcaccgtgttagccaggatggtctcaatctcctgacctcgtgatctgcccgcaccggcctcccaaagtgctgggattacaggtgtgagccactgccccggtctgtttagaaatatttttaaagaattattgcacttctgttcggatagaaaaacaaaaatacattttaagaatatatatttatatgtatgaaaatataaaattttgaaaagttgaatatttcaagccaattatgtagatgtccttgtccttccctgagctgctgactcacgttccacgaagcgggatgggtctcacagggcctgtcaggatgcaggctgtgatgtgaaggccactcgaatctcacaggattggacgggtttgtgaaggaatttggagcgagccttagttagctccttaacatttcctttgagcaacatcagtgcttttgacattttgcactgccgtataaaactgtaagtgtatgcagagatgtatgtttctgaataaatcacaaaattgacaagcaactgccatgcattgttttttgcatcatagctaactgataaagtacagactgcaacatttacttattcaaatacctttaaagatctggtatttttttgcttctacttcccaggaatttgacctcagggacattttctattatttccatatctattgaaatgaactcaaatcaaaaatgagaatgtttcattatacatttaaaatgtgagttttcccatttaaagtcacgcaaactgaggttactacgaaaaagatttaaaattgtgcagaatgaatcactgaaaaattagtttattctaaagatcatatattcagagtaaatatatttaaattttattcagtttcctctttgtcagcaaattagtgaataacattactgatatcttagatgtttgtggacacaaagagaatagaggtaaaaatcatgaccctcaaagagctcaaaatcctaagatttttatgggcagccccagaggtataaaattcaaaaggacattacttctccattcctgattaggtacgcaatgttctggattattcatggctcttggatacttgagagtaataatgacagtgacctctgaattaacatagttcaacttttataataattatgaccttcaaccatgtgaagtttgtggagcactgagatttcttggggcaattttgtaacagctaattcttaacagcaatgttatttcaggctttttggacattccctgttacaactgctgatcttttattcctataatggtacagaattctttgagaaaaataaattcatcttttcattcatttaagggaaaattgtcagcacgagcctatggctataatgttctccatcatttaaagaataaaaggaataatctggttgaaattgaattatctaaggttacatatggttttgattcaatggttaacgtgcatttttaacaagtgatatggtttggctgcaacatttacttattcaaatacctttaaagattttttttttttctgcctgtacttcccaggaatttgatgtcagatgcattttccattatttccatatctattgaaatgaactcaaataaaaaaatggggatgtttcattacacacttattaatgtgtaatttaagattaatgtgtaatcttgtaattcccataatcctcatgtgtcaagggcgggaccagatggacatgattgaatcatagaggtggttttctccatgctgttctcgtgatagtgagttctcacaagatctgatggttttataaggggcttcttccttcactcaaaactcattgtttctgctgccaccctgtgaagaggtgccttcggccatgattgtaagtttcctgaggcattccaagccatgtcaaactatgagttaattaaacttcttttctttataaattacccagtcttgagtagttcttcataacagcatgaaaacagactaatacagtaaattggtaccacagacatagggtgctgttataaggatacactaaaatgtggaagtgactttggaactgggcaacaggcagaggttggaatagtttggagggttcagaagaagacagtaaaggctgggtgtggtggctcatccctgtaatcccaggactttgggagaccgaggcaggtggatgacctgaggtcaggagtttgagaccagcctggccaacatggtgaaaccccatctctactaaaaatataaaattagctgggcatcgtggtgcatgcctgtaatcccagctacttgggaggctgaggaaggagaatggcttgaacatgggaggtggaggttgcagtgagcagagattgcaccactgcattccagcttgggcaacaagagcgaaactccatctcaaaaaaaaaaaaagaagacagaagaatgtgggaaagtgtggaacttcctagagacttggagggcttggaagacaagaagatgtgggaaagcttgggacttcctagagacttgaatggcttctaccaaaatgctgatagtgacatggaaaatgaagtccaggctgaggtggtctcagatggagatggggaacttgttgggaactcggataaagatgatttttgattctcctgcctcagccttctgagtagctgggactataggcacaggccaccacactcggctaatttttgtatttttaatagatacggagtttcaccatgttgtccaggatggtctcgatctcctgacctcgtgttccacctgcctcggcctaccaaagtgctgggattacaggcatgagccaccgcgcctggccaagtgaggcgttttaaacagcgcgtggttccaagtaatggctcagaaaagttagctattagaattgtaatggttgttagtgatgtttgccattttctttaagaatttcacacttgtatcaaaaaacagtattaaaaaaactatacaatcatttaatatataaaaaggataattctttgtagtttaagccataaaagttgcatccaaacatagatttaaataacctcttctccccacctttaatagtctttcaaaatatcgcatgtgctttttatattgtgaaaagaaataaattaaatagtcatacttacatgattaaaagttattttcatgtacttcgggaatttgttcatattagttacacttcaagttaatattacatgtaatattaaatgtacttaatattaaaagtgcatttaaaatacttgaatgaaaataaattttcataatcaaataaatcccagcactgattcaagaaaattataccaccatgctcatactaagaagacactgaatcaaagcagaaacacatgccttaatcgttgataagtgaagccttcagtgagtatcaaaaataaaagatagcaaaaacagaataattactacactaatcatagatgattggcaaaggtaaacataacaaatttctagtaaggagctgcttcaaagagtgatctttatgcgggaaaactccagcctggtgcctttgggatcactgatttcccttgctgggagtacttgcggtgaaactaataaaatcactgaggtgccacaagaaaaataacatgggaagaagctgaccaccgagttacagattcatgggaaagacatcaggaggtcatttccctcatttccttgccttgagattaatactcaagtcatcaacgctaaataaatatttcctgaaaataaagcatttctaggaaaaaaataactttgagaatcctcatgttggtataattgaatcaaggacagatgtgactaacttcagaagtctgttgttcttcctatattcagtccagcaaactctcagcaaagcccccagtgtatgaagaatatgaaaaaggagctctactagtagaatttgggactgagagtccagagttctgatcttttggcctgtgccttctaatgccctttcaccccacttcatctaaggcaaccctagaaattgtcaaagaaaaacagcagtgctggatacttgctaaaggcaatgagacctattgtattcagactatttcagcaggagggagagacttcagtataaactaagctcaactccaagtaagacaaaggaggctgatgtttttaaaaagagaacaaatgggaaataaaaagaaactatggaaaagtaaaaagaggggaattaaaaaagggactgaggactacgtgaaaatgcaaattataaaagggggtaagagcctggcacggtggctcacgcctgtagtcccagcactttgggaggcagaggcgggcagatcacgaggtcaggagatcgagaccatcctggctaacatggtgaaaccccgtttctactaaaaacacacaaaaagttggccgggcatggtggcgggcgcctgtagtcccggctactcaggaggctgaggcaggagaatggcgtgaacctgggagggggagcttgcagtgagctgagatcacaccactgcactccagcctgggggagagagggagactccttctcaaaaaaaaaaaaaaaaaaaaaaaagagcgggaggtaagtagagaattactgaaaatgatttgacatcatcggttacgacaatatacattatgtggtttggtagcattgtattttcttgagcaaagactcagcacagggcctggggttaactactccaagtggcagccaggctaatgtttggtcaagtctcttagcacagtgtttaggcaaatctttttggcttcagggaagttcacagtccctcctcttgttcaagagaaagaatgaatttctttctcatagaataaatatagttgttgcactccaaagtcctcaaaagaaaaaagttcagccattgtttatcaccgttgtgcaattcaggaagagtcaaggtggtaaatgcaagaatcgaggtttggcgtattatcaatggcggcacaattgtctcataagaatagagatgcacttggtgggtcatgcctgtaatcccaacactctgggaggctgaggagggcggatcacgaggtcaagagatcgagaccatcttggccaacatggtgaaaccttgtctgtactaaaaatacaaaaattagctgcgcatggtggcacgcgcctgtagtcccagctactcaggaggctgaggcaggagaatcgcttgaaccgggagggggaggttgcagtgagtagagatagtgccattgcactccagcctggtgacagagtgagactctatctgaaaaaaaaaaagaagaagaatagaggtgtacttaagagacaaagaatattgccattaaggatgtttttaagaagccaagtccaagatcaaaaaagacaaaggagagcattacataatggtgtaaagagttcaattcaacaagaagatctaactatcctaaatatatgtgcacccaatacaggagcacccagattcataaagcaagttcttagagacttacaaagagacatagagtctcacacaataacagtgggagatttcaacactccactaacagttattagatagatcaccaaggcagaaaattaaaaaacatattcaggacctgaactcagcattagatcaaatgtatctgattgacctctacagaactctccactcaaaaacaacagaatatacattcttctcatcaccacatggcacatactctaaaatcagccacataattggacataaaacaatgcttagcaaatgtaaaagaaccgaattcttaccaaacacactcttggacgacagtgcagtaaaaataaaagttgagactaagaaaatcactcaaaaccatacaattacatggaaattaaacaacatgtttctgaatgacttttgggtaaataatgaaattaaggcagatatcaagaagttctttgaaaataatgtgaacaaagatacaacataccagaatctctgggacacaggtaaggcaatgataagagggaaattcatagcactacctgcccacatcaaaaagttagaaaaatctcaaaaagttagaaagatctcaaattaacaacctaatatcaccactaaaagaattacagaagcaataacaaatcaaccccaaagctagcagaagacaagacataaccaaaattggagctgaatggaagaaaattaagacacaaaaataattcaaaagattgatgaatccaggattatttttttgaaaaaattagtaagataggccaacacctagactaataaagaaaaaaagagaaaaggtccaaataaacacaactaaaattttgagacccggtgtggtggctcatacctgtaatcccagtgctttgggagactgaagcgggtagatcacttgaggccaggagtttgagagcagcctgacaaacgtggtgaaaccctctctactaaaaatacaaaaattagctgggcatggtggcacacaactgtagttccaactactcaggaggccgaggcacaagaattgcttgaacccaggaggcagagcctgcagtgtgccaagatggtgccactgtacaccagcctggatgacaaagcaagactctgtctcaaaaaaaaaaaaaaagaaatgaaaggaatgctaacactgactgcacaaaaataaaaataatcaaataaccactaaaaactactctgaacacctctatgcacacaaactagaaaaccttgaaaacatggataaattcctggacacatatacccacccaagactaagccaggaagaaattgattgcctgaacagaccagtaacaagctccaaaattgaaccagtaacaaatagcctaccaaccaaaaaaagctcaggacctgatggattcatagctgaattctaccagatgtacaaagaactggtaccattcctagggaaagtacccccccaaaaattgagaaggagtgactcctctttagcacattctatgaggccaccatcatcctgatactaaaacctggcagagccacaatgaccaaaaagaaaacttcaggccaatatccttgatgaacatcatgcaaaaatcctcagcaaaatacttgcaaaccaaatccagcagcacatcaaaaagctaatccaccatgatcaaatagtcttcattcctgggatgcaaggttggttctacatatgcaaatcaataaatgtgattcatcacataaacagaactaaagacaaaaatcacatgattatctcaatcaatgcagaaaaaaagctctagataaaatttaacaccctttcatgttaaaaactctcaataaagtaggtgttgaaggaatatacctcaaaataataagagacatctatgacacatccacagccaatatcactttgaacgggcaaaagccggaagctttttgctcttgaaaactggcacaaaacaaggctgccctctctcaccactcctattcaaaatagttgtgaaagtcctagccagagcaatcatgaaagagaaagaagtaaagagcatctagataggaaaagaagtcaaactatctctgtttgcagatgacatgatgttatatccagaagcctcattccttcagcccaaaagctcctttagctgataaacaactttagcaaagtctcaggatacaaaatcaatgtacaaaaatcactagaattcctatacaccgacagcagccaaaacaagagccaaatcagaaaagcattcccactcacaatagccacaaaagggataaaatacctaggaatacagctaaccagggaggtgtagaattctctacaatgagaattacaaaacactgctcaaagacatcagagatgacacaaacaaatgaaaaaatatctcaggctcatggataggaagaatcaacataattaaaatggtcataatgcccaaagcaatttacagattcaatactattcatatcaaactaccaatgacattcttcacaaaactaggaaaactatattaaaattaatatagaaccaaaaaactaaggcctgaatagccaagacaatcctaagtaaagaggagaaaagctggaggcattatgttactcaacttcaaactatattacagggttacagtaacaaaaacaacatggtactggtacaaaaacaggcaaataaaccaacagaacagaatcaagagcccagaaataaggttgcacacctatgaccacctgatcttcaacaaagctgacaaaagcaagcaatggggaaacaattccctatttgataaatggtgctgggataactggctagccatatgcagaaaactgaagcatccactcttccttacaccacccttccttacaccagatacagaaatcaactcaaaaggattaaagacatagtgtaaaacccaaaactatgaaaacccatgaagacaaactaggcaatatcatcctggacataggaataggcaaagatctcatgacaaagatgctaaaagcaattgcaacgaaagcaaacaatgacaagggggatccaatttacttaagagcttctgcacaacaaaagaaaactatggacagagttaacagacaacctacagactgggagaaaatatttgcaaactatgcatccgacaaaggtgtgatattcagcatttataaggaacataaacaaatttcccagagaaaaacaaacaaccccattaacaagtgagcaaagaacatgaacagaaacttttcaaaggaagacacacatgcatccaacaagcatatgaaaaaaacttcaatatctatcactaatcattagagaaatgcacatcaaaaccatagtgacatactgtctcataccagtcagaaaggctattgttaaaaagtcaaaaaatagcagatgctggtgagaatgcagagaaaaaggaacacttagacacattggtgggatgtaaattagtttaaccattgtggaaagcaatatggtgattcctcaaagagctaaaagcagaactgctatttaactcagtaatcccagtactgggtatatacccagaggaatataaaccagtctaccataaagacacttgcacatgtaaatgttcatcgcagcaatattcacaatagcaaagacatggaatcagcctaaatgcccatcaatgacagattggataaagaaaatgtggtacatatacaccatggagtaccatgcagctgtaaaaaagaatgagattatgtcgtttgcaggaacatggctagagctggaggctattatcctcagcaactaacgcaggaacagaaaaccaaatactgcatgttcttacttgtaagtgaaggctaaatgatgagaacttattaacacaaagagggaaacagcagacactggggtctgcttgagcatgcagtgtgggaggtgggagaggagtggaaacagtaactgttgggtactgggcttaattcctgggtgattaaataacctgtacaacaagaccccatgacatgagtttacctttgtaacaaatcttcacatgtacccctgaccttacaataaaagttaaaagaaaaaaaaaaaagccaagtcccttaaaaagtctcctaagccatttggctggggaaaccattttctccttagagactaagcctgtctggaggggcgtgagctatgttggctgcttctcaggcacgtgctgccacgacttcttgattcatttctctttatcattcatgaatgaaaagcattgggaactcaccagtgcacaagcaccttcttgaaaactcagtatgtagtctaaggcgagctagttttgtaaagtcattttagaagctccaatacctcatggatttatgaaacaaaagcttatattaagtttgagatgaactctactaattattttttaaattattatttcaatagcttaaggggtacaaatagtttttggttatatgaataaattgtatagtggagaagtctgggcttttactgtatctgtcaccaaataatttacagtgtacccaagaggtgatttttttttatccctctcccttcctctctgagcctccaatgtccattatgcccctctgtataccttgtgtacccatagcttagctcccacttatatgtaagaacatgcagtatttggtttttccattcctgagttacttcacttatggtaatggcctccagttccaagttgctgcaaaagacatttgtgtgcgtgtgtggctaagtagtattcctttttgttgttgttgttgagatggagtctcgctctgttgcccagcctggagtgcagtggtgtgatctcagctcactgcgacctctacctcccgggttcaagcaattctctgcctcagcctcccgaggagctgggattacatgtgcccgccaccatgcccagctaatttttgtattttcagtagagatggggtttcaccatcttggccaggctggtcttgaactcctgacctcatgatccacctgcctcggcctccccaactgctgggattacaggcgtgagccacctggctgggcctgtagtattccattttttatatgtaccacattttccttatccactcctccgttgattggcactcagcttgattccgtatctctgctatcgtgaattgtgctgtgataaacatccatgtgcaagtgttctttatatataatgacttcttttccttgggtagataccagtagtgggattgctgattgaatagtagatctacatttagttccttgagaaatctccacatcgtttttcacagaggttgtactaattttcattcccaccaacagtgtatgagcattctctttcaccacatctgtgccaacatctgtttttgtttgtttgtttgtttgtgttttaaccttttggctagggtaagataattctgactagatggtatctcactgtgattttaatttgaatttccatgatgattagtgatgttgagcatttgttcatatatttgttggccgtttccatatcttcttttgagaaatatctgttcatgtcatttgcccactttttagtaggattatgtgttttttttcttgctaatttgttggagttccttttagattatggatactagtccttcgtcagatgtatcttacagcataggagttggctgacctggtgacaaagggtagaatatcaagaacagagcaccctgtaagtttggcctgagcaagtggctctccccggacctgtttaaggctgtttgtcatccagccattatccattcacaagtttcaggctcagcaattgtaggagcactcatgtttctaatttttccattgggaaatttttcatacatttccatttgagggacagcataagccacatcgcagcagccagcccaatgggctggaagtactttgtatggttttatgaccacatactaaataatgtcccttgagggcatactagtgttggttattgcctctagtggttgtaacagaggctagaggagctaacctggaatagactccaaagagacagttacaaacatcatcttctaaatggctgggtactttggtaccatttagccagcaattttttgcccagtctttcagttcaccaaaatattgatccggggtaaaataatttcctatgatactggtattgcgtgggtattgcagacaatgctgtccttaatgggagtttggctcttacaaagaatgtctgtttcttgaaaataggtttcatcttttcacaaggacacagagcatttactgtgttccacagggtgactatatttattagactgatttctagtaaaacaccacgtttcttaggttaaagaggccacatcatactcccagtcacaagggcttttaagaaataacccaatatctttctaaaagggagacctaaatggctgtatatttgtaatgttttctgccaaggccatctaaagcataagggagacaattattaagggaatacgagttttaggatagagtgggaatgggcatagacccggcaattactttggttaatttcattggctactttgtcagctaagagaccgagggaattacggtcatgagaggaaagcacgggatagggtaagataaggaggaaacagaggggaatcatgacagggctgctgaggctggagatggagtatatatgttgtaagtaggacacatcactaggataaagatgggacgttgtagaggacacaggagtagtagcagaatgcgtagacccaaaattgaagtcagagacaaagaaggggaatcggagtgaatcttgtttcaggatctttggcagaagcggactgcttcatcatatcatttacttgctccgtagttcttaggatggatgtctgtctccagctcttggctacttttagaggttcttttcttttctttcctttccttttctttttttttttttttttttttttgagaccgagtcttgctctgtcacccaggctgaagtgcagtggtgcaatctctgctcgctgcaaagtttggaggttcttttttttttttttcttttctttttgagattgagtcttgctctgttcccaaggctggagtgcagtggctcaatctcggctcactgcaagctctgcctcccgggttcacgccattctcctgcctcagcctcccgagtagctgggactacaggagcccgccaattagcgcccggctaatttttttgtatttttagtagagacggggtttcacctgatggtctctatctgctgacctcgtgatccgcccgcctcggcctccgaaagtgctgggattacaggcgtgagccaccgcgcctggcctggaggttgttcatagagtctcagcgtgagtctctggttagagtgccttccaattgaaatagattttgtattttttcaactaaaagacatgcacccaagttcaaacactctgtaatttgttagcagtgttagcaatgagtgaaacaataaaaggtcccctccctctgggttcaaggttagttttctgatgttggtgttttttcaaaatgccagatcacttacttatgaagcaagtaaggactgatcagggagtttaaagatacaagaagcctcaattgtggagtatagtggggctgtgtgtatttaattaatccctgacaatatctgaggttgttgaactgagttagtttggaatcttcggctagtttgcattagtaggttattctcatgggtatcccgtaatgattcaaagaggatcgtttgtgtgaaggtagggccaaggatctgagagtcagtgtgatgggtaatatctgtggccatggcaagttctttcttcagacagtttagccagttcagcttgaggatgctgttggctctttgtatagaactttatcactgaggatggtaagtccagtggaatatttggctggtgtgtgtaacctttcctatttcctgaataattttgccagtgaaatgtgatcctctgtcactagaggcagtagaggggataacccatgtggggaagattcactcttaataaaccttggcaaccgatgtccttgaggagtttcaacagggaaagcctcccattctattttccagtgaaggaagcctattttccagtgaaggaaggatgtagagggagccacttcccttttttgccccacctttatgctttttggaggattatgttgttggtagatgcagcaaatggcaacagcttggtccaaataaaatctaaagagtccaagccatattgttttgtttaatatatactacatgttatcctttctgtggtaaatctggatgagcaaattgtacacaatgacttgggagacagacttaggagttatcaaatggccatctgggtatttctgaagtccacttaagtgggtcaaacattcacctttttctcatccaattctttctgactctgaaattgttatctgggctgtgtgaattttacatttcctttagaggcattgtaaagacattgcttctgtcaatttatttaaagagggtaaataatcctagcaggactgtgggtatttgaaatgaagcccaggtatctagtcacaaggtttggagacttcctggatttcttaggcggccaaggaagaggatgctagcttagcacctttatcagccaatttatttccctgagcctcatctgagtattttatactatatccctcagctttaactgtaacaactagctggggcaatagcaatgactctagaagttctgctatttggggtttacttttgactggggacaagttgctgtcatgaatcctctctgttttcaaaacataccaaaatcatgcactacaccaaagacccagtgtctgtcactgtaggtgctaatcttaattccctctgccttatataagcctgaatgagaacagttaatttagccactttggctgatttaacgtgtggcaaagcttggcattcaagagttttgtgtagatgagtgatggcatatccaggctggaaggtcccaacctccttccagaagtaggagcgattgacatagagcatcaggtcgacttaggagagaagggtttctgacatatctaacctaaatgagacagtgatctggtttcagtagcaccattgtgtgtgtgtgctgaggggttcccttagtggacaaaatgtacagggtagcaagggatttttggcagcaaaggattgtgattgggtggggaggcatagtaatatttcatgagaagtaagtcgagaagcaaacgagtgctgtgtgttttcattaagtaatagggtcaacacagcatgggaacatacacatcaagtgggcggcctaacactaaatcagaagtagcctggatgagttggaagtcatggccactgtttgtaggccaggaggatatgcttcagcactggctggttttgtgggaaaacagagagaaagacatggctgagtctcatggtgctcagagaaggccacagccttggggtgccgtggtgaccacaaacacttcccccatcccataccaatctttaagagccttttccttcttaaagacctgtcacttagcaaagagctttcaatgaaccctcccctctgggccacttgttggattgcagccaatcagtgatggagggctggacacaactgtgggatgctgtgatttggtttagcccttgggtctagagtgctctggggtccactgtacttctgggataaaacgccaaggccacgactctcttgctcatttacaaacaaaaaattgagggctagctaaacaaggacagagtggaagcagctttctgtaagacacacccaccagtgtgccctgtcagtttaccattgccatggcaacactcaggcattaccacccctttcagcagcaatgacctgatgacccaaaagttaccacccttttcctagcaatttctgcacaaaccacccctgaatctacatgtaattaaaagtaggtatacatatgacagcaaaactgggctcagctgctactctcggcaccctgcctatggggcaaccctgggagcagtcactgagctgtgaccctgcaggagctgtaacagtgctgctttgataaaggtgttttcttccaccttaccactggctcgcccttgaatcctttcctgggtgaagccaagaacccttgcaggctaagcaccactttggggttcgcctaccttgcatcagcatcaggttttttttttaaacttgtaaaatagtttttgtgactctgtcatgtattttgcagtcatgaactaatattttttccctcaattgtcagttgcagtttcctcaaagatcattataaatactccttaacctacaaagtttggcagtcacagcctactctttgaggaacagcctgactcaccatcaagtggctcctcaggtggttttacttcccatgtttcccatgtgaggtactaagcctcagtgattcctggcaaaacttgtattctctgttagtattgcgctaactttggagtgagtttcttttggtgagtaataattttagtcaatgatactactgattattttatctttttttaggcttatgatgaatacctgatttatgattagtatgtttttcacttttacacatttcaaggaaggaaacaagaacagacagaaacacaacatacttcatgaaaccacattttagcatcctggccgagtattcatcactcagcaagatagagagacataaactatttctagcaagaatacttcataaatgatgaatagaagaaaaatagaagtcctaaaaatcttgcagaactgtcttaatttactaatatatttacactgtatcctaagtcactctctagcttcttgctctaagcatatgaaatgtaagagctaatgggaaccccagtgcctgtataaataacaagaaccagcatgtctttatttatggcagggaatactctacaacctgggacagatgccactctgcttcagtttggggaagctcctcactttaccatcctgacgttgaataaatgattcaaaggcaacctgatgcaacctgagccactggatggcttctgtaaataaagttatctcacctggcattcattacagagaaaacaagaaataaggcactacatgtcatatttgtctagatcctatacatatttaggttcacattaaaatgaagagaaaacaacataggctgagaatcagaaaacctgaactctgtcccagctcagctactgaccaaagagaattaatgaatcgctttaaatgtcagtttcttcattaagcatcgtagagaatgtcaaaaccaagtttacaaatactgtcattccaaaaccacacaactcaaatataaataatctttataaggtaacaaaaatgtacataatactttacataaacatttttagaataactttattataactcgataagcaaaataatccaaacctttatacatttctacaaggatagtcatgtatgtcaatttttgggtttcctctcgtgcctattttgtctcctgagccagcccctttccagctgacacatgtgctccgtgttctcccacaatagcctgatctggcctgagtccacgcccctgtgagcctcctttctttgcttacaacagcagcctgcctgatgtcagttatggactattctttttttcagcctcgtttcagggtcccctgcctcttagagctgctgctgtagcttagctagagacccgctgctgttgcatcatggaaaagtgccacatatgtgcacatgtgaaagaatacgcagaccttcatgttgtgttttagttttagaaaaagtcagaagtagcttcacttgatttcagcttgtaaagacataggagggaggcaactgggaatcaccgttgcaaaaagcaaacatcaaaaatcacattaaaatgctgaagtgttgtggagcacaaacctagctttattggatcaagcatttgtgagagttcttctacttgctttgttatgctttctatcagacagggctcattctctgtctttttttttaacatattcatttttttcctttggtctgtttagattattatcacatcttatgttttaaaactagcaaaatattatgtgtaagtcatgaagacagtgtaagaaataataaaatgaacactgatgtacacattacctgcctaagaataaaaaactacccgtatttttagagtccttaacactgtcctgttaatgagtcccatttcttatctttataattttgccaaaataaatgcattagtaaaggacattgagcattattgtttcacatatttttcagtttaaacaaatggaatcacactgaatatatttttctgaaattgctttttggttcaatatttaatttgtaaaattcattcttatgatatgtttgtctgtactttctgtgcattgatttagagtattccatcacaggataatactataatgagcattccattttattagattggggttatccatttttttctattacaaaactagatgtccttttcttgtatgagtctcctggacataaaaggtagattttctctaaggtaaaaacccaacattcaaataattgtgtcaaaagatttgtatactgttggttttactacgttaaaatgaactgttttccaatttatgctcccatgagaagttaaaggttctggtagatctatattctcaacaatacttaatagtatcaaacgttttaacgttagtcaacttggtttctcatttgaattgtaatctgcattttttagaagtactgaatcaaggtaagaatcaagtaatgaaaaactattattttagtaaataaaaatgctgtaaagacaataaagcaaatgaatgtaatcaaaagtggagacgggctacttcattctgatagtcaaagatggccttgctggtcatctgagttgagaggtggctagtaagacgagaagagatgttaagtagctgtggaaggggcctgctggcacagggcatgctccaaagccctgaaaagaggcaaacattctttccctctaaatacctgaactaagtaaaaacagtcctggctttgcacatttgaatatgcacaggtttaattaacatagtttagttaaatagcactagtctcccaacaacctggttacaatttcggttaccaccatatgctaactgtgagcaactgcataaaatccaaacttcattcccagctcttaattccacaaatgcctgtgtgagtaaataacagacaagcatcatgatcagggactgtattaatcttgtggggatgctgcaacaaagtacaaaaaaccgggttgcttaaaacaacagaaatgtattgactcgtagttgtggaggctagaagtcaaaaagcaatgtgttggtaggttcatgctctctgctggctctaggggagaatccttcttcccctctccttcctgtttgggtttgccagccatccttggtgttgtttgacctacagatatgtcactgcattttctcagtgtgtcttcacatcgtcttttgtgtgtgtgtgtctggagctgtatccaaattctccttcactataagacaccagttagtctattggattaggacccaccctaatgacctcattttaacttgagaacctctgtaaatgtgctatttccaaataagctgatattatttggagatattggggattaggatttcaaacatatcttttttggggaacacaattcacttccttcaaagcctgccagtgactgatcaatgtgcatcagctagttcgcacacagacagcaaagtctgcaatcgtgttgattccttgtctcccagtgagaaacccatgtgacatttataaatatgaataatcagaagaaaaaacttgtcaacaaccattgatgtgcagcaaagaaataaaaaatgtgataaccctggaagtggattcaaatacaatgtaaatggaatcatagaattggctcaccacaggaaacgcggcaagaggaactcggcgcaacgcagtgttctgacataaatgaggaacgcagctgtgattaaaaggatgaagaagccccagaggaagtgatgccggcaaagacagcaacaaacttcatattaaaggaactcttgtagatattgcatgacgttgacaatgttagatgctgttccaaaaacagcacgacagttcaccaaggcatagaaacactgctggctccttatcataagctatacgacaagagggaggcaagcacttttcaaactgggcttgatacacgtctataaataaataaagcactttaattggctgttgtttaatgttttaaattacagtgtataaactaagtactggccaggcgtgatggctcactcctgtaatcccagcactttgcaaggccaaggtggacagatcatgaggtcaggagatcaagacgatcctgggtaacacggtgaaaccccacctttactaaaaatacaaaaaatcagccaggcgtagtgtcacgtgcctatagtcccagccacttgggacgctgaggcaggagaatagcttgaacccaggaggtggaggttgcagtgagctgagatcacgccactgcattccagcctgggcgacagagcaagattccatctcaaaaaaaaaaaagtactaacttcactatgtttcatttccttatacatttataaccaacagtaagagatttttaatgttttggccaaaatttttaaatgacacagaacagtcgatgtttcacatggattgtttaggtcactttacagatcttcagcttgcatagtgatttgtatggccctgcactgctgtgcaaagagaggactgtttgtgttcttaaccagtaagaaggagggcaagaaagaggttctcagccagatattgcatatgtaataaaatgatgggagagggaataacactttagatatgaaatgtaccatgtggggaagctatttgaacaacaacaaaatagcttaatttaacccgatggagtacactcagccaccttctagatgtccctgcttattcttcaaatcttctcttttgtggccccaaagaatgattcactctctggagtgaaaaataaccgttgctttctttgcctggaactttaaactgacttgtgctgtatcatccaaacctactcaatcctctcttctccattaatcagtgaggtccaaaggagccaaagacaaatctctcctgtttttcttagaaatgtaaagatgttgcatctgtaaccacaggctgcttttaatcctaaaagtcagcgtgataatgaaatccagtgattaatttctgtcttctaatcaataagtagacatatcaatttatagtatgttagaaagcctcaacttcactgaaacaaaaagcaagaggctctgcaaatgttggagtgtgctaaaggaaaagcatggactgatgtttggggaaaggttggtcaatgtgatgaggccatctgtgtttgctaatagtgcttatcaaaattaggttcctacgcagagacagagaccaggagacaatcctgtatccttcttgatccttatagtccaaagggatggctcccaagtctttcagaaagacatttccatgttgtaggagatttaaaggggcagagaaagggtttataactgcaggttatctgtctttttttttttttttttccagacagaatctcactctgagcacaatctcggctcactgcaacctccgcctcccaggttcaagagattctcctgcctcagcttgctgagtagctgggattgcgtgtgtgtgccatgacgcccagctaatttttctctttttagtagagacagggtttcaccatgttggccaaaatgttctcgatctcttgacctcgtgatctgccctcctcggcctccaaaagtgctgggataacaggtgtgagccaccacgcctggccattgcaggttttctaaagttaaacctcttagaaatgggaggtcagggacctatagtcaagttttgggtgggacaaacagtaaattcttttggcagaattgaatgttcccaggcaggtgctttagaggggtatggggcatcgtagggacgtggctcggagctgatagacactgtgttggaatttggccaagtctcttagtgtatgtatgaggaggagggatgtgcagaagaagttgtctgtgccaagaatttatggttttcacaggttaagacagtggtgcctgggatcatctgcaaggcatgagtcaaatgttgacacaatgattgtttgcagactcatctgagggcttaggcagatctggacctgttgatactgaagtttctgaaggtagaggaagaaaacataatgtctcaataatatctgaagtaggggtaggaaaacagagatttaaggaggtgagatcccttaaggcctcagaaagaagcttcacttcttgcgcctcccttcagagtaaatgggtcattaaattagtttttgtaaccaacctgggaatgatggtgaagaagggaataatgagaggaaaaactttaaataagaatgcctgagagataatactaggtcagtgggagagaaagaaatttccaagaagttgtcatgggaaagggctcacgaataataaataaaaaattagttattaataatataaattaatatatgaaaaataaataagacatctgccaacagccacacttacagcactagatggattttaactgaattaaaacttgagtttttaatgaattttctacaatccaaaatttatttgtttaatttttgtaacaaaacaccatttctttactttttgcaaaagtaaaagtaaagtgctatttgtactttttaaataaaaactaattttaaagaaaaaaataattagctggacgtggtggcaggagcctgtaatcccagctactggggaggctgaggcaggagaattgcggaggttgcagtgagcccagatggccccacttcatccagcctgggtgacagagtgagactctgtctcaagcttcttcagtactcacatgtaaacttctactttccccttcagattacagcaaccatcatgccaaagctatacactctcagggaatccctgtggatttcactgatgaccacttgaccaactattataaaaatcaaggccaggggttctcaaactctcaacatttgtgtgctcatctccccttcacccagagactccccagggctgctgggccacgctttgtttggtttgactggaacatagctcaaaagggatggaaatttccaagaggtgttaagagacacataaatatttcaaagattaaaatgaaagaaataaagaaatgggcatttgtgagctttggtcatgagaatgcaggcctcgcagtacttagctacttccaaacccctgtccaaagagaggaccaaacgctagtgaggcttccggcagcacaagggtgtcccgcggatgaccccagccctcttaaaatgactgcctgaaaaagctcacttgcaaagaaaatttactgtttgtttcaggcaaaacctggtgatgggcaggtagagccccgaatcccctcttagaaccttagaaagcttgcaattataaatttttctccacctttgaagtgtaaatctacattccagaattgtctcctcaaagacctgagagttctctctttgaaatgcaaacattcaggaagctaactcttgctcttgttgccagttcctgagggaggggaaaggcctagctttggcgagcaccttgctccagcttgcacctctgactcttttattgccatgaaaatcaacatgtagacttttttcaaacccaatgacagcccattacaatggaggccatagcaatggaggtctctacatgcaaaaaaaatggtgggacagtttcctgataacaggtcaactttattccaaggataagcatgtcatgaaattattggatggcagattatgcttatctatggtcttcctttttctccttggtctcatcccaataacttacagatcctttaaaggcaaaggccaaatattcagctaagttaggcatactttagatgccaatatcaattttagctatatgggagatcctacttaagatattgaggacgatcatgtgtgtacagggcaaaaaagatgggacaaagagataagaaggggatgggaaatcacaccctccctccgcaccacagaccatgacctggggcaggtcctgtaacaccaagcccacccaggccccatctaacagtatgccgcattctacatgacctcagagttctttcggaattccagctgaaaagctgaaaagcaatactatatagttgtggtttccagctggcccatgttagtatgtatggcttttcttcctcgccatgaaagcactatgggagaacgaagcccgatgctgggcatgctttgccaggtgggtgctgctgaatcacagacctcagcaactgtgttccgcctccacagaggccggagatgtttgtttccccagtgtgttcgtatatttcagccagtttcatgcactttgccctctcagtttgcttcactttctggctcagtgaacctgacctgcaagtctccctgcagtttccctcagcaagtgctcactgggcagccccaacatgtgagaaacggctgtagggtgcacagaggtgaactaaattactaaaaactattactttactaaaatgcttcctggattccaaaactcaccaactgggagaaaggtcagacacacacggagacaactcatctacacaaatgatcatcagtgatttaaagaaggtacagcagagcgagactccgtctcaaaaaaaaaagaaaaagaacgtacaggagatcatggaataagaacaagaagagattactttccagggctctcagaaagtttctaaaaagaggtgccattgaccctgaccttagcattgtgatggagacattacagagctggtaggaaggagaagaagaaggaacggctggaacacacttggggtgaaatgagcggcatttcagtgtgggagctgcagactcagttttggtggaagagttaagagccaggatcttgtcaggaataattctgtgtccaagtgcagaatcgtggtttgctccactactgccagtaactccatttctcaatcatgatggtgatgcttttttttttttttggctcccaatcccggagagtggccatactgaagtcatattacaacaattaacttttcaactattagatgattaatttttaccaagtagcaagaacagctgtttggcacgtagcagtgtggcatgagtatcttgtaaatgaattaaacaaaatatctctccaacacacacacagtcattcttgctgcatgtcagcctccacttctccctccattatttgatgctgtgaagctgaggcagccagcttgagcgaaagctttcagatctcactccaacaaagagctttgattgattcatttagtataaggtgttttatctggctagagaaatccaagctgagttttattaattactaagaaaagtatgcaatagattaatctttgatcaaaactatgtgtgaagtagaaacatattacacatatggagagcagttttatggaataaaaacaatctatgtgtggcataactgacattgtctttatatttttgggggggtgtgtgaggacggagtctcactctgtcgccaggctggagtgcagtggcacaatcttggctcactgcaatctccacctccttggttcaagcaattctcctgctgcagcctcctgagtagctgggattacaggtgcctgctgccatgcccagctaatttttgtatttttagtagagacggagtttcaccatgttgtcgaggatggtttcaatctcctgaattcatgatcctcctgcctcggcctctcaaactgctgggattacaggcgtgaaccaccttgcctggcctataaataatttttaaaacagatacagaatatatagatagcttaacaattataaaattgtatttatcaagtaggtcacgaggtaaacattttacgctatgcaaaagggagcaaacctctgaatttgtcatgcagggtcactagtggaactcacagcaacaggtctgataaagcagaggagggaaccgggcttccgtgtgctttagagagagtgaaacatgaggagtcacaggcagagaaaactgtttttcagaaagaaaagaaaggggacatgacagcccagcagtagggtgaagagggcctctccgtgggtgccgctggcttgagctgctgtaagtggctgtgccgggaacagaggatctgtataggagaatggggaagggagtgctggaaccgggggtgggcaggagcagcagtctggagaccagaatgacctagggtttcctctcatgctcccattcccagtgtttcacgtgtgtaaagtagcaagcatgcatatactgcttagaggcatctacacttaacatactacactcatatacaacacttgcatcgtacaaagtacacatagtaggtgtggcatgtaataagttaccctcctatattttcttctaaaagatttttaaatatttgcatctcaaatttaagtcctttgtccatttagatctggcctttgtgtgatagcgatccatttttgggatagagatccattctgatattttcccatatggataccaactgctcataccatggattatatagaccctttctgactgttctgtaatgttagccagggcatacatcaagatttcacacaagcatacactttcacaatagcaattcctgctgtggtaattataacttcacagtaaatctggtacgtgatagactcacataagctccacctcccaccttcacacactttagtcttctatgggattgtcttagttatactgggcccttttatcttccgtataagctttggaagcagtttagtgacaatggtactcttgtctttttcttgattttaaaaggagtgatttcgatatttttaatcacaaaacatgataggtgctgtaggttatttgttgactccttttatcaggttaaggaaattaccctttattcataggtggaaatatcatgaattatttaatttttgtaaaataattttataggccttttgagacaatcatataacttttgtctttaattcattgataaggagatgatttcagtagattttctaacattgaactaaatttgtattactaaccgagcttgttcatggtttttatactttgctaggtatacttcctagtattttgtttacaatatttgtctctgtgtgcatggatgaggtacacaatagcaaggttaccctagtctcaaatgaattgaagaatggcctcttttttctcccctcgcaaataattagtgtaacattggaactacttgtgacatcatctgggcatcctgttttctttgtagaattattaattatcaactcaattactttaatggtatgatttccatccagattttctaattatttgagtcaactttaataagttaaatgtatccaaaaatttgttaatctcacttatttacaaatgcatatatttaattgtcttattacttaatgaaatagatcataaatataaaagtgtgtgtgtacagcttaagaagaatataaaatgagcatatgtgtccttccttcaggttatgaaatagaatatttccagtatcttagaaactcccattgcccttctacaatgccactcactccttccacaagaggtaaccactatccctaacttcctgttaatcattccattgcttgtcattacagacttgtatattgtttagttttgcacatttgactttttaaataagtgaaactatgtattgtttcttatgatcagatatgcatacacacaaacatgtatatgtatgtatatatacacacatacacacattatttttaagagcagttcaaagttcacagcaaaactgagcagcaggtatagatttcccatatactccctgtcccccacacatgcatagcctcccccataataaacatcccccaccagagtggtgcatttgttacaattaaagaacctacatgatacatcttatagtttgcattaaggttcacacttgggcttggacaaatttacaatgacaagtattcactattaaaatatcatacacgtactttcactgccttaagcatcctctgtgctctggttattcatccctctcttcctcctaactcctgggaaccactgatttttttttctatttctatagtattaccttttccagaaggtcataaagttggaagtgacatacgtagcctttttagattggcttctttcattctgcaatatgcatgtaagcttccactgtgtcttttcatggcttgacagccatttattttatcattgaatggtattcagttgtctggatgtaatacagtttgtttaattattcacctactgaaggtaatcttgcttgtctccaaatttttgcaattataaataaaacgtccataaacatctgtgtgcaggtttctgtgtggacataagttttcaactcctttgggtatataccaagaaacaagattgcggggtcgtataataagagtagatttagttttctaagatgccacaaaactattctccattttgtatttccatcagcactgaatgagagttcctgttgcttcacatcctcatcagcatttggtgttgtcagagttctggatttttgccattctaatatgcatgcagtagtatctcattgcagtgctgtgtttgagaatgtgagtagctgcagttcattcactcttagtgctgcgaggtactctattattggaatatatgatcatttagttacctattccacaatctacccatattgagagataactggattgtttccaggtttttaaaattgtgaacattctcatatatccctaggtaaacaaatgcaagaatttttctggggcctgtaacaggctgactagattgcactaggttgtagtgaagccactgggtcatagggtacatgcatgatcagctgtatgagctaacatccgttttccaaatggctgtccttctacttgcatgggatgaatgcttccacggttctttatccttgccaatactacacctttcagaacttccaaaaaattttgtcaatatgtgtgaaagggtatctaattgttaattttcattttcatgattattattaggttgagcactttttcacatgcttatgggctatttatgctaacttcttgaggtgttatttttcacttattaatttataggagagctttatatattctggatactaaacctgtctaggtaacatgtgttgcaaatatctctgccaagttttgcatatttttttctcattgcggtatccaataaacagaagtcttaaatttttatgtgatcaagttagtttttactcttgccgtttgttcttcttccctatgtaaagataaaagagatgctccacagtttttttctaagaatgttgagaaggtatctttatccattaaaatatatttttaggtttggtctatgggattaagtttcaatttccttttttcccccttatggagaccagtggtcccagtgttgcttattgtaaaatttactatcttcacttaaccacaagaaaagctgtgttacaaaatatgtttccaagtatgtgtgaaaaatatatttatctttatgattctactcagattaattagctctcaggactgctgtgtccagagttgattccttctggtgggttcgtggtgttgctgacttgaagaatgaagccgccgaccttcacggtgagtgttaccgctcttaaagatggcaaggacccgaagagtgagcagtagcaaggtttattgggaagagctaaagaacaaagcttccacaacggggaagagcacccacgcaggttgctgctgctggggtgggggtgggggggtggccaggttttattcccttatttgtcacgtttctatcctatcagagtgcccttttttcaatcctccctgtgattgactacttttagaatcctgccgattgatgcgtttttacagagcttgctgattggtgtgttttacagagcgctgattggtgtgttttacagagcatggattggtgcgttttacagagcgctgattggtacatttcacagaactcgtgagacaggtaagttcctgattggtgcattttactatcctctggtaagacaggaaatttccccaagtccccactcgacccaggaagtctggctggcctcagctcttgctaccagaggctaatttccaccctggtatttctcaggcccatagatagtgtgaattcaaacccaaaccaatatggctattgttttgtatttagaaattatcatacgttttttatttttcatttttttgtctaccctattgggaccaagacaagcacatattttcactttcttatgggggtgggattttcctagcccaggcacttaacgtgcttctttttagaaatcctagatttatgcaggaggcattttagcctatattccttcctgcatgggcatcagtctctgtttcctgaattaggtgctcatgggtctgggccagtaggtcctgggagacaccgcagggcaaatgccagatgagacactcacacctctggattcagactttttttgctcttctagatatctgaaaatttgccttactttgactcagcccatgcattaaagcagatgcttttaaatattttatgatgcatgttttaggaaagggtctgtctgggtatttcttctttcgatttgcatttttcattcagttcttctttcacactatcctaagcattaatcaactcgccatttatgtcagtacaaaacttcactatcctgttcattatcaccatttcattttgttctgcataggccagactatttatctaaaaatgtttaaagaaatctaaggccttaaaggattctttctcaaggactctactgtttgtatttagagaaatgctcatttgttccactgttttactttcttcttgggtcacgctctttgatgactgcgatcttacagaggatgacaaaagagggcccaccctgagacagtaatacctgcttgcccctttggattttattagtgttatcaaaatattaataaaatgtcaaaaacaaattactatcattagaatgtgtgcctcacttaaaaatttctctctctaataagaagtttttgtttcctagttcctttggtaccctaatgtttaggtaaatattctctgaggaaaggatgtggaagtcatagcaaaatatatgctggacttgaatgaaaatatctgtttcataaaagttaagcaggcaaccaaaatttaccttttttaacctaaattatctaaacatgtatttacatttctgtttcattgaaagatatttgacattaaatgtccctgagacagattttggaatgccctctccttctaaaatatattttttatcttttgtggactaaacagttagttaaaaatgaacttaatgattgctaattactaagttatctaaacagttatttaaaaatgaacttaatgattgctacttagttatttataatgcatttcaaaattaactttatcatctaaaccttttaacacaaatgtattaaattatgaaacagggaattggctatttttgttcaaatgtttattctcatcaaacttaaaatatcactcagctatatgattaaaaatgaaggcttcagtcattaaattatttcccagttatttgcgatatttctccgtattaaaggaacaaacagtgcccttcgaatctgttgatagttctattgatagtggccatcacaagttacacattatcaataaggtcaaggcacaaataaaatttctcccttgcttttcactcaaaaactacaagtatagttctttgataagatgtcccaatcatgatttgtgatgccaatcatagaaggaaagaggatgttgagaaacaataaaatagctactttaaaatgttctgtgcctgaacattttgatggcaatattggtcatattataaatttgaaaatataaattttaatctagattgactttattctactagtgattttaagagctttatccaagagaaacacttacatttttattcctaatgtttctttaaaaatgtgaaactcttttttttttttataattttaagaattcctagataagcagaacatagagccaactgttatgttctggttgtttttaataggtatatttatgttatcccccaaattataatttattaatgtctaacttcagttagatgagttgattacttttcatacaccattgactaaaggaaacctaattttacacgtaattcaaggggatctgtgagtaagaacatttttaaattaaagcaacacatgtgcatggaaaatcattcaaacagtttgatggcaaaaaaatcagtggaaaccagaaactttttttttccttccacagaccttggtcctgtttttcagagttaggcaggttttatcatactcttttttttactatatgctattctcttgaactgtaaataatattatataatcacctaatttgttttatcagttttaagtaatatcccttgactttttatgaacgatagagaatatagctcatttaccctactttcttttcttttttcttttttcttttttttttttttttgagacggagtctcactccctcacccaggctggagtgcagtggcgctatctcggctcactgcaagctccacctcccgggttcacgccattctcctccgtcagcctcctgagtagctgggactacaggcgccagccaccacgcccggctaattttttgtatttttagtagagacagggtttcaccgtgttagccaggatggtcttggtctcctgacctcgtgatccgcccgccttggcctcccaaagtgctgggattacaggcgtgagccactgcacctagcccatttaccccactttcttcttctaaaactatatttccaatttagtctttaatatataattttaagggatttttaaaaatttgcttcctctaaataatatacttacagtgcttaattctttgcttaaataatatattgtttaaatatacagtccatccaatttgaacaccactgattggctcagtaggatgtggagattagtgtacaacttccctcctctccaacagtccctgtcatagctttcgacttgtatcaaatatggttctatacttatattttcacattctatgtaaattacatcctattttgtaattataataaagtctgtgctttgttcataggttaattttgatcatggaatctcaagtgaattgacagcatcattattatgttttctttttttttcaaaccacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttctatttttatacatttatgatgcattatttcttatttcccaggaattttactacctttgttttgaatgattaaaaaggaaacatagcaccttttttcaacacatcaccaagatagcctagttaatattcttctctttctgaagtagttgaattgggatagacagcttgccaggcctgctgccacttgtcagcatcgcatccctacattcaaccacacttgcatctaacgaccgtctctttcattaaatttcttttgcaccttttcttcctgaatgagtgcatgatagttaattttcctgtgcacttgcatgtctcaagaaggttttaattctttttgtattgcattaatatttaagttaagtttataattgcaaaatgatttatactcacaacattgaagactcctttgttttgttacatcctgtcaaaatgatgagaagacagatcatcctttagggaaaaattggttttgattggcgtcagcctttccaacagcaatgctggagacaagaataaaatgaagtaatatttttcaaggattaaaaggaaacaatttttaatccttgaattatttgcagccaaaatcttttaaatatgaaagcacagaaaaagacattataaagtaaggcctcaaaagttttatttcaaataaatccctttgaaaatgcctagaggacatactccactaagaagagaaatacaccgtggtgttagaattgagggttccagaatcaatggtagtggtgtttatcataccctaaaaaatacatgaaaacataacatattgaaaacaactccgagtaaacttcagaaagtaccaccttagacaaagtgctgtcgtaacagagaaagcaaaccagaggtggcaagaggaggctagagtacttatttggtttgctgagatgatattaattttgacacatggaggaaattgagaaaattaacataagtaatgacataaccaccattactatgttaaaaatttccagatttcaaacaaatgaaaaatttttgatctatagagtgagaggtacaaataggaaaaaagacacagtaaagtatgaaaaatcataaatgagatgacagaaagaagtcataatggaacaataattacataaatcaaaggttaagattgtcaggtaaaatttttaagtgtcaaaaaacacaatataacctatcgaaaataaattagtggaaaaaatgtagcaggaaaatatgaataaaaagagctaggtccaatttttgataaaaatttgaattcaagttgataatatcctaaagaaggaaaagtctgtaggccaatagaagaaatagcagatgcagaggtgtgctcacaaacatgagtgctcatgacactagtcatacaaactcaaattcccattacagttgtatacaaacatgatggccgacaagaaggaagttcctttaagcccacttggagcattaagacaaatttaccatgtgaatccctaattgaactctgagttacttctgtgaaggaatgaagaatgatatcataaatgaatttcatatagcactcaaagctcctcctctatatggttcaggatagacttgagtatccacggttctggagtgcaagggaggagaaaggaaaggtgcattcagacaaaaaaaaaagtgtacagaacacaccacggatatcagaagaggctgctcatggcaaggcgtggtggctcgtacctgtaatcccagcactatgggaggccgaggtgggtggatcacctgagctcaggagttcaggaccagcctgggcagcaagggaaaccccatctctgccaaaaatacaacaaaattagctaggcatagtggcacatggctgtggttcccattacttgggaggctgaggtgagaggattgcttgagcctgggaggcagaggttgcagtgagcccagatcgtgcctctgcactccagcctgggcaacaaagtgagaccccgtctcaaaacagaacaaaacaaaacaaaaaaagaggctgatcaagaccagactcagctcctaggccttgaactccagtcccaccttacaccctaaggttcctaaagaatcagtaacttagttcaccctaccccactcctggcttctagatgtagcacaagtttctaaacatgcaaacaatgagaactatctattttgacaaaataagaagaaatggagtcaaggcaacatataacatatttttgccagttctattgattaacagaaaaattgtatatagttaaggtgtgcagtgtgttattttgatatacatatacattgtgaagtgatgattaccacaatcaagctaacatattcatcacctcacctggttacctttttatttgtgtttgtgtggtggagaacacttgagatctactctttcagcaaatttcaagtatacattattattgactttagtcactatgctgtacattagatctccagaacttattcatcttataactgaaagtttgtactttctgacaaacattttttcttttcccccaactcccaggccctggtaagcactattttactctgttaccatgagtttgacattttcttagtatgcatataagtgaaatcatgcaggatatttgtgtgtgtgtgttcctggcttattttacttaccataataaactccaggtttgtccattttgttacaaatggcagtatttcctcatttttaaaggctaaatgatattccttgtgtgtgtgtgtgtgtgtgtgtgtgtgtgtgtgtaatacatttaaaacatccatctgtcaatggacacaggtagtttccatatcttggctgtgtacataacactgcaatgaacatgtaagtatacatatctctttgagatagtgattttctttactttggatatatacctagatggggattgctggattatatgggagttccatttttaattttttgaggaaagtccatactgttgtctctaatggctgtaccaatttacattcccatcaactatcaactaagcacaagggtttctttttctcaatatcctcagcaacatttgttacctttttactgttacaatagccatcctaatagatgtgaggtgatatctcattgtgcattttcctgatgattagtaatggcaaacatctttttcttagtatatacctattgtcaatcgtatgtcttttagaaatgtatctcttcaggtctgatacgctttggctgtgtccccacccaaatctcatgttgaattgtagctcccataattcccacgtgttatcagagggacccagtaggagacaattgaatcatgggagcagttttccccatactgtttttgtggtagtaaataagcctcacaagatccgattgttttataagcgatttcctttttcacttggctttcattctgtcttgcctgctgctgtgtaatatgtgcctttagcctcccaccataagtaaggcctccccagccttatggaactgtgagtccattaaacctctttttctttataaattacacagtctttggtatgcctttatgagcagcatgaaaacagatgaatacagtaaattggtactggtaaagtggggtgctgctgtaaagttatccaaaaatgtggaaccaacttcggaactgggtaataggaagaggttggaacagtttggagggctcacagaaagacagaaaaacatgagaaaatttggaactccctagagacttgttgagtagctttgaacaaaatgctaataatgatatggacaatgaaattcaggctgaggttgtctgagatggagacgaggaacttgttgggaactggagtaaaggtaaatcttgctatgttttagcaaagagactggcagcattttgcccctgccctagagatttgtggaactttgaacttgagggagatgatttagggtagctggcagaagaaatttctaagcagcaaagcattcaagaggtgacttgggtgctgttaaaagcatgcagttttaaaaggaaacggcataaaactttggaaaatttgcagccaaacgacatgatagacaagaaaaaccaattttctgaggagaaattcaagccagctgcagaaatttgcataagcaacaaggagccaaatgttcatccccaagacaatggggaaaatatctccaggacatgtcagagatctttgtggcagtccctcccatcagaggccaggaggcctaaaaggaaaaaatcctgggttggattcaggggctccctgctgtgtgccactttgagacttgatgccctgcatcccagccactttagccatggctaaaaggggccaaggtacagcttggactttggcttcagagggcacaagccccaaaccttggcagtttcacatggtgttgagtctgtgggtgcacagaagtcaagaactgaggtttgggaacctctgcctagatttcagaggatgtatggaaacacctggatgtccaggcagaattttgttgtggggcgggtgggggggggtccctcatggaaaacctctgctaggacagtgcagaacggaaatgtggggttgaagcccctacacagtccccacttgggtactgcctgctggatctgtgagaagtaggccaccgtcctctggaccccagaatggtagatccaccaacagcttgaccatgcacacgggaaggccacagacaatgccagctcatgaaagcaaccaggaggggggatatgtcctgcaaagccacaggggtggagctgcccaaggccatgggagcccacctcttgcataagtgtgacctggatgcgagacgtggagtcaagggagtgcattttggcactttaagatttgactggcctgctggattttggatttggggcctgtagcctctttgttttggccaatttcaaccatttggaacaggtatatttacaccctccctgtacctccattgtatctggaaaataactgacttgcttttgactttatgttctcatagctggaagggacttgccttgtctcagataagactttggagagtggacttttgagttaatgctcaaatgagttaagatgttgggggactgttgggaaggcataatttgctttcaaatatgaagacatgagatttgggaggagccagggcagaatgatatgatttggctgtgtccctacccaaatctcatcttgaattgtagttcccataattcccacatgttgtgggagggacctggtggaagacaattgaatcatgggggcagtttctcccatactgttctcatggtagtaaataaatctcacaagatctgattgctttataaggggtttccccttttgcttggctttcatcctgccttgccggctgtcatgtaagacatgcctttcaccttccaactgtgatcatgaggcctccccacctgtgttgaactgtgagtccattaaacctcttttttctttataaatcacccagtctcaggtatgtctttatcagcagcatgaaaacagactaatacaaggtcctttggaatcgtctaagttcctaatttatttggatattaacttcttatcagatatatagcatgtaaatattttctcccattctttaggttgtcttttcattgtattgattgtctcctttgttgtgctgaatcttttactttgatttagtcccatttgtctagttttgcttttgttgtctatacttttggtgtcaaatctgaaaatttattaccaataccagtgtcaaggagcttttctcctatatttatgtctaagagttttacaatattgctcctaggttgaggtcttttatccattttgagtcaatttttgtatgtggggtgagataagggttcagtttcattcttctgcatgtggatatccagttttcccaacaccatttattaaagagactaaacttttatcattgtgttttcttggcaccaatgctgaagatcaattgattgtaaaggcatggatttgtttctgtgctctctattcttttcccttggcctacatgtctgtttttatgccagtaccatactattttaattactatagctttataatttagtttggaataaggtaatgtgaagcttccacttttgttttttctgttcaagaatgttttgactgtttggggtctgttgcacacagattttagaattgcttttttccattgctttgaaaaatgccactgaaattttgataggggttgcattatatctgtagatcacactgagtaatagagattcttttatcttcaaattctttcatcagtgttctatagtttttggtatatagaaattttactttcttatttaaatttattcctaagttaattttttgatgctattgtaaatgagattgtgttctttcagatggactctcgctctgtcacccaggctggagtgcagtggtgtgatctcagctcactgcaagctctgcctcccgggttcacaccattctcctgcctcagcctcccgagtacaggcggccaccaccacgcccggctaattttttgtatttttagtagagatggggtttcaccatgttagccaggatggtctcgatctcctaacctcattatccacctgcctcagcctcccaaattgctgggattacaggcgtgagccaccgcgcacagcccgagattgttttcttaatttctttctgggatagttcactgttagtatatagaaatgcaataggtttttttttttttaatgttaattatgtgttctgtaaatttgctgaatttgtttcttaattttaacagtttttttttggagcctttagaattttctctatataagatcatgtcatcttgaaatagacacactttcacttcttttccaatttggatgccttttatttctttttcttacctaattgctctggctaggacttacagactttttcagaaaccccccacagtaatctaggggagtccactgtcactagatctgctttataagaaaccctaaagggagttcctcaaactgaaatgcaataagactaattagtatcatgaaaccatatgcagttataaaaagtcactggtaactatacagtcaaattcaaaatactcctaatactgtaatgatgcagtataatcactttaacttttaaaaggttaaaagacaaaaaatactacaaataaatataattacaaaatatacaaagaaagaaactctgacatcaaaaaacataagtggaggggagtaaagtgtagggtttttgtatatgattgaagttaagttgttatcaacttaaaatagaccattataactacaatcatgcatttcttaatgcggatatgttctgaataatgcaattttgtcatggtgtgaatatcatagagtatacttacacaaaattagataataccacctaacacacacccaggctatatggtataacctattgtttccaggctacaaatctgtacagcattgtactatactgaatgctataggcaactgtaatacaatcataagcatttgtgtatctaatgtatgtaaacatatgaaaggtacaataaaaatgttataaccttatgggaccaccgttgtatatgtggcccatcattgaccaaaacatccttgtgtggcacacgatagcatacaatgttttatgtaagcctcatgataatcacaaagacaaacatgtaacagatacacaaatgagaattttaccacgtttaaaaaagaattaatacaaaggcacaggaaagaatcaaagtataccactacagaaaataatcaaagtaatcaaatcatgcacagcaagagagaaataaaagaacaagaaaactacaaaatgcctatcaatagttactttaaatatcagtggaccaaatcagtgaaacaaaagacacagagtggctgaatggatagtaaaacaagaaccaaatatatgccacctataagagactcacttcacctttagagacacacatagactgaaagagagggaacaaaagaagagaaagagtagctattcttacaacaaacaaaatagactttaagtcaaaaactgtaacaagagacaaagaaagtcattatagaatgatacaaggctcaattcatcaagaggatataactactgcaaatatatattctcccaacattggagcacctaattatataaagcaaatattaacaaatctgaagagagaagtagacaacaataatacaataacagtaagggacttccatatcccactttcaacaatggattgatcattcagacagataatcaataaggaaacagctgacttgaactacactatagatcaaatggaccagacatatacatgacattcctttccaaaacagcaaaatacacattcttctcgagcatacacagtacattctccaacataggtcatatattaggccagaaaacaagtcttagcaaatttaagaagattgagatctcaccaagtattctttttgactacagtggcatgaaactgaaattaaaaacaggagaaaacttagaaaagtgacaaatatgtggaaatcaaccaacacactcctgaataaccagtagatcaaagaaaacatcaaaaaagaaataaaatatcttgagacaaactaaaatgaaagcacgacatactaaaactgatgagatgaagcaaaagccgttctaagagagggaagtttatacagataagtgctaaataaagaaaaaagatcccaaataaacctcaaaaaatagaaaaaaataatcaagcccaaaattagaaggaaataacaaagatcatagcagaaataaatgaaatagactagaaaaacaatagaaaagatgaatgaaacgaagagttgattttttgaaaagataataaaaattgaccaacctctcactaggccaagaaaaaagaaatctcaagtaaataaaattagaacaaaaaaggagatattaaaattggtaccatagaaatacaaaggataataatagtctactctaaacaactatgtgtcaacaaattgtttaacttagaatagagaaatttctagaaacatacatccactagactgaaacatgaagaaatagaaaataaaaacagataaataatgattaaaaatattgagtcagtagtcaaaaagctcctgaaaaaggaaaatccaagaccagatagcttagtggagaattctaccaaatgtttgaagaagaattaatacgatttcttcacaaactcttccaaaagttgaagaggagggaacacttccaaacattttttatgaggccagcattaccctgataacaaagacagaaaaggacactacaaggatgacagagatttttaaggtacaaatgatgtattgttggaattgaaaatacaggctttgttagtacaaagatttgtgtgtggataggtggatgtgtactggtgtgtgcatgcatacatatacaagcttaacttgttttattgcacttcactttattatgcttctcggatattgcagtttgtacaggttgaaggtttgtggcaaccctgcaccaagcaagtctaccagtgccacttttctggtagcatgtgcttattttgcacctctgtgttacatctttgtaattcttgcaatatttcaaatgttttgttattattatatctgttatggtgatctgttatcagtgatcattgatattactattgtcattgttttggggcatcacaagccatgctccaaaagacaatgagcttaattgatacatatgtgtattcgaatggttccatcgatctgcccttcctccatctcaccctctcctcaggtctgttttctgagacacagcaatattgaaattaggccaattaataactctataaaggcctctatgtgttcaagtgaaagtaagagtcacacatctcttattataaatctaaagtgagaaatgattaagctgagtgaggaaggtatgttaaaagccgagacaggccaaaaggcccaggctggtctcgaacgcctgacctcaagcaatccacctgccgcagccttccaggtagctgagattaaaggcatgagccaccatgtccagcttctatgcattattttaaatggagtattgaagactctgttactgtagaactatttctaacttcaattctgtcaatattttggtcacaggccttaatgtgattacacgctggtctgatgttcatggccaggacattttgttttcctgttggacataaacaatctcacagaatatcaacttcagaaggttaatctgagaccgtgataagtgcaaacaaaaacaagggcactttataatgttgtctaagtgcagataaaaaacaaggtcttgatgccacccacaaaatacttaataatcatattgctcctgctttctgacagcatccaatctaaagtcttcactttctgagatcctgtccgaaatcaaccaattaaagtccaaatcgtataatagtttctctctaactcctcccactgagatgacccatagtaccccattccttgctgcaatgtaattatatttacttacaagtgtgctcctggtggtctttaactgaagggcactgactgggtcactggtgaagttccccgcaggaactgagtcagaccccatctcagggccctgcacaagataggtgcctgctctaaggcgtggaccctcgccacagccctggcccgtcttgacgggcgagggttactgtacttgtcccaaccgtacagatgagaaagctgagactcagggcgagcaacccgggtcccagcggagcgcccggcacacgccgacacttcagcaccagtcgcggtggccaccactgtgcgcggagatggctgcgacgcgtgcgcaggtaaagtccatccgtgccttgcctcccaccggcgccttccccggcctctggtttttgtacccgccagcggctccgactccatcgcgtcctcttccagtctagtgcttttttccagatctcgatcccaaactccctcctgccagaatctggacccgaatccacccattgcccgttttctgctgccgctggagagaatctctgaggtccccaggagagcctgcctgcacggaagagatgcctcctcagtatggccgcccccggagaggagcgattaagtgcagacctccatgttgctcttgagcctgagcggcttcagggagccatgtttgttactggcgggc

SEQ ID NO: 2278 - DNA, 4029 bp, Homo sapiens
agattaattagctctcaggactgctgtgtccagagttgattccttctggtgggttcgtggtgttgctgacttgaagaatgaagccgccgaccttcacggtgagtgttaccgctcttaaagatggcaaggacccgaagagtgagcagtagcaaggtttattgggaagagctaaagaacaaagcttccacaacggggaagagcacccacgcaggttgctgctgctggggtgggggtgggggggtggccaggttttattcccttatttgtcacgtttctatcctatcagagtgcccttttttcaatcctccctgtgattgactacttttagaatcctgccgattgatgcgtttttacagagcttgctgattggtgtgttttacagagcgctgattggtgtgttttacagagcatggattggtgcgttttacagagcgctgattggtacatttcacagaactcgtgagacaggtaagttcctgattggtgcattttactatcctctggtaagacaggaaatttccccaagtccccactcgacccaggaagtctggctggcctcagctcttgctaccagaggctaatttccaccctggtatttctcaggcccatagatagtgtgaattcaaacccaaaccaatatggctattgttttgtatttagaaattatcatacgttttttatttttcatttttttgtctaccctattgggaccaagacaagcacatattttcactttcttatgggggtgggattttcctagcccaggcacttaacgtgcttctttttagaaatcctagatttatgcaggaggcattttagcctatattccttcctgcatgggcatcagtctctgtttcctgaattaggtgctcatgggtctgggccagtaggtcctgggagacaccgcagggcaaatgccagatgagacactcacacctctggattcagactttttttgctcttctagatatctgaaaatttgccttactttgactcagcccatgcattaaagcagatgcttttaaatattttatgatgcatgttttaggaaagggtctgtctgggtatttcttctttcgatttgcatttttcattcagttcttctttcacactatcctaagcattaatcaactcgccatttatgtcagtacaaaacttcactatcctgttcattatcaccatttcattttgttctgcataggccagactatttatctaaaaatgtttaaagaaatctaaggccttaaaggattctttctcaaggactctactgtttgtatttagagaaatgctcatttgttccactgttttactttcttcttgggtcacgctctttgatgactgcgatcttacagaggatgacaaaagagggcccaccctgagacagtaatacctgcttgcccctttggattttattagtgttatcaaaatattaataaaatgtcaaaaacaaattactatcattagaatgtgtgcctcacttaaaaatttctctctctaataagaagtttttgtttcctagttcctttggtaccctaatgtttaggtaaatattctctgaggaaaggatgtggaagtcatagcaaaatatatgctggacttgaatgaaaatatctgtttcataaaagttaagcaggcaaccaaaatttaccttttttaacctaaattatctaaacatgtatttacatttctgtttcattgaaagatatttgacattaaatgtccctgagacagattttggaatgccctctccttctaaaatatattttttatcttttgtggactaaacagttagttaaaaatgaacttaatgattgctaattactaagttatctaaacagttatttaaaaatgaacttaatgattgctacttagttatttataatgcatttcaaaattaactttatcatctaaaccttttaacacaaatgtattaaattatgaaacagggaattggctatttttgttcaaatgtttattctcatcaaacttaaaatatcactcagctatatgattaaaaatgaaggcttcagtcattaaattatttcccagttatttgcgatatttctccgtattaaaggaacaaacagtgcccttcgaatctgttgatagttctattgatagtggccatcacaagttacacattatcaataaggtcaaggcacaaataaaatttctcccttgcttttcactcaaaaactacaagtatagttctttgataagatgtcccaatcatgatttgtgatgccaatcatagaaggaaagaggatgttgagaaacaataaaatagctactttaaaatgttctgtgcctgaacattttgatggcaatattggtcatattataaatttgaaaatataaattttaatctagattgactttattctactagtgattttaagagctttatccaagagaaacacttacatttttattcctaatgtttctttaaaaatgtgaaactcttttttttttttataattttaagaattcctagataagcagaacatagagccaactgttatgttctggttgtttttaataggtatatttatgttatcccccaaattataatttattaatgtctaacttcagttagatgagttgattacttttcatacaccattgactaaaggaaacctaattttacacgtaattcaaggggatctgtgagtaagaacatttttaaattaaagcaacacatgtgcatggaaaatcattcaaacagtttgatggcaaaaaaatcagtggaaaccagaaactttttttttccttccacagaccttggtcctgtttttcagagttaggcaggttttatcatactcttttttttactatatgctattctcttgaactgtaaataatattatataatcacctaatttgttttatcagttttaagtaatatcccttgactttttatgaacgatagagaatatagctcatttaccctactttcttttcttttttcttttttcttttttttttttttttgagacggagtctcactccctcacccaggctggagtgcagtggcgctatctcggctcactgcaagctccacctcccgggttcacgccattctcctccgtcagcctcctgagtagctgggactacaggcgccagccaccacgcccggctaattttttgtatttttagtagagacagggtttcaccgtgttagccaggatggtcttggtctcctgacctcgtgatccgcccgccttggcctcccaaagtgctgggattacaggcgtgagccactgcacctagcccatttaccccactttcttcttctaaaactatatttccaatttagtctttaatatataattttaagggatttttaaaaatttgcttcctctaaataatatacttacagtgcttaattctttgcttaaataatatattgtttaaatatacagtccatccaatttgaacaccactgattggctcagtaggatgtggagattagtgtacaacttccctcctctccaacagtccctgtcatagctttcgacttgtatcaaatatggttctatacttatattttcacattctatgtaaattacatcctattttgtaattataataaagtctgtgctttgttcataggttaattttgatcatggaatctcaagtgaattgacagcatcattattatgttttctttttttttcaaaccacagtcgcaggtggcatgatttgatttgtgtgaaggcaatgaaatgatacacagatacaccgaagcctcccaaaagaatcctggttccaagattcaagaagatggattaatgtttttccattaattgttggaatttatgccatttttttactatgtgccatcaattttaaagcacttctgaaaagagataacaatctacaatagctggcattttaaattcataaaaatatagtattttcttctatttttatacatttatgatgcattatttcttatttcccaggaattttactacctttgttttgaatgattaaaaaggaaacatagcaccttttttcaacaca

SEQ ID NO: 2279 - DNA, 5651 bp, Homo sapiens
cagcaggatgggctggtcagtgggatagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccagtgccagggcactactgggaggctgggacctgaccaaagcccatggtgtctgtggcctgaggacagggtgtcttggggccatgaggacaggccaccaatggccgttgggtcatagggcctgagccccagtgtttgtccttccctggctccttctggttcagtcccatcagggctctggatcccaagacgcagcatccaaggttccctccaggaatcctggtggctcggcttactttgtcatgtttcatctgatagcaaaaatatcagatcggctgcacagaaaaatggctcaaagtgcttaatgaccagaagaaatctgggagtagcaagaaggtaatgtggagaggggaggacctccatgactggtgtctgcagagccaggggtacagggacccagtgcagtgacctggcaccacctgcctctcagagggtgggtagcacactgtccttacctgggggacagcaggcctggtcaccggcttttctccctgtccctgcaagcatcacattgctggaagagaatctcatgccagagcttggaccatccctagcttgggggttaggggttgtctcttggtgacctaaatgaaaaaataggtccagatcagagttcgtgatgcatagcactcacccactctttgaatcatgggaggggaggcctagtcctaggtaaacctaaactctttgaggaaccacagagcccaaggctggaaacctccagaatcctccagcccctgatcccccccccccccggggacctctgtggcctgtctcaccagagcactcttctgtctgtagaggtctcaggtgctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggtaagctgggtttggtaccccttcctggcttcagaaagaagccaaacaaggagctttctgcagaatgaaacctcttttccatccagaagcactgctgactgtttggtggttgctgttagggcagtgagccttttgtccattctgagattaggctggtttctcctcttggccctggcctacagaccataaaggaaaacagcaagaggtccccagcaaacatctacagatggccctggacatcagccacattcagagaaacgtgtcatgttctgggagggctaaggcatcgagtaaggcctatggggctggaggatcacagggcaggtggggcaatccagagctgtgggggcttccatgggaattgggaggtcccaaggcagaggtaggggttccacaggaggagtcacagagccaccaagggctctcctggcccagggagcagtcaacaccatggactgaacacccactgggctaagccctgggccaggctggggcatgtggggccaggaggcagctcagagtgggagacagagagacaagtgtgctcagagggcacccatatctgcatataacgtggtcctgaatttctggctgggaagtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaaggtgggcttctccgggatcttaattcaggaggtagaatgcagcttgagatctagtgtctgatcaaagaacttgaacttgacctggagggctctggggagccatggaaggtgctggataaaggaagggacagtcatatatattttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcagggttcttgtctccaggatgaaaataaggaggagttgtcagacaaggacatatacatggaggctggcatcttcatgagtgccaatcgtggtcctggtgtggactactgtgggagcaggggtctctccatccagggacatggtggatggaccctacatcactccattctgcccttcctttccctcccattctcctgagggactcaatgcatgggcactgtccaacctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatggtgggtgctgggcctcatggctgttccccagcccctctcattggctctgctccaggtggagaagggggatgatgtctctgtcagttctgctgttttagcctagaaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaactatgtttctgtcatctgtacattgagaggaatttcttttactccacgaggctgcttggagaattagtgacagtgtgtgtagagcatgtgccacccagcaggcatttggtgtcgagaccacacctcctcccccttcattttcagcctaaatttgcattttgttcttaagactttcactcgccttaattttactctttcctctgattcccaccttatcgtctatcccatggagtcactaggatctaagtgggtaacagtcatgtatgcatgtatgtgtatgtacgtatatactttgttggtgttggagtgtggtgtgtgaatgtgtgtgtgtgtgtgtgttggagttactgggtgactgaaactgtacacatcaggctgtggttctgcccattgctggaagcgctgtcaggggtcctgccctcaaccccaggtctgacccttgcagcgcaggcaggacattctggaggaatcatgcccttgggaggatccctgaggagtgactggtgggtattggtggataaatacccctggtcccttgctctgggtatgatgactctgaagcacatgttctgtgctgtctctcagaggtacctggcagggctgagtcctggctgccacagtggaaactttcttgatgaaggtccctttaactgctgcattcctttcctgtctcagttccccactcctccactgatgtttcctgggattagcaccctaaggaagaactggcagtcgaattaatatcctagcgttatctccaaacaaaatttttgtatttgaatctttgcctcaggatctacttccaggaaattcagactaagacacacatttttcttttggctccttgaatccccataggcctgacattttgctgtttttatcaaaaaggaacatgaggatcagagagggaaagtcacttgcccaaagtcacccagctgaacagtggtagagttcaactttgatcatgagatgtctggcccccaggtggaggcttgctcctctcccatgagactccttccttatcagggtcaaatgaatgaatggaggatgttaaaagtggggtctctgatgcctttgccagataaaccccaggctcatggctggcgcctgttttctcattcttacctcattaagagtagtaatgaaaaacatgctcagtgctgaccgtgtgcctgggggtgttgtaggcactccacttactttaattcatttaattttcacaataaccttgtttttacttctagttgttatatgaaaaaactgaggcaaagagcaatacagagagttgcaaaaattcataccgctggtccaggtttgaaccaaacagtctgcacctggagtccttgtttgtaaccatggcaccctgtcttcacacatatctcatcgtggagttccatcttgtgttaggcatggcactgagcagcttcttttaagaacataatttgtagccaggcgcagtggcttatgcctgtaatcccagcactttgggaggccgaggcgggcagatcacgaggtcaggagatccagaccatcctggctaacttggtgaaaccccgtctctaataaaaacacaaaaaattagctgggcatgatgattggcgcctatagtcccagctacttgggaggctgaggcaggagactggcatgaacccgggaggtggaacttgcagtgagccgagatggcgcgactgcactccagcctgggcgagagagcaagactccatctaaaaaaaaagaaaaaaacatgatttgtaattatgtaaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagtcaggttctggcagggacctcgaagtggctggtaatgtctttcattaccaccaccacgtgacctggtcttacgacctgttagcttccttcatcaggcatgagcaccaggatggcaggggcctcatctgtcctgttcctcctgtggcctgggtcctagcaccatgtctggtacagtgtaggtgctcaagggaagtttactttatagaactgtctacctgggagatgttgctgttagtctaacctgtaccattttgtaaacctgcagccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtca

SEQ ID NO: 2280 - DNA, 3110 bp, Homo sapiens
gctctcctgccttccctgaataaacttacacaatttagtgctgggacatttggaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcgctccagccggggctgcaggtggcccggtggggcggggttgcgcttccccgagagcacatcgagggcggcggcggcccgagtgacccttcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccgcgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcttctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacattgtcatctttgaagattagtgacatagcattcatcttctgttgtcaccttttccgtcattccctgtatgcctgatggacaggtttcactgaagttcagagaacagcatgcaaaattagctaccaattaatctttatgaagtgagctgcatttctagccacactgagcttatgttttagcaggaagcatttttgggaaatgtttatgttagagtttgcccttcttgacaaggtgagacataaatgtctactttagagacatgaattaagatgggaagatatttgggggaatcatttactcaaacgctaagtaataaaggtacacaaagggcaaattatactagatttctttcccacttgttttctatgtctcttgcaattcaccttgattcccttcagtttctgtttaatgtagaaagtggcattttcattattttaagcttctagcacaatgaaagaatttctctttttcatgaacaggatcataaatgaaagggaggaagagtgtcctatatcatatttattgttcaacaaaacactgctccacggcttcaattcagtttaaaaaagagaatttattgaacatttaacacatacataaaaggcagtaaagacaaatgagaagagggggggatattgaa

SEQ ID NO: 2281 - DNA, 3110 bp, Homo sapiens; identical to SEQ ID NO: 2280

SEQ ID NO: 2282 - DNA, 14717 bp, Homo sapiens
tgagtctatatatatatatatattagcagttgtatgaaagtatatgagtcaatattccatcaatacctagaaaaatagtagatcaatatgctgattttaggggtggacacaaaagtgttataagtgtcttttaacttttcttttttccctccttgactctgaagagaaacaccattttttctacgtatgcaaagagtaaaaattcagaactaacatgcagggattaatagcagtgaattgcaaactcaactcagtggtatagtacctggcaacattattactcagcatatttccctggctgaggctgacttcatttaaagtagttttatacttgtgctaaaaataagtgtacatcccattaagggagaaaagatcttctacacaatggattggacctacataaccttatgtaccagagaagaaaacatcattctcatgagtcgcaaagctttcttcttcttgtcaatatgataaacagtttccgtaaattgagaatgacgctggttactttccttcctcctgaacatgccacactgaagagacagggatgactccttccctatgggacagacacacatgtagctttccctgggttgtggaggaaggcatggccacaacaccattggcagtctgctgcagggacctcacgatgagaggaagcaatggatgcctgggccagggaaatgcatatttgggagaaagcaggaaattctgatgtagagatagggaagaaccctggggaaaaggacccaagctgggcggggaggaggaaaccaccaggatcccaggatcagagacaaaggacccagggacacaaacaaagtgaggccagatggagagggcaggctcacggggagagcaagctcacagggagagcatgagccaaacctggcttatttcacactcatcagagagactgcacagatggggccaaaccagggcccaggagcatcggagagaggagggccatttcaaagacttttgtaaaataagctcaaagtttctttgtttatttgtgggtgtgggagtggaaacgtagggaaagtgaagaaagtgggggaaaagggatgggtgattttgtaggcaagatgctccctgaggaggtcctggtggacctgctgtggggcgtggcattctgcacactctcatatcatggggagcgcatgactacattactgcttacacatctccaagtgcagcttggggggtgaatgtttaattgtctcactgtaactgtctaaatctctggaaaatgtgaagggtcatgcatttgatttaaacctatgaggtctgaatgaattctcctccatgcctaaccgagtgaagcaagtatataaccaaccatgcatccctaagcagggccggtatgaaagggaggaaacgcctccccactgagctcgcaaagaacttcatcactgacctgaatcagatccagcaggaaatgaaacactgagtacatacttttacagtagagggagggggacggaaaacaaagtgagctgaactgaaacgtgagaaagaacagaatggcagtgagtccacggggcagggccgcagctttcttttttcatggccctcagtccagtaaccccacccggcattcgtagcggatgacatcattgatgcccaaacatgctccagcaatttcctgctttccagagtccagccgagccatgatgtcagtggtgcacctgggtaaagatatggcagggccgggtcacagggagtggggacaaaggccaacccagttaaataaactgctggtcttctagggcctggtccctaggcaggcttccaccatgagataggtatagcccaggccaatcccaacaagaggaaaaaaagcatgtacttggccgggggcggtggctcacacctgtaatcccagcacgttgggaggttgaggcgggtgaatcacgaggtcaggagtttgagaccagcctgaacaatgtggtgaaaccccgtctctactaaaattggaaaaaattagctgggcgtagtggtggccacctgtaatcccagctactcgggaagctgaggcaggagaatcgcttgaacctgggagatggaggttgcagtgagccgagatcacaccactgcactccagcccaggcaacagagtaagactctgtctcaaaaaaaaaaaaaaaaaaaaaagaatgcacccatgcagtgcctcctgtcaccctctgcccagaaagggcacaggggccagggtgaaagagttacaggaagacagagggaaggaaaccatgcagacataaccacatgggggcaggccctaagctgctgggacctccacagtgtatccctttcctccaactgggagacggaagcaccgatggtctttctctacagtgccaggagccaccctgcccccagagatgccctacaatcaatgactaccatctaaatgcttctggatagtttcattccttgtagatgatattccaaatattataatttgtacttctccacaattacaattccagttttggggtttctttttactcattaaatttgaaaagccaattccagttttaaagcttgacccttttcttaaaagtttaacttctctttttattcaggcttcccactaaaccctcaaactgactctgagggtggcctgactaatttacaaaaccggccaggctgcctaacccctagattccagcccagagtgttgccataaattgctgtcaagacatgcctctatgtcccatgtttgccagtgagaaaagggttcatattctaagttcttcaagtctctctcactgcctcaatgtgaagtcaatggaaaacagtcaaatacaccaaaaattaacttcaaatggatatctgctatgaattccaacttggttggacacctctccaggccaactgttgtgaaaatgcattgttgttttaaaaaacactgtgagagatggctgggcgtggtggcttacttgaggtcaggagtttgagaacagcccggccaatatggtgagaccccagtctctatgaaaaatataaaaattgagccagatgtggtggcatgcacttgtagtccacgctacttgggaggctgaggtaggagtatcacttgaacctggaaggcggaggttgcagtgagccgagatcatgctactgcactccagcctgggtgacagagcaatactctgtctcaaaaaaaaaaaaaaaaaaaaaaaaaaaaaaaagagagagcgagagaaaacactgtgagaagaaagaagtcaatcaccccctctccaatgcccaacacagtaagcaagaagggcccaggaaaaaattaacagggaaaaacaatcttgcatttgcttagtggaatctggggtttgcacacattagtcagagctagacaaatcatactgaatacacttcttatagaaacattctagctcttatggcctttccttgctgtcccaacttttgaggtgcgaaaacacagcaacacagccaggaccggccaggtgatggcacggagcccgctcccacaggctgcgtgtgtgttctcactctcttgcaactggcctgagttaagccttctccccaagcacttgcagtttatcatcgccctatttactgtattttcatgttataaaagtgatatacacccaacgtagtaatttgatctatacaaaaaagagaagaaaaaaagctactcataatatcactgtctaatttaaggttttggtgtagtctttctagtctttttctatatggaatgtaatttacttctcaaaaatatcatttcatattctttgcttacatattagcatttttgtcatgaaatttatgccaactgattaaacagcccttgtaaattacagaaacttaaagacaatatcaaaacaatgtgaccacaagacaaagaccacctactactaaattatttttggcatgagattattttttgagaagttttataaactattaggtttattgaacactataaactgtaatccttgaaagaattttggaagcatacgataacagggtaatttgtagtagaatatagggttggaaaaccttaaaaaacacttgctcatttcttcctatatcaaagatttgtattagaaaatctatttcttacaaaaagatgtactaagtggtattatgtcagtcaagcatcttgtattattttctagctttcaataatatgtataatgtcataaaaaagagggaagaatacacaaaatacatatgaagcttactaggaatgaagaaagttattttaggaaggaaaaattggttaccatcaaggaatatggaaaacactagcaatgcatgtaagaatgacctcaaaggtcttagacgtccacgagctgggaatgcttgtgctgggtgcttcagttacaacagcatggggaagttaaatagactagtgaagctgttacatcagttaatagtatttattattatttgtggtcaccaatgccaattaaaacaataattaaatagaacatgatgaaataattcaatggtaggaaaaaaaaatctggcctacaagtgaacatggaaagtaaaagtaaatatttagaaagtgaaatcaggagtggaaaaaagctccagcatctcaccatggggtcttccaaagccagcagtactggagatgtttattgttcaaagatggacttgcttgggttgggattctccaactagagccagaggggagattctctgcttcccttgaggacacaaaaagagaggctttcttataaagcctgccacattctgtgcctgtattgttttatttactggagtctatcataaggcctgtgaggaaaggactgaatctctttctcatagccgttgggctgatggccctgcgtgctgtaggcatttaataattcactgagtaaatgaatgaaccctgcaggagattgggagcctttctgatcttgaggtctcagtttggactatctttctggaatggatagacgaatatgtttttcagcagcactctaataagcgcacattgggtgactaagcagaagagtgattcgttttgctagaattttccaacctgcaggagccagtccccctggtgtccccattccctgtcccctcagtcatctcagcaggaaattactatcctttctcccacatgggtgatgaatgttcaaggcatttcagcacactgtggtaaggcccagaatgggttcaagtaaaagtaaataccagtccttattaggagatcctggcccctctgctgcatgtgtcccagtacacatgcagcttcctgctctgtcatagaaagcagccctctagggccactgcctccagtgagagtttcctgacctccaggaacttctgtagtcaggcaccactcccttccctcacacccaacaccctgttgttccagattttatcactgtgcactgatgctcactgcgaccccacatgtggccacaggaggaactcggctgagggctgagaagaccagataatgacacagagggctcacttcaggaaacccagagagctgcagcggctcctccagggccattccacgcattcattttctaacaagtcataagtcaaagagtgacatcaggagcggacagcctggtgtccaggcatgagccatggcaacagattctgatttcccagaacggctttggtctttacctggtgttggatatggtagtgttagctggagtgggaggagattcacattgtatatttgtttagtgactccaaagattttaaattatattgtgttttttattattttattccatttttttagagacagaggtctcactctatctcccaggctggagtgcaatgatatgatcataggtcagtgtagcctcaaactcctgggctcaagtaatcctcccatttcagcctcctgagtagctgggactccaggtgtgtaccatgactcctggctaattttggtttaagtagagatacagtctggctatgttgcccaggctggtcttgaactcctggcctgaagcaatccttctaccttggcttccaaaagtgcttggattgtaagtgtgaaccactgtgtgggccctggtttttgtttaatggctattaaatgctcagaagtgaattaaggttgcagttaaatgcacaatttttatatcaaactattttctttgctaattcacttctatctgcgtctaccagctgtaaactacctgaagcagagaaagtttctttaggttggggcttcctgtagccccgagctgagtgtcttatgcagcattggccgagtgaatgaatttgttgggtgaactgctgcggggtttagagtccgcagagggtaggacaggacagatcgtgatagaggctaaccttctcatctactctaccatttcatgctctgtttgggcacctccatcacccctcacttcccctgatggtccagtctctctgggcctgcactgtccagccaccctcttatccctaagccaaggcctttgccaactaaagctcaggagtaaagtggccatcactgaggccattctatgtatgtatgtatgtatgtatttagagatggagtcttgctctgtcacccgggctgaagcacaatggtgcagtcttggcttactgcaacctctgcctcccaggttcaagcaattctcctgcctcagcctcccaagtagctgggattataggtgtccgccaccatgcccagcaaatttttgtatttttagtagagatggggtttcacccttttggccaggcaggtctcaaactcctgaccttgtgatccccccaccttggcctcccaaagtgctgggattacaggcatgagccactgcacccggctgactgaggccattctaaggaatatacagcaagctcttcagtacccatttttgttaactgaggtataactaaatgatacacaggcccagcacagtggcacaaacctatagtcacagcaacttgggaagctgaggtgggaggattgcttgagatcaggagtttgagtccagcctgggcaacacacgtgtataggtctatgagtctggaagaatgtatatagccatggaatcactaccatgtcaaaacataggatatttccattatcccaaaaagttccctcctgcccctctgcagtcaaacacttccctcccccaactcctggcaactgctgatctgaactgtagacctgaaaatgtcattcagaacccatttcatctggacccttctctctgtgtcaacattgctgtgagcggtgtctgtgggatttttctggacgttctctgccatgcccctgctccttccttcctgccttctggaaggcacccctgccaggagtcggctgcattaaagtgggtgtttcaggggtgtcttcctttactctcttctcactgatttccagctatccctgtgtctcttgtttaatgagtgccttcacccatatccttaaacccaccagggcgaccttcctgcccctttctttggagagctgtatctgtatttccagtggagacacagactgttccttagatcctattaaccctctgagctctctctcttcaagccaggctcatttctggcttggccaatctgcctcctcccgtgtcctttccatgacacggtgatggcatcaccagccagtcaccaagctagaacagtcccttcacccggcccctactgtaggaggatacttttagagtatgtctgcaattcacccccactctctgtatctacttctgtggccaaagtgcggaccttgatttcctctggccccagctgaattaacccacctctctgggcctggttctcttttcactaaacattctccacattgctgccagagctatttttctaaaatacacatcagaccacattcttctcctccttctttaaaaacaaaaaatcaaaaaaataaaaaaccaagaaacaaacaaaaaacccaccctaccgtggctcctcagtgtgtagagatcagattcaagttccgtgagatggtcttcaagatccttggccatgtgaccccgtcctgctatcccaatcccattcccattcccatccccagcctccccacctcatccaactccagccacattggatcaccccaggagaggatgtcatgtattagtactctggtgcctttgagtcaaaactcactgttttgccagttcagaggttgagccctttttgaagaatcccctcttcttccacagcccaggtaagttctaccccaggcataatgagctgttatccccctgggatctgagggcattcagaataccaacacaatgctctccagatacctctatgctattcaaatccatgcatctcacacctgctcatcttaaaatctctgtgcctcacatgcaggaagaattcaaatgatgctgattgaaaaaacattgtgtccaatattagatgaagcatgtaaatatcaaggcaagaatctgcactttttgtctgtctattgcttgtttgcacaatagagccacatggtttattataaaaaattattataatgtatgctgtttaagctcagatcactttgcactaatgatgatgataatgatgggttagaattttttttcttttcttgccatgggatctgccaggttttaagaattcttttttattctaaaccaaattcaggagcactcccaaagacaagaaatcaaatttaggccactgatggtaccaacggaaggctatcactgtgtagctataccaaatgaagccaatcttcatggattttaagcactttgataagcttttatatctctgctcatctcgtttacctccatagataacacaaaataacagaataatcaaccaatagcaacgtaatcccatcacaacaacatcaaaaatgagaattcatatgattcagtaatttcctaagccagaacttcccacctgatgtgctggggaagtgagagggtgaggactgctttccccagcccttagggtgactgggcagatcctgtctggtgtgagcattcaaccctactgattacatcattttgggtgctatgtgtgataaaggttgacaaccactgtcctaagccattctaccatttaaatagactgaattctcccaagttatgttcttacttgccttaggaaggaaattagtattatgactctaaggatcctgaacacatgatctaaaaaaagaaaaacccaaagcacaatggcaaaggtaggtgagacagagtgtttagaaaaatagcgaatactgtactattaattactcccaattctccctaatccatgatttttaaagagcgggtggagcataacgatttgaggcactgcgacaatgcagaatggggagggattttggaaaatgtgactcactcaccgttccgaccaaagggtaaatgaacccagcacctatgctggcccggacatcactgataggtaagatgaagtcccttggcacaccttttttgtcaggttggtgagacagagaaagatcggtctttgccatgcagatgggcaaatttccaaaaccctgtaagaaaggaaagaaaatgtgttcactgatatagacgtgagtctcctgtgtttttcaatttgcactttatacagtctcggcagcaatggtatgccagctcagatcgaggcacacgcaggagctgcttgttactacttgttcactgaagaagcaagaaggtgaggataaaaactcatctccatgtgatgactgtttagtaggtcaggggtgactattgtttattttggaggttctcgttaagagaaggcagtgttatgtgcatgtttgggaaaagcattgctatttgcaggcaaagcagcagctgtagaaaccgctttccaagactattaatatccgggacccagcaaggtagtctggagaaaggctctgcgactaggctcttagtcatgttgttcactcattctggagtcagtcaagaagcaaagggttcctttgtgttggtttatgaatcatggttatttgatctgcaactacattacaagagctaagatgaggtcactatttaagcttcttgtttttaaggacaaaagtctatgtctgacccagagttccaaaggtgaaagagcaggaagtcacatgtggtgtctcacaaaaagcacagtgtcctataagcctgtttctgattaaatggcacacagtgttccttcagaggctttgctaattcattgcaaccacatacttggcactaactttaaaaaaaataaaaatagagatggaggttttgctatgttgctcagagtggtctcaactcctggcttcaactgatcctctgccttgcccccacaaagtgctgggattacaggtgtgagcaccgtgcctggttgacacgacttttaaggagtatttccttgatagagataaagggaatgaaatctttagtcaaattttcataagacttagcctaaaactatttggaagatcttagagtcttatcaacttagggaggacttgggcttggggccattttctttttgaaatctccactcttctatactgataagaattttgctgagtgagaatcacaactgcctttcagaatggtgccagaattttgaatttcagacatggttaaatattaaagtaatttctataggtttgctaatgtaaaaattttgttagtaggcatattaaaaagaaacagaaaccaaccagtatgctatatactgtcaccagattacttcataaaagaaataacattttaacactgaaaggagaaaagacttaatattacaataaatgatagtcttaaatatcattattaaaaactcggggaataaaaaacaaagcaacctcatgagaatgaccttattttacttggttcattgcacatgaatgaaaacttcaccacaatgcctaggcacagagcagtgcttgggaatcctttttgtaaagggtaagccaagaacatcagggaaaattctaagaatttagaactttctgagttcctattttaccaaacctaggagaacaaataccctggctggcaatggtagcatttaacaaaatttcaaatgggtttacaaaaaagaataaggagttggagattgtttttaaagataaggtcaacactaccaatcatgaagctctttagccaacaggctcttaaaatgttctgacttctatctatctgattacaccaaagtaggagggacactggaggcacatgatccttttggtaaaaggtggctgagcctcctataatggagttgattcatcatgactgtcactggactaggtgatgacacatgctgtcagatcgtagccactttcccagctgtttgcctacttgcctttctcagtggctagaggtagaagatgatggagccttcaacctcagtggaccagctcagtaaaaagccaatgaaccgcttgcataagaacagcaaacattcccatctttataggctgcactcctatctgcctaccctggcaccttgctagcatttttaaggtagtaagaggcctgtaaggaagaggaagcattgcaattcatgcaaatctgactccgcagctctactccaaaggatagtttcaacgttctgggctgagtgggagggatgaaagatcacacatcacctacaaacagggataccacccatatcagacacatttatagtcacagaagtaaatgatgcatggatcagaggatacatgcctcaccataaagttctaaatatagtttacactctacccgaggatattgctttcatctttgttaaccagaaaatagattaagcaaaggttagctggtgagacatgtacaaatcctcaagtcaagctgagtattctgagagcctaaggtgaattttttcttttcccctaaaagtacaacttttacctgctgagtgtaacgatctattttgacttgtgcctcaggacagagttcgatatctttggctccatagacagcctgggcaatggtccttatcttgtccacaattggaagctgcagaaacacaaattataaaaaaattgtgtaagtttaatctggttaaagatttttttaaaagtttagtgacacttactgtaattgcttaaaattcccttatcagggtaccccctcagcaactgcaggattccttgcaaaccctcttttttccttttagcaccctaaagcactgaaattttcagtgtcagaatagatcggatgtcaactagcaaataagccttaggtgttcaggcaatttagaggctgcctagagcccatgtagaatctgcagagggaggccgggcacagtggctcacacctataatcccagtactttgggaggccgaggcgggtggattacctgaggtcaggagttcgaaaccagcctgatcaatatggtgacaccccgtctttactaaaaatccaaaaaaactagctgggcttggtggtgcatgcctgtaatccgagctacttgggaggctgaggcaggagaatcacttgaactgggaggcagagactgtggtgagacaagattgtgccactgcactccagcctgggtggagtaggactccgtctcaaaaaaaaaaaaaaaaaaaatctgcagagggaagagggaagttagtgccttacagagggcttctgactaggaagccccagaactgcggccgaccccttcctctccctgcctcacccctgcagaaagatctgcagaaaaagctggaaggggtgggatggtgtgtgtgggggtggggactggggctatgcagtttccagacctggtctttggcaccctctacaggacagttccattcccacacctgagctttggacaactgaatcctatgccccttcccacccagggaacctggtgccagaaattcccaggacttacccaccatccaccacgccacatagcaagtgtcctcagtgtctgcagaccagaaacaactcccttgtgtctcagcactgggccacctgctgaaaccccaaactgcctgccccattgtttgagacccagtcaggccttggctccaaaagtcctcttggactgccactggcccccagggtctctcctgactgcacctcggtcccggagctcccacaccgctgggccccgagccccatgccccgatccagctgtggctcctttacgggggccttgctggcctttcctaagggaggtgttttcccgagggcaggtggactgctcctcagactaggggccctcggagggccaggcctgggcttctacctcctctcgcaggctggtgtttctctgcaaatatggctcgtgtgtcctccttcctctcagactgggggcccctgaggactgggcctgagtttccctctcccccttcagaatgggggttccctgaggactgacccagggcctccccccgtcccctccatctggctgttaatctccaacacttccacctccagtcctattctgcacagcgctccccagcgctgggagctcagaggcctcttcagccttccccagggctggggctcagggagggcttcctcaggcgctggccccagagtcaggctgcacattggcttggaggacaggcctttcctctgggactgtgaggcccagagtgcccacccagaactccacctctgacctcacaaaggcctgcttcagaactcagtctccactgcactgctggccagacgagggaagttattttgggcagtgcatctggacttggttcaagtggcaccagccaaatccctgccttactgacctctcccctggaggagcaggagcagcgctcaaggccgccttgggagggctgagaggcaggctctggactggggacacagggatagctgagccccagctgggggtggaagctgagccagagacagtcacagaggaacaagatcaagatgcgctttaactgagaagcccccaaggcagaggctgagaatcagaagacatttcagcagagtgagtggggctccaggcagggtggggatggggcagcctcctcagtgcccagatctggaagggtcattccctgggtaccatacagcgaggaggtgactgagggattgtttggggaaggagccccggctgggagtggaagtcccggctttcttgttatggtgcagtcctgtgttgctgtgtgacacaggcacatacaccttctctctgggcctcagtttccttacctgtaagttggttgttgggaggaccagcggtagagcagagatggcagggatgcactgggctgggctgtcagcagaccatgggggtgggacgaggagagagctgaagaccaccggcagtggaccacagggggaggcatgcaggccagagacgggtcagctgccggcttgctggagtcattcctcccacgcagtcccctcctgaggggctggagctggggctggagggtttcagcagtcagggctggagataagagtctgtgctggagctagagggaactgggctagagaatcaggaggacagacagggtgaggggacttcgggctaccttcatgctgtctgttagagataaagataggagtacaaaggggaatttttgggtgaggtacacgggtgaaatgagttttcagggcctcatcctgtgtgttcaccttctgtgtgtgtgtgtgtgtgtgtgtgtgtgtgcatgcgtgcatgtatgtgtgtgtgccggtcctggacagtcacagcttaagttagcagcaagagaacttgaggttaaaggtatagcacgcaaatatgaggctggagccactgagtagaggctgagggcatctccacagtccaaagctgggctgcagacagggaaggtcagcaggagcact

SEQ ID NO: 2283 - DNA, 4949 bp, Homo sapiens
gttagaggtgtttaaccataactactattcacgaaaaaggtctactcattacaactgaaaatcataaaattgtaagttctacaaaaataagtcaaccttatctactgcccagtcctaccaaactacagaatgtgagaacagaaggtctgaccgtggactcgagagctgacattaggaatgtcaccaccatcctgctctccaaggactcctcatcttcaacaaactcctcatcttcaatgggcagagtggaaactgcaacttgtgccatgatccttgcacaagaaaagtagtaagaaagtgagtggtagaaatccagtgtcctaaactcacatccagagctgtgagagcttttccaccggctggataattcacagttttcttgaatcaggggaaaaataagactcagaaactaggaattcgttttgcccaaaactctcatcagatagagaatccatccactaactttctgtctagtattatttccataagttagatcagtatcactcccaaaacaaatgcacatggcacccagaatctgcgcatttctcccaagtaaaagaggaggtggatgggcgcagtgtctcatgcctgtaaccccagcactttcggaggccaaggtgggtggatcacttgaggtcaggagttcaacaccagcctggccaacatggtgataccgtctctactaaaaataaaaaaaattagccaggtgtggtggcacgtgcctatagtcccagcttcttgggaggctgaggcaggagaatcgcttgaacccaggaggctgaggttgcagtgagcagagatctcagcactgcacctgagcctgggtgacagagtgagactctgtctcaaaaaaaaaaaggggggggaggaggcaatgcactttacaacccagtgatgggctaccacaactcaacacagcaaagaggtgccaagctccctttctcccctgcacaacccgacacagaagagttggtgcagtggaatgaggttgaatggagagaagttcctcttctttccatttttttttttttttttttttgagatggagtctcactctatcacacaggctgggtgcagtggcgcaatctcggtcactgcaacctccgcctcccaggttcaaccaattctctgcctcagccttccgagtagctgggattagaggtgcccgccaccacacccagctaatttttgtttgtttgtttgtttagtagagactgggtttcactatgttggccaggctggtcttgaactcctgaccttgtgatccacctgcctcggcctcccaaagtgctgggattacaggcatgagctgctgcgcccagccaagaagttcctcttcttactgagaaaatggatcacagggcatcaagtaacacataaaattctttataataagcagtattatttttggaaaacctttcctaatattttggtatcagcaaaaaccctcagattaatttcaaacactataaaaatacaatacataaacagaaaatattaactgtcagcaatgctatagagaaattggaagctgtatgcattgccttttggaatgtaaaatggtacagcccactgtggaaaatggtttagcagctccttaaaaatattaagcacagaattatatgatccaccaacaccctttaagtgtatatacccaaaataactgagagcagggactcaaacaggtatttgtacacccgtttaacagcagcattattcacagtggccaaaaggtagaaccaaccctaatgcccatcagtaggtgaatggataaagaaaatgtaatatatacatacacagagtattattcagccataaaaagaaaaatatctggccagattcaggggcttacacctgtaatcccagtattttgggaggccaaggtgggcaggtctcttgagccccgaattttgagaccaggctggacaacatggcacatttggtcagaagtgtttgaccataattactattcaagaaaaagatctactcattagaactataaatcataaaattataaattctacaaaaacaaatcaaccttatctaccacccagtactacccaattacagaatgttagaacagaaggtctcaccatggactcaagagctgatatgagcaatgtcaccaccatcctgttctctgcggactcatcttcaacagactcatcttcaacggactcctcatcttccacggactcctcatcttcaatgggcagggtggaaactgcagcttgtgccatgatccctgtgcaagaaaagtagtaagaaattgaatggtagaaatccagtatcctaaactcacatccagagctgtgagagtttttcactggctggcaaattgtttctttgcatcagagaaaaaaacaaaacttggtaacttggtattcgatttgcccaaaactctcatcagatagagaattcatccgctaactttctatctagtattatttccatgaagttagatgaatatcactcccaaaataaatccacgtggcaaccagaatcaatgcatttctcccaagaggaggtggccaagcgcccacatctgtaatcccagcatgttgggaggccgaggtgggtggatcaggaggtcaaaagattgagaccatcctggccaacatggtgaaaccctggtctctaccaaaaatacaaaaaatagctggatgtggtggtctgtgcctataatcccagctacttaggaggctgaggcaggagaatcacttgaaccagggaatcagaggttgcagtgagccgagatcgtgccactgcactctagcctggtgacagagcaagacttcgtctaaaaaaaaaaaaagaaaaaaacagtaaaatacaaaatgtctttttctcctaaccttcttagccttctgctggtacttcaatttctgctggtactgtttggtcattgccctctaaagaatgatggcttcctaaaaagaaaacaaacaacatataaaccaataaaaactcacattgaaagataaaaaataatctaggtgacgatgcaagcacttttaagacataataggccaggtgcagtggctcacacctgtaaacccagcagtttgggaggctgaggagggcggatcacctgagttcaggagttcgagaccagcctgggccaacatggtgaaacctcatatctactaaaatacaagaaatcagccaggtgtggtggcaggggcctgtaatcccacctactcgggaggctgaggcaggagaatcacttgaacccaggagacggaggttgcagtgagctgagatcgcgccgctgcactccagcctgggtgacgagagtgaaactccatctcaggaaaaaaaaaaaaagacataataaacataaaatatgattctattaactctattaatccaaataacgttttctaattcagaagaaatatataacatgtctatttggtagcttaaaaacattcttttaaaatacaaatacagtagacccaagtaggcttggggacttaatattagttactctagctacatgataaaattactggatattggaatctgaagcagcacaattatgctacaagtaccatgctcatctgtcactgacacacacacacaagtgtgaatgcctgctttgctcaattaactctgtaaataagttcaggatttgctgtggaatgttccctgctttccattttcactatggtgaaagttatggaaactcgatccccataatttaagcaaagttgtacttaaagtaactcatatgtaaaaatttaagatactacctttagtgtcaaaaacattttaatccaagtaacgtaatctgcctgcttctaaaaactggcatataaagcaacagatctgttaggcagtcacaaggtaaacaggctcatcctactggagcagaagttttactcacaaatatgaaagaaataatctaaaatatcagagtgccacttaggattaagaccacaaactgcccccagtacacatcctctgtccttaaagatctgagctactaacatggaaaagattgaaaaacactgtcttcaagtataaataaaaatatattacatttcggtaagaatacattgtttagggggaagggaagcagatgctcatctattttgtcctatctgttgataactaaattcagaagctgtactaaaagtcaaacaaaagttataaatacatctcaatttttaaagagcaatgattacagtcagaaaaactcatttggtggctagtattcttgaattaaaagtgccataccaaagtgaaatctttttggttttcaacatctagctttttcatgtcacaattattttgggattcttttccacttactgcatattgtgaaaactcacctgaactcaaaactctaggtaaatctataaacctgtatctcagaatccacctttaattcatttgtaaaatacactttctctgcacacatttcctctctcttcttttaaccgtaatatttggatttagggagcatcaagttccttgactgtaaagtcaacgaaaaaagagatatgaagtcaaaagaatgggagataatgaacaagaggccagtagttaaaaagtaaaatttcaataaagaataacagttaagatggtcgttcatgttattacccaaacactaggggtttcgtccaggtcctcctgctcatcggagaaaaagccagtcactgaggtgacaagtactgccaaggaagaaagctttaacctggtgctgcggcccaggagctggaagctcagtctcaaatccatgggcttgactaataggggcaggaaaaaaatttaacaatgtataagagaacagaaattagggaggggcaggaggcatgtggtgctgtgatctggtatgtttcagttatctgatacttcctgaaggtctttttttgaggagagaactcagatacaacagatccaagtttcaagctttaacagcagggtcaattttgacgttcatc

SEQ ID NO: 2284 - DNA, 6230 bp, Homo sapiens
cttataaataaaaaaccatatatattgtggaatattaaatgttctgcatttactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgcctgtctctgttgggacaaccctggctcttgagagtggcttgttgactgctggctgcatagctcagtattctgccatgttctgagtagaagaggtgcctgtggttgcagggaaacccacagactggggcttgaaacttctgtttgtgctgatttaccttcgaggcatggtgcgcatggcaaagtgacattttcttgtccagcatttgtccaactgccgtcatgagaccctgagcttcagcactgctgctgtacacacatgatctgttttttactgttttttggctctcagcagtgactggtgctggcttgctttttttctttgaaaaaatccactgaaaaaattgcttgatgttttctccaaagtggcttactgaaggaggctgtttctttgatggcagtagctggacgccttcatcctgatgggtgtcttctgttttcctgactggggtaagttgaggagtcctcaatccttcaagcctttcttcatgtttttctaagttgggcttcctagacttctcactcttgtgaatagggggaaacattggcctttggctcttgcatgagccttgacagtttgggtttctgggctcctcttgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcggcacaaacttgaggctgggtctctgactttgtggccattccaggctcaaattcactaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctgggtgctgcctgtgaggctgtacgtgaggggcttagatggccacctgccctcctgtccagctggaggaggcttcaagggcccatgatcattccaagatgggattcctcgcggtgccctctggaactgcttccatgcaggtgaggaggccagaagactctctggcatgtgatcagatgctttggtcagcacctgctttctcagacttgccattggtggctttctaaggaacatgtccacctcaacttctgagccagccccagattcacaggtggctgaggagggaccagcaagctgcgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccgactcctcagaagtcacccccagaaccttccgtgggaagcttttcatgtccctggatagattttgtggggtctcacccagaatttgccccagatgtgggcacaggtccctctctagctggaacttcaccttctgtgcctccttgctgctttcacctgtggacgtggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtttcctcaacaaaggccattcagggtgctgagtttcaggtagggagagagcttgcactttattctgcgatgcagggcaagctactccagtgttcttaatcagggatggaaaagcaggagataggactgggaaagaagactgaagatgggcctgagcctcggcctgagccataggtgtgggcaggaattggggtgtggatgaaataaagggttggcggtgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgcaagagcctaggatctgagcacttctgaggtccgggcagctgtttcgagttctctcccatgttccagaagggttttgggtttgtggtgtcctgctcagcatccaatgatttagccaaattccccaaagaatttaagtgcttttctggggtcatttgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagaggatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaagtgccactgagtcacagtgagatggagttatcagtgtggagtcccgcaggggaggagcagtgaagccttttggaggaggcggagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcgcccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccatcccacaccctgattgcccaattctcctgctacccctcgccccagggttttactcccatcctctgtccccctggtctccccatcccaggtcagctccaggctgcctgtggcccttgggtcatgtcccagccctggtaggaaggatgcagggaaggggaagtgcctcacctctgcagttgtgaaagaaggtccgaagtctcctccaggcctctcgggcactctctaccagctggaaatcaggagactgggttagggcagtgagggaggggcctgggatctcacaggaggctgagtggctgtttctttagggaggaccatggggaattagaccctggaccccacccatctgtgtccaaagccacatgaccccgacgttaatagcaaggcatggaggacagggctttttcattcacaacaggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttccctccgggacagatgagatcaaattaactctagtgtgctctggcagagccttacctctcagactgtggtttttcatcctgcctctgggcctccgcctccgccctactggacactgggagacatgatgacgtacggagacaagatgacgcggagagacaagatgacaatgggagacaagaaagggcgagaagctaggactggctctccctctctgctccagcccagccgcagcatgctgcactcaggaaccgcatgactctctctgtcttgctcagggagctctgtgtgcttcctcccactcatgtttaactggatgataaactgcttttcttcttagaaaaacagcaagagggggctgggcgtggtggctcacgcctataatccaagcactttgggaggccaaggtgggttgatcacctgaggtcaggagtttgagaccagcctggccatggtgaaaccccgtctctactaaaaatacaaaaattaggcaggcatggtggtgggcgcctgtaatccccagctattcaggacgctaagacaggagaatcgcttgaactcgggaagcagaggttgcagtgagcctatatcactccatttcactgcaacctgcgtcacagagcgagactccatctcaaaaaataaaataaaataaaataaaataaaataaaataaaataacacacaaataaaataaaaataacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcgggggcccagcacaggccccagatcaccccacacaggggaggctgggccctgagccacctgccccagaaaggggctgatgagccagggctcagggcctggtctcggacagagacctccccagtctcatgactggtactggtgctgagtccactggtttgattttgccttgatgcctcctgtgctcccccacagatggactgagatcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggtcgggactgagggttccttacctttctcttcccaggcgatggtgagggtgggtcatcacaatggaagtaagataagtaggggagtaataggaagaagaaccccagggcaaacaccaaggtgaggaagatatccaacacccatggtgtggagctgggggcgtttagcgatgaggcactaagtaattttaaaggaaagggaagattctccatgtgaataggcacgttgctttcaagcaact

SEQ ID NO: 2285 - DNA, 237590 bp, Homo sapiens
gagagggacggaggaagctgccggtataacgggaggagagcgccaggcggagctggggcgtccctcccgctcgcttcttgactcgcgttggtgccggccgcctcccgcgcctagtgtccgggacgcgcctgaacctgccgcctccgtgcctggggcggcgccgcgcggcccccaggctcccgcggggccgacctcggagacgcagctggggccgggcgcggcttggcgggagggtctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagccccgtaggagcaggaaatccacgtaagtacagcaaatggtttaaaacttgcgctaggctgtctggaaaactttgtatttttttattatcggtaatatttggaagtggaattgcagaacatgctcctgaacatgaagaaccttaaaaaaatatttggaattgcaacccgaaaaagacgattttgtttacaatagactttcctcttgtgggggagtctaagatataccatgcatgttttgactttttaatcgatgttcttgaatattcattgagaaagtggccgtttctgtaaaacctgaaaagagcatcttaataagagattagcctgcaaatgctgtcatttattcctttttaggattgtaatattttgtaggaattaagtctaacagggaaaaaactggcagacattacatcatactgcatcaacttagatgttagcagcttacagttttgccgaccttggcagcttcagagttaaaatgctaattaacttccacgcagtatagggacagagtgcctgtaggcgaaactaaattaataacctgccctaactactaagggaataacacttgaacacccctgtcaggggcttcgtttctcagtagaaagttcttggttaaagacaaaactcagccagtcatttaggtgatcttgaaaatgattcctctctggatgctaatattttacattatttaatttgccatcgggttccctgttttttattttacttaatttggtaaacacctaggaagcttttatttctagaatgggctatgattctaatataatgatgatattccagacagatgagcaaaacataatgtacccatattttatcacacataaaaatgtttacacaacattgcacatttttttttcggcttggagtaaatctctatcagagagtcgtctttctttcttgattaatgaaaccatgagattagaatttttaaaatgtcttcctcctccttctcaaatcacttttatttttctttcagtggcatctccctgctgtcagcctcagccctctcctaccaaaatctctttcgaaataagttccaataaatgctagtggccatgtttggaaatttagattattgcaggataaccaagggtagctttcagcagttttcctaagctgtcatgaaaagtttgccgtagctcagtgctgttctgcctgtgggctcaagggtgggttgtttcttcacacacagggcacgcacatgggttcatgcactcactgtgcatcatgattcagttgtgcctcagttaatcctacacttggtgtgcccttcgaaaaaacaagctccggattgctttggtcagatgctgtaccgtgtttcagattcaactttaatctgcttttgtgagagggctttgtgaataaaacgttgttacttaaattaaaatccttgggtcttgtaatggaaactgccgtttggcttaaataaacacataaatgagttacttatagaaaggcatgctagagtaattgaccaatcaactggcaaaatacaacaaaataagtcactagaggtcactcttactattgaataaacagggcttcaaaaagaccttcctggagaaaaatgaaatctgagatcctgccaccacctttcctgtttttgttgcatagttgtgattactttttattctcaggattagttgtattgatagttattttgcttggaatccagtggaaggattacaaagcccatagaaattaagctcttctcatttacagtgaacattctttttggaggaggggagggcagggacagatattccaaacggactcagcaccagacgggactctcgcgagttgctgagtgacacgtaaaatttcaatactactactgtgggtgttttcagtcttctttcgttgatgaaacttagtatcctcatatctaataaattttactaattttaaattaccttttagatcaagtaattcttccagataaaactatgtaactataataattataccaccttcaataccaagaagaaagtcaataaggacatctaaaagtttccttctcatgaagacaccatgagttgctcacgttattcacagctggttttccagaagcacattggccacccacgaaggcagcctgttgatgatggcatgaaatggctcttcatgggaagagctctctaggccgggcacagtggctcgtgtctgtaatcccagcactttgggaggccgaggtgggtggatcacctgaggtcaggagttcgagaccagcttggccaccatggtgaaaccctgtctctactaaaaatacaaaaattagccgggcgtggtggcaggcatctgtaattccagctactcgggaggctgaggcaggagaatcgcttgaacctgggaggtggaggttgcagtgagccgagatcccaccatagcactccagcctgggcaacaagagcaaaacgcaaaactccgtctcaaaaaaaaaaaagctctctaaacatttggcattttggggattatgtgcagtttatctgaatgttatttgacctgacaaatacatgggaaagctttgttaggaagattctgcatgaagggaaatattttcgtaacttcagtgcccatagacttgcactgagtgaaaggtcacttactgctctcattgagtccctgaaaacaacaggaagcatcaagagaaagattgaactctgggcactgatcccagggatacacaaacaaatggctgggcagattttgcagaaattcctgtaattggtaaaatgctgagtaatagcctttgatgtaacttttcagtgggttaatttattcattacttagcctaaaacacttttaattttaattgcctcaattttttcccctaaatggttatgttttgcaagttcgccagccagcctggggaaagaagggtaagcctactatagagtgtgtgtgggttagttaggaaactcacttagatgtgaaatgtgtcaggaaagagatctcacagagtgtaggaataattatttttacagatgtttcattttggaccttttagtaataccattttaagagagattctgcagatgagtaacagactcttaattttagtgtcaaatggtactctataaaaaatggagttcaggctgggcacggtggctcacagctgtaatctcagcactttgggaggctgaggcgggtggatcacttgaggtcgggagttcgaaaccagcctggacaacacggtgaaaccctgcctctactaaaaatatgaaaaaatttcagggcatggtggcaggtgcctgtgaggaggcagtgagctgagatcgtgccactgcactccagcctgggtgacggagtgagactctgtctcaaaaaaaaacaaaaaaaaaaaaacaaaaaatgtagttcacatgcctttattcattttcaccaaactctatacaaacagtacggagctgaagtagcccatggaaatgataatcaattccaagacattggtttgatcatgaaaaaagaaaaatcaaattacttggcattcttcttcctcttcctttccccttctctttttgaacaattcagtccaaggtcattcagttcagcttaggcatccatgctgggtagtggggaggcccaggaccatggcagagcattcagaaaccagcagggtaaggaaagcatccacagtatagcaagggtggggacctggagagacaggagacagcactggtggtgacctatagcaagttgtcagaggttgagtggagtgaggaaggaggcattccagattgacagaggctaagaaaacaaggcaactaaatactattctgcattaaatgcttatgttataaaggacatgattgggaattggtgaaacttgaacaagattggggattaaatattggaactttatccatgatgactgtgatgatcatattatggttatataggagaacatctttgttgtaggaaatgtacattgaagtattcaggggtgatacagcatattagcatagttcttccatgttttctgtaaattggtttcaaaatcaaatggttactttaaaaaaccattcaaaattgtgtttaaaggaaacatggaccaatagaaaaactcagaataagtaagtgtagttaaattgatgcattttacctaagagatgtagattaaaaataaagaggctgaaaaaaaaacaattatgagaaataacagttcatttatatatgtctctaaatcaaattagcctggatttctgaatgacaaagatgtaattggcactgggattgttctccattctttttgggaagtttattgcctaggacatctgtatcagtcttcgaagtactttttaaagcttgaatatctgaatgaacccgtcagactgactgttatctggtcttctgtaatgggcttccgcacctttgacgagactcttagctgaaaggttgcttgtccctaggcccggttgctccacgttgtaagagcatttgcaaacgcttggttgtacatgactgtgcacatgtcaagtctgctctgtcactgtagaaaaaatattccttttccacttgacatataaggcatggaattgtttgttttaaatgtattttgtcaaggaattcatatatctgcttgatgtgttgtggtactgtataaaagacaagtgtgaaattcattgcttactatgatagccttaacaggactacagtaaatctagttttctaaaaaatggagtatatgcttagcttggttaaaattttataatgaaatgactactctggtaataaaaattaaaaaatatcataaagtgggggctaaaaaatgatactgcatgtgttccagttaatgaacatttttgttgtaataatacgaagagtgattgaaatctaaaaacatttgagattttaaaatagttttaaccttataactacaggattgtgatttaagtagcatgcctacttaattaggcagcaattaaaattattgctaagaattaaattaccaagaagacgtggtctagtatgtattgcctgggctgtggtttgaattacttttgattaagtataatcacattttttgagagtataaaaacagaggatattacttgcttctaattcacagatgtgtttatgaaccattggcaattaaagcatttgcaattgaggccctaagaaaattttaggttaaaataacatgttgagttatgccttataactcagtatatgcttatactttatatgctttacggagttttgaatatataatatatatgtataatagtatatttttccaggaaatatataacttgtagttccttaacttattttgtaactaaatcccgtggaaaaaagtttattgaatgtcattgcttctcaggcaaatgtagagttaggaaaatgatatatatacatattgggaatcttttagaaggcttggacttggtagctcaaatcttctgcaaccttgagcttcaactttctggccggttcaagagatctcttcactgtccttttcatgtaaagtcaatgtttatggaacactagaccaaaatggaaggattcctttggaaactgaacaaacagttgaattagtctttgacttgatggagtgatttgatctaaaatattacctatcagttttagatatctgttcaatcagagctgcctccatatatgcaaatgataatttgtcttggatttttagatatcttagccctcagacaagctaatagagtttaaattgaacctggtgttttagggacagttgaattgttgggttgcccaggaaaacagtcacatttttctataagtatgtgtttatttggctggaatgtgggtgaggaagaagttatatgtgaattaaaagaaacattgtctcaatgtcacatgttaaattaaattaaattacaggcagaactaagcgagtttacgattgctgccgctgggagcagagattattttcagcttacatttataacagaaggagggatttaaaatatagtattatgcctaccctgatacagctaacctcctccacccgcccctccacacacatacagctacatgcttaccctcgaactatgaaagaagggtgtctctcagacatcctatatttaacccagctttggacaggtccctggagtctagtctttttgaacacagcagtgaagataaggaatggggagggggctttgatttcaagaccactagatatagtagattcctaatttaatttcaaagacaaatcaattattaacacaaatacaaagagaacagtattttaagcaaagcttctgttgtggcagataaccttttaaggtgtctcccagttgggtttctattttagatgactttttgaagaatatatctctgtaatagaaatatgtttgatgattctcatctttaagaactgcacatttgccataattaagatatttatgaatttattgtaagaagattggtagaaaaagtaatgcaacatcaaatgggaaaataaatatataatattatatagctgttcaaatatagggtttatgattcttgtgctaatttgaactgctgtacaacaccaggataaaagtccacagctgtgttaagaaagctctcataagcttatgaaattttatagcacaggctgtcacagaacctacaatttacaaacatttgtaaaagttaggaaagttttgggttcctcaatagaaaatgatgttgcttagctttaagaaagtaactaatttatctcttttcattcttgtccactaacaaaggaacccaaatggtcttttaaaattataataaaactaagctagtaaaatatcacatagattttgagatactgtgaataaccatagaaaataacaatttgttattcttcatatataaaaataagcttaacacgcttatcaatacatcttgaactataagagatttatttcagcagtgttgccaaagggcaagcaaagcctgctgcccatagaaaactttgaattccctaagctcagggctcctcacttgtcatgtaacccactgcgtgtgcacacatccatctgtgcccatccatattcccccagaggacttggaggcaaggaaattgatgcaaatatgctgatgctcatactgtttgctatgctgtaagtaatacagtcctttgctttgacccaggagtcttctgccgcaaccatgaaacaaactggcagactcatttgttagcttgcaagtaggttaaaatctctcctcacggttcttcacagtgtacttgtctgtgcaatggtcatcttcttcatgaatataattataacatgatataagaaatagtgagctcttacctatagataagcaaacattgcaatataaaaatagcatatgtcatttcataaatcacagttgacacattctagagaagagattgggcagctttccttttttggatgtcacagttgattctactgtcctcatttcttcttttttctgggatatgaggaagaattgctgtgacaaagctcatctcctgggtggccggggttgattgtcaatttgttttgttttggcaggctaggcagatgtcctctacctccttctttatgccatgtgacattcatccctttgattttcctattgcattttatttagtattttagaatactgcccacattccattctggaaagtccactgtcccagccagagttttcttagaaagctgagcctgtgatgggcgtttgtgcaggtagcctcttttagaaagtgagctcataaaagagggaagaatggaatagagaagaaaaatccaccaaaagggggtgtcattgagctggtcacttctgtgagcaactggggcgtgaactccctgggaagctctcaggaagccggtagaatgtgtttcacagctgtgcctctgagagacagcagggggaatgcatttatcctgagtcctgtccagggattcagcactgcccttggggtgctaactcctggctctaaggagaggaatatgaacgaatgggttgcgactgggtttctgcaggcatcgcagaggccaagagacaaagagagaactcgaacactgaactttttaattttttattattttattattattatactttaagttacagggtacatgtgcacaacgtgcaggtttgttgcatatgtatacatgtgccatgttggtgtgctgcacccattaacttgtcatttacattaggtatatctcctaatgctatccctcccccctccccccaccccgcgacagtccccgttgtgtagtgttccccttcctgtgtccatgtgttctcgctgttcagttcccacctatgagtgagaacatgcggtgtttggttttttgtccttgcaatagtttgctgagaatgatggtttccagcttcacccatgtccctacaaaggacatgaactcatcattttttatggctgcatagtattccatggtgtatatgtgccacattttcttaatccagtctatcattgattgacatttgggttggttccaagtcttgctattgtgaatagtcccgcaataaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgtcattctaactggggtgagatggtatctcattgtggtttttgatttgcatttgattgccagtggtgatgagcattttttcgtgtgttttttggctgcataaatgtcttctttagagaagtgtctgttcatatcctttgctcactttttgatgggattgttgttttttctcttgtaaatttgtttgagttcattgtagattctggatattagccctttgtcagatgagtaggttgcaaaaatttccttccattctgtaggttgcctgttcactctgatggtagtttcttttgctctgtagaagctctttagtttaattagatcccatttgtcaattttggcttttgttgccattgcttttggtgttttagacatgaagtccttgcccatgactgtgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttatttttgtcaggtttctcaaagatcagatagttgtagatatgtggcattatttctgagggctctgttctgtttttctatatctctgttttggtaccagtgccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgatactgattcttcctacccatgagcatggaatgttcttccatttgtttgtatcctcttttatttcattgagcagtggtttgtagttctccttgaagagttccttcacatcccttgtaagttggattcctaggtattttatcctctttgaagcaattgtgaatgggagttcactcatgatttggctctctgtttgtctgttattggtgtataagaatgcttgtgatttttgcacattgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgtatcaaatcaagatacaaaatcttgattttgagactttgctgaagttgcttatcagcttaaggagattttgggctgagacgatggggttttctaaatacacaatcatgtcatctgcaaacagggacaatttgacttcctcttttcctaattgaatgccctttatttccttctcctgcctgattgccctgaccagaacttccaacactatgttgaataggagtggtgagagagggcatcctgtcttgtgccagttttcaaagggaatgcttccagtttttgtccattcagtatgatattggctgtgggtttgtcatagatagctcttattattttgagataggtgccatcaatacctaatttgttgagagtttttagcatgaagcgtctttgaattttgtcaaaggccttttctgcatctattgagataatcatgaggtttttgtcattggttctgtttatatgctggattacatttattgattttcgtatgttgaaccagccttgcgtcccagggctgaagcccgcttgatcatggtggataagctttttgatgtgttgctgtattcagtttgccagtattttattgaggatttttgcatcaatgttcatcaaggatattggtctaaaattctcttttttgtttgtgtctctgccaggctttggtatcaggatgatgctggcctcataaaatgagttaggaaggattccctctttttctgttgattggaatagtttcagaaggaatggtaccagttcctccttgtacctctggtagaattgggctgtgaatccatctggtcctggactttttttggttgttaagctattacttattgcctcaatttcagagcctgttattggtctattcagagattcaactttttcctggtttagtcttgggaggatgtatgtgtcgaggaatttatccatttcttctagattttctagtttatttgtgtagaggtgttatagtattctctgatggtagtttgtatttctgtgggatcggtggtgatatcccctttgtcattttttattgtttctatttgattcttctctcttttcttctttattagtcttgctagtggtctatcaattttgttgatctttccaaaaaaccagctcttggattcattgattttttgaagggtttttttgtgtctctatttccttcagttctgctctgatcttagttatttcttgccttctgctagcttttgaatgtgtttgctcttgcttctctggttcttttaattgtgatgttagggtgtcaattttagatctttcctgctttcttttgtgggcatttagtgctataaatttccctctccacactgctttaaatgtgtcccagagattctggtatgttgtgtgtttgttctcattggtttcaaagaacatctttatttctgccttcattttgttatgtacccagtagtcattcaggagcaggttgttcagtttccatgtagtcgagcagttttgagtgagtttcttaatcctgagttctagtttgattgcactgtggtctgagagacagtttgttataatttctgttcttttacgtttgccgaggagtgctttacttccaactatgtggtcaattttggagtaagtgtgatgtggtgctgagaagaatatatattctattgatttggggtggagagttctgtagatgtctattaggtctgcttggtgcagagctgagttcaattcctggatatcctttttaactttctgtcttgttgatctgtctaatgttgacagtggtgtgttaaaatctcccattattattgtgtggaagtctaagtctgtttgtacacctctaaggacttgctttatgagtctgggtgctcctgtactgggtgcatatatatttaggatatttaactcttcttgttgaattgatccctttacaattatgtaatggccttctttgtctcttttgatctttgttggtttaaagtctgttttatcagagactaggattccaacccctgctttttttttgttttccctttgcttggcagaccttcctccatacctttattttgagcctatgtgtgtctctgcacgtgagcagggtctgctgaatacagcacactgatgggtcttgactctttatccaatttgccactctgtgtcttttaattggaggatttagcctatttacatttaaggttaatattgttatgtgtgaatttgatcctgtcattatgatgttaactggttattttgctcattagttgatgcagtttcttcctagccttgatggtctttacaatttggcatgtttttgcagtggctggtactggttgttcctttccatgtttagtgcttccttcaggagctcttgtaaggcaggcctggtggtgacagaatctctcagcatttgcttgtctgtaaaggattttatttctccttcagttatgaagcttagtttggctggatatgaaattctgggttgaaaattcttttctttaagaatgttgaatattggcccccactctcttctggcttgtagagtttctgccgagagatccgctgttagtctgatgggcttccctttgtgagtaacccgacctttctctctggctgcccttaatattttttccttcatttcaagtttggtgaatcttttcacagtcacatatttcttggaggctttgttcatttctttttactcttttttctctaaacttcttttctcgcttcatttcattcatttgatcctcaatcactgataccctttcttccagttgatcggattggctactgaagcttgtgcatgcgtcatgtagttctagtgccatggttttcagctccatctggtcatttaaggtcttctctacgctgtttattctagttagccattcgtctaatcctttttcaaggtttttagcttctttgcgacgggttcgaacatcctcctttagctcggagaagtttgttattaccgatcatctgaaaccttcttctctcaactcgtcaaagtcattctccatccagctttgttccgttgctggcgaggcgttgtgttcctttggaggagaagaggtgctctgatttttagaattttcagcttttctgctctggtttctccccatctttgtggttttatgtacctttggtctttgatggtggtgacgtacagatggggttttgtgtggttgtcctttctgtttgttagttttccttctaagagtcaggaccctcagctgcaggtctgttggagtttgctggaggtccagtccagaccctgtttgcctgggtatcaccagcagaggctgcagaacagcaaatattgcagaatggcaaatgttgctgtctgatccttcctctggaagcttcgtctcagaggggcacctggctgtatgcggtgtcagtcagcccctactgggagttgtctcccagttaggctacgcaggggtcagggacccacttaaggaggcagtctttccattctcagatctcaaactccatgctgggagaaccactactgtcaccaaagctcagtcggaaattcagaaatcacctgtcttctgcgtcgttcatgctgggagctgtagactggagctgttcctattcgaccatcttggatccggacctgtctattttcttagccttatgagctttgtcaaaagagtgcagcttcttctgttttttcttatgagtatacaaaaaatctctttgattgcatttagcaatgtttgaaagtcttaatgtgttctgggctttaactcactttgctttatattgcctccttttaatgttccttttcattgtaagtatttcttttttttttccgatatggagtcttgctctgtcacctaggctggagagcagtggcacaatcttggctcactgcaacctccacctcccgggttccagtgattctcctgcctcagcctcccgagtagctgggattgcaagttcccgctaccatgcccagctaatttttgtatttttactaaagatggagtttcaccatgttggccaggctcgtctcaaactcctgaccttgtgatccacccatcttgaccactgcgcccagtctcactgtaaatattctttccttggttactttgcccatttctctcttcttcagtggaacatgttttttctgggtttcatttgggtagcttttcacatttgatgaacgatgttgtcctcaatcataacaacagtgtctctttgtatagtggttgctcggaggtctacaaggtagtattatgtaacatttcccattgtgttctaaatactcttatctttttaagttaaaaaattgaagtcaaagctgcctctaaagtcacacacatagcttgaaataatagagttgaaatttggacataaaacatattgccatgggataatgcctgttgttttcctaaagttttaaaattatctttttgacatctcaaataaacatttgtctattgacagggctccttccttgggcacaataaattctaagatgttctggttattattttctcaaggattctgacactgccatcttactaatcatattagagccaagtacggagtagtgaacaagttctgataatttgcaggtttattactttgggctgaaaaaaatctagctgatgtcattggtcttgttgggatctgtcttcagaatgcaattggagtgcatctcttaacccttacttaagtatcactgaagttctctttcttcagctcccagatgctccatagcctgctctggcctgtgaggtcatgaggtccctttaagatgttataagttgaacacagtcttctttccatccctctgtaacatgtcttgggaagaagccatatccttctcataccttatattctcattcagaccctaattctgtcaactctcagaggtgcatagaaagaattattattatttttaatttttttagtttttaattttgtggttgcatagtaggtgtatatatcgatggtctacatgagatgttttgatacaggcatgcaatgtgaaataagtgcatcaagaaaaatggagtatccatcccctcaagcaattatccttcgagttgcaaacaatccaattacactctttaagttatttaaaaatgtacaattaagtaattattgactatagtcacctcttgtgttatcaaatactaggtgttattcattttttctatttttttgtacccgtggaaagatcatttattgccctttattaacagttcatctttatcacttatattcccacagctgtggatacatttgtaataacaattattagtgatgacatcgccacatgattttctttttaaattatatgcacctgtgttgttgtatttttttctgtgtcgtgtctgatgtctttctgcacgacttaattttgttatttggtttcctctctttctacttagcagtaagtctcaaaaaaataggttcgtcttattctcgtattatatactttagccaaaaatctatagtttaaaaataggtattgaatttatcacagaagtataatttaactacatagcaagaaatttagaaataaaaggaaagagaacaagatcatctatccagcttcctcagggaaaaggagctgatctatgttgaatcccttctgtgtttctagagctgtgtttgttggatttaacacccattatctcatctcaatccagcagatctctttgtccattatcttctcatatgcagattttcccatcccatctccttcatctctccacatgtttaaatagttcttatatttattgttgtaatgactgtagagtagatcgtcaaactaagatgcttaaatttatgtaaacttgaccgggcatggtggctcacgcctgtaatcccagcactttgggaggttgaggcaggtggatcacgagatcaggagatcgatactatcttggctaacatggtgaaaccccgtgtctactaaaaatacaaaaaaaatttagcctgggcgacagggcgaggctccgtctcaaaaaaaaaaaaaaaaaaactctgtaaactttcctctaggtcttcatttgtgttgtgtcttttgtagttctcatagaataaagtccttggtcctggtatgttaaaattggtatactgttgttataactttatatttgtagtgctgtaagtcatttgaaaacaccaatgtcaggaggtattcaatgttcctatgctaggttttctttaacaagtcaaaatgtcatctggaaggagagacaacgtgtaacccctatctcctaccccctgtaaattctaatttatagaatttaaacctgtttctatgtgtcttcttccaagcctcatctgttcccacaggtagactctaggaattgtctgtcatgtcccgggaaccagacactcatcagctggtcatgccagtctctcttcctcaccccagaatcatcagtcagcaggcaaggctcctttctcaggagtgaggttctcctgttccctctcatccccatctgccgccgcacatggctgctgtgtggctccctgtgagtgaggtgctgctccttctccagaggtgtaattcattttccatgagacagacctcagtatttcagaagagtaagccttactggggccttcacacatgtgagaagacttcagagcagagacaaaacttgagttgagccctgaagataataagtgatgggaactcgcagacagcaggggctgcaatgtcatcgggtgagcggtcaaggagcattggtgcatgcatcccacattcaggaaacagtgagaagaccactccaattaaaggaggaagcgcatctgagaaatgtgtaggggattcggctgtagtgcagagagtaacggggaacaggtgatggaaggaattgaatgccaggacctgaaatttgaatttcaggacaggtgcagtggggatccattggagctcgttgatatggctgtttgtgtgacttgcactcagcaatagtttaaaaccgtttctgctctggtgatatgtaaggtgtgtgtgtggctggggacagtcaataaggaaacattggctgtaaggattagttaggtcgttaacatgaggacctacagtgagatgatgatcatgataatggaaaagctgccatatacacacaaaaagtacataatccttggcaatttattggctgtagagggaagataagggtgggggctcaggacagtgtacttattgagtatttttcagtttcaggtgaccaaaatctaagatcaaataggcttgaacaataaagggaaccaaagtgtcttgattgaagccaggctgaatttaggcaatcagattctttcatcagcagtctgcctctttccttcttgcagttttattttcatctacaactggcctcattcttgggcagctctgtctatgccttagcttcaggcataccgtttaccagcttaggagcgtgactattttcctttatttctgttcttagcaatgttgagttctacagatactatgcctttatttgtttattctactcagtaggataagcttcacaggagcagagactttttctgttgtttatggttatatccccagaacataggggcacacctggcacagtatagattttcaacaaatatttgttgaatgaatgaatgggtatttctcccaagagttcaagccgaaagtcccaagttctgctgttattcattcgaaagtcccaggttctgttcccattcattcagcgtgggcttcctgaccatcctggaaccagtcctttccagtaggacaggcatgacattcagttgccaggcctgaggcttgtccctgtgctggccccaggtggtagggtgagcccccttcagaccccatggagtgagatgtagggaagacagtgactgaagataatcgaatggagatcaagaccatgtaaaacagaagtttttatatggaaaacagtagatttttacattgaccatcactgcttatgttcactgtgagtaaaatgtactttttccgaagcattccctctagatagcaatgcacagatcaattcagattcataataagatgaacttttggtaccttctaaataaaagcattatttaacctctcattaagataatgttaaggtacattaagaactgaaaagacaggtgatgaaatgggaagaatggaatagcgccgtatccagatgaacatccagacgtggcctgaagaaggtatgggcacccccttccctgtttgtgattcgattcccgaggccgtgctccctgctgactcaatatgtggaaccagagagaagcctgctgtggagttagtgaatttgacctaatcgagacagtctgagaaaggacaggaatctttttttttcttttttttttttttagaacaaagaggttttctgtacatctgtgataacacagtaaccatctgttgaactctttaataataggctttgtgtttttctgataattcgaagctggttaaggtgccgtcccctcatattagcagttcggtggccccttcccctctccttccatccttaggttccgccgacacagtgcttagctcctttcacagtgaggagcaagtgcagccgcaagcatggggagagccacagcctggcagagtggcttagcatcacgaagcccttctcagaaggaattgagtatctgtgcgattcaaagggatgttaaacgtattttcagtggaactctcctgcatttgccctaaaatatccaatatgtaattccatataaagtgtgttcatttcctatggcccttgtgagaaatgaccataaactggcagacttaaagcaaaagaatttattctgtcatagtctggagaccagaagttccgcatcagtatccctagtccaaaatcaagatgggccacactccctacgaaggctctagggggacatgcattcttcgtttcttccggcttcctgtggttgcccgtgtgcctcaccttgtgggtgcctcactccattttcacaccctcttctcttttgtatggggctctgttcatcatcacctttatctctcttacaagggcagttctgatggtatttaagacccagccagataattcaagataatttcctcgtctcagggtctttgatcacatctggagaaccttaccttctgaagtaaccttcacagggtcccgggattggggcatagacatatctttgggagccactgtcagcctgtcctaacacatgtaagattcatctctgataaaggcattcagccacaagtgcagtgtggtttggtcttttaataaaatcctttaagtaatactgtaatgaattcggagctccatctggagatgccaggaggtgtcctcatttgaatgtaaagctcctccccaaaggatcagttgtcgcccctccttttggcttttcccatttcctctgcagatacggacaaaatctgtccatgtattatccatgcattctttttttttttcattcttattatcagatcccagaataatgaattgctgtttgaaaatgcatggtttatgtttatcttttccagaagcacttttatacgcatctctccctagtagtgtttgctctttcagaggctggttttgttcctaagcaattaagatgcttccctgtgttttggaataaatagtagtatctaaatattttgctcttctgtttatttcctataacagatatttacacatctccctcccatgttagattctggacttcttgaacctagaaccatgtctctctttatgccccataatgctttgaacatggtaggtgctcaatacacttttattaaataagtgcaagaattaacatactcaaatgaaatgctgttttgaaaagtatatcatctctgtcttaggtaagggcaattcctcaaattgattttttaatcatttcatattcatgtggtaaaaattgtcataaactagcacatctgtgaatgcaatgttgatttgtatacaggaagcccttaggctaattttaatcttctgctgtctttcatgaacataatactaagaaatggtttctgtcccaaaccgttcataggcaccatgctgggaatcacaaagcatgctgggaatacttgtcaaggagaagtgggaagctaagagtgatgccaggcaggggtcaggggacaaatcaagaccatagagtggggagagaggaacctaggcagagctaatcaccgagactaaatcaacaagcctaaggaagtgcagcaagccaaaaaccctctggtctagcgtgcatcttcaaagttgtcacttgaggtggctgcatggaaggtggcaggtgggatcctctatgggtttatctctacttctctctcaaccgttgttgagccttcagctaagtcaccaacccatactgtgtttattctctgcattttccaaatgcttctcttcttcaaacctgcaagttttaatatgaatccagctgttacccagttcagcacaggtgatttttaaggaagtccaccatttttgaacagatataaaacaaccctgaataaaacattttatatcattttcaaccatgatcttctaggagaacaataatataaaatatacctatgtagcaatgaatctctgcctttagatggtgagaataaatgtgaaataatcaatacttgtaacattaagaccctagaaccctctatattgagccaagcacatggaaatatagtgaatcttaaccagatttccaaataagctgaggaagagggagatccagcccctgtaacacttgtggggtgcccactgtgttttcccctctgactcagtagtgtacaattctttctagaaagaaagtgttcacagaattcaaaatgatagggaaaaaacaataaacttaggtaccagatatgttcttatgttcttttattttataaaatttagtgcctttctttctttcttttttttttttttaagacggagtctttctctgtcgcccagcctagagtgtactggcaccatctgggctcactgcaacctcctcctcccaggttcaagcgattctcctgcttcagcctcctgggaagctgggactatgggcacgtgccaccatgcccagctaattttttgtatttttagtagagacggggtttcaccgtattagccaggatggtctcgatctcctgaccttgtgatccacccgccttggtctcccaaagtgttgggattacaggtgtgagccaccgcgcccgaatttattgcctttctgaagggcaagatttattcaagcctgtgccagaaattttcttcattacaaggtgactctttggcagacagatgctattgactcttgaattttccaaaggcgaaatggaaaatttcagcaattttgtttccagctgtctttacagatttatatttggaccttaatcctattggaaatcatctgaaactcgtgaaacacacaattggaaagttaattagggagaaaccaagggaaagaataactattatctattacacctatttagaaccttctcttgagatctggttattatttttattagagatgtgaatctgatacctgtaggcctcttgtgtttgaactttaataaattgtactctgctaacttaggaagactaagtttaattaagtgtattggttaatgataattctcttttacgtatttagtaaatattcagttgaagtttattgagcatgtgctatctttcagattctgcgctaggtatagagcacatgaagttgggaaagacttttattgtgccttcaagagctcatgattccacagagagagttagacatgtcagccaggaatcccagggacacgtgaaatgcccagtgctgtttcatgtatcgcatgatactgcaggaatccagggacacgtgaaacgcccagtgctgttttatgtgttgcatgatactgcaggacagaggcatcatgagaacagctatcatgcttttctaatgtaggaagagattttatccaaaaaatgtcaatgctactttagatgttcttggatttgttttattctttcccagaaaatagagagaaaataacatcaggcagacaggcttaggaggcactattccctggatgatgtccttccttcttggatcctgctgtgaccactcgtgggccatgtgggacttgtctatagatggagcagagccttagttgccttcttgtactttagcttcttcacagttttaaaatgcctttttagaaaatgtaagtaaagttcgtagccagttggattcgtatttatctatttttcttagcccactctgtagcatatttgctgacatctgggaatcccgactgcacagtgttatccagagagcatgtgtgctggggaaatcaagaaagcctctcttgtggcataaacattgagggggacatttaaggaaagtgtagagaaagcaaacctttcttaacagctctgcacatttcaatggcttcttgctgtgtaaaaatattgggtgctcttcatgctaaagatgttaaatgcaatttcttagctagattatgctgctctttgtatgtaaaaaaatcacaaattccagtgtctgactcacctgtataaatgtgacattgtcacttatggggaatatatagaaaaatgttcctatatcaaatactctgaatgttttaccaagcaatgagatactgttctccctattgtagaatagatgcttcacaatgagttactgagtttttcttttgtcatgtcttaaagacatgtcactgtcttaatggtaatgcatgcttttagaaaagcagatataattccagtatttctttatgaaatgatattcactcaggcaaattatgtgcactgaattttctttctgttgttgcagtatcatgtactcaaccaaacaaatcaggagagaccctgaattacctcttatctatctcactgaacatagttgacattttgctaagtcgtagcaatctaattaattctggttgccttctttctgtgacttaacaagttgctcacaaagaaaaaaagtgtatccaaaatatgcagttcagaatcatctaatgatatattcaaggtataacattcctctttcacagacatatcttaatgtgtgacagaaaacttatgtgtaacattattagatcaataaccatgctggaagaggtaccctttttatgacaaaatatatgacatgcctgaaagtacagtgattacaggattggactgcgggactcagaggtaacctctgggttgcttctgttacccatggctacgcataggaaaagagctacccaaggtgggaatggtcccaggggctcctcaagtttgatggtggggaacaccaggggcaagaaggctctgagggtccttatggtcttaggacaaataagatgatctgggtcaaacactacttaacccccagcaattcttttagaccagagctgaagcaatagagagtcaccctgaggtgaggatgacatggtgacatgcaggggtccttgggttggaaaggcagagcaagttcctgcaatgctcaagttatcaggcaaaaaggaggagcctccatctcctgtaggcaagtagcccgcagtaattccctctggaggggtctacagagtgggctttttccagttcatcactacaggtgttgcctctcatgggtcctggcttcacgcaggtaactctgacctgaacacctggtgcatttcacttttcccatcccccacaggttctgtgctggggcactgtgagaatttctagccgctattgaggtttgggcacagaattcacactacctctgtatgtgtgtacctaaagaacctaagcatcaaattgagtttaaagtagtgttggatgggtgatgtacccagacatcttgcagaattgagaaaatgtgggacattagggaactttgagggctaatggacctgttttatgtcttcattatggtggaggttacaaggcagaatgcatttgccaaaatgaatagagctgtacactttaaaaacatcaaataaattctctggaattttactctctgtaaattatgctgcaatgtaaattttaaaaattgtaaagaattaaaaaaggagtgatgattgccatacatcctagaatatattcatatatatttttggactattatttctcccaagctgcaatctgagtgttaaccatatcacggtatttttcctggcagctgactgtgattccccactggcctctgccttgcctaggtcatccttcagcagctcctcagagctgtccagcagccacggcccggggttttcaaggcttaatcgaagagatggtgagtctgcctttttccttgtattgctccttggtgactctcattggattttcttttaacaaaataattataattgattaatactttgcagaaggaagtaaaattcagaataagcatatttgttcacatttgaaactccaagaatgtatttgacaggaataagttgatcacttcggctttcttgtcctgctgggtttcccttggtatgatctttgtgtgccttgaacaagtcacacctgactttgacagtgtttgaactctttgtataccccttgcaatatctgagtattatttatcaaagaccttagattctgccatgtcctttttttttttaccttggattcttttgttctgccacagtatacattttgttgtcccagattatttaattatccctatttggatgagaaaattggcaaagtaaagaaacgtttaagaagatttttattatgttttaactacaactcttagtttatttcttattatggtggacttgattctctctttagcatccactgtagagaaataaccatgtaatggtttattcatgctccactgtgactattccatttatatttgtaaacatatctcatgaggagtgtgtttcttttacatatgcttaagcagaagtgtagaaaattgaatgttgtcttgctgtgtaaattagagggaactttaaacaccaaatacattgtgacaaggaatcatcctggcattttctgagcacaaactcagatagaacttctttgaataaattctcagaggaaattaaatttacactattaataaaatgtatttgtaggcatatattaaaaagattcaaaagtgtctactgtattttatataattgtgctttcctattttcttattgcccttgttcttttttttttttttgagacggagtctcgctctgtcacccaggctggagtgcggtggtgcaatctcagctcactgcaagctctgcctcctgggttcacacaattctcctgcctcagcctcccaagtggctaggactacaggcacccgccaccaggcctgactaattttttgtatttttttttttttttttagcagggacggggtttcaccatgttagccaaggtggtctggatctcctcacctcctgatccacccacctcagcctcctgaagtgataggattataggcgtgagcctgtaaccgcgcccagcctttttttttttttttttttaactccctgttgcatttcttggtgttttctgtatttgagcacatttaatgcattgcacattggaccaaataaatatgttctggcatttgttataggcagtatggctatgaaacatgaacaatttaacttttcatttttctgtttatttttcttaagtctgtgatttcatttgttgcagagatatgggctctgtttcgttactttagattctattgctgcagagcctcagtggatggtcattatcactgaaacagtgactaagcctgggcacagggggtaaaggaaaacaagagcaatctcaagccatagctcttcttgatgtcaaatcatattttgtactaaagtacatgattatgaggattctttatcttagggatcatttttattcttagttcatgttcctgtaactcatcgtgcaaaaaagcatgatatcaatcttaataaaatttattttcatgttaatgaagttagaaaaacaggcttactttagttagctatcaactaagtttattacaaattcattgttgttgcttttttaaattggttttgacttttttcttctccctcgtggtagcctggagtattcatcaaaggagttccaaattgggagtgatttattgagggctatagattatctctagtgttttcatatcctttattagattcagaatggtctatggaagagtgactgaacaaatgttctgatcataaataattaaactaacaaataatgaccccctgtctcagacattaaagcctttctccagtggagtgtaaagatctcagagctaaaaattaacaggcagaaaacaagtagtttccctgttgtgcagcccagtgccttcttcccatgtgatgggaagacgccatggaaacagctgcaatagttactcaagccttagcctgaggggtgagaggggaacaaggtagctatgcatcccgtctgtcccagtgtaaagagtcaaaatggactttttggaggtgtctttcttcatgcctcttggataccacaagtaaactagttcttccatgccactaaatgatgaacccatgggccaaacaagttaatgcacttttataagcaacttatttaattccctttaatggggaagactcaatttttccaccaaaggtttcataagttatgaagcataatccagaattactttcaacttgtaaaaatgtattatcatgaatattgcacagattggattataactaattaaatatgtttttgctttctacatcttcatagttagaatttcagtataacctctaacatggtattggctaatttgaggataaagtgacttgttgtaaatttatttatttatttatttatttatttatttatttatttatcgagatggagtcttgctgtgttgccaggctggagtgcagtggtgcaatctcggctcactgcaagctccgcctcctgagctcaagtgattcaccttcctcagcctcccgagtagctggaactgcaggtgcccgccaccacaccaggctaatttttgtatttttagtagagaaggggtttcaccatgctggcccggatggtctcaatgtcctgacctcgtggtatgcccacctcggcctcccaaaggtgtgagccaccacacctggccgacctgttgtaaatttaagaggctaagggtcagtgtgcatttctacacctttcacattgcatcacttgaagctaagaagaactctgtggtatattacatgtaaaaataagactgaaataagctgacaaagacttagggcaaaaaaataaggttttgagtagaattgaagaaaacattttgataataatatcaaagaaattcagagatgccattgaaaccatttaattatttaaacatgtttgttattcctttttctgtaacttcttctgacactaattgaaaatttcagaaaattaacctatagtttaaaatgtttaaaatatgagaattcaaatgatacactggcacatagtaaattcttaacatttcaaaataaataatgaatgatctatattaggaaatgaaatctttatatgatacacacatacagttgtaaaacttggttttctccataatcaataattggctttcagaggcaatttaattatgcaatggttgtccttagttttattatactttataataaatggattgatgctttgtttagttgacaaatacagacataggtgaattaattttacctttttccttaggcctgtcttctcatgtgcttatagctgtgtctgtgtcagatgaatttgtgaaaatatattctcttgttttagacaatttcaacaattaataaacactgtgaagttgttattccatgactgtttgagatggaaaaccagccgttttgggtatcattcacatactggctaaagacatacatttatttgtgcatttgctgccctgtgtctcctctgcatttattatattagcagtttcagtttaaagtttatttttctgtaattcagattccttgcttcttatgctggttgtcatatgaatatgcctttctaagattaggataaaacactcttcttggtgttttctttcagtcctgtcttgagttatttttaatcaaaatgctaggctgaggtcaactgattgtaatttgtttataaggaaaaaatggaaggtgacctgaagaattttctctcctccctttacccaaaagtatttattcttattttgaaatgagaaattccttcagaattccccaagatcaaagagggctatctcactgacagctaagacactgttgtcttcatctgtaacttgactagtcttgtccaaaagaggcctcttctgggttggaattgcatttagttttaaataaacaattatgcagaaagtgcttcttccatcttattaaaatttcagagttagaagaaaaggcatctgaagtttccaagtagaactataacagacctagtgtttttagtatccccataagtaagcattctagcataagggagggtttgctggttgctcattgaatgttgtcttggccactcacagaccaacacatgatgagtgtaagataaactctttggtctaaagagagaaaacataagagtctgtagctgtaacatgtctgctgacccaagctggaatgttttagtgtattgtgtcacctagtgagttttaggatttccctccccacttgagttttccacctcaggttaaaggaatgtgggatattaaggagaattattaagagagaaagggcaagtatttggaaatgcaaaacctagacaaggtggagatgatgtactggagtcagagaggaattaatagcatattaatatcaacatcattatggcccacacacatctatcatgctctctagtattgtgtccaaggtccatagatggtcactgtcttattatatccctgatcatactagcttcaccagactttcaggtcacccaggggctacatctcttagacagcagaatattaagataatggaaaacaataataagttatgacagtgtgtgaaaaacatgaaaaagattttatattctctcatgatagatgtgattcaagatgctactgcaataaattaaaaaatatatatgcttttttgcaaggataacccgtgtgttttcatggtctaacgaagttagacagcattgttatttgtggcttgacacctctgcaattgctcctttttaaagttgcaaaatgaatgtacaataactaaccatgcattagaccgaaggagagtttgagaattttttcaaggggccttcactaatgaagcaagctgtcttatttggggatctgtaagcagcaaagataaacattgcctaagacatttctgttgaaatggcgtaaaacacatggattacttacttcttcagggattttaaatacttggaaacaatgcagtgaacacagatattactgtgaagaacatttcagcaaatgagtttacaaaatggatgaaaccgaagaagtgtcttatgtttatagcttctcacctgaagagattaactatatgggtggacctcatcaacattcgaaactttctttccaagaggtttttcctgtagaattttaggactttctgggaagatgcatgacagatgcatgccattgttgatgatgtgggtcactgtggaaactgccctaatgaggccattatgctgcctatttgtgatatttggttatgagttgatgacaatattgtaaagaaaataaacactcaagctgttgaaaaattttacaggttgacatcaattatcacttagaacttttttctcaattttctgagtgaatgagcattgtgtttaaaaagatactttctgcctcatttcttctccagttattttgaaaaagctcaggtactgatttcttaggaaaagagtaaagcagggaaactagaggtgggaatttgtgctgcacacaacctagccacgactctgggtgcaccagcccttcggatgtgggcaggtaagcatttgcccaggtatcaggctgcctgtgtggctccacagaacaaagatggggaagcagaggcatcagcttctcttatagcacagcacacagccttccaggagtggatacacactttctttctattattagcacaaataattatctcaactcaatagaaaaaatagccatctgtgcctgattgtcctgaaaatgtttcattaatttacttgtattcagtgaatatgaaaccatagttggtggtttttcagtaagtacagaaaacatatttggtgggttgttttccatgcagagttaaatattgtagggccaaagtcttagttatctgtttttttttgctgttggttttttttttttttttgagacagagtctcgctctgtcacccaggctggagtgcagtggcatgatctctgctcactgcaagctccacctcccaggttcatgccattctcctgcctcagcctcccaagtagctgggactacaggcacccaccaccatgcccggctaattttttttttttttttgtatttttagtagagaaggggtttcaccatgttagccaggatggtctcaatctcctgacctagtgatccacctttctcggcctcccagagtgctgggattacaggcgtgagccaccacgcccagcctagttatctttttcatggaataaaactacagaggatacattccagtgtcagtaagacaaagagtttctgcttctctgaggaagtaagtttgctatgtagacacacacacagagaaaatggtcaaaagttgcttttataaactccaataatcaacttttttacattagcaccttactccatgaagatcacagtatatgaatacaaaataatatgtatgaatgtttatttgtggaaaaaaatcttagagatatcactccctcgtttttccaaattctgtgtattgtctgttgaaacagttcatgcttatgattctaatacatcatttccatggatctccccctcagcttagtctcttcatgtctcacttggattattttgaaagtcccatgattggacttcaacttttgaagctttccctaattaaataaatgcttagcaaagtcctcagttaatgttctttaaagtgctattctcttcttattccatgctcagttgatgaatctcagacactaaccccatagagcagttctcaaattcacaagccacctaatgcccactgccatacgtaagaaggtggtctagtaaattttggagtaaaggcaatatatatttcacaaaatcaaaatgtaagatcaattacaattcagctaatatttaattaggatataaggcatctcagtgaatgcatttttagtttttgaagtacgtaattatttttttagatttgtacttagctattcttactaaattttggaaagttcctgctttatggaaatgaatcagtgactctaaatggttctttgaggtataaaaacaaagatagtaacaaatacaaatttcacaatctggactagaaaacattactagtgaccacaactcaaatacaaatataaaaagcatctttattaacctggggtaaaagcttctctgcgtggggcagttttacccaggcaactgaacaggcggtgcgggaggaatgtttgaaaattggaactaacttggacgcactcatccccattttccatgcctgctgtgcactcctgccagatgggaacatgatgtcatattttccgtcagttttcaaacaaaacggggataatctaatattttctggaataaccatagaataatgttttccaatgtgaacttggtgaattttatgagtgaaagagaagcagatattggatccacacagccatcattgaaggtggcacacctaacatcaaaaacttctgtgcgggaccgggcacagtggttcacgcctgtaatcccagcactttgggaggctgaggcggttggatcaccttgagcccaggagttggagaccagcctgggcaacatcaaaaccctgtctctattaaaaaaaaaaaaagtttcatgccactgttacggactaggaatgtctaaaatccatcacaaagttagtattttgcttggaggggcaagtagaatgagcttttggaaagtttctttaacaattctttgatctagtaattcctgaaaacctttgaggctggtgaaaatactttttcatgtagggatgaatcattctgtgagtcctggcgtaagtcagccagaaactcataatgggagcttttgatggggggatatgaggtttaaaaatggaaataaaaactttcttcacgacactgataattcctataaaggccatttctgtgtgggatgacatgtacaattaacataaatgaccctgcttccaagctcactgaaatttttcgccagtgccctcagacctccgtctttgctcctaactcagattgtcttgagtcctctgtgtagagaaaaggggatcattgcagagactgtgaaccaagacattaatcttcacttctgaagtccaaaagcatcttttggtctgaggtagaaaaagtttgaaagggaattgagcaggctaaaggtgttttaatttttctgctatctcgcagactaggaaccctcagcaggactgcacgatagtatgcatagagaggtggggactgccctgaagctctgctctcaagcagagccttgccggtggtggcttaatggaagtcttcactgaagctcagggatctgagtgggcactctcaagtgtgtagtggaaaggagaacgccagtctccaagagcagcctgcacagcatcctcattgtgctgcggcacattcagtgacaggactggacgccctgcggcagctctggtggccggtgaggacagccccagttatccaaggacaccctgaggtaccaaaggcaggtgagcaagaccatgttcctgcctgaggtctggcagagggaggagaaagggtcaccaaaacgttgtggagagcactgtcccagcctgggatgggaggacttggctccgtcggcagcaggtcgccatccctgaggacagtgcagtgctgacctctacttggggcttgaacacactcccctccccgctttaccaaggcaattagcaaagccagaagagaccagagttaactctggggatgaaggggaagtaaaagaacccctgaaggaattttcaagggtctgcgaccaatacagacacgaactgacaggcttatcccttaactggacggagacacctgttgtgactacttccagtctctgtatcagccagaattccagctcctactagaaagctttctgggttatggagaaatgaagttacattttccctcatgagtttgtgatttaaaaatttatacctgcagaatgattctgacggatttgctcaagtggcttttgtcagggttatagtcagtatcttctctagcctcaaattaatgtgatgttgttgaggatgacttaaaattttctttgaaagtctgaaacatgatgcagaatgcttgcaccaaaagagttttacattttccccacgcttgtacttactagagccaagtacatcaaaggtgtgggttaaaacccgtgatgcagggaactctgacacttgtgataacatggatgaacctggaggacattatgttaagtgaaataaaccaggcacagagagacaaataccatatagtctcacttacatgtggaatttaaagacagtgctcacagaagtagagagtagaatggtggttaccagacgctagaggagaaggtggatagggaagggggagatgttggtcagtaggtacatagttttgggtagataggaataataatttctgttgttcttttgcacagcatagtgaatagagttaataagtgttgtctgttttgaaatatatgagagaattttaactattctcaccgctaaaagaatgatacatatttgaggtgactgatatgctgattagcctgattcgatcattttacagtgtatgcatgtatccaaacatcacattgcacctcataaaaatgtacaattattattcatcaattaaaaataaaagttaaacatgggagttagcaaacttctgctgtaaagagacagatggaaaatgattttggtattgtggaccatgtaaggtctctgttacatttcttttttttcttttttctttctctgtcttccctccctccctccctcccttcctcctccttctccttccttccttccttgcttttttccttccctctttttttcttttcccctcttctctctttctctttctttttctgaaacacagtcttgctctgttgcccaggtttggagtacagtggcaagatcacagcttagtgtagcctcaacctccgtgggctcaggtgatcctcccacctcagcctcccgagtagctgggaccacagtcacatgtcataacacccagcgaacatttatattttttgtaaagatgggatctcattatgttgctcaggctggtcttgaattcctgggctcaagcagtccagccacctcagcttcccaaaatgttgggattacaggcctgagccaccatacccagcccccgccctctttgttttttttttttaaatgcaacgctttacaaatgtaaaaccattcttagttctctggctatataaacaggtcataacctagattttggctgccagacctaatctagatttttactaagcctgcatgctaaatatgtctggcactttcccttaaaaagctctcagcatttatcatatgccagtgtgcttactaggtgtttgtatgcttttcttacgctttgtgcaattctaacttccttgaaggaagggtgctatcttatccttagtgattagggataagcttggaatcatccaggctctaccccttactagctgtgtgactttggacaaattcctttatctccctgagtttttgtttcctcagttataaaatgggattagtaaagtacctatcatgaaacagttaacttgagtaaaataggttgtgaagattaaatgaattaatacacataaaataattaggttatgttacatcaatgttcagagcaggtgtatccacaagagccaaaagagaaacaacccaaatttccattgatggacaaacggagaagcctagtgcagtgtaggaagaaaattctggcccgtactgtaacacagttgaactttcaagacattatgctaaggaaaataagctagacacaaaaggacaactactacgttattcatttatatgaggtacctagagtagtgaaattcatagagacaagaaatagaatagtggttgccaggggctggtaatggaggttattgttagtgggttcagagttttcatttgggaaggtgaaacagctctagagatggatggtagtgatggttgcacaatgtgaatgtacttaatgctactgaactttacatataaaacagttcaaatggtaaatttcctgtgatgtgtattaccataattaaaaaattagtatatgatctgatccaaagtagctaaaatctactgagtgctgctgaagcaaaaattataattagtagtttttttttaatttgttttgttttggtttggtttttgagatggagcctcaccctgtcacccaggctggagtgcagtgacgtgatctcggctgactgcaacctccgcttcctgggttcaagctattctcctgcctcagccttctgagtaactgggattacagggtcgcgccaccacgcctggctaattttttgtatttttagtagagacggggtttcaccatgttggccaggctcaactcctgacctcgtgatccgcctcggccaccttggcctcccaaagtgctgggattacaggtgtgagccaccgcgcccggcaattagtagtatcaacagtgggagtaaaagtggcagttaagcacattgtttcacaacatctagctcagagccatgacaaagcaaacattaaataatatgtatagatggaattaaacttaagcttctgtagtagaataattcagaataaaacatgaaataatgccaggtaatgtcagttgttaccaaagaaatgtccaaactctgaaagagcttgttaaattaggttatggcagcccacggtgcaggggaggggaccgtcaggtgatgtttaagtagtttacatggactgaatgaatcccctatggttccatttaaattggccaccacactgccaggcatatgacattggcaacttaaactcgacagagaaacctctaagaataagattaatgcatttctcattctctgtgtcacaattattcaatttaaaaaaacaggaaaatatcaaaaatctttttatgaaatggctgtaccagttttaccttctatagtataaatgcaatatggcttttggtgcatttaaattaattttataaggagtcccaatcagctgatgagtagttttagaattgttcctataattgtcaacctggagagctcttcactattttattcatacttcactgaaaattaaagttcagttttatgcctaattttatacataacgtgttgtaaaacatcaccatttgggtgatgtgtgtatatgtgtattttccttccaataggatatatatgtgtattttctatttataactagctgacacaggaccattctcataatcccatttgatttttgtatttgtcagtagatataacaatctccctttggttcagattgaaaaaacggaaaatgatgatgatgatgatgatgattgttgactgtgctgataattctttgtataccattattttagctttaaactattttaagtgtggtccagtacaaaagctgcttaagtcagataccccagtctctatgatgtgattattatgtattacatgcctgtatcaaaatatctcatgtaccctataaatacatacaactactacatacccacaaaaattaaaaattaaaaaggaaaataaaccagaaaaaagtcagattttttaaaaattttacatttcattatatttagaaaacttagctttatggggttttagagaacatggtttttcttccatgtatcttcctatttattttttatgatgctcaaagttgctaagtttccacatattttagtaagaattagcaatgccctgaattccatagctttcataaaggattacctgtgtaccatctcatcgccacctctttcctattacaggaaagcaataagaagatattctgtagttaatttagattgcttgccaaaatagttttaaactgatttgtaatttttcctaaaccagaatgaggaattgtatagtttaaagtattaatatatatgaaattgtcacactacgtttcagatgcttaggaaatgtagagaaattattgtaaaatacattttagaaaagatgttgcaacaagacgaggacagaagtctgtgaagtgttgtgaggagggcccagggaagcaggaggaaggtggggagaccacaggatgacctggagccaaagaagaagggcccaggtcccagggtctctacagcactgccggccttccagccacagtttttctcaatcttcctgtcatatccctcaaggaagtaagtggacattgtaaagagcgagtaattatagcacaacaaaaatcaaaagtcatgattctggaaagcattatcaataaaaaatggagaaatagttgacatctcttcatgtttcctctggaaatttctgattatgtatgtatactcttccactctaatatccaaacaactctcttacttcttcatgcaaagaaacatgaaagaatgaaaaggttcatcacaagtgtatgattaattttgtatatataattttgcaaattaatagattttaatgtgttcaataaatgtacataaatacacatgtatgtatatatctgtgtgtgtgtatgtactatgtactaaatatatactatatgtgtgtgtgtgtgtgtgtgtgtgtgtgtatatatatatatttagagagagtcagtgtgtacttaatagtcaaatccaaatttcaagaactttatattttatgtaatggcaccagttttcctgaagctgaatgtatgtgtgtgtgtgtgtgtgtgtgtgtgtattcagttgcaggaatatatacatatatacggtcagtgtgagtgtgtgtatatatatgtcagtacatacatggtcagtgtgtgtgcatataaacacacatatgtcagtacatatacacatatacatatatgttagtgtatactaactgtatactgactatatatagtcatagtcatatatactgactatagtcatagtcatatactgactatatatgtcagtatatacatacatatatatttcagtatatatatgtatgtatactgacatataggtatagtcagattgtgtatattcagctgcaggaaaattggtgccattatataaaatatgaaattcttgaaatttggatttgactattaaacctgactttgttgtcattaagtttacattgatatttcctggaattgcacattgctaaatttttctgcaaaaccaagatttctaaaatatgatggggcatttgatacaagaaaaggcaaataaagaaaaagtagagctccatttgtcattcttcttaagtgtctccttaagaaaactatgtgatccaaagttatttagacaaaagcttaagaaataaaacacttagtaactcatgctagtacttgattattcttttgcttatcaagttttcttctttttatgattattatacctttaattgcgaacattcattggattggctcagtagcattttatgtgagacaactttccattttaataagtacatattctccttcgttaatatgaaatagaagtgcaggagtagggatgaaatggataattttgctagaagcaaattgaaactggctaggcaaaagcgtatatgtattttgccctctttttctgtttttagaaagtgcttgcgttaactctcattctcagccagaagcgttaatgattcaaacgggctttatatattgaaaaccatgaactctcacgtgcagagtacaatcagggagcaagcccgtgggtttgaatggaaattaacgttggtgtatgggaatgaatttcatagacaaggataatttagaaacctgtgtgataaactgcaaacacagagcaaatggaaacatattggatcttttccctccactcctcatatttctccactattcagatgtccttccatgtgatcatgctttcttggcacactgactaggttcagtgattaagaggcagagaaaataattactgaatatttttaatacaaaatgaatagctcaggatatttgtaagggcttttcaatatcaagatatttatttcccacattagaaagtataactcctaatgaaaacttggcaccatagtttaaaatcatattaataaataaaagcaaaattcttacattggggaaatgacccacaaatggtttgttatagtatgcgatctttaactacttagaatttccactattctgcacagtgcaatatcccaaaacagaataggatgtgagatttcattgttttgtatgaggaatctagaggatagaaattgataaaaatgtatgcaataatttaaaaatataaagagtatcaatctctgatagaataatgtaaatgtagcaaatatttaagataactaatctaataagaattaaattcccctacatttttcttctcccctcccctcccctcccttttccccttctttccccttctttctcctttccccctttcaccctttttccctttccctttccctgaacagctgggattacccttgtcccaagtaactgagattacaagcacccaccaccaggcccggctgatttttatatcttctggtacaaatggggtttcaccatgtttaccaggctggtctccaactcctggcctcaggggattcgcccaccttggccttccaaagtgctgggattacaggtgtgagccaccacgcctggtcctcatttttcataaaatcaaaattcttgcatattcccctccttagtttataggtcagaagctacactaagcttcccaatgtgcctaggtgttagatgtgccaatttacatatgcaacaaaggacctgaaaagtagaacattaatacaacagaaaatattttgcctgaggatattgtttactaaattttttatctgtgccttttaatagttcttagaattagtaagtccaatggcattctatttttatgcttttttttcctcagatttgtagcatatgacaatgtgaatatgttacaaatgttgaatgattcagctgactacaggccaaacaaaatagcatcaagttatctatagcaaaatgtgtttcgattgaagaaatatgtagattttaaagaaattaatcttacttacttacgcaaagagtatgcttcagcagcatatgtaactttaaaattcatctaaaataggttgttagtactatgacaggaagtggcattcaaacaaacaaaatattcataaggatgttaatatagattagacatgagaacaagaaatatttggctggtctgattctcttgggtcactttaaaaattatttttaaaatttttgaaattgaggcataacttaaaatacaattaaatgcataaagtgtgccatttggttaatatttacagatgtatacgcctgtattaccagagcccagatcaagttacagatcagttcatcacccccttaccatttgttaatactttttattgattatctaggcacctcccacctatcactgttctactttctgtcatattatttaggttggcttgtgcttttgaacttacaaaaagtcatacagtaccagaatcatacagaagcttttgtatccagctccctttagggagcataaggtttctgagatccatccatgttgttgcgtggatttgtggcacatttccttctattgctgagtagatttcaattgtgctgtttgtttatccattctttttaaaatggacacttgtggcttgtttccagtatggatctattatgaataaatttctacaaacattattttacatcgcttttgggagtggaatttcagtatgtgaaactctaaagaaactgtcaaactattttcaaaagcccttgaacatgttatactcccattgccaatgtgtgtcaattctagttgcttcttatcctggtcaacatttggtattaaaatcattaaccattagagaaatataagttaatatcatagagagataatatgttctctaggatggctaaaattaaagaatggcaacacctgtgaactatattactcatggcaccacaaacaacaacatgagtttcagcatatttgtatctgtctcctttgcccctgaggcccacaggggcaatgcaatagggcacgtatgaatattacactcatagcagacttgtattgcagctgagaaataatgagcttggggaacctactgcagttatagcaagtagtaagtgagaaggctctttgtgtggaagaaaatgtaacctcacctctcaaggttaccagctgcataaacaaccatgaaaaaagggtccataaaagagcttttaggcctttgtagtcttagcagacccaacaaaacatgtaggagtgcaagctgcttaaagtggactgtctctccatacattattgtgtatggataacatgttcctatatggagatcttctaagaaatctagaaatctaaaagacaccaactaataagtgaattttaacaagttaacaggatacaaggttaatatacaaaaatcaattcttttttatgtagtagtaacaatctgattatcaaattaagaaaagaatttcattcacaatagcattaaaaaataaaatacttaaatgtagatcttacgaaaggtgtgcaggacctgttcatggaacactataaaacatagctattagaaaataaagaagactcaaataaattgagagacacactatgtttatagattggaagaaactggaattgtcctaattgtaataatcctaattgtcatactttgttggtgggaatgtaaatagtgccaccaccttggagaatagtttggcagtttcttaaaaagtaaaagcatgtacttaccatataacctagcaattccactccaaaaaatgtatgtccactctaagacttaaatgttcatagaggctgggcacagtggctcacacctgtaatgccgccagtttgagagggcgaggtgggtggattacttgaggtcaggagtttgagaccagcctggccaacatggcgaaacccagtgtccactaaaaatacaaaaattagctggacgtggtggtgcacaccaggaatcctagctactcgggtagctgaggcaggagaatcgcttgaacctgggaggtggaggttgcagtgagctgagattgcattgaatcttggcctgggcaacagagcgagactccgcctgttgtaaaatgtaaaaaaaaatgtaaaaaaaaaaagtaaatgcaaaaatgtaaaaaatgtaaaaaaaatttatatatatatatatattcatagcaacattattcatagtagatgatatggtttggctgtgtccccactcagatctcatcttgaattgtagctctcataattcctaggtgttgtgggagggacccagtgggagataactgaatcatgggggcggtttcccccatactgttctcgtagttgagaatcaatctcacaaggtctgatggttttataagggggacccccttttgcttgataatcattctctcttgtttgctgccacgtaaaatatgcttttcgccttctgccatgattgtgaggcctcctcagccacatggaaatgtgaatccattaaaccttttttctttatgaattacccagtctcagatatgtcttcatcagcagtgtgaagatggactaatacagtagacaaaaactggaaacaactcaaatgtccatcagccactgaatggataaccacaatgtggcatattcattgaactggttgctatttagtaataaaattaaagctactgataggccatgatttctttatgtacttaattgttgcttaatgttaccaattactcttaatgaagaatgccgtcccactcctctctaggattttcgcatcactctcttacagtttgcgttcttccttctaaaaatgttgtcctttcacttttttcctgttcaaaaaaatccagtgatacatgtgacagctcaactgtcatgcagttcttggcaagaaaggtgaggttgaataggaaacttcctgtttaccagaggcaactggaatcactcaagaataaagggacactgtattcaccatcatattgccagcttctgctccggagagatgaagtacatgtctttaatatattcttcctgataagtacattttaaaaggaactttatatataaaataaacataagaatgaaaaaatgtagggaagacagaccatctaggaacctgaggaattgaggaaattatagagatagaaaacaaattagtggttgctatgtataactgtaaagggtaccaatgaggaggattgtcgtggtagtgaagtcattctctttcttgattgtggtgggggttacggaccctaaacgtgtcatacaactggatagatacatcgtttcctggttttgatattgtactgtaattttataagatgtaaccattggtagaaactaggtgaagagtacacatcacttctctgtactgtctttgccaattcatgtgaagctgtatttcaaaataatttttttcttaaataacatttaaattctgactggcagtttaatttgtgcttcaaaactgattcaaaaggactatgaccaatgatgaaaatggtaaattacaacaattggtcctataaccaactctcctacattagttattaaagtcagtgttaagggaggcattccagaacttctataggacatggtgcagattcacctattttctttcacattaatttttgccaactggatttttttaggttgtcatattttttccaaagaattcagtgggacaaacgttagcagaattctgatgccccacattgtccctgttgtgtgcttgcctctaaaaaaattcctctgttaatagcaacttaaaataaacattattgtaatgtttagaggacattccttttgcatcatattttgatagtgtcctgttacatgcaataataaatgcatgtctctcttcatatgaggctttaacagcaatttcataaactataattagtttaactacataatatccttaggaaaaatgtaaatattaccatctctttttttttagggggtggactaggggattttggttgactgagcaatcaatcacatacagatggataatttgatattcactaaaatattcacttctcagcatttcactctcgtgtttccttgcatgacatcaattgtcatttaataagaaagacaaatacacgtgtttaatcactccctgaagaaagtaaacacactatctgtgggaaatggaacacaatgagaggcgtgccatcagcctcagggtgccctgactccattccagccctctccgcatatgccccatttgcacatcacccatcacttttgcctaattgtttctactcaccaagtgaagataatggcttctttgcctgctcaagtgataatttgagattatatgtctcatcagatactttattggatgaatgaaaaaatgcacaatgatggttttattaaattatgcagttagttaccaagatgaatggaactacacctatgcaaaaatcaagatgtggagataagggaggttataggctgagtcatttaacctttagggctctttctgatattttctgtgagggccaaatagagttctcagtggactgcatgtgagtttctgccaatggcctgtggagcaagtgcctgcaagagggaacactcccccaacttctggggtgataaaggatttctcactgtcccaccagcctgcacagtaggtttcaccattttgttaactattccagctgaacttttcttactgacctctggtttcatctatctaaggtgagctcctgctcacatctctccctgcgaggttcatatctctttagattttaggccaggtggtggttctgcaagctcaactctccaatgcatttgtaaaagatcatgaacttgaagtttgttgtaagggtggaaatgaggctccttatagctttctacttcctggggcagaagccagaagttccagcccatagattttgataagttgtattttcattttcattcagcttgaaatacttgctaatttcccttttagtttcttctttgattcattgagtatgaagtatgtgttattagtttcctaatattcctggatttttcagagaagttgctattgctgatttcttattttaatctattgtatatcacaaagatatactttacatgacttaaatgattttaactttgttgaaacttgtttaatgactcgtttaatggtctattttggtaaaagttccaaatgaactcgaaaaagaatacatgttcttctgttaggtgaaacattccataaatatcaatgaatcatataggttgatagtgataattaatacttctgaatccctattttctgtcttcttgtgcaatcagttactgagacggggtgctagaatctcctactgtcattgtggatttatctatttcattcagttttactagatttcatttcgtgtattttgaagctctgttattaagtgtttgcatgtttaggattatgttctctgatgaaagaacatcttaatcattacaaaataattttctttaccttttataataatttttgcactgaaatctactttgtttaatatagccaatccagcttttttaaaaactattattagcataatatatatttttccatgtgtttacacttaggctatttgagccttttttatttaaagtgtgtttcttgtaggcaacatatagttggatcttgctttctcatctaatctgaccatcattgccatttaataggagtgtttgcactacttacctttaatatgattgtttatatgattaattttaagtctaacatctactatttgttttttgtttattctttgtccattttcaaagctgctagggagtgtagatgcattttgtaagagaatacattttataaattgttatatacactctgagattttaaccataattgcagttctttttttatgaacacatttttagtaggctgaatattctttctgcttcaacctgctaagattgaaggaaatactgctgaaatagaacatgtacacaaagacagattctgagggagggtttctgtatttttttactttaaagcagcctagttgaaaaagactgtggtacctgattctatatctgtgtagttagcccttttttttctaaatgaaattagatctcaggtaaatgtttaaattcccctcagcaaaaaggcagatctactgacaaaaagcatggctgtttaaagcctataaatctcagaagtggaatgagggagtttatttaaagccagcttcactcctcttccctataaattacatataatcacactggagtgtaggagctgtgacagtccctacctcacgtctcacttcccacctcctgctcaccccaggtaatacctgaaatttttaatgtgaattaaaatgcaattagatgaggaaagaaacaaacaaatatatctggataaaatcacatttgaaacaatttgttatcttagtgggaagtgtctcatggggacaaggttgacttaactgtgtgtttgcttgatatatagaagcccctaatagtggctggctttgaacatttactttgtttacttatattttgtgccctcaatatcaaatttagttaaggaaggtataagattatggtgatatgatgataatcgtaatgatgatgatgatgatttacctgtgcattatttcccctgtaaacaaagtcaatacatactctgtaacagtgctgccacttaatgactagatgctatagtcatgggaagttttattgttgttagtcagaaacaattcaggctccagctgtagggtttctacttttcttttgcagagccccctgccccagatagtgaaatgtaactttgacctgatgtaaatgcagaattataacacagatataactgtacaaaatagagacataatcctgccagattatttataaccaaaaagtactaagtgattgacaaatcatgtgaatatattcatggacaaggataaaaatgaaacatagctgattttaaaaataatatctttccatgtgttttaattagtgattttattttctcatctgtaaggtagatacgataaagacaacccactgaatgcttttagaaataaaaaatgataatatgcttgaaaatatctggtcgaattctcagcatacaatatatgcttcacagtttctcacttccctcttttcccttgttttccattacaaaataagtggcaaaactttaataatttcctcagaacttgaaaacttaaaagtggataaaacggtacataagataaatcctatgttgtgtgaacatttagggacaaaacagcgcagctcagcatcttcactgtggtaccaatatcagcctttataaaaacgaattaccctttaaaaaataacatctgctgttcctcaagccatataaagtgtaagagaaagtttcagttgctcagcatattttaatctcattccagtaatggaacatgtgtgtcagaacatatattatgaatggaggggatgagttttcgtgattcataggatctgtggggtagaattgtgacactttatttaactcaggtgcaatgtcttgtcagaggcagggggaggagggtgaagtggagaagaaacatttgttatgggggagaggctgagcttagaggacctaactgcttcccctgttttgtgtacaaagttttgttgaccatagactagaagggactatgaaaagacacttccaggttgaaaattagtcagcacatgtataatcttgacttaacaaatagaagactttcatttgttttaatttaaagacaacaaaaattgagtataacatcacatttgaataataatttagttacaaagtgctgtagtttcagttatcccattgtcttccttacagtcttgtgaggtgatttatatgactgttaatcccctcactcccaactttatgcttttcttttttaaacaaagacaacatttttgtctcagagaggctgagtgactggacaattaccacactctagttgggggtggagtcagccaatctcctttctctttctgttacccatagtggccttctataccaaccatcaaagctgcctttaacaaaggcacacagattagtgctatccagcagtgcacaggtcagtcacgctgtgtttcccaccatttccactcagcgtttaattaaattgtgtgcacagcagcttacccttaaaatgcatctgggattgcagattgtaaccatgagtctacaacatcctgatgaaattctttggtaatgccagaatttcattactttatcagtaatggctgaaaatatagcttatttgcatttaagtactacttcatcaaaggtaaaatgaagtcactgaaatgtgtcatctgttagcaggagtgcaaccatgaacaccaacaaactaacaaactgtgagggatgccgagaagagggatggctagtggctccctcttcatctaatgaaaacacaccatcccagggtagcacaccagaaccgtgtcaactcattttcctccttgtgcttctccacatgtgttctcatagtaattacttttctaaacctggaatgagagggagtgaaaacaccaaagaaaggttatgaaatacaagctgaagaggatgcccttcatgctgactaaccaagatgaggggaagaaccaaaaatattgaatagttcctcagaagtttcagctctgtgtataaaattcccaatgtacaacatccagcctaagatgatgggttggctgttagcatctccttcaccttctcccaactcttttaaaacaaccataaaataggctgggcccagtgcctcatgcctgtaatcccagcactttgggaggctgaggtgggcaaatcactaggtcaggagaccaagaccatcctggccaacgtggtgaaaccccgtctctactaaaaatacaaaaattagctgggcgtggtggcatgtacctgtaatcccggctacttgggtggctgaggcaggagaattgcttgaaccagggagttggaggttgcagtgagcagagatctcgccactgcactccaggctggtgacagagtgagactccatctcaaaacaaaaacaaaaacaaaacaaaacaaaacaaaaccccttaaaatagtaataagaaaaacagaaaaggatacacagtttcagtagtgttgtacctaggaccattggttgctagttagaccaaccccaaaaggatctcccaccaattaaagtttacataggcttaggagagaagagtagatctggtggagtcaacaggaagggccagtagagaaaaccccattggcactgcaccctcagctttccgaaacccagaccttgcctgaccaggagtaggagaggttgccctgctgcatgggggctgctcccttaggtagccagacctgctcactcccaaatgtctttacatctttgttacatttatttgagaaacaccacatcccatgattatcatcaaaataatataataaaaatatttaattgcacaggttctggatccaaagcttgtgggccccttgctagatgcgtaaacataggtgagctgcccaccatccatatggagggtagtaatgaggccttgtcttttaaaggtatgttaggaattaaatgcaaaatttacttaaagggaactctttgcctgacctagagttctcaaatgctcgataagtgttcattgttaaattgagtgattatggaagtgggtacgtggaattctgttacatcctgaaaagttaagttggaaggaggaatgagcagagagaagaaactgtggaagtagttcctactgagggctaaagaaatctgtgcactgtctctggcaggggctcacataaatattgctgtaaatcatccaagaataaatcttgcccgatctaggaaaccatgttgcatgagtggaggatgcccctgatctatagcagaacatttaactttgaacaagagctgtgtccacctcctagctgtctggattaagaaaatatatggagtattttagtgtcaatcagatgcacagtgttggttatcagtaattttccatcttgtctactagatcaaattcctgactcttcaattcagaacatagaacaataaaaagcaaaacaaacaaaaattatatttatatatatgtctgtgtacatactatatatataatataaactttagaggtgcttatcgtacattcagaggaaaaaatatttttgaacaaagattcactacaaaaatatcttagaatctgacttctaagaatctgtaaacttgggaatcataaggaaacagtagttaagtgtggtcatcaattcaaataggtgcctaatatttatatttcttaacacttccccataataacttatattaaagtataatgtcctcacttattcgtttttacacctagctatattctaataatatcaaacttttttggacatgtagtgaagtactaaagactttacaaatgaggacataatgataaactcctaataataaaatacacagtataagtcaatgaataataatgaactgtctagaacttcagaatttctgtcagagccttcaggtaagtggcagcaccagggaataataaaagtgttctgactcctcagcttgggaatagtttatagagcactctctttttctagacattgattattaaagaagctgtggttttcgagtgtcccctaattctattagactagaaaaataataaacatcaataaaacatcagcggacatgcctatgtttttgtttcagatgtggcattggtcagagcaaaaagagcaaattttctgctctgcatgcatcttcttcaatacccaacagtctccttttccttgtccaaggtggatgagcgctgtgtgaggcttgccccagtttccctgcagtactgccagagagagcagagtgcaccagaacctgcttaggactcaccttgaccatttgctactccatacctttttgtattttttaaccaatatctcctccacaccccagttcctcgtaaccatcactctcctctgtacttttgtgaaatcaactttttagaattccacatgtaagtgggattgcctcacaaagcactctatgttttaactcttcttttacatccatttctcctatgagactgtaagcactttgagtgcaaggtcaatatattaactgtctttcttttatcagtgcttaatactgtacttcctactactggaatttagtctcttatgttggcaaagggcaaatcttgcacaagggctatgaaataacactagttccaaaagttgacaggaatgctctagtggccacctgcattaaacaaacattttctgcagtcagtgggacacctgccttctagaatatcaggggtcatctagctaaatgtgaacacaatttagggttcatccagtcacatgtaattattctattttttctattgtaaatcgatgattttcttaatatatattcataattttatagttttctaatctagtaacagctatgttaaataacttcctcctctaccatttttatactttttctgtttcaaaaaaggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctgggtatgtttctaataacaataattgctacctattgctgcaaacctattagaaaaacagaattttaagaattactttgaaaaaaatgttctaagtgaaagtaagatacctatttcattgaaagcattgaaagagaatcttataccattaaatagtgtggaagttaaaaaataatacaaatcatatataatttattttttcttggtttgcttaataaagtaatttaacattgcctctgcagtattttagagtggtagattgaattcatttattttctctgatttgatctgatatttttgaaagacactgaaatttcaaaatgtaataaatgagcagtttctgtgtgtatgacaagtacaggaacacagactttgaacttgaagaattgtgtgtcctttattaagcagccagatttagtttttcttgttttttttttttttttttagagacagagtttcgctgttatcacccagactagagtgcagtggcacaatcttggctcactgcagcctctgcctcccaggttcaaacaattcttctgcatcagcctccttagtagctgggactacaggcatgtgccaccacacttggctaattttttttttttttttgtatttttagtagagacagggtttcgccattttggccaggctggtctcgaactcctcacctcaggtcatccacccatcttgacctcccaaagtgctgggattacaggagtgagccaccgcacctggccagatttagtttttcatagactacagatctctgtgacattctctgaatctgtaaatatcctcataacagtgacattatttctgtttctgattatatgtcagtgcctctttgccggggtaatcactttttgtttgacttttgcagctacttgggaggctgaggtaggagaatcacttgaacccgggaggcagagattgcagtgagcagagatcgcaccattgcactccagcctgggcaaaaaagagagaaactctgtctcaataataataataataataataataataataataataagtatttattacatagtgtttgaaagtaacctgtatctgtttaaaatcttgctctgcattgattaataatgtttaaaatgttgtggacagtttccctataaaagagatgctgtaagagaagactcatatagagtctgcatcgtatttgtaatttggctctttcttcctcctaaaaaaaaatacgtcaatgacagaggtaccgtcagcatttttgttaccaagttaagcagttcagagggaaaccatagccaaggcaatgtcatttgccaattttgcttactctgaaaggttactagcctgcggggaaagagcgtaaaggttaaggttcttactaatccagaacacttaaaatgacagatgtcaactctcatgatcttacctcgtgtaggagcgtgttgagcttcactggaacaagtgatttactttcctggtgcccgctcacagtgtgagcttcctttcaaagtcactgtgcctgcctttcatccctgcatctctatcctggattgacttgtggtttcccaaagacatatgttggaatcctaactcccagtacctcagaatgtgaccttaattggatataaggtttttacagaggtaatcaagttaaaatgtagtcaggagggttgaccctaatctaatatgactggtgtcctcatcaagaaggacctttggacccagagacagatgtacacacagggaacacagtgcaaggacacatagggaagcagccctgtgaggagggaggattggaataatgcatggacaagccacagaacaccggaggcaccagcagctaggagatgggcatagaacagatccctccctagagcctccggaggcagcacggccggcagacaccttgatcttggacgtatggcctccatcactttagctacctagtttgtggcactttgttacagcagttctggaaaactaactcagcctctaaagcctaactgtgcctaacaggactaggacatcaggaaatgtttcctgaatgaatgagggaaattcatcctctcccaggatgccttttttgaacaaccacactgaaaatgatccttcctggctctgcacatctcttggacttgttttggactaaagcaatgaaatgtagtgctatgagggttcaggactcagccttccatcgttttgagctaaaaggtttttggggatagggctttatctttgcatctccttcatcctccatcactgtgactggcaaattataaccatttaatagcttcatttcctactctatgaccaactatacagaatttgcatggtgaaaaaaatgttaatgctactgaagagagaacccacaaaacaaaccagagatggttcttgtgagtgttcagttataagacacagacccgaagacacttgagaatgacaggccttggagaaagcgttacctcatgagttgttggaaaataattcaggaggatatttcagaaagcaaaagtaatgcaaacaaaaacatggataatggatgagatacacaaaaaacagtgagctgtaagatgtgaaatggctgttcagactgagatggagagaatatggggaatttgctgaaagttgtaaaattgcaaagagagaggctgtcaagtttggattataaaatacctatgtagatatttgagtttctttttttaaaaaaaacttttactttttgtgggtgcatagcaggtgtacacatttatgggattcatgagatactttgatacaggcatgcagtgcataataatcacatcatataaaatgggatatccatcccaagtatttatcctttgtgttacagacaatccaattatacacttttagttattttaaagtgtacaattaaattattattgactatagtcaccttgttgtgctatcaaatcctaggtcttattcattcttactatttttttgtgcccataactatccccacctcctccccagccccccacgccccttccctgccactgataaccatcttgattcgcgtttcttgaactgctacatcaacatctcagggacatattctccatttgtttattcattaatccattcttttagtaaataagcaaataattatggtagaggttagtaatatactcttgggaaatgtgagctgagtcatagttatcatattcttcactaggcatgtcccttgtgtctagtatttttcctatcaaagctacttctgtagaaataaagttcactgactgtatcctatttattattttcttaaaaagatgggctgatattggctgtcctccagtcttatcattgctgccttaacaataaattacatctcttattagagtttctgccctttaccaaggcattaattttagatatgaatggatgatattaaaataacttaagatttatttttgatacctaaaatattaacactcttgattaatgaaaattatgtttttataggcttactatctttcccagcacattattatctttattattattatcttttcctgaccacagctacatcccctgccctcagggtcatcgtattaaccttcctgtaccaggagaacagaatgcatttccagctctctcctagggatcctgctgcctctacttttatgttaaggacacattaaaaatgcattctccagtcttatatatttcttgtatgctctccctctgtcgttttatggctttgttttttttggtctggttttacccattacctatgctaatgttttctattattaaagatccacagttgcttatctgcaatttttaattctaaaagcaaaattattaaaatggtgaaccctaagcagacccaaatttatttagcagcaaaatctgaatgtactgactttggggctatttgcattttttagttactctgcttaatgtgaatattcatatgttttattgcaaaaatagtaacatatgtgattaccacctagtcactcatatttggtgtatacacagtatgacctttctaatatatgaaatgaatctgaatctaaagcaaatctgataccaaggctttagataagagattgtatagctgtcatatcaatcactgacatttgattatctgaatggattaatatatcaatccacattcttactaattacatgcttcacattgacgcttcaagggctagactgagtttgtgttgagaaatacccaagaaaactagatgtaactcccagatttatggaatcttcagagtagtaaaagctctgttcaaaagagagaatccctgttacttacaacaggaatacatgaatattttctgagtaacagaacaagcttcattatgtattatactttcagttaacaaaatgtgtttcaggacacagactcacttgaggtgaataatctcctcatctgctacatcattttaaaaggtgtcattactcaaacaaggtcaaaagaataaacaacagaagagggaagataaaagataattttctgggagaaccatatgtgtgtgtgtgtatgtatatatatatatagtagtagtagtaataggaatggccttaaaaaaccacctggcctaataagaacaaatgttctgaatcagaaagagagaaaagatatttagaaatccacctaaccatgtcctggaatcatgctgagagattataccataacattctattaaccatagtcccagattagcaatcactgacaagccattttccctcatgtctatttttcacttatttctgaaagaataaagaattaaatctgctaggaaatatagaactttttaattcattgtgaaattttcttctggttgggattagatatattcaggttattatccatccctgacatatgtttcaagttcccctctgagcaccagactccatttcctttcggatgtcaaatagtcacatccaaaactaagtttattatctccatatccttcccatcaccaaacctattacccctgggcttccacctctcagtaaatatcacagcatttaccaattgttggcttgagccaatatgcgtggagttaccaatgacttccattccttcacactccacgatcaatccataggcatatcctgtcaactcagttgttagacagatcatgtcagtcacagcttcagagtatatgtggagtctgacaactttccctcacctctgttattaccatgacagcccagttgcccaccatctcttacctggaccattgccacagcttcacatcccatcttgcttctgcctttgcaactggcttccaatttaaatctatagaattttattttctttaattcttgctgtaaattgccacatattttatgcaccatatgaatgtagtcattttcaataaagaactgaccttatttagataaaaagaaataagcaactttgaccgtattctctgcttatctgtggcttcaaatattttgtgctatgttgttcttctagctgctctttaaaaatgtcaagcaagatccatcctttgtactagctattcagtatttctgaaattttcccctatagcatagatagcttcctcaattcatttcttgggtaaattatctcttcctgatagaattcttctagataacctaacccctaatgtgcatagaacacacacacgcagacacgcacgtacacagctcccactgccctccccaccccacccgcctccagcctgtgtcttccctggttttgtgtttccttatggaagtcattatttcttgttcccatgtatggaattttgtttttttcctgtctgtctcttctcactaggaagattttatgcaaagaaagaaaatgttctctgaataatattattggactttgttttttaaaactttctgacaaagagcatacaatttgctataactgaattcttgtttcactggtctttatcagtgttgagaatttttgagatccaaaatgtagaaccgttctaactgggaaatctaaaaaagtgtccactagctgtcatgggacgtttttggggcagtggacaaagtgcattagtagatctcccatggcctgtgtgtatttgttcctaattgttatctttattttccgggcctgactggagcaaatgtgagtggaactaacggagggggcagaaggaaggtcagaggttggagatctgccgatcagcactgagcccagaggcagcagctgtctggactgactcggtacctgctatgagagagcaggaaaggatggcagacactgcagttagcacagagacagaaacattctcagtctgagtgtgtgttacatgccagacacacagttggttgacagtagggaaaagagaggctgagggtgtggctgggtagctaccaagctgtgagccagtgatgggcagcgacacagtgagtcagaggaagagcaggtctgcaggacacgtcagccctgctgccaggtgtggtgtcagcccaaacagctgcacctgtgggtccagaggtggtcagcggatatctagtttcggtcggccttcattcagcctctggctgtcatggccactgggttactgaaatcatggcttgtttccttctgtatctctccatcttcgtgtacagcttccctttatccaacacgaagtcaggcagattgtccttgtaaggcaaactaaacattagcagaggcaagtacacacacacaacactcaggaagttagagaacattctttagtcgcttgaagcaaaagggcttttcctggctaggaagcaaaaagaaaacattgtttctaaacttgaagctaatgccatctaccatttatgaagagctctttgtgcataaggctgtgtgctctgggtttccagcactcccacatttaattcttgcacaattcctgtaagggttacagtttccaagaaggtaaagaaacagtctctggctgtgaaagggctctttttcaccttgtttcctaactccatttctacaatagcaaaggagtgagagacttagtggtgtatttgtccttatgaaacattctcacttaattctaattttttatatatatatatttatatacacacacacatacacatacacacacataaatgatcctcctgcaaagcaaaatatatgtatatatgtatacacataatatagataaagatgtatagatataaaatccatctgaaacgcaaagtgtagagaaaaaagaagaacacaaaatcctgctaggatgtggtgccaattgaataggagacatttcttcatgtggatttagagttgagcagagtagcccaagctttagaagtttgtttgagatggatctgtgctagcaaggaatgtcacatcaagtgacacctctacaaatggatctttctaatacttgtgggccttcttcacaaattaagggtcagcatggtgtgttgccaacttcacaaattattcagaagatttgagtttcagctgtaggatgaaatgagttcaggggctggatgcaggtggtggttgaacaacaatgtgaatatatttaatgccactgaactgtacacttaaaatggttaaaatggtagattttatgggatatatattttaccacaataaaaattattttaaaaggcatcctatgagttaaatagtcaatgggctatattagtagtgcatgagttacacagccttgtgttactttttttctctctgattttaattgggtctgattattggtaatattggtaatatttggtaatatttgagcaacttgcttttaactgtaggcttttgaaaaaaaccatttttttgtggattcttaaatattgtagtaaatggaaatgccctttttatgggagcctgtgctggggcttcacagtcacacagagttgcctttgagaacaagaatcagttataaactatgtaaagttgggtaatctaacttctcaaagttctagctttctcatttgtaaaattttaattgggtctgagttttaataataaaacctttattctgaaggttttattatatttttcagaataataagactcctaaggttaatgtttttagtctgatgttattgattcagtcccattagtgtgagggagaagccttctgtggtatgatgccactaggaacacagaggtaccacctgtcaagaaggatttaagccattgttgcggtgactgagtgagatgccagtactctaagttccatgggcaaacacgtgaccttgagaaatagcagaaaagattttaacacatatttatgttagattaaatgggtaactgcctgggaattttatagagtatccaaaatagcaactgtgggtgagtgttatcaaatgattaagcatggaagtgaagtacaataaccatactctttaaggagaagcccttccagctctcttccccactttgtgccctaatctggtgacaacatcttagaaagcacttgtgatgatatgaagaataatggggctgatccagaatctaactgatttattccacagtaatggttctgttttgtcagggattctgttgttttgtcaaatttaaaatcaatatagcacttcagtatcattttgttgttgtaatagtgaaaatcctcagtgatttctttaagctgctctgtcttttaagagaacctctaccacagccccaaaggggaccctgtcagtgaaagtctggtttaccagccaaatcctcagatatctctctagttccccattggctgtgagttatttgaccttctgaaacagctgccctagaattgtacagatatcttaaaaggtattaactttcatttttaaatcagtgacattgacaaatcagagaagtgtgctggtctaagcagttttgtttcaagcagtatcctctgttttactgctatcccagatactgatgagcaggggtgtttttctacactgaaactttggctatagtgataaattatctcaataggaagtataatcctctatataattagtgaaagttttacttaaacaaaagtgaatattctagtttctgatgaacattcactagataatggttttcttgtttagagagtgtatctttgtgtgcctctgtagaaaattcctgtgagctgcttttttttcctctttcattgcgatcaattttttaaactgattattctattttaggtaatatttgagcaactttctttcaactgtaggcttttgaaaaatcagtttttgtggatttttaaatattacagtaaatggaaatgccttttttatgggagcctgtgctggggcttcacagtcacacagagttgcctttgagaacaagaatcagttataaactatgtataaagttgggtgatttaactcctcaaagttctagctttctcatttataaaatgagcataattgtgtgaggaaaaataagattatccacttaatgagcttaactctgcgcttggcagataataagctcccataagacctttgttgttatattttttcttcttatctctgttgcagcacttttctattatttaaaactttttctatcaagcagtattgtctgttattctttcatatagttttgttcacttatagcatactacgtcaattttcataaacaagattgtatctatatggatacatgtaatagaacatgaatatgtatcaaacactataaaatttaaatttatatataaggatgcttataaaatgactcatattgactatattcaaattgatgagtttctagaaggaaaaataaaaatagtagggaaagcaaatagaaaattttgtttggctccatcttaggagttcaaggagagaggcctgactaaagtttctattcagagatacaaaaatgttttaatacttatacatcacagtatattatcaatgcaaaaccgcataatctcctttcctctttccctcttaatggtgctatgatattctcaaattctatgtatgacttttttttataatttggtctcagagaggctgagtttggagtttcctttattttgtggcaataaagatttatttattccttcattcctgtaaccctgaaaaagaattttaggcccttctcactagggtctatccttattttcctatgatacaaagagtatttcaattagagaagagactaaacaagaggcataaaaaataggaaccaagtaaaaattattattatttgatccttgaaaacacacataagaaaatcacctgggccagcgtggtggctcatgcctgtaatcccagcactttgggaggttgatcacctgatgtcaggagtttgagaccagcctggccaacatgctgaaaccccatctctactaaaaatacaaaaaaattagccagatgtggtggcaggcgcctgtaatcccagctactcggaaggctgagtcaggagaatcacttgaacccgggaggcagaggttgtggtgagccgagatcatgccactgctctctaacctgggcaacaagagtgaaactctgtctcaaaaaaaaaaaaaaaaaaaagattcaacagctcacattttttaatacttttttttggaaattaatttaataatcagaaatacctccctttgtataagttatcagttaaaatgaaaagaagcaaatactgtttataatagatttagaaggcataaaataccactggcaggcaggagaggggtaagaaatgtacaagctacatgggaaaagaaaggttaaaacattactatgaggtatataaggagatctgtgtaaattctcatttatggatatgaagactcagtaatgtaaagatgttaatcctctctaatttaacccataataaaatgatgtaattcaaaattttactttgaagaatgttcattcaagaataaacaaggcaagtgtacagatgccagcaagatggtgaaataggacattcgtctgcagaatcatctatttgaaccactgttgacatctgaaaataccaccgaaagagctaagtgaacttaaaagaaaatagaaaaataattcaaaatagccaaagcaatccaaagcaaaaagaacaaagccagaggtatcacattacccaacttcaaactaaaaggttacagtaacctcaacagtctggtactggtattaaaacagacacatagaacaatggaacagaatagagaacccaggaataaagctgcatacctacagccatctaatctttgacaaagtcaacaaacataagcaatggggaaaggactatctattcaataaatagtgttaagatcactggtgagccatatgcagaagaatgaagctagaaccctacattttaccatatatgaaactgaactcaaggtggatcaaatatttaaatgtaagacctcaaactgtaagaatcctagaagaaaacctatggaacaccgttctggacattggccttgggaaaggatttataagtcctaaaagcaattgcagcaaaaacaaaaattgacaagtgggatccggctagactaaagagcttctgcacagcaaaagaaactatcaacaaagtaaacagacaacgtacagaaagggagaaaatatttgcaaactatgcatccaacaaaggtttaatattcaaaatttatgaggaacttaagcaattaggcaagcaaaaagcaaacaaccccacttaaaaatgtacaaaatatatgaacaaacatttctcaaaagaaggcgtaaacatggccaataaacatatgagaaagtgttccacatcacttatcatcagatcagtgcaaattaaacccacaataagataccatctcataccagtcagaatggctattactaaaaagtcaaaaaacaacaaatgctggtgaggctgtggagaaaagggaacacttacatactgttggtgggaatgtaaattagttcagcaactgtggaaaaaaatttggagatttctcaaagaacttaaaagagaactaccattcaacctagcaatcccattactgggtagatatccaaaagaaatctaatcattctaccaaaaagacacatgcacttgtgtgttcatcatggcagtattcacaatagcaaagacatggaatcaaccttggtgcttatcagtagtggattgaataaagaaaatatggtgtatatatatacaccatggaatactatgcagccataaaaaataatgaaatcatgtcctttgtagcaccatgatgcagttgggggccattatcccaagtgaattaacataggaacagaaaatcaaatactgcatgtttgcacttgtaagtagaagccaaacattgataactcatggatataaggatggcaacaatagacactagagactactggaagggaaaaggagggagtgggacagtggttgaaaaagtaactgtttagttagtatctgggtgaagggatcattcataccccaacctcagcattacacaatataccaaggtaacaaacctgcatatgtacctcctgaatctaaaataaatgttggaaaaaactagagatccggaactgggactgctctggtttgaatgtgtccctcaaaatttatgttatgagggagtaggtttcttataaaaggaccctacttttgtctctctctcacccatgtgatgccttctgccttgttatgacacagcaagaaggccttcacagatgccaccaccttgatcttgagcatcccagtctccagaactgttacaaataaatttctgtttatctaaaaaaggaaaaattcaaaaattagtaagtcattaaatgaataaaatgagaaaattaaagattgaaattatacaaaaaactaacaaattctggagctgagaaatgcatgaattaaatgaaaattgcaatagagaatgtcaacagcagaatcaatgaagcagaagaaaggctctgaactcaaagacagtttagtgaaattatacaattggagaaaaaagaatataaagtaatgaagaatgcttatggaacttacaggaaagcatcaaaagaacaaaacttaaaagtatggacactgaaaaaggagaatagagggacaaaggtctagaaagtttagtaaagaaacaataggctgggtgtcatggctcatacctataatgtcagcgctttgggaggccgaggtgggagagtcgcttgagcccaggagtttgaggttgcagtgagccatgatcatgctattgcactccagcctggctaatagatccagtttttattgtaaagaaagagatatagagagagaggaaacagtagcagaaacaaggaaggagggagggagcaaagaagaaaggaagacaggaaggaaggaaaaaaggcaggcaggaaggcaggcagaaaaagttttatcaatctgggggaaaatttacattttcatacacaggaaggtcaaaggtctctaatcagattcaatccaagcaagactacaccaagacatattattatcaaactttgaaaattcaaggacaaaaagagtattctgcagcaaaagagcatcaagacaaaagaagcatgtcacatataagggaattccattaatactagaagcagacatcacagcagaaaccttacaggccagggaagagcaggatgatatattcaagtgctgaaaggaaaaaaacaaaacataacaaaaactgtcaaccaagaatacacagcaaagctcttctacagaaggaaaagagaaaaggacttttgcagagacacacacacacaaagtcaagagttcattactctcagaagtgtcttacaagaaatgctaaaggaagttcttcgggctgaaagaaaaggatgttaattagtaacacagaaacataagaaagtttgaaactcactagtaaaagtaagtacaaaaagtttaagtcaaaagtaagtacaaaagtaagtcaaattttaaaactgtggtggtagtttttaagtaacatttattacagtggttaaaacaaactattaaaaatagttaaagctgcaataattcattaagggttacacaatataaaaagcatcaaaaacataaagtgtgggtgggtaaaaatgttgaatttttgtgtgtgatcacggttaagttgtattcaagttaaaaaaaacttgctgcaactataagatattttatgtcagcctcctggtaaccacaaagcaaaaacctgtactagatatacagaagatacaaagtaaggaatcaaaccatgccactatagaaaattgcctaatcacaaaggaagatggaaagagaaggaaggaacaaaggaaaacaaagctagaaagaatgaactaaatggctgtagtcaggaaacaaagccagaaaagaatgaactaaatgactgtagtcagttcttacctggcaacaattaccttaaatgtaaataaattaaactattcaatcagaagacatagtgtgacttaatggattataaaaaccagacccagctctgtgctacacacagggagctcgcttcacttataaggacacacatagactgaaagcaaagggatggaaaaaagatactctatgcaaaggaaaccaataaaaagcagaagtagctgtacttataccagataaaatagattttaagtccagaactgccacaagggacaaagtcagtatgtaatgctaaagggggctgggcgcagtggctcacacctgtaatcccagcactttgagaggccgaggtgggtggatcatgaggtcaggagttcaagaccagcctgaccaacatggtgaaaccccatctctactaaaaaaatacaaaaaaattagttgggcatggtggcacgcccctgtaatcccagctactcaggaggctgagtcaagagaatcacttgaacccaggaggtggaggttgcagtgagctgagattgcaccactgcactccagcctgggccacagagcaagactccgtctcaaaaaaaaaagaaggataaaggggtcagttaaccaagagaatgtaacagttgtaaatatgtgtgcaccaaatgatggaatatctgaatatataaggcaaatactaacagatctgaagggaggggaggacttaataggagggaaattctatatcctattttcagcaatagacagctcatccagacagaaaatcagtaaggaaaaattagacttaaactatatgttagaccaaatggacctaccagacataaactgaacattgcatccaacagcagcagaagacacctttttcaaaaacacacagagaacattctccaggatagatgatatgttaggccacaaaacaagtcttaataaatttaaggagattgaaatcgtatcagttatactttctgaccacaatggtatgattctagaaatcagtaactgaaggaattttcagaaaatttggctgggtgtggtggctcacgcctgtaatcccagcactttgggaggccaaggtgggcagatcacaagatcaggagatcgagaccattctggacaacatgatgaaaccccatctcttctaaaatacaaaaattagctgggcatggtgctcgcctgctgtcccagctactcgggaggctgaggtaggggaattgcttgagcccaggaggtagagattgcagtgagccaagctcgtgccactgcactgcagcctggtgacagagcgagactgtctcaaaaaaaaaaaaaaaaaaaaagaaaaagaaaattcagaaatacatggaaatgaaacaacatgctcctgaacaaccagtgggtcaaagaagaaatttaaagggaaattttaaaatgtctttagacaaacaaaaattgacccatgccatatcaagacacatgggatacagcaaaagcaattctaggtttatagcaataatggcctacatcagcaaggaagaatgatatcaaataaacaaccaaacattacaccccaaggaactagaataacaagaacaaactaagctcaaagttaaagaaggaaagaaataataaagatcagagcagaaacaaataaaatacagactagaaaaacaataaaaaaaatccataaaagtcaggttttaaaaaatatataaatatatataaaaatataacatataaacaaaatagacaaatctttaagaaaaaagtctcaaaatcagaaatgaaagaggcaacattacaaccaatattacagaaatacaaaggatcttaacagactactatgaataagtatacctcaacaaattggacaacctagaagtggataaatttctggacatatacaacctgccaaaactgaaccataaaaaaagaaaatctgagcaaaccaataatgagcaataaaattgaatcagtagtaaaaagctctaattaaataaagacctaggccctgatggcttcactgctgaattttaccaggcatttaaagaactaatactaattattctcaaacactgccaaaaaatggaagagaagggaatactttcaaactcattttataaaaccagcattaccctgataccaaactcagaaagtacactacaaaaaaagacaattataggccaatatcctcatgagcataaatgcaaaaactctatgaaattttagcaaaccaaattcaacagcatattagaaagatcattcatgataatcaagtgagatttatctgtgggatgaattgatggtccaatataggcaaatctataaatgtaacgtatcatgttaatagaacaaaggacaaaaaacatatgattatctcaatggacacagcagaagcatttgacaaaatgtctaacaaccttttattctaaaatctctcaacatattggttgtaaagaggacaatatagctcgacaaaataagggtcacatatgacaaaccctcagctaacatcctattcagtggtgaaaagttgaaaactcttcctctgagatccaaacaagacaaggatgcccactatcaccacttctttcaacacagtactgaaagttctatccagaacaattagacaagaaaaagaagaaaaaaaatccaaatttgaagaaaacagaatttaaattgtccctctttgcagatgacatgatcttatatatagaaagccctaaagacttcaacaaaaaattattagaactaatgcataaatttcaggccaggcatgatggcttatgcttgtaatctcagcactttgggaggccaaagtaggaagatcacttgactccagtggtttgagacctgggcaacatggcaagacccccatttctacaaaaaaataaacaatgagctgggcatggtggcatgtgcctgtggtcccagatactcaggaggctgaggtgggaggatcacttgagcctaggaggttcaggcggcagtgagctgtgatagtgccactgcactccagcctggatgacagaacaagactctcaaaagaaaataaccccaaataactaataaataaattcaataaagttacagtacaacatcaacagaaaaatcagttatgtggtctatatactaataatgaagtgtctgaaaaagaaatcaagaaaataatccaataagatacttacgaataaatttaaccaaggtagtgaaagagttgtacactgaggtttacagaattttatagtagactataaaatattgatgaaagaacttaaagatgacaggaatcgaaagatatccccatgttcatggattggaagaattaatattaaaatattcataatacctaaggtgatctacagattcagtgcattacctatgaaaattctaatgacattttccacataaatagagaaaatgatcctaaaatttgtgtgtaaccacaaaggacctccaataaccaaagcaatcttgagcgtaaagaacaaagctggaggtatcacactatctgacatcaaaatgtactacaaagctgtagcaatcaaaatagcatggtactgacataaaaaacagacacatacatagaccaatggaacacaatagagagcccagaactaaatccaggcatttattgtctgttgatttttgacagaggtgctaagaatacacaatgaagaaagtttagtttcttcagtaaatggtattgggtaagtgggatatacatgcacaacagaatgaaattagacccttatctcacactatatgcaaaaatcaacacaaaatggattaaagagttaaacttatgacccataactgtgaaactactaagagaaaacacaggggaaaagctccatgatattggtctaggaaatcattttctggatacaaccccaaaagcattggcaataaaagcaaaattagacagatgaggttatttcaaactaattttctgcaccacataggaaacaatcagcagagtaaaaagacaacctatgggatcggaggaaatattttcaaacaatacatctgataaagggttaatatttaaaatacataggcaactcaaacatctcaatagcaagaaaacaaataactgtgctttttaaaaatgggcaaaagacctgaaaagacatttctcaagaaagatatatgcctggccaacaggtatatgaaaaaatgctcaatatcacaaatcatcggggaaatgcaagttagaaccacaatgagatatcacctcgtacttgttagaatggttattatcaaaaagacaaaagataacaagtgtcgatgaagatgtgaagaaaagaggatccctgtatactgttggtggcaatgtaaatttgtatatccattatggaaagcagtggggagtttcctcaaaaaatcaaaaatagaattaccaaatgattcagcaatcccactattgtgtatgtatccaaaggaaattaaatcagtatgtcttttagatatctgtacaaccatgttcattgcagtattattcataatagccaagatttggaatcaactgaagtgtccatctgtggatgaatggataaagaaaatgtggtgtacatacacaatggaatgctatttggccataaaataaaagaaatcctatttatttgtgagaacatagatgaacctggaggacattatgttcggtgtaataagtcaggcacagaaagaccaatactacaggatccagcttatatgtggagtctaaaaatgttgagcccatagaagcagaaggtggaatagttgttaccagggactagcgagtttgggagttggggagatgttggtcaaaggatacaaaatttcagttatgtaggaagaataagttcaagaaatctatcgcacaaaatggtgactatagttaataacaaagtactgtgttcttgaaaattgctgagaatagatttttagttttctcaccacaaaaataagtatgtgaggtaatgcatatttaattagcttgatgtactcattcaattatgtatgcatgtttcaaaacatcaagttgtacatagtgcatacatattttattcatcaaatttaaaaaaattaattttcataaaaggataagcagtacaactggcaacaagaaattgaaaaaggagttagtcttaccaattagaaaaatacctagaggctggatgcggtggctcaggcctgtaattccagcactttgagaggctgagttgggcagatcacctgaggtcaggagtttgagagcagactagctaacgtggtgaaaccctgtctctactaaaaatacagaaattagctgggtgtggtggcgtgctcctgtaattccagctacttggtacgctgaggcaggagaatctcttgaaccctggaggtggaggttgcagtgagacaagattgcgccactgcactccagcctgagtgacagagtgagtgagagtctgtctcaaaaaaaaaaaaaagtacataataaaggttgattctagattttagtatgcttgatattaatagcagtggaaaaaatagtattcactaacaaattcaaatatatatgctgataaaagatgtggcattttaaattagtaagaaaaaaattaataaatggtactggggaagctaggtatccctcaggaaaaaattaataaaactggaccattaccctattccttgcgtcaaagtagattgtagatgaattaaagattttaaagtagccacagaaacagttctagaagattctgggagaggtttgcatatataatgtgggagcgggcatgtatttctatgcaagatgtaaaaccaagaccacattaaagagactaataaatgaaattatttgaaacttaccagaagatatcaatttataaatgggaaataatattttaatatacatgacacagtttttttgtaaagtgctcttacacatcaatggataaagattaagaaaagcaatgtaaaattgagaaggattgataagcattccacatgaagaaaaaatagtatataaatttatgagataatgcttggcgcggtggctcacacccgtaatcccagcactttggaaggccgaggtgggcagatcacgaggtcaggagatcaagaccatcctggctaacccggtgaaaccccacctctactaaaaatacaaaaaattagccaggtgtggtggcgggcgcctgtagtcccagctactcaggaggctgaggaaggagaatgctgtgaacccgggaggtggagcttgcagtgagccaagattgcgccactgcactccagcctgggcgacagagcaagactccgtctcaaataataataataataataataataataataataataataaaattcatgagataatattcaaccttgtttataagttaaagaaatgcaaattaaaacagcagtgaggtactactcagtttattagaacaactaaaacatttactgaggctgtgttgcttaggacattactttcaactatactttcatagttaatgcattaaatttaaagtctcttaaaattaaatagtatggaaacatgcaatattatggatattattgctcagcataatgctcaggttaaaaataatcagttttaagaacaaatttaagtatgaagacattatgtatcttgagtgcttactgtgcaccaaacatgattctttgtgctttgtatatattaaaatcctcgcagaactctatgagctagatactaatattcttcccagatgaaaacaaggaaagcaaaaagacaggctttatttatttgccccaattatagagctagttagtggtagcacaataatttgaacccaagtggcctggctgcagaatctttactcacaacccctcaccacatctgggaatgttttaggtctgtttcaagtgtgcacatgaaaaggtaaaactcagatgattcaatttcaggaactggtgcctttttatgaatatgatttcttgaagaaccatttggcactatctataaaattaaagttccaaaaaatgatcaactttcagtgtagtgaatggaggtaatgcaaaaagagtgatgctttcagtttctctcaatgtatagtttacgttaagcagcaatgctacttctaggaatttatcccacagtcatagtgtaatatatgcatatgtgcatgaagagattaactaacattttatgaatataatggtaaatatgttagtacagttctctttcagtggtcatggtacatttatactctggaatagcatgcagccttgagaaataatgaggtaaacatacttgctgtgaatgaacttcaagatatttttctaaaatcaaagaataaggtaagatattctcccatttgaaattcccacaatgaatatatgtatatatatatatatactcatgtaaatatgaaatatttctagaaggacatataagaaaaatcatagcattttttccctctgggtaatgggaatgggataaaaatataaaatggatgtagatatggtttgaactatgtgaatcgtatggcttttcaattaaaaacaaactgaaataaatgtaaaaaataataataagtagtgattttaatgcagttctttttcccattgaaatttctccaggatgaaagccaatcgctaaagctcagtatactgatataaaacctgaaagtgaacatcaagaccttatcttgatgtgagagtgaagggcagtggctgggatgtgtgggcatcagtgtactggtaagaagaaagactttcatgggctttcaaatgcgaaggaacagcctggatgtcaggaggagtcccagctagggaggtcatttggtatagcacagaaggagcttattagattaaaaaacaacaacagcggctacaaaactgtatctcaagttaaatgtcatcctaactttgtaacatttattagtggatgtaacccgacagaaataaatagccttcaaattctagttgtaatatttattttagtggtgttttttaaattaatgagtctttttttcccatgtttaatgttgaatgaatgatacttattcatgtcctgggtcatcagtccttgaccatcacgtgatgtggtgcagacagcacctggctaagagtaactaactgagtgctgtttctaaaatagcccctaacaaacacctggccaagtacaaggtgctcaacacctgtgagcttcctcaccttcgattacaaaatgcagggtggatgtggaatccagtcacgcactataaggctgaacctcgtgaatgtgctgatatctaagtatcttgacctacaaaaacagcaatttcatatgatcaagctaataaatatactttgactttcaggtttaaaatcacccatttctgcagcaaaactaaagggagggcaacaccagttttccacaggggcagctgcagttcaggctaacaagttcctatctaagttctcctcatttttaaattcacatggtgtaactatttctcatgctaagattttatgagtgtgtgcaaacacacacacacacgcacagaagtgctgcaacaagctacaatgaagaaatcccaaagtagactgaacaatgggtaatctacaataaggaagcagaatgatgtaaagcttaatattttattgtgctctaaagtagtattgaagttcaaagtaagttagctttgctcagtcctccactttctcatcaaacctttgtgttgatatactcccagagttctcacaggggatccatttggaaggggaaaatgcatcaatacaagtctgccatggtttgggtgggtgtgctgggtaaaccttgtgaagaaaggcagcgcatcgctgtctcaaaatatatggctttgctgttggagcagcctgctctgtctgcgactttaatccggctttcttctaggatggcttcctttttgcatttcagctgctgactcggtttctaagttgctgctactagtcagtcactagagttttgcatctttactctcatgaccatttctccagttcttgctttcctttggtgtcaggtatcacccccaaacgtttgtcatctcatcacctctgaattaggtcctttgaccaagagtaaagccatgtgtttgccaactggtctccacctcagaaatatttactaatttctcttctgtcatgtgaatgacttctgagatggctccatatccagatgcctttctgaattaccatgagatacaatggcttgtctactctttgcctgccagtatttgaaactcagttattttccattctatcttacaattattctatgctggcctttcccccaaattatacatatgacatcaattcatgacaaatctaattttatatgccactggctaaaacatgtcatttaggctatctttacattcagaatattattgctcatttcagattgtgaattcctactatatgagtccctttatcagaagcatttgaaccatcttgcgtaggggctgggaacactgaggctgagacctgttgggctccattcctaggaggttaaggtattcttagtcacaggatgagacaggaggtcggcgcaagatacaggtcacaaataccttgctgataaaacaggatacggtaaagaagctggccaaatcccaccaaaaccaagaaggctatgagagtgacctctggtcatccttattgctcagtataagttaattataattcattagcatgctaaaagacacttccaccagcgccatgacagtttacaaatgccatggcaacgtccagaagttacgctatgtggtctaaagtggggaggaaccctcagttctgggaattgcctgcccctttcttggaacactcatgaataatccaccccttgtttagcatataataaagaaataactatatttatctgagcagcccatgctgctgctctgcctctggagtagccattctttcattcctttactttcttaataaacttgctttcactttctggacttgtcccaatttgtttcttgcacaaggtccaagaacccttttttggggtctggatcgggacccctttcgggtaacactttgttttatttcctcatatggatagattcttaaatcatctccacaatgaatattttcctaatactttaaaatataatatggataagaataaatattaataatgctatattcttaatgactctctttttgattaaaacgtaatatcatatctcgttccatcactgctggattaccttacagaggtttctgcttataaagagacatgcatttctcaaggaaaactctccctcataaatagcaggacctgaacaacatggcttctctctcatccgcgtttccatttcctgtctaaataggctttgcataaaatcctttgtttattgcgttagaaatatattcttcctttcgcagatgtccttgtggaataacctttggtgctgtggaaaagattcacgtgtcaagacactagttctgaagtagccgattggtgtcaagcatgagaataaaagatgggcattaaaaacattagcacttaacctcagtcaggattttgtctgtgaaacaggaaaaatagaagagaagtcagatttgatctgcattctgaaaatgagaatttttttatatttaaactcctcttattttgtattccttaatgttcttattaatcattcatatcaaatggcttgtctttctttcagagccttgaacattttaaagacaccatgtcattctttttacaagagagagaaaaaattacgcagttgaaagagttcccaagggagctattgtgctacactctggcaaaagttttattagctaaacttctgactgaaaggaaaaataaattcaggtttaggaacggcttctatttattgtaaggaagtttgcaaaaattactgaaaaatatcccaagaacacaatgtaaatttactctggtggtattttttccatccttgcttctccaaaataataaaaaaagttaaacggccaataaatttacattaacagtcaattgtctacccttgaatcagaatgaattcattacttcagtaattaattaagcaagctcaaatgaaaactaggttctcctgaagagcttgcatgtcagtattgtcaagtcacagttaaaacatctctaaacagagaaattagccctatcacatctcattaatttgtactatgggtttcttttattgttctatttagaatcttaatactaagattttttttcttcatctgagctaaattccttaagctatgacacaaaatcttttgcaaaaattatttctgaaaggaaactgcatttgtgtgctgtgactgggcagagtaagctgtagctacctctgagttcaggttcaggaatatgcatttcttatccttcccaaatcttttttcatgttacctgctttgggcattgtttggagcttctggttgccagaggtcctgtaggatcacatcttagatcaaggcaggcctaccttccagagctgcagaacactgggtactgagctggtcatcctcaccctttctctcttctcttctcttctcttctttcctctccttcctctcatctcctctatcccttcccctctgtggatccttaccctccagctccttgggttgtggcaccaaaaacgtggctggatctggtacccaagctaatgtggtagaggaaaataattagtgaaaaccatcagcacactccctctgttctggcttctttgtgcattttaacagtggagtctggaaataatagtcccacttcagctatttaacccaagactgactggaatgctaggaatgtcaaatcaggtagggcagaattttgtcatcagagcaagcaaatgtcaggtgaactggaagacaaagcaggacgtaggtaagaatgcagattctgagtcaaatcagttgggttcaaatactggcttcatttgctagctgtatgaacttggactagctgattaaccactttgtaccttgtttcttcatctatatagtaggtgttattatagaacatacattataggattattgtgaaaatgaaaacaaaataatctataaattagtgatagatcggaggtcatcagtaaattgatgaatggataagagtagatgcctgattgcagaggactgaggagaggaaatgagttaatgaaaaggagagagcaaatgatgaatactttctgtagaagtcgggatgcttagaaaaagagagtgggacagcagtagcaagagggacatcgggcaggagacagtgtgaagtggaagctagagcgactagagcctggtcactgccagggatgctggtggaactcccatgcccatcaacagcttggagacagaagaaactcacagagtagctgaggggcaacgtcccagagggatggcagggaaaaggatccagaacacagaagacactgaaaaacagtgatgttttctgaaacaggaggaaaatagctaattatatacgctttattttaaatttctgaaagggagtttatagctgtttcttatctacttgatgttcagaagattcaagctctgtgatatgagtgatgaaggatcaggtgctgtggttcatacctgtaatcccaacactttggtaggctgaggcaggcagatcccttgagtgcaggagtctgagaccagcctgggcaacacagtgagacccctgtctctacaaaaaaatacaaaaattacctagttgtagtggtgtgtgcctgtagtcccaactactcggaaaactaaggaagattgcttgagtctggaagatcgaggctgcaatgagctgtgatcgagccagtgcactccagcctgggtgacaaagcaagagcctgtctcaaaaacaaacaaacaaacaaaaaagtgataagggaaaagtggaattaaggtaggaaatgtttatgtgtgtgtagtagaggatgtggaatggaaaaagattttgacagggaacaacaagagtccctagtaatagtacatttctacactggaaacacctgcccagaccacttaaatccgaacctcaagagagtaggaactaagcagtatgttaaagaatccacctgatgattcccatattcattcaaggctaaggaccattgtcctcgtagcatacagaccccaggatggagaccatgaatagggaccccacccgcacagctggggggttttccccagcaatagtcagctgtttgcagaacctgtgaaggcaactgagaagactgacctagaattagcatctgcaggtatgccgacattgaggatttggctacataaatgctaacaaattggcaaaagagtctggaaaaaaaggtaccatgctgtttgggcaatgtggagaggacagttagatcaagagaggctgataatgaaaatcagaaagagtcagcatgtcaaagaagctatagtgtgggagtgagagatctgggaatatctagaggtgtacagtcaacacagagtttaaataagatttcaaagatggtgcccccatcccaggtggtgatgaggttggccatgggaatgaggctgaagtgaagcagctggagctcatttgcatcagggaacttgaagtcaaaggatcttattggtattcctcaaggatgttcatattgtggctttgggatagaggagatggtgataagtgtaagggaatgactcggagtttagaaaatgaattacaatggccaggaagggtagagggagctatagtcaaatgatatttaagagaagagataactttctcattgtgttagttcagttacttttgtgaggaggtgcaatgttatgaaatcaaaggagattggtgaaaatgtatccagaccccaccacaaataagatgaggggaaatgaggaaactgcattcctgagtgttacaagggcaggggtgtccaaaaggaagacctgagttttaatcaaggtgtagatcagtgtctgacacccaatataactgagtatttattgtgtaccaggtgagatttttagaattttagctgcattctattatttactttttcatcattaacttgggatgaagaaatacaactttagagaggctcagtaatgagctcatgtcacacaagcagagcctgtaccagaaaccttgggctgcccacctggggagccagtctcaatttctaggctacaccagaatattctcagataagattaaagtagtcttttttcttccttctttcctcccctcaacctcatcccccttccctctctcctttctttttcctttccctcccttcccttcccctcccctccttttcccttcccttctttatgagggtcaaagagtgcacagaaaaaaaactgtggggaaggaagaagagtagtggggagtgcatgggcggatgggagtgtagagagcccagaaaaggacagattgatctgaggatcaacggcatacgatttgaagacatgtccggggatgatagggatgagaggcctgggggaatggctgctctcgggtctctgattggaattctggagtgatgtggttttgctgccatcccagcccagaacgtgtctctcttcagggttccacacagaaacattaatccctaactgtttggcacgctgtggattctatggattctgtctccctggtgggagtgagggcgatgatcaggcacagctgttccccctcaggtttggaatttatcagtgaggacgaatttagtgctgggcaaaatgcatttcctgccttttaaaggaatatggatttgctcagctgaggactccagggcactttcatgcagaaggggcaggagacttagttccaggcccaagttcttttccctctgagtcataggaaccccctcctcctttctagtccctctggcattttgtcctctaaagaaatctgaacccaagtggttggtcctaaaacactatcacaaacagagaaccaaccaagagagggagaaaggatgaaaaggagatgcaggtgagaggggcgaggggcagggtgctggtgcagttcacaccagaaggaaggaaggaaggaaggaaggaagggaggaaggggcagaaggggggaggggggaagggggagggtgaagggaggagtgggagagggtagtgggggagggagggagggagggagggaaggaagggaaggaaggaagtctgaatgttttcatctcaccccacccttctccaggctggaggctgcagaactcgactagactcatttctttctatttataatttgctatgtcattttaaaatttaatttttaatttatcttcccatttaaacttaatttgggattgaatttgctttggttttgctttctgcttttttcctcctgattttagctttagtaaccacttacttcttattattgacattttactttgtatgctgaaggctaattttctaccttcattcaaagtctgaaccctgcagcgatgccaaataatacggagaagtctgattgtcctttataaaaacagcaaaactttttaagttaaatcacattcaccttgaaagaaatcatgtgctcaataaaccctgagaactgcggccccagggactcaccgtgcccacattttagttgtattttcacatgcagattaatgaatgtgactaacatctcataactcgtattttaaaatgtaatacagtatttaatatacattgcataggaagactgaaccgtggcttacgttgatgagtactgtgagaaacaaattctacattggggtgaaaatgaataaaattagaagttgggactgagaaggactgcaagctgctgtgagcaagtgaacaggaaactgaccctctgcagacttgagtaggaccagacacaactcttctagaaagacagagtaggaaaacatcttcctttttcaaagtgtacgtagttagagccccccacccaatgcattttcttccattattacctattttttaatattctatttttcaatctaatttcccttttccagagtggaaaaacaacatttaactctgggagaattttagtgtaattttgaaatctgttaagcttgctgaaagttaaaaagaagggaacatattttaaaatttacattttgctgcgtggtttctgtggtatgtgtaggcctgttggctatgaaacacccagctgctatcacctttcaaactcctttgtgaatttattagagcaagacccaagaaacaaaaacaaaaccttgtcttccttattttctttcaaccttgcttcatcccaaagtgtacttgaaatggaaatcatttgaattttccacagtgcattatgtttactgatatctatacatcttccctcagataagatcctaggagtaatcaccattacctccattttgcaaatgaagatgggaaattcaagggggatgagtgatttacatcatacttggaattgtgacaggtcttgaactctggtttatttagatcttcaagttaaaaacccttccccccaaccctgcctcaccacagaatccagcactgcctccctcagtttataagtaggtgacatgtggacagaaagattctggaaactcctggtttctcagggtggcaggattttctactggaagtttctcacaggccggtccttgtgtggtttgcaaagtgagcccacagcactgactgtggggaggaagacggggacaacagctctgtgggaaatgaaagaagcagagaattctgactgtcctccatctaccccatggctgtcctgcagctgcaggactctgttggacagttccagtggcccctgttgttctcccagttgctccaacttggaagacggaatcccagaggacaggttgctattgggcctctaagctcctcacagcactgaggacctacagaaagttcagtgacaggaaagtctgagccccaccgagatgatattaaagatgcagattgctattctgtgtttaactgaatcttcaaggtgtgaatgtcaagctgaaaatgacatgccaatattaagacattagaccaactcagtttgtgattttaaaaattataccatattttgtttatccattccactcatcagtggacatttgggttatttccacatcttggctattgtggataatgctgcagtgaacataggagggccaatatttctttaacatcttcattttatattgggggggtgtatatacccgaaagtaagattgctggatcatatgatagttctatttttaatcttttgagtatttgccataatgttttccattgcagctgcaccatttacattcccatcaatggtgcaaaaggggttcctttttttcacatccttgccaacacttgctatctctttcgaaataaatttcagttaaacaagttctagcgatctgctgtacaaaactgtgcctatagttaatgatactgtattgtttaagatgatagatttcatgttgagtttcttacaataaaaataattatgccataaaatatgcataagactttttcaatgaatgtaatactcaaaatctgcaatggaaatgcttcttagcaacaagggaccaataggaggattatatcctttcattcttcagctatacttaaagtgggtatttagagttgaaaaataatcagtgtattttcactgtttttatttggagtcactacacaaacagctataaaattttgaagaaaaataggcttatgcagaagtatagagaggaaagattacatacatccacagacctgactcctagcaagcgcaacttgtaaagtatgaaacagcttatatgttacgagtgtaattataaattggcaaaatgtcctttttatcacagtccagtacatttttattgctttcagcttgctcaaggttttatattgctcaggatttttctctgaaatgtacttggaggagagagctatacattgtaaagccatacactatcttagaaacccttacctcctgaaccacttcttctggcacaggctttatccttttccttttcttgttaagtccacagaaccatctcagggcaaaatggtgaagtgggccaacgtagtcttttctagttctctgtgtggttcacccattcaccgatctgaatttcttcggaccccgtctgagtcggttgtcctcaggagtcgtgtaaactctctgggccccagcctgtgcgctccttgtttcctagcccagggagtgccggtgttctggtttaataaacatcctggacaaatgaatgaaaaaggcactaactgataagaatccccataaaaggctatttaaactttaataatgaactttaaaaggcttgtaggcccaaaacaatgagtattttgatggtgacaactcagatgtgagaaatggaggtgataccttgagagaaagtgactgcagtagtccccaaatccctggtggatgccagaaactgcaaacagtgctgaaccctatatgtactatgtttttttcttatacatacacacctgtgatgaagttgcttttataaatgaggcacagagattaacaacaagaaccactaataaaatagaaaattgtagcaatatgccagcatcactacttgtgcactttggagccgttgttgattgaaataagagtgatttgaacacaagcactgtgataccatgacaacccacctgataacccagagggctacttaagtgactgataggtgggttgcttatagggcatggatatgctggacaaagggatgattcacgtcccatgcaggacagagcagggtgacacgtgttttcatcacattactcaggatagtgagcaatttaaaacttatgaattgcttatttctgaaattttctatttaatattttcaggctgtgattaaccacaggtaattgaaactatggaaagcgagcgaaactgcagataaggggagacgactgtatttctgatgtacttcgaattatactttaaaatttgtctatagaaaattgtttgtgtttattcttacagacctgtggaaccaatttttaaatctcctaggcaggctaaaataattgcttttgctatctcattttttataaacatttatttgtgagataaatctttacttttatcttacaaataaaaaagataaagagataaagaatataataaaatatatttgcacttctaaaatttgtattattaagctttaaataaaatacaggaaaatagttctactatactaaactaaggaattttcttctaagcctcaaatctaaaaatctataaactaatctgaaagaaaagtaatgaaaatcagggccaggtacagtggctcatgcctgtaatcgcagcactttgggaggccaaggcaggtggatcatctgaacttagtagttccagaccagcctggccaacatggtgaaacccagtctctactaaaaatacaaaaattagctgggcttggtggcaggcatctataatcccagctactcgggaggctaaggcaggagaatctcttgaacccaggaggcggaggttgcagtgagctgagatcccaccactgcactccaacctgggcaaagagtgagactgtctcaaaaaaaaaaaaaaaagaataaaagaaaatatcaatatttctatataaacttgggaatcatgcatttcagacaaatttgggtgaagttgattatggttgtcatgacaatgaaatactgaccatctctgagcaaagggcttaaggaagtatgtgggaagtgctcaaaaacataagctatgatgatgatgatgatgatgatgatttgaatttgagaatataatcccattttctttgggctattcaaaaactagcaaaaagtcaattagttaaaaaaatttcatttcagaaattagtttctgtggcctagaggaaaaatacactgtgtattctcatcaatcactgatttgaatggacacttaaaatacacctccatgtgcaggtaaaaagaagttactcaatggtgagcaaccttgtggactagaaatacagtcatccctggatatctgcgggagattcattccaggagccccccacccccaaatataccaacgttcatggatgcccaagtcccttatataaaatggtgtagttttgtatgtaacctttgtacagcctcctgtatacttaaatcatctccagattactaataatacgatgcaaatgctgtaaaaatagtcgttatactatattgtttaaagaataatggcaagaaaaaaatggttgtgcatgttcaacaaagtcacagccatccattttttccccactattcttaatcacagttggattcatgagtgcagaacccatggatatggagggctgctgagtgtactatatccctagaaagttattctgaaatagagataagtaagcgtaaatcttactcatatttacagggttgcagcattgtttataagagcgaaaattgacaactctctaatatctagaggtttatctatctagaacaggaagatcattttaaatatataccatccaaaactatgcagatcttttttttatatatacttcaagttctagggtacatgtgtacaacgtagcaggtttgttacatatgtatacatgtgccatgttggtgtgctgcacccattaactcctcatttacatcaggtatatctcctaatgctatccctcctcccaccaccccacgacaggccccagtgtgtgatgttccccatcctgtgtccaagtgttctcattgttcaattcccacctatgagtgagaacatgtggtgtttgcttttctgtccttgctatagtttgctcagaatgatggtttccagcttcatccatgtccctacaaaggacatgaactcatcattttttatggctgcattgtattccatggtgtatatgtgccacattttcttaatccattctgtcattgatggacatttgggttggttccaagtctttgctattgcagatagtgtcgcaataaacacacgtgcatgtgtctttatagcagcatgatttataatcctctgggtatatacccagtaatgggatgactgggtcaaatggtatttctggttctagatccttgaggaattgccacactgtcttccacaatggttgaactagtttacagtcccaccaacagtgcaaaagtggtcctatttctccacatcctctccagcacctgttgtttcctgactttttaatgatcaccattctaactggcgtgagatggtatctcattgtggttttgatttgcatttctctgatggccagtgatgatgggcattttttcatgtgtctgttggctgcataaatgtcttcttttgagaagtgtctgttcatatcctttgcccactttctgatggggttgtttgattctttcttgtaaatttgtttaaattctttgtagattctggatattagccctttgtcagatgggtagattgcaaaaattttctcccatgttgtaggttgcctgttcactctgatggtagtttcttttactatgcagaagctctttagtttaattagatcccatttgtcaattttggctttagttgccattgcttttggtgttttagacatgaagtccttgcccacgcgtatgtcctgagtggtattgcctaggttttcttctaaggtttttatggttttaggtctaacatttaagtctttaatccatcttgcattaatttttatataagatgtaaggaagggatccagtttcagctttctacatatggctagccagttttcccagcaccatttattaaatagggaatcctttccccatttcttgtttttgtcaggtatgtcaaagatcagatggttgtagatatgcggcattattcctgagggctctgttctgttccattggtctatatctctgttttggtaccagtaccatgctgttttggttactgtagccttgtagtatagtttgaagtcaggtagcgtgatgcctccagctttgttcttttggcttagtattgtcttatcaatgagggctcttctttggttccagatgaactttaaagtagttttttccaattctgtgaagaaagtcattggtagcttgatggggatggcattgaatctataaattaccttgggcagtatggccattttcacaatattgattcttcttatccatgagcatggaatgttcttccatttgtttgtgtcctcttttatttggttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgtttatcagcttaaggagattttgggctgagacaatggggttttctaaatatacaatcatgtcatctgcaaacagggacaatttgacttcctcttttcctaactgaatactctttatttctttctcctgcctgattgccctggccagaacttccaacactatgttgaataggagtggtgagagagggcatccctgtcttatgccagttttcaaagggaatgcttccagtttttgcccatccagtatgatattggctgtgtgtttgtcataaatagctcttattattttgagataggtcccatcaatacgtaatttattgagcgttttagcatgaaggttgttgaattttgtcaaaggccttttctgcatctattgagagaatcatgaggtttttgtcattggttctgtttatatgctggattatgtttattgatttgtgtatgttgaatcagccttgcatcccagggatgaggcccacttgatcatgatgtataagctttttgatgtgttgctggatttggtttgccagtattttattgaggatatttgcagcgatgttcatcacggttattggtctaaaattctctttttttgttgtgtctctgccaggcattggtatcagaatgatgctggcctcatgaaatgagttagggaggattccctctttttctgttgattggaatagtttcagaaggaatggtatcagctcctccttatacctctggaagaatttggctgtgaatctgtctggtcctggacttgttttggttggtaggctattaattattgcctcaattttagagcctgttattagtctattcagggattcaacttcttcctggtttagtcttgggaggatgtatgtgttgaggaatttatccatttcttctagattttctagtttattggcatagaggtgtttatagtattctctgatggtagtttgtatctctgtgggattggcggtgataccccctttatcatttttattgcatctatttgattcttctctcttttcttctttattagttttgctaccggtctgtcaattttgttgatcttttccaaaaaccagttcttggattcattgattttttgaaggatttttttgtgtctccatctccttcagttctgctctgatcttagttatttcttgccttctgctagcttttgaatgtgtttgctcttgcttctctggttgtttcaattgtgatgttagggtgtcaattttagatctttcctgctttcttttgtgggcatttagtgctataaatttccctctacacactgctttaaatgtgtcccagagattctggtattttgtgtctttgttctcattggtgtcaaagaacatctttattccttcatttctcaatgtacccagtagtcattcaggagcagattgttcagtttccatgcagttgagcggttttcagtgagtttcttaatcctgagttctagtttgattgcacttttacatttgctgaggagtactttacttcaaactatctggtcagttttggaataagtgcgatgtggtgctgagaacaatatattctattgatttggggtggagagttctgtagatgtctattaggtctgcttggtgcagagctgagttcaattcctggatatcctttttaactttctgtcttgttgatctgtctaatgttgacagtggtgtgttaaagtctcccattattattgtgtgggagtctaagtctctgtaagtctctaaggacttgctttatgaatctgggtgctcctgtattgggtgcatatatgtttaggatagttagctgttcttgttgaattggtccctttaccgttatgtaatggccttctttgtctcttttgatctttgttggtttaaagtctgttttatctgagactaggattgcaacccctgctttttttttattttccattgcttggcagatcttcctccatccctttattttgagcctatgtgtgtctctgcaggtgagatgggtttcctgaatacagcacactgatgagtcttgactctttatccaatttgccagtctgtgtcttttaattggagcatttagcccatttacatttatggttaatattgttatgtgtgaatttgatcctatcattatgatgttagctggttattttgctcgttagttgatgcagtttcttcctggcatcaatggtcttaaaaatttggcatatttttgcagtggctggtaccagttgttcctttccatgtttagtgcttccttcaggagctcttgtaaggcaggtctggtggtgacaaaatctctcagcatttgcttgtctgtaaaggattttatttctccctcacttatgaagcttagtttggctggttatgaaattctgggttgaaaattcttttctttcagaatgttgaatattggcccccacctcttctggcttgtagagtttctgccaagagatccgctgttagtctgatgggcttccctttgtgggtaacccgacctttctctctgactgcccttaatattttttccttcatttcaaatttggtgaatctgacaattatgtgtcttggatttggtcttctcgaggagtatctttgtggcattctctgtatttcttgaatttgaatgttggtctgccttgctaggttggggaagttctcctggataatatcctgcagagtgttttccaccttggttcctttctccctgtcactttcaggtacaccaatcagacgtagatttggtcttttcacatagtcccatatttcttggaggctttgttcatttctttttactcttttttctctaaacttctcttcttgcttcatttcattcatttggtcttcagtcactgataccctttcttccagttgatcaaatcagctactgaagctcgtacatgcgtcatgtggttcttttgccatggtttctgctccatcaggtcatttaaggacttctctacactgtttattctagttagccattcgtgtaatcttttttgaaggtttttagcttctttgcagtgggttcgaacatcctcctttagctcagagaagtttgttattatcgatcatctgaagccttcttttttcttttttctttttttttttaattatactttaagttttagggtacatgtgcacagatcatctgaaaccttcttctctcaactcatcaaagtcattctccgtcccgctttgttccattgctgatgaggagctgcattcctttgaaggagaagaggtgctctgatttttagaattttcagcttttctgttctggtttctccccttctttgtggttttatctacctttggcctttgatgatggtgacgtacagatggggttttggtgtggatgtcctttctgtttgttagtttttcttctaacagtcaggaccctcagctgcaggtctgttggagtttgctggaggtccagtccagaccctgtttgcctgggtatcaccagcagaggctgcacaaccgcaaatattgcagaacagcaaatgttgctgcctggtcgttcctatggaagcttcgtctcagagggacaccctgccgtatgaggtgtcagtctgcccctacttggaggtgcctcccagttaggctactcgggggtcagggacccacttgtggaggcagtctgtacattctcagatctcaaattccgtgctgggagaaccactactctcttcaaagctgtcagacagggacgtttaagtctgtagaagtttctgctgccttttattcagctatgccctgcccccagaggtggagtctacagaggcaggcaggcctccttgagctgtggtgggctctacccagtttgagcttcctggctgctttgtttacctactcaagcctcagcaatggcgggcgctcctcccctagtctcgctgctgccttgcagttcgatcttaaaaagtattagtgagacccaaattcatagaaagatttccatgacatatatcatttaagtgaaaaaagaagttggagaaaacgtgcactgtgcaaaaataaaatacgtgtgaatataatgttaaagaactcaaagtgcattcactgatctggttattctagggaggagaacagattggcaaaagatgacttactcattttattccatatatttagatatttgaatttttacaaggacacattcatgtacataaatacataggctgttaggattgctcatgcctgtagtcccatgcttttagaaaccaaaatgggaagagtgcttgaggtcaggagttttcatttgttttgttttttgagacggagtctccctgtgatgcccaggctggagtgcagtggtgcgatcttggctcaccgcaacctctgcctcccaggttcaagcgattctcctgcctcagcctcccgagtagctgggactacaggcatgcgccaccatgcccagctaatttttatatttttagtagagatgtggtttcaccatattggccaggctgggctcgaactccgaggtcaggagttttagaccaaccagggcaacatagcaagacctcatctcaagaacaacaacaaaaaattaaaattagctgggcatagtggcacacacctgtagtcccagctgctcaggaggctaatgcgggaggatagcttaagcccaggagttcaaagctgcactgaggtatgattgtgttgctgcattccagcctgggtgatagaatgaaaccctgtctctaaaacaataaaaaatatgtaagtaattaaaaataatgataatgaacactttgtgtgtactatgtgtcaggcactgttcctcacaccatcactctgaaatatatactattttcataattttatggatgaggaaactgaggcactgaaggatttttgtccaaagtcccacctttagtgagtggttccagagtctttattattaacccccaagatcttctgagtgattttatcttaaaatagttaggaacctgaggttaggcagatctgggtgagaatccagctctgtcattgacaggctgctcaactctgagcaggccatattgaaaggtggcatctgatctgaaaattgaatcataggagaagtcagcctcgtggaaccttggtgagctcacttgctaatctgtaaaatggtaaagaataactgccttatgggattactgtggtgggaggagctagcccggaggagccttgggtaaagaggtcccaagtacgctttgattccaaaatcccagaattccgatttttacatctatttagaaactcaaaaatgtactccagagttataaataggaccatgtaagcattctgaggtataggggagaaatgtttagaagagtaagttctgaatcatccacacaccatctagaattccagttagatattcactgggtttactaagtaagcacatctgggagacgaaggtggaaggtagcagctacaattttacgaaccttagtttaatcatatcttataacccacaaggtaccaggcattgtgctaggcactgggggttcagagcataccgtgagagaagataatgttgagagatggtccataaacaactattcaacaattgcaacagcagttataaaaggagtcatgatgtagagtgaatggatgggggcttgaagggacagtaatcctagggggacggaacagagaaggtcaaagtgaagaagtgatactcagtctgaaaattgagtggtagaaggagccaaacagagaagatctgggggaggaacattatgacacaagagacaggaagaggaaagccttggaaacagggaccagcttgagagatttaggggaataaaaaggttcattgtgactggaaatcagcaaacacgtgggaagggtgtgggagatggaaccagagagggagtgctcggagttttgggggtcttgtaaaccaagggcagtggagactgagaactgaggaaaaggggtcaggcttgttggagtgatattggtgatcactgcaacatcagtatcagaattgtgaggaaaaaagtcaaatcgtaaaaggtttaaagttagtgagtgtgggaaaagcagaagcagtggctttatatttctctttcctggagagaggtgccgaaggcattcaggagtagaggaaagaagggttggaagttccacatggttcactctaagaaggagagttattatgtatagatgagaaatagatagatagatagatagatagatacatatatacatacatacatatagataaataggtagattatgtacacatagaaagatagacgatatatagaaatagaagaaaaaatgcaggccagctgtttatggttacgtttctaacaaataataagatcagtagaaataatcaacctgcacccttttctgacatgtgttgttagaaagtcgatatgtggtgtcacataactgagaccggcactgtagccagttctttggcatttcattaaaaacattatctctaccaggtatcattgtatattggtatttttccatgtatctataattttttaaactaccccaaagtagagccagcatcattttagaagtaaatttaaaacctctttgctaggcatgctgcttggaaaatcgaacatggtaggttagtcagccatgccgtggctgtgattcaggcagcctgatcatatttgcagtgctgctcaaacaagcagcgctctcatccttcatttcatggtgattcagactaaaattactcacaacttatgaggatcattgttaaatggctattgaagattttgatatttgaaaataatatcaactaaaagataatatttctcagaacaatttggaattcttggtgtagacttgaggatttagtaggttttttcctaattttgatgagaagtacatcatagtgtatacaaatataaaacacaattagcccctgtgaaagtcatgattggagtgaaaatacagagtcatgatagacatgtaatacatatatgtatttttctgacacatacgtaccagtaaaatacgtaggtaccactttgatcagcaagagacagtttatattacttttcaatttgtataagctaaattagcttttcacttatatttatttgcttctagtttattgctcaaagatggatgagattttatctcaaaattgccttcagtaagtcaaattgggtaagattagttttcaagaatattaaccaacaatagtgaccattattaatgggaaagtgattcttttgtaaagcctaactttagaaagtttgcactgagaaacagattttgatatttgtttttatagacacagtacttagtttttgtcttttttgatatttttctcagaaaagccattcacatggagtgctgtatggacagaattctgttcctccaaaatgtatatgttgaagccttaaccctgaatgtgactatatctgaagacagggcctttcaggaggtaattaaggttaaataaggtcataagagtagggcactaatcctgtaggacggtggtcttataggaagagagggggagagagagagagagagcactgccatgtgaggacacagtgagaaggtggtcgtccacaagccaggaagaaagccctcatctggcaccctggtcttggccttcccagcctccagagctgtgcgagaataagtgtctattatttaaacctcccagtctgcagtattttgttatgacagcctcaacagactaaggcagggtgcctgacacctagccagacaagtccactgttttccacattcttttgtgctgtattaatgattaataagcctcaacacataacttcaaaataaatatttgcagaaaatagattccttttgaaattaatccgcatatgtacccgtaaattattctctgaacaaaatttgctacgttatctgtataaacgattcacccaaatgcttctctttgtctaccattatcccctccatgtgaggccatttgtttctaaacagtaatatttcatgtacctcagccattatcatggggagctacattctctctgtggattttaagtgaagatggaacagaatgcaatcattagcttttagaaggagccagtgtaggctgtgggtttcagtcttagacctgcgagttcaaagcttaagatactgaaataacatatattttggataagtgatacaaataattattttaaagctatagtgttaaatggcagaaaggtaactgtgaaggccataaaatccctttggaaaggtatgtaagggggaataaatctactaagagatttgtaaccagaaaaaaaggcgtcatgcaggcggggctcctgggagatactaataaaggcggagcatttgggcaggccccgttcgcacaaactcaccatccatccgacacgacctcctccgcctgctctcagacaagcttcagatccacctgcagcttcaagacatgattctattgctttacctaaaatggcaaaggaaaatttttcttcaaattgtatttgagttcagtgacattatagctccaagtcccattttctgaaaataatcttcatccagccagacttggaatggaaagagaattcacacagaaaaggagaaaaaagagaggaaacgtatcgagtaaatgtttacatgtgaagcgctgtctgaaatgttttacatttatcacattttattttcatgaagacatatgggaaaatggaggcgtagcaggcaacgtgtgtaaacgtcactgtttactcatactgacatgggctaaatgaagatagaattaatgcctctgagagttatttatgtatatataagagctaattacgtattttatcccaaacatagagcagccagccacacattttggactctgtggaagccacaattttaaaaattcagcgctgtcttgttccatattttcatcttatcatcaaaccctctgtctcaaatttagaacagtaagtttggacacagctcctggccaaaccttcttttggcatctgtgaatgaaagtgcagttatacagcaaagatcaccgtcagtgggagatccagaattaatgtggattgaagctgagtcgagacgcagtggctttaattcagaactgctgttaatccagtgtccacggacactctcgtagagaaaagaatgcaaagtacggggtgcaggagatgatattaaacagtctccgaatgtaggtaagtgcaagaaaagaaggtggaggcagtttatagaggtgatttaaaagttttcatatagtagaagcacatcctgaaccaatcaggaagagttggtttaaaaaaaatcatgaaaaggatattttggtgattctgtactgaaaggggagaagacgagagaaaaatcaatcagaagattcaaacctagagataaagagactcaaacctggagagaattacttcattttgctagagatgtctagcaaaacgaagtaattttgcaaatgaaagattgaaggtagagtgaagaagtgtcttctgagagatccttgggccttgaaagaggctgagaaccctatgtggtccccttggtcagtcctaatacagaccctaaatcatagcacacatctctctctctctctctctctctctctctctctcctctctctctctctctctctcgcacacatctctctctctctctctctctctctctctctctctgtatctctttctcactcccttctccgggcaggagagacagctgcaggtgggggaagggtggtgtccagtgaggggcccaggccagctttctcaggggtcgcactgggctggtgaggatctttgcagcctgagggcaccaacactggatgggataagggcagaccagatggaaggaacctggcacaagccatttaattaaatgcccctgcccctcacccttaagttagagagaaccagtctgcaagcttcagattccagagtaggaacccaggtaaggagggaggaagtgccaggagcacacacagacccagagccaaaggggaaggtctgtacaaagctgcccccatcctcggcatcgctggtgtgcctgagtgtcatgggagacagcgaccacacaacacccttggggaaatgggtgagagagcaacacagcgtggctaaagatgagcactattctaaaagaaaatacggactaagaaaagatgatcacaattttcatcttttcttcaagagtggttacttttggggttcagtgaaagagtggctatcattttttagcttaacttttatttcagtcttctttttttttctttttctttttttttttgagacagagtctcgctctgtcgcccaggctggagtgcagtggcgcaatcttagctcactgcaagctccgcctcccgggttcatgccattctcctgtctcagcctccccagaagctgggactacaggcgcccaccaccacacccggctgattttttgtatttttttagtagagacggggtttcactgtgttagccaggatggtcttgatctcctgacctcgtgatccacccacctcagcctcccaaagtgctgggattacaggcgtgagccactgcacccggccttatttcaattttctaaccaagaatgtttatgtgcctggcgcggtggctcacacctgtaatcccagcactttgggaggccaaggtgggcagatcacgaggtcaggagttcaagaccagcctggccaacatggtgaaactgtgtctctaccaaaaatacaacaattagctgggcatagtggcatgtgcctgtagtcctagctactcaggaggctgaggcaggagaatctcctgaacccaggaggcagaggttgtggtgagccgagactgcaccactgcactccagcctgggcgacagagcaagactccatctgaaaaaaaaaaaaaaaagaatgtatatgtgatcatactttgttggtttattaatacatttattttgtatgtcaacaagggttatctgactggtaagactgtgaaccatattttgttttttctttgttattctctgctaaaaacaaacaataaaaggaaataaacagaaggtcctcaaaatgtggacttgtaattgtgcactgatggaaacaaatgaaaaagcaacacatttatcgcagtataataaaacacaaactgacatattaaaaatgggaacttttttgtttaattactccatcaggtacattttatttctatccctttgggagtcagctgagcatctttcagggaattgacctcctgcagaaaattagtcaccctggggtctcagctttctggattcctgaggatgtgccctacacctgacagggcagaaacaaggacagaatgcctcatgcttacttcagtttgcttttcagataaatatttatttttcttttctctccagctcaacatttaacttttcatgcatagtaagcattcatcttgaatttattgttaattacatagctctcgtcattttggtttagcaatattgccgactcatttaaatgccaaaaaaattttaatttatttatgaaagcttctaaaaaagcttgaaaacacaatttggtggaggttagccatttgatttcaacaaatttcagatgtatatggctggattctatttaaatcaattttttttctgaatgcaaaattgatatttcttataaatgctaagcattattttatataaaaatgccaaacttctgtgataatcaacatatttcccttattaacgtagtctaaaatatatttaaaaattctaatttgatgagaaaattttgaatggggatggttatcattcactctttctggattgtttctcaacattgaaatggacagtcatcctcttaggaaaaacccaaactgaagttctcaaaactaggtttggggagaattataactgatttgagatttggttgataaatgcatcattcctgattgggaaatgattaaattttcagcaattggcatttgggccaatttaaagtgattcgagatagattgtaactgcagtaatattactggggaaatggagtatttgctcaagacaggtcttgttcttttaaccaattttccttttttcttgtgatctgaacttatttcaaattagttagatgagacatggcatatgctattcaaccaaaatgtaatggtcaatgaagatgttaacacatgtcctcgttcacattttaagcacatattaatattctcaatctcaaaaacatttacagtcatctccctgcaagggattggttccaggaccccctcgggtaccagaatctgctcatacttaagtcccacagtcagccttgtagagacttctgatacagaaggccaaccatatttattgaaaaaaaggtgacacattgattataatgcaaaagtgtaaatatgaaggaaaccatcttcctttagtacagaaggcatatttgtgccaggtgaaatgactgaatataagaacaatatttaaaataagctctgtagaactcgcatattacctaaccttgttaaatatggcttatttgcctctggtgtttctattttttagtccaaggtgttttccctttttttctctctgattacttatctttcttctttgtcatcaatattcacagtattgaagcatccctttaatttcttagtctatttgatttcctctaaaatgtcattagcatactctttacatactcagacacacagtactaattgattaaataaattccaagaaagacataaaattaagcacattattacattcagaacgaatgagagacatttaaagtcaaaaacccccaccaaactttaaattttcagcaaatagaagctctgtatgaatatgattttaattaacagtcacttcattttaaataatcacatcacttacagaggtatgatgttaagaggcttggttttcgcataatcgctgtgggaaggtgagcgctcacataaaaagcacacccagctgaacctggaggattcatgcagtggggaaactgaacttgcgttcaatgtagccttgctgaggaatattgaaagacgtgaccaatcataggtactaatgccctattgggacaaccatagatcctgataaagaattctgaggaacttaacaccagagcaagcctgatacagaagtatgtaaaacagaacatcagagtaagctcactgtaattactggtgcaaattgaacatctgctgactattttctaaagataggatgatgtgtaacaactgcaacattaatttcatataaatggagctgaatattcattacagctttgtagccacttgctgcctgtccacatacattcaggttatttgttttgcccaataataaaatcaactaattctgtatttgtgaattggcatgtttctttgggtattgattttccccccaacaatttggtgatgaggatgggatttcttgagtgagtgcttctattggttaatttgtgggaagatttgtgtccaccttcttaaaaagtcattttattgtgataaaacacacttaacataaaatgtggcctcttggattaggtaagagaccccgactgtttgcttaaaagtctcccattatctactttggctcagcaggattgggttcctggggaaaatttcaaaaccttactacaaatttggagttattattgagcaaaatgtgtaatacaggctcacaggtcctatatgattcaggataggttttaacggcagaaaaatatgggaagtccagaatgttgctggcaggtctttctcttagaagggttatttcactctattatgtttagaatgggtaaacttctgaaaattctgctttgcaatggccagagaaaggcttttttttttttttttccctgagacggaggctcactctgtcgcccgggctggagtgccgtgccgtggagccatctgggctcgctgcaagctccgcctcccagcttcatgtcattctcctgcctcggcctcctgagtagctgggactgcaggcgcctgccaccatgccctgctaatttttatgtacttttagtagagacagggtttcaccgtgttagccaggatggtctcgatcgtgatctgcccgcctctgcctcccaaagtgctgggattgcaggcatgagccaccgtgcccggccgagaaagactcttttgaggtagacaaattagtgtatgcacggagattttaaggaaaaaaaatcccaaataaacggataatttatattcctgagatgaagtagtcagtaataaaacaaaaaccaaaaagagtgaattaagaaattggaagaatagagtaagaatctgaaagctctttttcttcctccagcttctcatttcttctctgctgtcattccttttgtttcctcagcttctcttcacccttctttgctcaatctgggatctcagaggagggaggtaatggtctcttggatgaattggaaacctgggatgaattccctttagaaggagcaaattgtttagctttattagaatatcctgatattggatgccctagttctgatcccatctctgtgattccctctaaactgaatatgcaaaacacaactaaacatctataaattactcagaagaaagatcaaagagtcagtgagaatttgggtaagagattgtatcctagaataaaggttttgggttgctgaatggttgattgccttaagaacttagaagaaatggagggagtcaaattactatggcataacagggactgaaactacagtgccatacaaaccaacttatttttcatttcatgatgaaaatcagccctatccctttgcaactgcagtgacacaaatgccagaatccatattgccttcccccaagttgatatacttctcttaagagatttttttctattgctctgggaagattcacacaaatttgcagaagtgctctgcagcattttttcaacatataactacacacgtgaggatataaactggctgctgtgtgatgtgttgcctctggctgacttgctcaactagtggaacaggtgtgatagaggccaaattataaccccctcatcagggagtgccatggcctcaggaaaccagccgtccacctctttccataactcagtgtgagggatggctgatggcagtccttggagcctctctgcatatggtgacctctagcagtgctacaataacgcactcaagaggcaggtgtgtccctgttgcttttcatcagcagtgcactgaagcagtttataaatttttggggcccaatccaagggaagatcagaatatatccttggtcctctaccttttaagcaggctttttgccaggaatttccctgccagcaattgtcaggagaaaaaatagtttgatggcaagggcggacagttggtgccagcaatccattttgggaaaatgtggggaagaacttaagactgcagtgttagctgcccagttagaattattcacagatgggacagactttattgtgagccaacaacaaataaaaaggaatgctctaatggaaagttgatatatcactgttgtaagaaaccaggatattcagaaaggggatgctgaagaaattaagacgcaaaggattcaacctgagtctgaagctttattagcttctctaggagatttttctcctgagaaactggatgagaaataattggcaaacggtgcaaactagtgtgcaaaattgacataatgaggaaacctttgagttgggaagcagacagctttatatgtctgtttcttttcctcatcttaatcttttcatgtttttttttctttttttttttttttgtgaaccctggagccatgtattctgtaatttcttctgaccttttttttgttttaatgttttggatatctccggacaaccttctgtctgttcttgctgctctgaaattattctgcaaatagatcttttgtaaaagaaacatgcttttatctagtctcctgatgcacctagctatttgttggaaagggactcgctgtgtaaactaatgcctcccacccattctgtattctgggtgaaatgattttggagccctgggaggcaaggcacctgatgataaggtaaagatgtgccttctgaaaccaatgggggcagtggtgagtggcaatctcaccttgcactggaatagatcaattgacaagaagtagatccatttttttggatcccaggaacaaatattttagtaaaatgtatcaatgctataattatagcttacaacatggaatagctcaattataagatataatctatacattttttaattaggaaaatgagctgtaataaagggcattcagtttgtaatgcttctacattacctgtgaaaaaggaaggaaaatatgacagggaaggtggacctgtttatagatttgtacaagatcttatagaaataagtatgtttgtgattcttctggtacctgtgcttgtgctagctgacctggctactattttaattacaatacctatgccaactaagtatttttctgcagtagacttttgttcaggtttttttctgtacctttacatgagaaatcaaggttcatccttacatttacctatggcagctttcaatatttgtggcaacggattcctcaggatttagagattcacctactatattctctagacatttactgttcaagagaacttaaagtcattttcctcaccttagagtttcatgctgattcaatatgcagatgaatcattgatagctgctgacaccttacatgtgataagaagaaaatgtaactttctacaaatttttagcttcctaagcatataaaacatccctagataaatagcaatagtgtcaaactgaactcaagcatttgggacatttgtgactggccaataaaaaatagtcccttcctagactcagcctattttacaaattaagcttgcttaattaaaaaaaatcaagtttgccagttttggggattggttgggaattgcagtcaggagatccctgcctgttcagaaaaggcgaagcctgtcactgagctgttgcatcaaacgtcaccagcacctttactggggtcatgttagcagtggaagatctgtacaggtctgcaacaacctcagttcttgctacctcagaagaaggaattcaaccgaggagcttaaggcggaggaagagactgaggcagagactcggagcaggagtgaatgtttattaaaaagtttcagagcaggaaccaaagaaagtgaagtacatttggaagaggggcaagccggcagcctgagagattcaagtgcacggtttgacctttaacttggggttttatacattggcattccatatgcacagtggcctgtcagcacttgggaggggtcataggcataatgtgttcactggagttgtatgcatgttcctagaagaaggtcatgtaccagttaaactccaccattttgcctcttagtgcgcatgcttgaggccactcacccagctcctgagatcatattgggaagcttctgatcaccagttacaggtgtttctatctattgcgagactgcctttccctggcactggctacaaccaattattttagagagacagtgtaacaactgcctgaccatcacctgatggttgcctgacattcctggggtcggggggtcctctcctgttctgctcatgtctgactaactactatcacagtcagaagaagctgaaaagcctttcaaaccctttaaggacctattgtctccccacgtgtattcataactctggtaaactattctactttttccatctggagaataaaggagttgctagtggtgtgcttactcagaacctaggccctgactatagacctattggttactttcctgtcttgttggattctgttgttctggatatgccaggctttctacaagccacagtagctcttctgattgtgtcactgcccgatgggttcttcctgctcgctgcaaaaaaacaaaacaaaacaaaaaacatggtatttgctgtaaagagtttaaattaactcaaggttggcaacaccacattagagatgaagttattgttcaagtcagtctcatcgaaggctcataggttagggatttttcaaaggtagtttagggaaagggcggggagtggctaggcaatgggtgcttgccgctgattggttgggggtgtaatcataggggtgtgggaaatgattcttctgcatgctgagttacttatgggtggagctacgggagctgttggcaggtccagtggagccatcggtagtcaaacatgcaaaaaacctggatatctcaaaaggctaatcttagattctacaatactgatgttatctgctggaattcatgaggaagttgcatatctcgtgacctctggacaaatggctaacaatcatttatgtctgtattttagcagaatttaggctcctctattctcctagcctggtggtctctcattagctttagttttggggaagggctattatcatttaaactataaactagatgtctctcacggttggcttgcctaagcccaggaatgattaagggcaacttgaaggtcaagggcaagaagggggttaactagatcaggtctccccattgccataattttgtcactgttagaatttgtgcaaaggcagtttcaatttcactgttagaatttgtgcaaaggcggtttcagagctcagctttgaccctaggacattgaacttccatgtgcctcatgttgttgctgctgttttacaaattcatagacagaaaatttctagcacactgccggataagccacgagcaagtcttattatctcatactaatattattctaggcaggtggcaccttttgagtctggttactctgtttgtagatcctaaccaaataggaggatgtgactgcctcatagtcacagaaaatactcaacctaggcctgattcattcagtattcttattctcaatgctggcaatattgttcattgatggatctgtgtgagagacacacaggaatatacaattgcatcttattttataggtagagatggctttttcttagaacatattatacatgattacaagtgtaaaaatatggtgaaataattttatttgcttttcaaatgatttttgttgctaaaaactaaaattaaaaatagagaacaagtatcctaaatgtttttgaaactattatcatagcaattctcagactatcaagactatgaactattttccatgatagcacactaatcataacaatcataaccatttgtatgtgcatatctaatatctaatattcagggataaggtcatacagattacccagtttaatgctcacagattcttatgtgaaaaaatatatatttggtcatagttaaaatggacaaaataagtgaatctgtctgatggtcagatagtaaatatgtcaaacaaacaaatgattacaattttcagttagaataacaaaagcacttagatcactgatttaataatagtgattccctaggtaattttttcatctgtgcaggttgattatcagggatgaaaaagtgtgaaaacattccaattaagtaaattgctctgcagttggtgggaagtactaagtaattacttgtggtgagtccagagatgaagatggagtgggcatctctgagtcatccaggcaaaggaagacaggtgctgctcctcacagcagaacaaggagctgggtttagagagactggatagaatatagcattaggaaggttatctctaacaatcaagtcaatgcaccagcatttgcctgggaccaactgtgtgttaaacactggtaaatactgggagggttaaaggtgcagatcttggggaacctagcataaaattcaacacagcagacatttattctccttgaagaattcctgattttgcaacaatgcctatcatgtcccagaacgaggctggttgttgaaagtctctgagaaaccagagatggcaccagcataataccctgaacttttataaagcacaaagatttataattataataaggaaatctgagagcaagaagacatgctgatcgatctcacacaggaaatttgtcccagatccaagtcaaatgacaagttagatgaattgcctgctttctaaaaaggtattttaacatttaactaatgtgatcatttaaagtcaatagcaatatctcagaaagaacacctgttaagttgtgatatatttagttatatgcactatacacagagagctaagtggctagttctgctctcttcattatctgaattattttaaaaattacatttaagttaatcttgattcgtattttggattgctttatgtttctgaatgatcatttcctcaaagttatcagtagtgagcaaacacaaggaaacatttatttgtcttttttaaacatgcactacactttgtttttctctttttgacttattcaaatatggtaaattaattaatttttatttaaaaaaatgataggatgctcaagtatcaaacatacaaatgtatttgcagtgtttcatttttcaatgattatgtatatttaattaattaaagatatgcataagtgcatatacacatacatttttttcaataaggtactcttgctgtcattgattattcatttattttctaacatttctttctttcttgacccaaatataaactaactatttcaggccatgctcttttagtgctagagaaaactttagattccatagtacttttttttttttttttttgagatagagtctcactctgtcaccaaggctggagtgcagtggtgcaatcttggctcactgcaacctccacctcccaggttcatgtgattctcctgcctcagcctcctgagtagctgggactacaggggcacgccaccatgctagggtaattttttttttttttttttttgaagtagagatgaggtttcaccatattggtcaggctggtctcaaattcctgacctcaggtgatccacctgcctcagcctcccaaagtgctgagattacaggcgtaagccaccgtgcctggccccgtagtactttgtagcgtgctttccagctaaactgaagcctcaggtgacataccatggctctcacagctaattaatgaaaaagctggaaccatcacccacatttcttaattcctacttcagttcatttaataatgctagaataaggcaaagtcacacttttctcattttgtgttgataaacattgtattctaatggttagtaaaatattaataatgcattcatgagcactttaaaataattaagtacagctgttcacataggcagttatcgatactaatttaaataagaaacagttttgcatgttacatcattatctgtaatcttctgaaaataacagggacaaaagcagtatcatccttgcctaatgtcatctgctagtgaggggatgcagacctaagtgactaagttgattccggctgagaatcaaaggaaaaggtccatagattcatccttgctttcaaagagtggcatagtgagaatgagtaagaggaaatatcacttagtattaacagatgataataagtagtgtttcctactaattgattatttaccatatgctagtcctatgctaagagtttagagatacgtgagagtcttgtgagtccggatcatcattctccccagtgttcagaggggaaggctccgcatggttgagtatcttgcccatagtcacagaaccagtatatgttgggacttggcctcagacccaggtctctccagcttcgcagcctgtgttcatcatatgatgtatcacttacaggaaactccaaaactgagctgaagtctttgacagtcgcaggagtcagcatcctgctggagccgtggcctcacagtcctgtctgtgtccttgggagggctctgtggcagccccaggtcccacttgccaggagtcccttcttcacccatgggcatcctgagaacagaggaggctgagggggcagcagcagagggttaacagctcttcagcaggcactgggtccacatgctggagcccttttttgttgatttattgtgtttagacatcagatgtgaaggtttccatgagtcaccttcctcagtgaggaatcatgaaggaatgatcggtctggcctgcataaggccctactcttgccttggtgttcattcattcattaatcatatttttttatacatgattcatatttccccagtccaatacattttatttgtacatattcttttaaaaatcataattcttttgttcacacatatttacacttacatataatattgttttatatctttcattttgctttttactgattaactctgcataaatataattgtactagtcatactaaggtgataaagataatatgctaatttttaataatctatagaaacattttaattacttcataaaatcatcaaggtatatgtcatggtaattatattattaatgctatatacttagaaataatacagtttcttcatataacacttataattaacaaagtgtcttaatcaaataatcttgttaacaggcattacagggagcagcttaacaatatctttcatttgtatagttccttagaattttcaagtcacctacagaaacatcttccaacaagctataattgggcagagcagttagtattatccccatgttactcataaagaagctgagattacaagcactaaaatttgtatccaatatcagcatagtctggcaattaaggaaacagaattagaactcagggactcacgggcactttcttaccccacacacagacagcttaaaataataacagcatattaaaataagaatctctcgtagtacatttgagtgtttgggaaactaataataagctgaagctgctgaagaatctatttcttttagacaggtttttctaacatctttgtgaggactaactgaattgatgtgtgaaattgcataggacagtggtggccctatgcatagtagagatttaatgcttattttaaaattcagagactcatttcagtatctcgtaatttaaaataaagatttgatgataaaaacccactaaaacagaaacgacaaaatgacaaatttggaaaaataacaaatttctaacagtcttcttaaaaatagttgttgatgagtcttaccttgacagatttttttctgcttatggctgtcaatctgggtatttcatactcaaccacaactatccatgtgcttaacattttgcagaccaggatatcacatgagcaccatcactgactgtgactgttagatttaactaatgtgactgctaaaaatcaaagtacagtgttggaaatttttcagtaatgtcattaattcctaagttatttatgaaacatatttccagcatgtgagtggactccaagccacagatttcagtcactttcatgtatacctaaggaacatgttatgaaaactgatcattttatctgaaaatactcatttttgattacttaatataatacttagctagaatgccctcaaagacagagaatccacatcaaacttaagtgactgtctttcaataagatggagcttttatacatgaacacaccacacacacacacaaattgcagaggaatgctgtaaaaaataaatgatttataatcttaaaaatacattatatatattaactagtttaattcttaccaagattgccagatagatataatttttctactttacaaagaaagatgatgatttctcccaaggtcacatgcctgctaagacagaaaagaatttgaaggactatggcttccaaaaactattctgtatactctcactctccacagagctgtaacttttgctgtttatgtctaaaatgaagacgtaatcctctgcagaattgttgaaggctgcatatttctataaaagctggcttatccttctagaaggttcatttttccaccttaataaaacaaagcaggaataggtatttgtgttcgccattcttttgtccgtagtggtcatgtgcttacgtatgaactcatgtctgctctgcaagctctcgaagcaaactttgaatataatgaataagagactacactgcatatttttaagacacacattattttactgttatagataaggttatttcaataataagccctgaatgttatgacagtgaaatgctagtataaatctttcctgcccaaaatgtattctctttaatttctatatctttaaagaacaatggttcatttggttggtatcccatgaagctggttataattctatataagacaataatgtgatttctgaaatttcaaatgaattaatgtgattatatatataaacttttaaatatattttagtcatatgtaataaatgtttgattttttattgatatctctgaagttgcaaagagtatgtttctcatctgccttattcacaaactattaggtaatgtctatttaaagtttcttaaatgttaatctatttaattacgcaaaaattgacattaaattttattttgctacatgatcctattatcacatcactcagaagtatattttccagagtttacactttgaaacaaattgagaaagaagtaacatttggcagataaaggtgaaaaaattctgttttggtagggttcctttgaaaggtttttattgtattgtttttactgaggtttacaaagtttattcagctacagaaaaatatgattttaattctgcaactgaattttaacattggagtcaaaatgctcataggatctgatgttcctgtattagcttggctgtatgtcttagatattaaacccaaattagaaccaaaataaaaggatggatcaaccatctctaccaaccatgccaacaatgaccaacctgggtcacagtcacagcagccacctccacgcaggtggtgggctgattgatttccaggtgttatctcaattagtactctggcccttcaagatcagttttacagatgaagaaaccgcagcttgcagcagagtagcagggtttgaggtggtggagctgggatatggcttattttatataggtcagcctgggctgtccagacagaaggttgtgagtgcagaggttgtgcaaatatttacctgaagtttgtatagcgattgttaactcaaaaaatgttgatgtacatgaccctttagttggaacaagagtgaaatgattatctctggctgggcatggtggcttaatgactgtaatcctagcattttgggaggcccaggtgggcaaattacttgaggctgggggttcgaaaccagcctggctaacatggcaaaaccccgtctctactaaaaatacaaaaattagccaggtgtggtggcatgctcttggaatgccagctactgggcaggctgaggcaggagaattgcttaaatctgggaggcagaggttgcagtgagtctagatcgcaccactgcattccagcctggaagacaaagtgagaacctgtctcagaaaaaaaaaaaaaaaaaaaaggtgaaatgattctcttggaactggcatgaattagcaatagacgaactgttaccaagtctgacatcaacactagcatttaaaattgaccacattcactaaggcatttcctatatttttatttccatgtgtttatacccagggacacccattggtggttggatatgaggcaggctgatctttattctcttcgttttgttgttaagcctggtacattctttttttttttttttttttgtgacggagtctacctctgttgcccaggctggagtgcagtggcacgatctcggctcactgcaagctccacctcccgggttcacaccattcttctgcctcagcctcctgagtagctgggactacaggggcccaccaccatgcccggctaatttttttgtatttttagtagagacagggtttcaccgtgttagccaggatgatctcgatctcctgacctcgtgatctgtccgacttggcctcccaaagtactgggattacaggcgtgagccaacgcgctggccctaagcctggtacattctttagtacagcaaaataattaggcaggagacattcttcattcttggttgaactaactgctggcctgttccatacataaatattaactatgtgccccagtcatgttaggtgatagcacttctagtgcaaaagagcattaaccctttccttgttctcacacatgccatattcttaaaaatctgaaaacaatgaaaaaatatctaaaacaattttgtttgctttgcactctgatccttcccaatgttcagatagcaagatggagtgaagagtgaaagcccctttgtcctggagcagatagtggcagtgtgctcctcttgacacccccaggaagcaggccacaggtgcatggagctgtgttcactgtgaagtggattcagcctgataacatggaatcaatgatgccattgaaataaaagccagatgtaatcctgcccacactctatgatagctgtcctacatccagagtgtcctttcttcttcctagactgtagtttttcatttataaattaagggtgtggggctggaatcatgtctaggtcccttccaactctctaattgcagattccaggattctcactgcagatcctttgcatgttaccgtggtgctcgattgccctgccatgtgatgtggctttttgtgagcatctttaccacttgattagggaggaatctgtgggatagcattttagaaaagtgaacttcatagaggttgccatgtttatagtcattttaatgatgtggatgaaatttaaactaccttgtaaataaaaaaacgtagacaatggtgacgaattcagggactggagaggttgtcacatccttgttaaccattagcagtgtttcctttaaaacagcagctttttgcatattagcaaagcgagcatacattgctcattgccatgagaggtgacgacatgaagatggtgcatcctgcagatacattgatccctttctctgttttctcctagggttttccaggaaacacaaacgcagacagtgtggtgcactacagactccagcctccctttgaagccaggttcctgcgctttctccctttagcctggaaccccaggggcaggattgggatgcggatcgaagtgtacggatgtgcatatagtaagtggcctttattccctgtgtgaaatcaaggtcagcatgagattctgtcaaagccaaactgtaaaagccaatgtcggcatgaaatgttgaacttgactttttctgtctttttatatagctgggcaagcagaactggtttttattgaaacactctagtgtctccccatgacaatatgaactttagttactgtcttttatagttgaatttagtggtggacctgaactgaaacttacctgtctttagattcccagagtttagcaaagtacttgcaatatggtaggcatctgatgaaacgaatacaattcaaactaacaacagatgatgctgtttttctgaagctgagatgacacgctgtctgggaaaacaggagctgtactgggggcagggtgtgatttctcgcaatctcttggttctctgtgtttttctctgctaacgtcctcttttgcacaccatgctgtcgcttcacttgatcttcacttggtgggaacctgtgtttagttagcctcttttctcacctattctttgttataaaagtggaaaggatggggccgacatgaatataacacaaacaaaaagccggccgtgagattatttggtggtactcagtgacacagttgccacttgatgatctagaacatacttgtattctttctttacattatcataaaaatgttttaaattattgtcaaaatggaataaaattgaaaaatactcctgtataaaactggagaacaagtcaaagagcagtctggatggaaatgtcttaagtggcttcaatttgggtccggccggatgttcatatcacactatttacacacagtcactcccattctctgcctactcacagctttagccctgcagaatattaattttctaaagcatgataacaacgtctgtcattcatgcagcatttaatgtctcagatactattatttccattttattacataacccctgtacaacccagttcatttcctaactctgcttgttttttagtgtttacatttctacagggctaaatataatgatgttgctttaccaacggtcttttttcttcctgttattgttcatctccttccatccctgtgttttctgggacctataactgtgctctctgtttcaatggctaagatgtctgatatttagaatttctctttgatgctgtgaagttaccttctcctctcattactctgaaacaacttcaggtttactgactccaaagtggaacatgctctttgatggcgatttgccattagcttgatgttccttcatgaagagatattactccagttccttgggctggaggttggtaccaggaagatcaaagccctgtgcctgattccaggaagggccggtgggcggtgcagctgccatgcaatctgctggcaccgttaacttctgtaaacacatgctgttggctgtaagggactactagtaaaaaaacccaaacatgcagacagataatatgtgaccactgctaactagctaaaagtaattctttagaacaagtggacatctacattgtctttttttccttagaagaataattgttcaagtatggtgattttatttttgttgttgacagtaatacaaccctttatgacttatgttaataatggtagtttcagtattttcctttgtatttccactgccctgcttgttttctagaacgttgcttataatgacttataatatcccttccacgcagcatctcttcccatttatttgtttatgtatttatcaatttatctttttttattttaagaggcaagttctcattatgttgcccaggctggagtgcagtggctacaggcacaatcccactgctgatcagcacgggagtcttgacctgcttcatttgggagcagggctagttcactcttccttaagcaacctgatggtcctccgctcggagagatcaccatttgatgctaaaatttgttcagacacctgatcatcatagtgcacccctgggctccatcgatcctctacctcagcctcctgagtagctgggactgcccagccctagtgttattagcttttctacacttcatttacagtaatagattcattattcctttaaactgtgtgtgttttcacagactcctggcttactctatgcatttatttctatttccacttctagcctggggataggttgtaggttctcccagagttgctgctcaactgcagaataaagccatgagcacagatggcctcgggcccttcttgacagctgtattctcctggttttccatgcacctttgcatgctactcttcttgccactccttaaaggctaacattatccacagattggttgtaggtcttttatcctgctcccaagctctctctgagtcttttatccacttccatgagttttcagtagcatttacacactgtggctgataacttccaaatagacgtatccgcaacctactctgaggagttccaacctctggtaccaacctctcttcactggccctgtgagcacttaaaactcagttgtctatctgctcattttcctttgttttccatcttataaaatgataccaacagccacctattgactgaaacctgattctatctcctaaatgttttgaatttctttctcttcctccagtttagcctaaatgagcaccagcctcctaaatcagctatttgtctctggtcttgatctttccagtttttagtccacacaataatcaggatgattcctggaaaaacatgcacattcgattgttcaaactcgattgttgaaacatgcttaaagccacacccaagacactaggattgtttcccagaggccttagacagaaaaataaattccctatgctctactgcctgtccaggcctttgagggcatctctcaagaacaaaggggaactcccagaatcttaggccagaaccctataagtccttgacgcatctatctctcttgccctccatgtccagtgagtcacgaaattctgtattcttccctccaaattacaccttgcatgatttcagctctctttagctctactaccgacttaatctaaacttggtgtcccacagattatggaaattgccttccaagtttgggtcattctgtctctgttcatagctgactacattatattctccacactgcaactcaagttaccttttaaaaatgcagaactgatacaattacgtccctgtttaataccatcagtggctttccattgttcctaaaacaacatccagactcccagcaaggcctgaaggagcttgtccctgaataactctccagtgccacctcttgctgccgtcacctgctacctgtccactgtcaattgtatccagctttttactgactcaaagcctttacgcctgtggtctcccctgcttgaaatgctccttccctatgttcttgactggctatttactcttcctcttttggatcttagtttaaatgatgcttcctaggccctcactctacatttggttcctcattataagttcccaggaagcctatagtatgacttcatgtgctatagtcactttttataatgtatctgtatctgtcttattagaggcctaatttcctttttcctcattagccttcaggctacactagggtaaggtacattcattgctgtaacatcagcacctaatacagagccaggaacatactaagtgcaccatagctttgcattgagtgaatgaatgaatgaagcaattcagaaaaaaagtctgacagatgataataaaatctgaataatgaatctaaatttcagatatttatttctctcttatactagccatccaggtaaggcaggtatcttggagattatattgttataaagtgtagtattaaaaattgtaataactctagtaaaaatagcgaatataaggttttacagttatgtttccattcttccatctgatatttgatgcatctttatgtagtagaaaggcagttattaacacccagatgttccaagtgagcaatctgagaagccacaccaagggccggcagtgcaggagctacaaatagtcaccagagacagggagaggactccagtcctctgactaccaattccatgttcttgatggataataactgccgaggtttcataaaggatcattatattgatacttgttttgatatattgctatattgattgatggcggcagcttcttttctactttcagagagacagcatcaagctgcattgtattgtatataaacatttagtttttgattctgtgccttcctcctttttatcatgccagctttaattatcctcaatttcagagttctttaaatcactccactttctttgatattaatgcaaaaaatagaacagtcctcttcttgttgttttctcaagtggttagtatcctttccatctctttaattcccagtccgctagtgcagattttaagggcttacattccactccatgctagtgtttcagtattttcattagataacactcaaacatggcttttgtctgattcatgtttctgttaaactgagattgggcttctattcctttgtaagtcacggcaataattcatgaagaaaaaagaaaatggttagtattcaaggttgacttcataaataaccaagaagagcttggttcaccacttttttggtcccttagtggcggaaaatttggtgggggagggggtctgggagtggtggattcctttttaaaattttaatacttggagcacagccgagataattaacagaattctaaaatgttcttttcacgaagatttcttttataatgtcccaagtgaaaatcattttttattactcacaggtaattctttattcatgcattttctgttacattttcttataacttagtcttcaaatagttttatatgtcattcagactgtcttacatagctatgctattaccaatcagtccttttcttattcatcattctagcttcacttataattggttgaaccatatatttgccagttttgtagatcaaatacagttgaatattagcagcttcatctggattaactgagtgctgtactgttttctgtaggaacaacagatggcaagtggaggtttccggtaaaacaaaacaaatagaacaaatagtgactggacaaaagcaaattttattttctcccttccaaaattttacctgtccttgattagaatttgagacatgggaaattttcataactcctgagatggtccaagtttgtatttcttcattggtgttctaatgaagttagaactacctacctctgtaaagttcctttaattgttttatcacttttatatatacacgctgtgctagtttgcatcactggcaccaattctgcacctgttccttgccagtacgtgtgagtggcgtatgcttccctgccccctgatttttgagccagccagtgacttcctttggctagtggtaggcagagtcaactctacagtgtacctactgtcctcctttgtgtctaccattaataagcatgcctgaactatgaattccagtaaaatgaaaagagatacatgctttacatattttgaagctgtttcattaaatgcatatagattgggaattgttttatctcccttaaagttgattttttgtaattatgaaatatccttgtttatttctaataatgcctcctgcatgtaagtctgcattctctgatgatagtactgtatagctatgccggatttcttctgattagtgttttcatggaataactttttccattctttactttcaaactttttgtcttcatatgtaaggactctttctttattatttaaaccgaatctggaaatcattgagttttagttgttatatttagtccacttatattaaatgtaattactgacatatgtgaaattgtagctgacatgttactctctgttttatatttggttcacttgttttatactcctttttctctcctcttcttttgggttaatcaagtttaatttttccagtttttccactattgtttgctgttctaattttgttcccccaggtacttgagctactacttttatcactttccaaacaatcctaggatgtaagtacaacttatgttagtttagttaaactcttcccaccatgtgtgctatgttgacacattttagtttcatacatacatgtgtatatgtgtacatatatttttaatcacaaaatttaatataattttgtttgcaatcagtattcacttgaatctactcacatatttactttctctgcattttcatgctctttctgaatcaaattctttcagctagaaagactccttttaatatttgtcttagcccagttctactggtaataaattgtcatatagcttttgtttgcttgaaaattgtctttattttatgtgaacttctgaaggctgtttcagcttgctggagaatacggtctgtagttattttctttcggccttttaaagatggcattctattgttttcatgatatttattaagaaatcaataggtaattgatttttatcctataagggaaatgtgtatttttcttctggttacttttgagaatttattctttgtctttgattttcagcagttttgccttgatgtggctattttagttttcactgaatttgtcctctttggatttcactaaatttcttttttctgtgcattgattattagattgggtaattcttcactgttacttcttcaaaatattgcctctgtctcgcatttcctttcctcctttctgagactccaattacatctgtctgagatgtttgtatcttattttctttctttgtctctctctttctccctcctcctgcttctctctctccctctcctctttcatcttttctttctatttatgctgcagtctagacattgtgtactgctttatcttctatactactaatcagatcttctgctgtgaccaatctgttgttgaatatgccagtgagctattaattttagttattgcgattttcagtttgggaatttctgttcatgtatcctagtgaaactccttatcttgctctctattttcctggaaatattaattacagttattttaaagatttttcgttaacttcaatatctggattatctcttgatcttttccattgtctggtttttgtttccgttttgatgtctgataattttggctgaattctggacatgttggacagaaatttgtagaggctagagaagacaaagtgatcccccagtgaatccccaccacagcctctgataggcttctaggttaggcacagttgttaattcaaatcagcatttaactgactcagtgcagcgtctcagtccccatgagacctagttgatatcttatatctggagtacagtgcttcactagtcccaactgagatttgaaggcctttgccaaaacatttttttgaaaatctctgaattctgccatctgactcctaattgtgatgagtctacagagacccctgcttcgtgacccagcctcatagctgtcctgtcactttctgcttggccaccttgtctcttgcccattgctccttgggagttgaccagtgcttcaagggtaaaagcagaaagagtgttctgagcttgtcttctaagatctttacattcttgagtcctggcagtcatagtagatctttaaaactttcaagaagattatttaaactttacttggtacacattttctacttgtccttggtaggaagtgtagtcttctgaatgtttgcttgtcataactgaaaatataactaactgcatttcttttaatgccatgggaaatgtattgaagaaaacaaagtgtatataattttttcatataataatgtgtttataatacaatctacttaatattttggaaaattatttttctgtaaaacactgaagtgctaattaaatttcaataaatattttttaaaaataaataaagccggtcacagtggctcatgcctgtaatcccaggactttaggaggccaaggcaggcagattacttgattgcccagtctgggcaacacagcaaaactccatctctacaaaaaatacaaaaattatctggacatggtgatgtgtgcctgtagtcccagctactcagtaggctgaggtgtgagggtcgcttgatcccagtgaggtcaaggctgcagtgagccaagatcatgccactgtactccagcctgcgtggcagagtgagaccttgtctcaaaaaaaataaaaatttgtaataaaaaagtaaaataaatagaaactcaaaataagatgaaaaagtaaatccatgtccatcagaaataagtaagttgaagaattggaatgtgaacctactcacagaggattccagactctgtgcaatcaactatctttaccaggaaatgggagaaggagaaaagagagaggaaagaaaagaaatagagaggaaagatcatgcatgaaaattaaagatagagatcaaggcctttactgagaatgcagaaccaaggcctgttttccctaagttcctcttattatgcccagaaggaaagaaaatatgtgagtgaataaaggcaaatatttcctaggaaagctttgtgtattcatcgattgcaggattcaatattcttatcatcctccccgaattgatctacagaatcccaatacatctattctaacttattattatattaaaatgaatcgtcactagtctttagagaaataaaatcacaatgagaaaccactatacacctagcagaaaggctaaaattaaaaagggtggaaacaccaagtgtttggcaaagatatggaattctcatacattgctggtgggaaatgtgaaaatgatactatcactttggaaaacaatttggcattcttctaagctaaatatacacttaatatatagctcagcaattccactcccatgtatttacccagcagaaatgaatgcatatgtcaacataaagatgtatgtgtgaatgttcctagcagctttatttataagagtttaaacctggaaacagttcaaatgtctatcagcaggtaaatggataaacaagttgtcaaacagttgaataccccaagcaataagaaagaacagactgttgatatatgcaacagcatgtgtgtatctcaaaaatgttacacttagcaaggaactcagacacaaaagaacacatacacgatacaattttatgaaattttggaactgacaaaactaatctgtagttacggaatgtagatcattggtttcctgggtctgggtctgggtctcggtgacagtgttgggagtttgatgcaaatggcaattagtgagttgatatgaaattgcctacaccttgattctttggcaataacgtaggtatatatatttgttaaaactcattgaactataaccttaaatttattgaatataaattataactctatgaaaatgatattcatgtttccatattggcaattgtgggttttgttgttgtttttttgagagggagtctctctctgttgcccaggctggagtgcagtggagcaatcctggctcactgcaacctctgcctcctgggttcaagctattctcccacctcagcctcctgagtagctgagatcacaggcatgcaccactacacccagctgatttttttgtatttttagtagaaattttaccatgttgcccaggctggtcttgaactcctgacctcaaatgatccacctgcctttgcctcctaaagtgctaggattacagtgtgagccactgtgcctcaccccatattggaattaatattcaatttatttagagagtaaacctctgtaatttgcccattatccctgataaatcatcctgaagcctttgtgtcatcacagctacctagttagcttattaaatatgcaaacccctgggtctcaaccacagaaatcctgattcctggtctggttgaggctcacgttctaaagtctccaagtggtcactcctagtcaatctgagtgaaggtgattgatagaacactttaagaaaatttctgtggaatcgtgtttttttttttttcttttgtaagacatcagtgtttgcaccctatggaatcttgctgttttcaagcaatgttttcctctcaatgttgatgtttcccctgaaaaggcagtacaaggtaggatggggatgagacatgcctgtgcttagaatgacagtgagaagtagaaaagtagtaatgagaagccagatttaagagtacattctgggtgtgaaaaatgtgaaagtaggccaggcggggtggcttatgcctgtaatcccagcactttgtgaagctgaggtgggcagattgcttgagcccaggaattcaagaccagccttggcatcatagtgagacccccatctctagaaaaaaagtaaaaaattaaccaggcattgtagtgcatgcctataatcccagctacttgggaggctgaggctggaggatcacttgagcccaggagttcaaggctgcagtgagctatgaaggtaccactgcactacagcatgggcaacggagtgagtctctgtttctaataaaagtaaaatgtgaagataaaatatggcgtaaggaaataaaggaaatagcaactcaaaattacttatgtcttagcttttcagaagcgtcatactttgcaggagtctaaagaaggtagactccttccttatcctttcttagaagtcattctggaccagatgcctgtttacagaagcatcactgtgaatgtggcagaaacaatcatatttcaggattatatgtcctcttttccatactgtgggatccttaaaagtaattcattgtcttctgcatttttatctttcacctgcatatggaaggctttcagtgaatattagctgtatgaatgaggacataacacattttagcaaaattacttctgacacagttcttccttgtatgacaaagttctttatctgcaagaattcgtatttgggaactttgtgaacatatctgtccttagtttttccggtattctttgaggaagtgtgacaaaaacattataattgcaccaataatcttcaagtatcatttaaaaactctcgtggtcctctaacacaagaaaatgagatagatatattaatacttctgagtaagatttaggttaccagtgattgaagtgagtcagcccaggaacaagctggctggcagagaaggagctgtgtaagtgtggatgaatggttgtaaatctctttttcctggtggaaactgaagatttcctaggtccttcaaaaattaaatctgctatcattttaagctgtctactttcctatatatcccctatgtgctattttaaactcatttccacctctttttctgcccagtgccctgacaataataatgaagcagtcgttcactgaaggtaccccatgtgcccagcactgttgtaaaagtacaaatactaactcatttaaccctcacaacgatcttgtgagagaggagtgtatgtgttctcacttcacttatgagtagactgaggcagagagaggctatgtaacttttccaggatggagtcaggattcaagcccacacagtatatactctagtgtactagaaaatgtggctcctgatctaatggtgacagactaacgtgtcaggggtccacattgctaatactgatcgagattcagcaatcaaaactataatcttaattaataaagctaataattataaactaaattcatataaaattagaaaagcacttcctgctttaaaccacaagctaagttttctttattcattttggatagcaaggcttttattctgaaaactttgaggaacgttggattttatcgtaaacataataagtgacattaattttccagtatcccactacatttcctatttatataattgaatttcatacaaaggattttttccaacagatttctgagaaaagattatattaaatgtgttactggaattattttattttagtgtattattcaaatatatattgtaggggaatatttgcattgattatggctaggtagaactgtttttttcttgaaatggggtcttgctgtgttgcccaggctggggtgcagtgacacaagcactgctcactgcagcctccacctcccgagctcaagcgatcctcccacctcccccttccaagtagctgggaatataagcaagtgcgaccagtcttgccatgctgcccaggctggtctcgaactcttgggcccaagtgatctgcccgcgtcagcctcccaaagggctgggattacaagcatgagccactgcacctgaccagctgggagaacttttctttgctcttgcaagtgttttaaaatgctaaaagtatgacttttgtggacaagtgagaagagagtttaccttttagcattacttctaaagaccaagacttgaaattttgcttctccagtgggaggatcttattcaagagggactacatgggagttgtccctctccagtgctgatcttggtgggctcattactgttgacttattgaactcaatgctttccatcccaaacatcattttttgtttcatatttttatgtattgacttcataaatcatagaatgttttatgatttttagaaagtttggatttacaattcattaatctgcttttattttaaaatatgcataatgagctataagtatattcttaaatttctagatacaagcactagcgattacaataaagaaaaaatcaaggtattagctaaagaacaaaagagtttcaaggtcattgctttatgtctcttttacttgataagttttttactattctatttgcctgagggaaacattccaggaactgtacttcacatgccttagaagaccaatactgctgttggagagtaatagtaaacatagaatgagaaaaagaaatgtataggttgcaataatccagaaaaaaccttttcgggaagaaaactttgttagtcaactaaaaaaaaatagctcaaatattagcattttctttaagcaacaaataaagacatgattataagtataagggaagtgctaaaaatgtgaaagtctgtagtcaatctttttcaagtttcccttagttcatggccagggaataataatcttagatgtcttcatttacatttgacagagagttttgtttttatcatgaacacataataagttatgtaacaaggaataattgtttaatttacacatattttactcagaatgtgcttattcatcatgcacttgatacattaattccttgtaagtacattaacccaatgtgagaaaatcaaacttctaaattttaaaatgatacataaaatggagaacttttgaagtgcagtttactatatgtatttcagatactgtgaatgaaatggatagccatgcaaaaagtactagtaatatttttgtgaaattaaatataattaaacaatgccatcttattggcttgaatgacatcagctcatcagcttcaaatagtttcatatttcactaggttttcatgcatcttcatttattaaataaatatatttttcaaaggacaattgcttatttttctttttacttttaaaaagaagagattttctgggtaatattaatttcttcatgtgattttgacaaatattatcaaatattattttatattactgataaaatgaaacaacttgttttttgatgagctgaacatatgtgacatttatagtgaatttataagaccctgacagagtgctgagagagtgtggcagcattggagttctgacaagctacagcaggaagaaccaaaacagaggtgttaaggccatgctctctcaacaaagcatccaagaaaacaaaacctctgtgcctttgtcagtcagggctctccagagaaacagaaccaataggatgtctgtgtgcctgtgtgtgtgtgtgtgtgtgtatgtgtgtgtgtgtgtagagagagagagagagttttaaggaattggcttacctgattgtaaggactggcaagtcctaggtaagaggtgatattgcagctggagtccagaggttgtctggaggcaaaattccttctttcctagagaacttcagttttctttctttctcttacagccttcaactgattggatgaggcccacccacgttatagagtttaacctgctttactcaatgtttactgatttaatattggttacctctaaaaaatacctgcactgcaacatcaagactagtgtttgaccaaaagctgtttaccatggcctagccaagttgacacattgcagtgcccattagcagtaccattagctgagggttgagaaaaatattacatgtcagctcatttaaaatacatttattacatgtctaaagcagtaattaataagtatgatatgtgtttctgtatctttacagacaaaatctttagtaaagtaggtacatgtgtaagaattaagagaagccaaagctactgggaatgaacaaaggtatttaaattgagtgacactgatatttaatataagagtgaccttaaaataaataatttatgtagtgaaatatgacttctttcctgagtgtttttaatcaaacagaatgagaagaaatgggctgctctaaagataagagccattgggagtagattaataaaagcatttctagatgatgaagtttgagaaaatgttagaaaaatctaacagtgggtattacatatatcaactcctgatgccaccagaaaatatattattgtcagttgtttccttcagtgaatggcttagaaatacaatgtgtgtctatgtgtgtgtggtgtggcatatggatgcacacattttcaatgtgctactgtatggcatatttatatttagaattgctttttaatatcttctttcctagaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggtaaaaaaatacttgaactttataccagtagttaaaaaaaatctgtttacatttgttggtactcagtcttttcacagttagataaaatgaccatataattcatcatctaaaccagaacacctttaagaaataaaaaatacacaagtgatagttactctgggacagtaagtgcaaagtagaactgcaatgaacaaatgtaaatgaaagtttaagagcattactaccagatgcatgcaatacatatcctaagtatgatttctgtaaacagcatatattttgacaaactgtgcaagatcaccatatgtgtgtataatatatatgtaatatatgattatccatatcataaagacaatacatcattataaaattatgagataatgctgataatgaggttctaagaaagaaaatatttgcaatgtaaatccaaatgtcatgagtaatagaaaaaatactaagaaaaatttcaacaaagtgtagaattgaacttaaaaaaataaaaacagggtaaggttattgtgttcaagatagggagaaagtgagaaaacaactctgtaagatggaaagttggatgcaaactgtgatgctcaactaaaaaagggaagccgtgattttgaacagaaataactgtttttttccttctcctttaaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaacttggatcttaattttgaggttattatagatatatagtttaaattaaatataacctgaaaaataaggtagctgcatagagaaatgccattttatagtaattcataactaagttgactaatagtaataggtatgtctgtcccggtactatgaaactgtttatgccttctaataggtcagtttattataatagatcatcttttccaccttgaaaagaagtaaacagtcagtgttaggtttaggaaatccacaaatgcagaaataccaaggtagcaagcattgttattaaatgtactcatttgaatatatttcatttgaaatttcatctggtatattacacttgttgtttgactatgcagattcctgggggattttttttcttgtcttggtgcaatcctaaccaacatagcattatttaggatcactttgagaagttaacaagataaacaccaatagatttattaaataacaagaaagtcagatgctcacatataaataatatcctgatattttttaagtcattaatgctttttgcaacccattgcccatatgtatctaagctacactgttaaatagcatctattcttccagtccttcacaggacaccttaaagtgtatgaaggatcagaacaaaccagaaaaactgtgatatttactggcataagtggctttggcatataatattaaactgaagatcctagtcctatactggattattcagttttattactttaatttaaccatgtaatagcaaaagataatatctaatgcagaggttggcaaactgggcatcaggccaagtttggacattttttaattaaaaaaatacaaagcctgtttttgttcaaaagagaaggttttattggaacatattctctttctttatgtgttgtccgtggccacattggtacttcgtgtcagagttgagtgctgcaaaagagatcatatgacccacaaagggtaaatttaactacatggctgaaaatttcaacgtggcagaaaatgtgtgttgacttcttccttttaagtttgttcaaaactgtgtggtgccagaaataaaggtattaacagctgccattatgatagaacacttcatttggaataagcaagcatgcaaatataagataatgggaatggatttgtgacaattagtactagacctattaatttataaatgctttaaacacgtaccatcagaaaatcactaaacaatgttatttatgtcatttttctttctaagatcagctttgggggaattctgtcacccggaagatcacgggcattcacacgtaaaagctttcatgggtgtttagaaaatctttattataatggagtggatgttaccgaattagccaagaaacacaaaccacagatcctcatgatggtaaggaagcctaatgggaaggaaagaaaaaaggacattttattttttgcatttaaaaattattcatgtgaagtctccatttcatctaatattttaagaatcagttcttactttaacagctgcccatgtaatatagtaatttagttttatttatttatttatttttttgagacagagtctctctcttgtctcccaggttggagtgcagcggcgcaatctcagcttactgcagcttacgcctcccaggttcaagcaattctcctgcctcagcctcctgagtagctgggattacaggcgcccgccaccatgcccagctaatttttgtacttttagtagagacggggtttcgccatgttggccaggctagtctcgaattcctgacctcaggtgatctgcctgcctcggccttccaaagtgctgggattacaggtgtgagccaccgggcctggccaatttttttttttttttttttttgagacggagtctcactctgtcacccagactggagtgcagtgtcacgatcttggctcactgcaagctctgcctcctgggttcacgccattctcccgcctcagcctcccgagtacctgggactacaggtgcccaccagcatgcccggctttttgtatttttagtagagacggggtttcaccatgttagccaggatggtctcgatttcccaacctcgtgatctgcccaccttggcctcccaaagtgataggaccacaggcgcactttttttgtttttgtttttgtttttgttttgagatgcagtcttgctctgttgcccaggctggagtgcagcggtacagtcttggctcactgcaacctctgcctcctgggttcaagccattctcctgcctcagcctcctgagtagctgggactacaggtgtgtgccaccacacctggctaattttttttagtacagacagggttttgccacattggccaggctggtctcaaactcctgacctcagacgatacactcgcctcggcctcccaaaatgctgggattacaggcatgagccaccttacccagcctaatatagtaatttttattatgcataaaaagttataaagtaaatatgcctcatgggacatcattgtttcatttttatatgaaataaagtaactttctatttttacatggaaatcagaattcatatgtctcacgtgtttttggtgttgttatccacaggagaccaatcattttgcaatggcagtccctaatgatctattccctaatcaactggaaatacttccaaatcagttaataaacttctttcaatgtttaaagtttgaaatatctaagttgggttaaagggaaagctcatgtttagttgtcagtgtatctcagcagcacatcatgggaatatttatttgtattgttggaaacatgttttctttcctgttatgtgctggaggagttggctcatgggttgcaggaccaaaacctgaaaatatctctgactgtgtgtcaccagaccacacaatgaatacatcacttaggttagcatgagaaaaggggaaaaacagctgtgaagcccatgaactttccaagaaggtaaaggagaaaaaaaaaaaaaagttgggtttgaagtctaagttttactatgaacagcaccctgctgagatcataaaaatgaaaaataccatcaagatacatgaaaaaggaaacaccaaagggaagagtgataacaaggctccacagagcgcagtttcctttgacaagatgaaaaagaaatgaaaagaggaaggagataaatggaacagccctctacctaaagtttctgtccatggagaaactgacatttaagtgctgctcaacaggaaaaagaaaaaagacctggttattgaagttggctttgttggagatgcgttactcagatacagatacaaagatgggtttggccaatgggcatccgtgtcaagaagcctgacctaacacgttctgaatattaagctaccttttatctgccagtccttggtgttcagaagaatccctcctcctcaccctaacttctatggggctatttccaaagacactgtcattgaagtgaggaagagtgagttgggccttatgacacaaagagacaagactatttgaggacaatagacacaggttttcatatacattccatgttattctgaattactgatgggttcgctgatggaattattgagtatagccaataaggagaaccacagttaagctggtgtctctgggttctggatatcatcctcaagaaaactatttactaattacattgaatgaggttattaaaatgtgtaagtttcacacaaaaacaaaaagacaattcattccaaattgtgcatatggatatataatgttaattatgggaattccattttaagaattactacaattctatgtgttctgtataaaaacaggaaaatagttgttccaatatataaaaggaaaacatttaaaaatgtattttcttgggaaaatcagctgccagaattcattagtcaactaacaagcactcctctgtggcaagaagccctgcttctctgttgtagcaggcagctacccacctaaatgatgaggtcaagaaatatacagctgataaaaagataaaaaatatgtaatagtccagtgattacatgtgtactacggatcagcgccaattagttgtaagcttttggtatttagttcgttacagcaaatgttttcttttttaaattttcttctgcaaatgttttcttgtcatgaaaagtgttttccgtttagcagaattacaaaaatagtcaagaagaaatgttctgattgatgtatacagttagaatgtgtattaaagattattataaaatgataactgaattatatccatttctaaagtatgttgggacaaaattttttaaaaatgtgattctgttttgaaaattgttttaccactggatcagtgtggttcttaaacttggctttatcttggagtcaccagaggagattcaaaagatacctttacctggctccacctccagagatcgggattttaaatggtctgtatctggattttaagagcccttctggtgattcgactgtttagctaggtttgagagccactaccctagatgagctgtcctgctccagtaacattctttttctaaaatcttttatagtatattagaaataaatccatggaaattccaagtaaaatcagaattactgtggtttttctctggaactgaaattcctatgtgtgaataatgcccaagaattgcttattcctttcaccagccaaacaaagcaaaacaaacaaacaaacaaaaaccatttaaaaacctagtaagatgttgacttaccagatattaaagcatgctaaaagcttctatactagaatcagtatggtaatggataggaacagagaagtcagtagaacagtcaagatctcagaaagatcccagtttatgtgcaaagttgttagtaacaaggaatgtggctcaattcagtggaacagggatgaattatttctgaaattctgccggaacaaacaagtgtccataaggcagaaaataagcatgatcactatcttatacacactaagaatatgtaaattaaagaggatgagaaacaaacaacaatcttaaagaaaatctatgaggttgtatgtaggacctagggtagtatgaaactttcttaacaaagattggaaactcagaagctgtaaaatacaatatagacataattgactatataaaaacatcaatgttttcatgctaaaaatactatatgcaaacattgtatataactattagatctgaaaaccatttgaaaggctgtcaaatataactttccaacagctaaaaatatgaccaatacaaatatcaaataagcatgtgtcaaagatttagtcaattcgttaatgagggaaccagtaaaatagtaagctggttcaatagagattttgaggattgtgtagagaagaccaaatgttgctcaggagaaagactgagtatgaaaatgtcctgttatttgctgtatcctcagggctagcacagggcctggaaaatagctggcatagattaaactcctgttgaactaaaattatattgagactcctttactaatgctgagaagtagagaagtggagaatttctcacacacatacagaaagccacatggatatctgcccaattataataatacttatgttgaaagagaagataaatgtcatagatttcagctttagcaggcagactaatcctggattgataaaaagccttgtacgtcttcgtaaaatctggctttaattagatagaagcaccacctgtaaggctgctcaatgtgctcttttgttttatttatagggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcaacgtggttcagggagtttcgtcctctttcttaaggatggcaagctcaaactgagtctcttccaggcgggacagtcaccaaggaatgtcacagcaggtaagagttgtattcccataaacctgacatatccacacggaaatcatttggtaattagtgagtgagtgaggcagtgagatgctccatgcccccactagaggaacagattgctgcttccttttagactgttctgtgtggtacaccccgctgccactaaagtgttcttttgaccaaaatgactatatatgagaaatatgaaatgcatatttctgcagatgtaccttcccatatacaaggaatacccttgagctccatttcctgacaaacatataccagcctccatcccaaagaactagggtcaggacctcatggaacagacaatacctagaggcacattcctctcctgtcctccttctcctttcccttctccgccctgccgctcagggtctgtgcacaaatattctatacacagtagtcaattgataactatcactttacagggaaagatgcccggcaaataccaagagttcttattctttcgttgatggctgattcgttttctgggatagccgggcaccctggaagaatctcagctcctccacttactgcccttctgaaatgtaaatcacgaagcctcctaagcctcagctgttttcacttgtgaagtggtaaacctcagatctcctttgcagggagaacaataggaagtctgattttattagcacaatgtccaccccacacacaggccctcacatccccactccccatcagggcctgtttttgttgggcaaatgctaggttaggggctcaaatcccatgaagccagactgagttacaatagatgggaactaatctcacatgcagtcagatgtgggcaagtttgttaactacagagctgctggattttgatgattggatttgcagatgggaggagcactgggtcctaaattgacattgtgcctaaattggcatcggaactaaatgggggctttaaaaaaaaaaagcgtaatctgaaaaagaaaaaggcacagacgaagaggctgacttctgcttgagaccagggggatatcatactcaaaaaaagattccttttggctgtaagaggcacatgtgactatactgctattaaatgttgtggtacgaaagcacgatttcaagacccgtgaagaaattcggagggcggggccttatctcagtacttctggaacaatcaggcaagtcctgggtgttagaatctgtgtccacctcacacaggtgtttcaggggagataaaacagatattcagaggagacgtatattttttatcttttagaaatgcaaacctagtttccatttcctcacgaataagattttttccaagaaaggttaaaatcgtgacccacacacagatacagaatgaacacatgtcagagattttctttaactcattgatgagagaaccagtgttagggaaataagtacagataaaattgcctaccaacatagtgaatcagtttcacaaggtagaaatgaaatagtcttattatggaataagtattaagccagactgtgatgtacatttcaggcaattgctaatgtgattgcaaagataaagaaatttcatccatttatatagccaggcagatacaacccattacatacatgttctaaagataaaggacaacttgtcctcaagtaagaggacttgacagcgccttttgctacacagcccatcttacattcacctggtgattggggaggcacactcctttatgcaaaggaaaactaaactccatgtctctttgacaagtgggtagttgcaacttggagccaggcacctacgttaaactcccacggagacaaggagataggagcactgcctttcttggtgtttacatttcaaagaaatgtctccaaggtcctcaagaaaaacactcctggaaacaagaaagaggctaaataagattttgtttgtttgtttgtttgtttgaagattttaaagatgtacaattacaagttttctgaaagaaatgctctaaggaaaaaaagtgaatgaaagtgtgtatcccttttagcactaagaaagcttttgtttgttttggtttgtgtttacccttacaccagtaaggcctgtttaaagaagtaccacacatttatagtcagaaaagagatgccgactagctaaacttttcaatatccaaagggaaaggcaaatcccttctctgtacacactttgcatctctatggacaagcattatttgcattattatcaatgttctgcaagttaacttctgtcactacacagctgtaaagtaactagtccaagatgatggtttacaatcccgtaatatcagctgatctttccattgaaaagatacccagtaatctcctttgcccatttcaaagactgccctcaatttttttcctacagtagttggttcagttttactgctgatgagttgcatatattctggattcaatgaagtgctgaacaagcacttcatccagttctgggttgcacaataactagaattaaatataattaaagttcttaaatctcatcaggattttgctttagctcatggctttgtgagtatgatattttgcctctgcagttaaaatgttgtagttgttaacaagagatcatcttcatatcaaatgtgtttaaaataacatctatgttgtgggcaattaatttagtaacttctcattgaaatatttacagattctactgtatctgattttcttgtgcataaactatggccaaaggccaaatacaacctaatagaaaacaaaaagaaaacaaatgtggatgatagacatgaaaacagttatacaaagatctgcttttatttgtcaaaagatattcttaaagagggcactttttgcagttataaaaagaacatgtcaaagattttgtttaactcattagtttatgagggaatcagtaagatgttactgctgcaatgattttgtgtataatgtaaaactggcttattccatgggatggggtagaggaaccaggaagaagttcagttgtatttctgccagacaaaattcatttgcatgtctatggacaataatcatttgcctgctttcaattttctacaattcacagggtggtaaagaattcaaagaaggggccaggtgtggtggctcacgcctgtaatcccagcaatttgggaggccaaggcatacagatcacgaggtcaggagattgagaccatcctggctaacaacggtgaaaccccatctctactaaaaatacaaaaaaattagccaggcgtggtggcgggtgcctgtagtcctagctactcaggaggctgaggcaggagaatggcttgaacccagaaggcggagcttgcagtgaaccgagatggcaccactgcactccagcctgggtgacagagcgagactccatctcaaaaaaaaaaaaaaaaaaaaaaaaaaaattcaaagaaggtaaaaggcacagaaacctgcagaatcatataatcctccagattgtgtttagacaatgcctagttttacattgaagacatccagaatcttggttgattttaaagaataatttatttccttacactttattactacttctgtttctgtttcatacatcactgaaggttaaaagggaaagctaaaatattaatgttaatgtttaatttttaagaagtactacatttgaaatgctaataatatactaacttcacataaatgcatgttaggaagaaaaataaatgaagcatagagtcattttaataatttacaggtttcccaagactatcaagtaaaatgttaactttataggaaaatttctgttagtctaaagtttattataatatatgtaacttctgaaatagtttcaatcttggcctaattttaaacttcagtgcaaagttaatttaataggcctcatgaagctaatcttatttttagcccatttattggcatgtatctttgacatattatcaggtaaaagaaagcacggaatacctctagtgattttaaataccttaacatttaaatttaccatcaaagacaattcattatgttaccaaattatttgacaagattaatttcataattactactaagaatcataatgtggatgtgagtgtaaatatataaaaatattgtacatatataaagtacaactccagttctttcctaagcattttttatcaaatattaaataatcgcttttattttattttattttatctttttgagacagcgtctcactctgtcacccagactggagtacagtggtgtgatctcagcatactgcaacctccacctcccaggttcaagtgattcttgtgcctcagcctccgaagtgactgggactataggctagtgccaccatgcccagctaattttttgttttttagtagaaatgtggtttcaccatgttagccaggctggtctcgaactcccaacctcaggtgatctgcccgcctcagcctcccaaactgctgggattacaggcatgagccaccatgcccagcgaataataacttttaaaagacagtataattatatctataataataatttaattcagaaacacacgaatatatgttaaagattttaactaatcaatgaagaaaccagtaagatgttacaatcagttcagaggataattcaaagtactacacatacaggcagataagaaatgccaaaatgaattacagacagatatgaaatggttcagtaagcaactgcacctcgctaggcacaagtcatttgtatttctatgggtacaagtcattttgcattactatcagttttctacagtttacagggctgtaaaatagctcagacagtgaaagcagggtttaccttaattaatgggtgcagtaagccagacatccagtgatcttccatttcaaatcctgtcacaccccataagtatgtgcaattttgtgtcaactttttctaaaaaaaccttttcacaatcattcttgacatattttttatcaactcactttcttgattcttgtaaaatgtttttgttagattcagtaaagcaagtaagttttgcatttgaagattaaaccaaactgtgttgtttttatcccattgtaaaggcttctactgtatatatttgataattaaattctagttactttaagcaaattaccagaatttgttacagtgattcttcagaaagagtaatatttttattcatgtgttattttcataataaatgaaatttttaaattaaagataggtggttaatgtttttttcagtgatacatgaacatgtaaataccactcttctctgacttattcagtgatctgaatcaaattgttttcaagtgtttacagagctcataatttagagttgtctctgactgattgtatttcctccaggtgctggattaaacgatgggcagtggcactctgtatccttctctgccaagtggagccatatgaatgtggtggtggatgatgacacagctgttcagcccctggtggctgtgctcattgattcaggtgacacctattattttggaggtaagagaaggcaactgaatgacactggcagtggaaccactttttatctttattgctttgcattttgagtctctagtcaaatttaaaccaagttgatactaagaaataatttatctctagccatgaaattaataccttttgagtttgtaaaaaacatgaaacatttaatcaatttttcttcccaatacaaaaataagtatctgcagaaagtttacttgctgtttaaataacttcatattttcatttaacattaaaagaaaaatatatttgagctacatgtagtaaataagtggaaactttcaaacaatatcatagtcatatctctacaacagataaatccatttatacttctaacagttagctcataaaaacaaaacaaatcgtactgtctgaagtcattggcttacataaaatattacttatatatttaagtccacatctaaatctatactattgaatcattattagtacacagctcagtttatagatagatggataaatattttttacatggagaaggcataataggaaatatcatactgattatgaagtactttcaaaacattgacaatgtaaacaaatattaattaataggagacaagcatattaaatgaatccagtataattggtgttacactggtgcaaagtattgaatgtttgcttccccaccccagattcatatgttgaaatcctgaccccaaagtcatggtgtcaggaggctttggagggtaattaagtcaggagggtggagccctaatgaatggaattagtgcccttataaaagaggcccaagagaactcccttgcctttcctgccatgtgaagttataaggcgaagactgtggtctgtgaagcagacactgcatctgctttgcctcaaactcagacttagactttccagcatccagactgagagaaataactgtttgttgtataagccactctgttcatggggttctgttaatagcagcccaaactgactatgagaactcatacagctaaagaaatggaaacaagtggatcttttgattataaaggaagtttggatttttttaaattaaaagaaccactaggaataacagcaaaaccctgctatgtattctagaatgctcctgtgaatccaaagattatgcttttatatctggaaaccacagttaagagaaacaatcatgtgagaaaacttatcacatgggggcatggatgcctgtacattacagcattctgttatcatcccatatcaccacatatatgataagaaaactcactctcaagtaagaaagttttcaactaggtacgaaattccatgctggacacagatacagagagccacttgcactgtacctaaacactgaagtgttactgaggtaacttaattacttgtaattcttactggaaaggtaaatatattcagcctttcttagtaataaaaattatatgtaaacagaaatatagatctagtaatagaagacttgttatatacatgcagtcctatacattgcattttacctcatcagtatttgtggtatttcgcaaagaatatatacttttccaaatatacagccacagacattcaaagacttcactgagctgtcctctggcacacaggtgtatttaaattgttaaagaaaattaaaatggcctgaggtatctctgaccagacaaagccttgtaagtggccttaactttgcttgatttaccaatataagcaaaacttaacttgagctatttcttgtaaatggctttaaaaataaaaaaagtcaaacttaaggctaaccaatcagaagccaattaacttatataactagagactttccagcaggatcaaccaaataaggcaattgtataactacaaccagtgaaaaatttgctactatatttaccttacagaagctgtccctttttgttcccttgaaagggtccctgaaccagttcccatttgaagctgcttcaacagtgattcatgaatcactgttagctcaaataaacttttgtgcctccatttaccttttattaatggatacatttatatctgtagttggatgcttttttcctctaagcagacacaaagtaaacctgaagagcttaagatttttatttatttatttatttttattttttgaggcggagtctcgctgtgtcccccaggctggagtgcagtggcgcgatctcggctcactgcaagctctgcaccgccaggttcacgccattctcctgcctcagcctcctgagtagctgggactacaggcacccaccatcacatctggctaattttttgtatttttggtagagacggggttttcaccatgttagccaggatggtctcgatctcctgaccttgtgattcgaccgcctcggcctcccaaagttctgggattacaggcgtgagccactgtgccaggccaagatttttaaaattagttaatgccttggtgtatcttgagtggatgataacataggagtcctcagaaaaatgcagccatgcccgccagccttttcagaagagcgaagttggcttaaggaatcatcatcggtccaagattgttagtgatctgagaaatttcatgtgctgaggatgatgccaaattaagggtttccaagtatgagtaccaggatacctcctatacctgctctcagccatatgtggtatcgacaattgcctctaacaaaatttttccaaaccaagtagaagaaaacagtaaacggaacagagattttttttttattaggatgggactgaaatctgtccctccttcaggatgagggctgtaatctgtgtgacagaaacagatgacagagtttgatccacactactttgttttcagaattgctagcccagattgaataggtccagaaagaaactaatgaaataagcaatagaaaatctctaacattatagtctttgacaatgtatattcatatataattcccatttcctacagaaaatacgtgatgcttctcttttttttttaaacttattttaggttcagaggtatacatgtgcaggtttgttatataggtaaattgcatgtaatgggggcttggggtacagattattccatcacccaggtaatgagcatagtacctagtaggtagtttttcgatcttcaccctcctcccaccctccaccctcaagtaggctgtggtgtctattgttcccttctttgtgtccatgggtactcaatactaagctcccactcataagtcagaatacatggtatttggttttctgttcctgtgttagttcactttggataatggcctccagctccatccatgttgctacaaaggacattatctcattttttttatggctacatagtattccatggtatatatgtacattttctttacgctaccgttgatgggtatttaggttgattctatgtcattgctattgtgaatgaacatgcacgtctgtgtgtctttatggtagaaagattattattcctttgggtgtgtactcaatggggttgctgggtcgagtggcagctctgctttaagttctttgagaaatcacgaaactgcttgctgcaatggctgaactaatgtataattcccccagcagtgtataagcactcccttttctccacagctttaccagcacctgttatttttcgccttttaaataatagcaattctgactggtgtgagatggtatctcattgtggttttgatatgcatttatctcatgactagtgatgctgaggagtttttcttatgcttgttggccacatgtatgtcttcttttgaaaagtgtctgttcacgtcctttgcccgttttttaatggggtaggtttttttttctttcttgttaagttccttatagattccagacattagacctttgtcagatgcataatttgtgaatattttcttccagtaggttgtctgtttactctgtggatagtttcttttgctgtgcagaaaccctttagtttaattaggtcccatttgtcaacttttgtttttgttgcaattgctttcggtgtctttgtcatgaaatttttgccatgtcctgtgtccaaaatggcatttcctatatttcctaggttatcttccaggatttttgtagttataggctttacttttttttttttttttttttgagactttagagtcagtctcacctgttgcccaggctggagtgcaatgacacgatacagcctcaacctcccaggcttaagaggttcccccgcctcagcctcctgattagcctggactacaggcacgtgccaccacattcagctaatttattattattattattattattattgtttgtagagacgaggtctcgttatttgcccaggcttgtctcaaactccgaggttcaagctatcctcccacctcaccctcccaaagtgttgggattataggcgtgagccactgcacctgacaggttttacattttattctttaatccatcttgagttgatttttgtatatggtgtaaggaaggggtctaggaactgcttatggttagccagttatcccagcaccatttattgaatagggagtcctttccctactgcatgtttttgtcgactttgttgaagatcaaatggttgtaagtgtgtggcattatttctgggcgctctattctgttccattggtctgtgtatctgtttttgtaccagtactatgctattttggttactatagccttgtagtagaggttgaagttggctaacgaaatgcctccagatttgttctttttgccttggattcccttggctattcaggctcttttttggttctatattaattttaaaatagtttttactggttctttgaagaatgccattggtgatttgataggaatagcattgaatctataaattgctttgggcagtatggcccaatatggttaaaaaccatatttattattcctatccatgattatggaatgtttttccatttgtatgtcatctgtgatttctttgagcagtgttttgtaattcttcttgtagagatcattcatctccctggttagctgtatttctaggtagtttattctttttgtggtcattgcgaataggattgcattcttgatttggctctcagcttgcatgttgttggtatataggaatgctactaatttttgtacattaattttgtatcctgaaactttgctgagattatcagatcgagaagcttttgggcagagacgatggggttttgtaggtacagaatcatatcatctgcaaacagagacagtttgacctctttttctcctgtttagatgccttttgtttctctctcttgcctgattgctctggcgaggacatccagtactatgttgggtaggaataatgagagacggtatccctgtcttgtcccagttttcaaggggaatgcttcacatcttttgcccattcagtatgatgctggctgtgggtttgtcataggtggctcttactatgttgaagtatgttcctccaatgcctcatttgttgagggtttttaacatgaagggatgttgagaaaatacctgatgcttctctagagacaaatatatgaaagcaaacaacatttcatgaaggaatgaggaatattttgtggcagcaagaatgagaatgactctccaagatgccctggaaactgaatatgttacatcacataagggattttgcagatgtaattaaggttgcagaccttaggagatgatcgtgattcatgcagtgggctccatgtaatcacatgagcacttaagagatttaactctggttggaggcagaagagacacagaagagaggtgtgggtgaggggaagccagagaaactagaagcaggagaatgtctctctgcaccattgctggtttagaaaataaactgggcactatgaagagcaacgcaggcagcctgacattgctgagaggccccaactaccagccagtgatgaattgggacctcactcctacaactacaagaagttgaattctgctctaacctgtatgtgcttggacacacattctgccctagggccttcataaggagcccaagagcaccttgattttgtccttgtaagactataagcagagtcatcagtccagccctcccacacttctaaagtgagagataataaagagaatgttttagtaatttgttacagtgatgattaaaagctgatacacattccaacctccatcagatccatttacagacattcccattcagttctaaacccttggacaatggccaaaaaaaaaaaaaaaaaaaaaaaaaggtttcctcaaacacaccctgagaatatactgaaaaagattacatatatatatatatatcttaggtggtggcccacgcctgtaatcccagcaatctgggaggctgaggccggcggatcacctgagatcaggagttgaagacgagcctggttaaaatggtgaaaccctgtatctacaaaaatacacacacaaaaaaaatttagccgggcatgatggcaggtgcctgtaatcccagctacttgggaggctgaggcaggataatcacttgaaaaaaaaaatatatatatatataaaatattttttaaatatatatatgaccaaagagaatagtttcaacagaaagtcaaaatagccaacacagtttctgtgttttgttttgtttggattgtgtatggccttcgagtgaagtaacatacatgataatgaaccatatagggacacagtgacagaaatgggaaggctgatccatgatcatatatgcatacatagatacactatggattccaaagtcccctttgacctgaaagtgtgagaagagcccataacccatttgaaacagatacgcagcaaccacaacccaaattgtatatgcataagtaaagttgtccttatttcagagatgatattatggattgaattgttttccctcaaattcatatgaactccagaatgtgaccttgtttggagataagatctttgcagaggtaatcaagttaaaatgaggtcattaaggtgagctccaatccaatatgaccagtgtccttatgaaaaatggaaatggaggtgcagagacacacagagagggaagacgctgggacaacatgcaggaacaacgcctcaggaagacagaggcctagactgttacacctgcaaggccagggctgtttactgggttcctccctgaccccacatcccacctggggatgaacccgacccagaccttaccacccactgctgctacactgccataaatccctttttcaaaaaaattaaaatatttatttgacaaataaaaattctatatatttaaggtatactatgtgacgatttgatataggtatacactgtgttctgattaccacagtcaagttgattaacacatccatcacatcacacatagttaccatgttgatggcagaggggagtgaagtcattgaaaatctgctctcttaccaaattccaggtaaataacacagtatcattatgtatcaccatgctggatcatcatgctggatcccttttgtttcatggggttgtatcaccatgaaacagtatcaccatgctggatcccttttgtttcatggggttgttgaaaaaagactacaaattaaggactgaaatgcatgtcttccagataggcctaaataaaagatcacactcaggaaccgattttaaatagaccaccctttatgaagcttcccttcatcattgtgcccaacggaattgtaacagtgtgaaatgagtgccactaccttttccactgctttatgtgctggttttattgcaccatacaggtatccctagagcctcggctcctctggagcatcttattgatttcccactgccgcatgaagaaaggccatgctttgcccaaagtgactaatagttttactcagtcggttatttcaacttatttttattgcccagtaatgatgcagtgaaacattttaccaagtcagggagcacatcagcctttcctagacaataataaacagaatatttgccagctcagtcaatgattgagtacagccaagagacactgcagcctaagagagggcagtcagagtggggaggtcacagaagggtgcaataaatcttctgcccagggatgtttactcagaaagtccttggtcattagaaatgtcatttaactctgtaaataataagatacatttgctaatcaatgcttgaggtgcttcttgagagtattagtatagttttgcattttactgttttttttttccagaatccttttaaaattatgttggagacagcacaatatgaaagtaaaattcggccaggcacagtggctcacgcctgtaatcccagcactttgggaggcctaggcaggtggatcacaaggtcaggagatcgagaccatcctggctaacacggtgaaaccccgtctctactaaaaatacaaaaaaaaaaaaaaaaaattagctgggcatggtggtgggcgcctgtagtcccagcttcccaggaggctgaggcaggagaatggcatgaacctgggaggcagagcttatacagtgagctgagactgcgccactgcactccagcctgggtgacagagtgagacgccgtctcaaaaaaaaaaaaaaaggtaaaattcatccctaaaattggctgtcagcatggaaattataaaactcattttctaaactctaacagtccttcagagcaaactttccaagagcaactgtgaaaacagacaatgtcaatctgcaaagtttctgattgttttctttcctcatattccgaggtgtgcatatgtgcctcaaattgtattaaaacatttgctatagatgacacattttataacaaaaaacaaataagccaatatatccaagacctatcatttcaaaggtaaaatatttaggaagcactaaaagggataagaatgaaagtactattcatttttttaagtgatactaaataaagttgattacagaaaatgatttgtcaaagtataaatatagtatcacctttagggtttaaattctacaggtgagattattcaagagcccatttccataaatatatacatgctaatgtgagaaatgcttttgagttatttttatgcatatcataattttattcatttttactgtgaaatagatcatatatgtacagttaaaaatattgctaatttttcaaaagaatgtatatattgttacatgaatataccacattttatcagttctactgtcccattttgctattgttaggcaattttcatttttgcttttagatttgctttataaaatttaggggggtggtgtttcgttgttttgccttttttttagacagggagtcactctgttgcccaggctggagtgcaatggagcaatcacagctcactgcagcctctgcctctccaagctcaagcacttcttccacctcagcctctggagtagctgggactgcaggcctgcaccaccacacccagctaatttttgttgttgttgtttttcttcgtattttgtagagacagagttttgccacgttgttcaggttggtctgcggtgatccatccacctcagcctcccaaagtgccaggattacaggcatgagccaccatgcccagcctaaaatttagtttttaaaatattcttaacatacctagtttttccagtgaattttgcattccttgtgtgtgcttttgtaactttatttacccatctgtatagtaaacttcgggaaacaccagctctaaccaccatgtttaacagcataagctggttgttaaattttactgatgtatataaacccaaaatagatcatttcttcacatagaaacagcctttggttccgctagtattcattactcattttagtaatttaaagaccacatgacccaaattcttcttgaatgctgtgcagtgcactgaaagagactaataagcccttttctgttttctaagcaaatttacttcttgggatatttctgttcatacggtttcctatgacacatagcatcactaagagtcaaataagtgaaactgaaaacattaaaattaatcctgtaatccagttttaataatgagttcatttcattatgtttctttttcctttccatttgttttatactggcctggagaaaacaggcttgatggataaaatccacagtattttcttcctaactagcttatatatttagaatggcctgaatatgtacagctgcagacactaacttcattcctacagtataatatctaccaatgattgaaactagtcagctgcacgttttatttatttattaaaaaggatttggatttttatacaatatttaaaaaccacaaaatgaaaagggatcaatcaacgtatatcttggaggtccttccaagagtctcagtatctaacagccatggaggctgtgacctttttccttcttttctcagcctgcttgtcatttaagggtcaccagagatgactcatgctctagttcttaaaatcaaacttgttccaccaaatccaagatgctgaatttgtacaaatgtaaaaacatcctcttgccacctgtccaccaaaataccttctattcaagtgaacaacagctttaattgctgactcaactctcaaattctaaaaaggtctgtgcttcatcatcagggacaccaagaatttcacatatcacacattttctaactttgccatatttttcatggcaaaattgggaaataccatggactttatccatcaagcctgttttctctgagccaatataaattgacaatggaaaagaaaaagaaacataacagaatgaactcattatgaaaactagattaactatactcttttcagtttcacttattttatccttaatgatgctatgtctcataggaaaccatatcaactgaaaaatatgtcatcacacattcttctctggtttcaacttccaagtcttcttccacctccccttcaccaaccatgttccttagtaggaccaccttagtaggactcaagtatttcagtcagtggatttgtacctgacctttcaatgcatctttctctgcggcgtcgcccacgatgatcttgccgcctgatttgctagtcttccccaccggaaaggcgtctcgaagcccctgcaggtgctccccgaggccccagccttcccggaagccgcgcttctgcatgatgttgtgcaccaccgttcccaccacgttagtgaggaaggagctgctaggacggtttggagatctcagtctgtcctgttcctccttcactgggggaggaatggctgctttggaagaccgtgactgaggtcttgaatcctcttcataaggaaaatctcggggtgactcttggtctttctctaccagagaagtgggaggggcaatggcagctccaccctactacttttcctcctctctccctcctaatcttccccttcatcagaatctggatttggtcgccttgatcagaactcccctaatttcttgcctgtcttcaggcctcttttccctttcttctatttcctttcatatttctagctcctgctgtgtctgtcgttcctctctttggcacttcactactttctcataatcataagggaacataggatcatattcgtcagctaagggaatcagaacgtcccctgcaaaaacccactgggagcaggatccttcagcccacctgctgcatgccgtggtgtgtccccaatttgcaggtcatctgaggagccgcctggccttaggtcaatgactggcaagagctgcactgtttctaactttggctctttccctgagtgagagctgccttcctcacctgaagctgagactgcagaagtttgacgttttggaaccagccttctgcttttgagtcactggtctccactctcaggccatcgtatgggggcatctttttttttttttcaatttaatgttgccctgctgactctacccatgggtagccaggttaatatgaaaaaatgaagaagaagaaaaacccaccaatttcctgatgccagataaatggaaaatgttatttgcaccaaagaaaccttgagagacttggaacaaatcactggtggatgtgggtttctggatctcactagatttattttaatagaaagtttaggccagacgcggtggctctcacctgtaatcccagcactttgagaggctgaggtgggtggatcatctgaggttagtaattcaagaccagcctggccaacatggtgcaaccttgtctctactaaaaatacaaagattagctgggcatggtggcgggagcctgtagtcccagctactgggtaggctgaggcaggagaattccttgaacctggaaggcaaaggttgcagtgaaccgagatggtgccactgcactccagcctggcaacagagcgagactctgtcaagaaagagagagagagagaaagaaagagaaagtctaatttgcagatgcagacctatcttctatactgtcatttgtccattcttttttttctggtctgtgatttcatctttttgaagtgtttttcaagcagcactctgtacggttgcaggttgtgcatatagcctgcagttttttgcattcatgcctgaaatagagattgactgaaggtcaaattcttttaaacttacctttatggaatctttctgctattcaatgccatgcctccttccatgatattgagaatacaaaattgactgttgtgtcgccagtcctcacatccttcttgtaggaatctgctagaccaagaacttgtggcaacactgcattgaagtctgtcactgcaataacacacagtgacaattttcttgccaacctcatatgcttacacaagtgaaaataaccgggctaaaattttcatgggtcttaatatctttatttgtttgatttcatatccatgcagtactttatgattagaatttgtcctgaaagtttcataactttttgcgggacacctggatttattttagtttttttttttctaacagagttatcgaattcattttcttttaagaataacctggctgggcgctgtggcttatgcctgtaatcccagcattttgggaggctgaggcaggtggatcacgaggtcaggagatcaaaaccatcctggctaatatggtgaaaccccgtctctactgaaaaaaaatacaaaaaaaaaaaattagcagggcatggtggtgcgtgtctgtagtcccagccactcgggaggctgaggcaggagaatgctgtgaacctgggtggtggagcttgcagtgagcagagatcacaccactgcactgcagcctgggtgacagcatgagactcaggtctcaaaaaaaaaaaaaaaaaagataacctaagttatgtgtcaggaaacaccacatggtgaaagaaagattagcagaactgttgatattcctataattcattactggaaaatatttattgaattaataatcctcttaattcttaatgtgtttatttcttaatgattagtgagatgcagtagaattatacaaagttcactctctatcccattcttcagaaggttctgctgtaccatttaaacttttatttcttttgtaaatataaaaatataaaagattttagtcttcaaacttttaaacaaatatggtgttaaatgttaaacttccaagtgtctgtgaggttatgtatagtttcgataagctaaaaagaagccttaatatgagggaggcttttactttagggatctaaagcagaaagtattaaagttaaagagataaagcttcagttattaaaatggaaatctaaacacaacatttaatttttatggaacttttagggaggaaataagagtacaggcattgagaggtgcttcatttattccagtaagaggaatcttcattgactattttttgaaattgtgctagtgattaacaatataaggtcaaagagaggtcaatgaaaaacacataagtacaaattctatacttcatttttttcattttaatgaacactgtaaagaaaactcaatcctctagtgataaatattgatgtatatttactataatctttggagaaaagggtatttgcatggactgaaagtgtcatgccaaatattaggtttaatacctaatatttgaatgattgggaaaagaaaataagaaattatatctcacaagtttgaaagagacaatacttacagaatcaatataagcaggcttcttttttaaaataaggcaaaggataaaatttttaaaagctatataatttcataatatacaattaaattaattactaattcaatttctcttgtcattggcattacaccattatgaaatgaggttcctctttcatatttgtatgttaaaattaagtattcatttagatcagaggtaggcaaatcacggtccatggcatattatataagcccaaatgaataattgctttgtatttttatttttatttttattttatttgagatgaagtctcgctctgttgcccaggctggagtgcagtggcaccatctcggctcactgcaagctccgcctgctgggttcacgccattctcctgcctcagcttcccgagtaactgggactacaggcacccgccaccacgcccagctaatttttttttgtatttttagtagagacggggtttcaccgaattagccaggatggtctcgatctcctgacctcatgatccgcccgccttggcctcccaaagtgctgggtttacaggcgtgagccaccgcgcccagccctgctttgtatttttaaagggttataacaagaaggacatgcaacagagaccaggtgtgacccacaaaaccaaaagtgtttactatctgcgttttacagaaaacctttgcagactcctgacgtagacaaatgccttatgattttattctgaattaatatgactctttctacaaacagttgtctttaaataataagattttacaattattgtgttttctttaactagagtgtgtactttcatccttttccttacttttcaaacttagagttccattattaggttatatattgtaactcaagagggtgggagtaagttcaagacactactttcctatatgcttggactggtgtggagtaatactgcttacgtcaaagtcaggcactcaccactgcttcttataagtactcttcttgtttcacaaaacaagcccacatagtaaagggaagtgatgtcataagcattgccatttgtaatttaggtgaaattagctgacgattgtagtgaaatttttaatatttaacttctaatattggaaataatcaaatgtctattttatctctttctattcatagaacattctggactgcaaatttttatccttatgtaccctaacagtgtgttatgtcctgttactttttgtgttgttgttaacattagaatttaatctttagttatatatttgactaaagtacctaataccaaagaaagtgttactagaaaagcaaatctaggtatttccacccagtcagtataaaaaaatacgtttttaaatactcccaaatatacatacatcgcaacgcacaaaaacagctatagggtagatatttaacatattttagataaatggtagtatacaattatattttcaggtagcatttttcacacttcacagcatatcctaaataaaatttgggctatgatttcatttattttaatttaacctccactttaatttttttcacttatactacataatgctaaaatgcatgcttatttcttagatgagatttcacaaaagaagccaaacctcttttcacttggttgggaaataattcctgttataggaattttagatctgaattttcccccgcaatttcttattctgaattccaggtattatcttaaatttgatcagttctaaccttgccccttctcacctctctaatgaatggtgaagctcatcgcatcataccgatgtccataaacaagcgggagcagcagtcttcatatagtaaatactgtggaatagttttgtcatagttgttgcttttgtcctatttttgtcttcatattcaggctgcctgggcaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtaagggccatcctaggtcactttagcttgcctgttttcaaagttgaagaaagcaaatgtagagagctggaaaaaggcattccgttctctttttcgttgttgttatctttcgagagggaatgaaatagtcataattactatgaggattagaaaacttcatcttggccgggcgtggtggctcacacctgtaatgcggctgaggctggcggatcacgagatcaggagatcaacttcatcctggctaacatggtgaaaccccgtctctactaaaaatacagaaaaaaaaaaattagccaggcgtggtggcaggcgcctgtagtcccagctactggggaggctgaggcaggagaatggcatgaacccgggaggtggagcttgcagtgagcagagatcgcgccactgcactccagcctgggcgacagagcgagactcggtctcaaaacaaaaacaaaaactgcatctctaatggaataaatagcattttttaaatgatagtattttattagaagatatacaccttatgaattttaccttaatatgatcccgagttgctcagctaatagttataaagctcgcttttgcaaccacacacccatcagttggatgatatttttccaggcagaggaatttgccaggttactattcatcagccacccaaccccacatgttctgcagagaaaataaaaagtaatttctgctagaaaagtttgaatcataaagacggatgaagatgtgtgcagaaggacatactcaatgaaatatggaggttagacaagaaaaacatttaattcaaataagtattacaaccacagttatgctagttgtgccataattttacaaagattttggctgagaagaatcatagggtcacacctggaaaaataatatttctacatacaatttgccccagtacatttggtatttactttcagtgaataaataaatgctacagatttaaaaattgaaaagtgataatctggcccagcgtggtggctcacgcctgtaatcccagcactttgggaggccaaggcgggcggatcacgaggtcaggagatcgagaccatcctggctaacatggtgaaaccccgtctctactaaaaatgcaaaaaattagccaggcatggtggcgggcgcctgtagttccagctactcggcaggctgaggcaggagaatggcgtgaacccgggaggcggagcttgcagtgaatgagatagtgccactgcactccagactgggcaacagagccagactcttctcaaaaaaaaaaaaaaagttatatctgcatctggtagaactttcaaaacctgccttcttcatggagtaaattcagttagtcaattctgttttaaacattaactgtaaaattatcttctctggctaaacaggttttaatttataactcacagttagtgacatactaaaaaaacgcaattactactaaatgaaaagttcattcatatggactttatttattcagcatggaataatttccccctgtgaacattctgttgatttgtaggaaaaatgaattaattcaaagatgaggagtatatgaagtgtaagaatttgtcaagtacctctcattcttgaccttgagatttgaattcttggcacacagctgggactgcatttacatctcaacaccagctccagaaccacactctgtagtcgtgggaagggtagttgggaaggtttctggccatttgctcacttaatataatcccaagttgctcagctaactagccagggagctcatctctctctgagttaaggggtaatgtcccatgggcccacactgtgagtgacaacagctgtcagctcaactgtgatgcaagtgtgattttcttcacttgtatgacattattttgataccttgttaattactcacaaaatatgatccatttgcagtgtttctgttatgagatatatattgtgaggctgcctcttttcagagatgatccattttgcctgctttgtgcatgtagctcccaaagtacaaaactattgtttttactgttataggctgttttgttttaaccttaaagtcccaagagttacattggtgcctaacttggtctctaagatcccacattttaaaaaggcctccaaattgtaccccaaagttacttgtaaacatgctcaactaagcatgaatgtgtgagccacacttaaacttcagccatgatgtgtacaataatcattgcagataaggattttaagaaagcacttttaaattattttcaaatagggctacaaataaaggctatttactatttcattcccaaagtcagtaacgtagaagactagctcctctgagattattttgaaaacctgaattttataaagcaataaaattagaaaactttggggacacaaaatgacatcctacagagttaaaattaaagacctttgctgttccctttacataaagttttgaaaacctgaaaatactgaaaattcacttttaagtatcctgaaaacaggcctgtaagcatctatcagcctttctttgttgttgttaacaaacaaacaaacaaaaatctaattgtattagtctgttctcatgctgctaataaagatatacccaagactgggtaattataaagaaaaaaggcttaatggattcacagttccacatggctggggagacctcacaatgatagcagaaggtgaaggagaaacaagacacgtcttatatggcagcacgcaagagaacctgtgcagggaaactcccctttataaaaccatcagatctcgtgagacttattcactatcatgagaacagcatgagaaagatctgcctgcatgattcagttacctcccacaggttccctcccatgacacagtgggaattatgagaactacaattcaagatgagatttgggtggggacacagccaaaccatatcactaactcacaaagtagaaacatatgttactcaaataccacacctaaaaatcctacttagggacagataaggggtatgaagttatcttttttagtcaaaattttaagctacgcaaaaaatagcaatgggcactttggatgacagagtcacaaataatggatgtttatgtttggataggtgtttgtttgtttgtttttttgagacagagtctcgctctatcgcccaggctggagtgcagtggcacgatctcggctcactgcaagctccgcctcctgggttcatgccattctcatgcctcggcctcccgagtagctggaactacaggcgcccgccaccacacctggctaattttttgtatttttagtaaagacggggtttcaccgtgttagccaggatggtctcgatctcctgacctcgtgatccacccgcgtcagcctcccaaagttctgggattacaggcgtgagccaccacacccagccaggataggttttaacttcttaatcacctcttacatcagactcctatactgttttaaggtttgccctgtataccacatggcagagcttccagtggagtcctgtgctgcgttccaactggggctccctgagcagggaggcctctgtcacctcctcacctggctgtgctgaccaggctgctgaccccactcctgccctccctctgccatcttcccctctgttggtcttctgcatgctagctacttcctctattatttgtactacatgtaaatttttcacaattgatgttgtgtttagttgaagaaaaatagtgtatacatgttgatagtctctagatcacttaaatagttcttatttccaaatattttgaactaaaattattctctccctgttgatatcaaacagcagtggtttttaatgttttttaaaatttgtggaatcttcaagtcaggtatgatcttaagatgctccattatattaagaaggaaggggaggagggggagaaggatgtgggggaagaggaacagctgctcttttaaaaatggtatgagggtgggcccccaccccagccaaccttgcctgtcgctccagctccccctcttctgatcagttcacacaggcttttccatgccttggcctttgaaatacttgaaaagttgtgattctcatggcccctaactcttctctgaatgcagactaaatgctcattaacaccatgtaattatggaagtcttggccctgagctggtggtgcagtgctggagagccaggatagggggctgggggcatggggagggtagggaatgctgcggattcttcccagcccctcaggttcccctcaaaggatctctcccgaggccaaatacaggcccctggggctttctgtcaacttcataccccagttctctgctggtcgtccttccaccacagccaggaggcctgtcacaacctcccagcccctcttctgttacttctctgggtcccatggtgaggggcacttgggtgctccccgcctctgccgctccagcatggactatgatgtccctcacggcctggaaggtcagtgtcctttagaatcttcactctttaccaggtccttagctgtgtactcagcagtgggagacagcggccagaggctgagatccaaccctgctcaaggcagaggtgggtcatggtattcaggccaggcctccagaaggtcacactacctcttggtgacactctgtgtcaggtgctggtcagtttccatagtgtaccctgctccctgttcccctaacaatcctgagaggcaggcatgctaggcccccaatattatagtgggcggcagcagattccaagaattctgaaagtgtgagacctccaactgttctttttcaacattggctggttcagggtcccttgaggttccctgtgaattttaggatggattattgttttctgcaaaaaaaggcattgagattttaataagaattgtattgaatttgtggattgctttgggtcatattgacatattaccagtgttaagattgcttaaaaagcaataaccgactgcttattgcaaatctaaaaggcgacaagatgacctaaattaaatgttcttcaaaatttctgaacctctgtcactatgtgactgaagctgttcctgtttctttcttctcccctctgtatcttcctccctgtttccccttctttcttttaaaaatgaccacaatatagtaactgagcatgccatatttcatagttttatgtgtgtaattggttttgctagccacatgtcaagttattgtgtcacttgggacaaagaaaaaaagaaatgtgttgaaaattcagctgtcacagaaacctaataatcagctgcatgctaatggatatatttatctaaagtttgtcaatataattagagaaccttgatggcagacccagtaatcacgtcatgtggggttatcttgcgtatgctggcctttcacattaacctgtttttggtaagacacttattttttgatgattgaaaaagggaaacagcagttgtatctgttttcttttaggtgcttgcccagctactgtgagcatgggggcgagtgttcccagtcgtgggacaccttctcctgtgactgtctaggcacaggctatacgggcgagacctgccattcctgtaagcctcacacctccctctcgtttctgtcagcatctctttgtcatttcattttgattagttgtttatatgtatctgcatatttgcaatcatgcaaacacatcagaagagatatttcagcactcaatttctagtttacttttaatccaccttatttaatacaagggtgttgagacagtgcacagaaatacgtggtacgcataggattgaaaaaaagaaactggcaagcaatggggaaataagtctaggagaatcagatatagtaaaaggtagaaactaaattaaattaaaaatgcatgatgttaacagcttgttccattacttgagttggaccataattttaattctgagaatcttctcagtcaaagaaaggtggaaaaacaaccccttgccaggctgtcaatgttacatttaaggtatttaaagattttttaacaatcactgggatgatgcaatcatgggattgtacatggcaagatttttgaagaggtaatgggatatcagctagaaactagaggacctttaagatctcttacaatgactgtgattttctttggtggtggtgatgatgattgtaaagtgaataattgtaaaagtattaatgtattgagtacttatgtcagccctctgctattgctttgcatatattaactcatttaaccctaaagcagctggaagaaagtactcttattatcttcattgcagagttgaggacagaaagaggttaagtaacttggcccccagctagtttgtgggaagatgaggagttgagctaaggaggttggctccacagccttggctccaggatgcctgattggtggtccatgcaccagcagcacccacagcccctgggaacctgttgcaagtaaagactctcaggccttacccaaacctactaaatcagaatcgctggagatggggccccgagtctcttgtaaccaaccttcctcatgcttctggtagacatttaagtgtaagaacaatgtctaagggatggcatattctaacacttctcaactgcctctgccatattaaaaatcatctgtctttactgaagaatcaccctctgtgaatttcaaaggccatgccgttttattgaactctaacctgttataattagaacatcacagaatctgaaaagccttttttttcctatttgtttttaacttttagagttttctttctgtatatctctactgacgtttctgagcaacttctcctcaggaatatttcgcccatccctgggtcttcaaggaaacagagatgcaaagtcctcagttccacttgctcatcctgagttcctaattgaaacttttaagaactcttccatgagacatttgattttcacaaaagccacaggagaaaggcaggctgtggagtgttaaaaccacacttcatacatgcaatgagaattctgcgctcccagtcctgaggttctgtaaaggatctgggcaaaagaggagacagtccaggagtgactctcacagattgaagcatgaagtatgatttttgtactagaagggtccctgtttataaagctgtgacacattttcttttttttgtttgtttgttttttgttttttgagacggagtcttgctctgtcgcccaggctggagcccagtgtcatgatctcagctcactgcaagttccgcctcctgggttcacgccattctcctgcctcagcctcccgagtacctgggactacaggcgcccgccaccacgcctggctaattttttgtatttttagtagagacggggttttgccatgttagccgggatggtctcgatctcctgaccttgtgatccacctgccttggactcccgaagcgctgggattacaggcatgagccaccatgcccagccgctgtgacacattttctaggagttgagtggcctctcacaccagaggctgaatgtcttgataaggtcatagagttggtgcagggaccacatcttttacttctgtgtatctttcatcctccaggcatagtatcttacctaaaagcagaagcctattcttgtgtgttacctggaaaatttatatctgccaccacactcagcattgtctgattgcatttaatgttgcaattaatcaatgagttatattagtccatggttattcactgcaatcaaaatataactccaaaaacttctgagggaaaatatcaggagattgaaaaagtatttcaagtgtcagtctcatctaataattgacggctataggtagaaatttgccaagcccacagtcattcactgtgagactagactgccacacctagttgaataggttattttgtatttctaattgtataacatgtatcaattatgtgcaactaattaattgtatataattattaattgtatataactcattgtatataattaattatacaattaaaatcaattgtattcaattaatatatactatacattaatacatgtatacattatcatttaaaaagccaaacagttcacataaagcacaagttctagtcactttcctcaatatttgtctccattccaaacctagtctgtgccctatatttaagtattgttattaatttgagtgaatcctaccagacatatacaaatatatgtatctatttaaatcaatatgccataagtggcacaaaaataaagattagcaatgtccatctcctgcagatattaattccataccttgtacttggtaaaacatttacttgcacaaatgaaaatattcaattatgctagagtaaatttacattatatagggatatctttcaaaaaagtttctctcctgttttgaatttcagctgtcttgaattgtcacttgcaaaatacttagggacgtttcttttttaaatcagctttaattattttttaatgacgagaagttgatagcttataaattccatttatctctttaaaatgctcattcatattgttttaaaggaagcaaagggtataactgccgcatagcttaagaaaaactttacagaatgcttatgggaaaataccagattatttaggccttttaatgtgcttaggtattcagttattacagggagaatgagggtttcttccttaattatagagtttaattctgaggtatatttgccatgagtttgaaaagaaccatgcttcaatagcacgcagaattcagattcacaaagttttcctctcgtatctcttcaagtgttttacactgtgcttcagagtttgcatgctttcttgcctaaaagcaaaagaaaacatttatgtagagaaagtacagtctctagacattgccaaaagattgtctattgaagatagtatcgcattcccactgtaagcacatcttcatgtttgaacaccaacacaatctttccttcttcctcaaaatagaaatacactgtgaccgaatatttattcagcatctaacaacatccaacatttgaatgtattttgactaggtaatttttttctcctttgttaataaaaatagatttaattttttaaatgtcatttttcttgcatctcatcaaatatactttcatacactataaaaatgatgttgggtcatatgtatcacatgtctgtaattcagaaatgcaaacctttggacactgactcaacatctggagatattttttctggttcttatggctggtgttctcctacagctctctacgagcagtcttgtgaagcccacaagcaccgagggaacccatccgggctttactatattgatgcagatggaagtggccccctgggaccatttcttgtgtactgcaatatgacaggtatgttgataatcgttagatgcatagatcagaatagaccaaggagaaatttacctagttggcagcattattaaaacatgcagtttgatagtgtgtacttgctaagtagaagcattaaatatgtatttattaattttgttgtcaacaaaattttcttgtatttcttctttgcctgggttggattataggcaagattcaatgctctgccaaggcatctctctagctcctacactcctcataatacatctgttcatgtgcatcatgataaaatacaaacctctgattcggtgatttacatgctttctgtatttagaaaaaacagaggtgtttaaaaatgctaagaaataacatagatatgttaatgttctatgtgcatcttaaataatttagtgatttttatgtcatataattttttcataaccaaagaaacttgattatttctcatgctttagatattagaaatgaacactgcttgggctgcgcatggtggctcacgcctgtaatctcagcactttgggaggccaaggcgggcagatcacgagatcgagagatcgagaccatcctggccaacgtggtgaaaccccatctctactaaaaatacaaaaattagctgggcatggtggcgcccacacctgtagtcccagctacttgggaggctgaggcaggagaatcccttgaaccagggaggcagaggttgcagtgagccaagattgcaccattgcactccagcctggcgacagagcaagactgcatctcaaaaaaaaaaaaaaaaaaaaggaaaaaaagaaatgaacacagcttgattatagaagattgcactagaacgccttttaaatagttacatttttacagaaatttgttgtcacctagctcttccaactctctgcaaagtggaaatctggaataaactgttctcatttattgtgctgacaaaaggtttcaaaagtttcataaatttggacaataaccaaatgggtcagcaagcatcaaggataaagaaacaaataactgaaattacatgggcatttaaagtgccttagcaaagattgtcaaaaaatagtaaaactttacaggggatgttcagaagattcagagccacctgcacagcaatgtgctgaagataaagaaacacaggcgttctgccataagataccaattacctccaaaatcccgactcaaacaatgaaagcaaagtgagaaatcccataaaaatggtcttggtggatatcaaaagactcaaccaaagtcacaaccaggaaggaccttggttgtcatcattttaagatgaggaaatcaaggctcagaaaagttggttagggaagtatctactgacaaaatctagctaatggtaggggaatcactaaactctggtctcttttctgccctagaaaatgtcaccttctctttagatgccgcattgctctatagccagtaataaattctctagttgtacaaatcaagcaataatgattataaaatgtgcaatttcaaactactctaatagcttgaaatgtatatatcgtaataaccttcaaaaagcagttgcttcagagcttggaagtcagcactctatcttaagaacaagtaaaaagccaggcaaactgaaaaattaaccaatttttttagatccagcagagaagtgaggtcacagaacaaaccactgcccctcaaaattggagagacaggcaggcttatatacagaatgacagttttcttccacaagcactaacctttggggaaaccgttgtcaaggtaggaaaacctaaacttaattgacgaattgttggatgtttgatgtggacacatctgagaattaaaaactccaggaagacccagacagagaaggatccccacacttctgtgagtttgacacctagcttgactgggttctcacagtgaatgttggagaaaaatctcctcatgcttccagaaagggaaggtgaaaaggaaccgtcttgaagtacaccagagctttctgttcttcttaacaaggtctttcctcaagggcaaatatttcacctaagctactggtgttttgttttcttttgttttgttttgttttgttttttgttttcagagcctaacctgcctggaggaaggaaattacccacctctggccatcctgtcccatgtaagggtggtgatgggagggagggctgagaagctcttgtgaaggtcacagcccagaggcacaggctccctaaaggactcagacctaatcacaggactacagaacctttccccttcccacacatgttacttatagtactgcaggcctctttacagcagttacagttacttttacctggtacatcacatctggttatcaagaaaaaatttcagctggacctataatcctattactttgagaagctgaggagggaagatagccttagaccagttttgagaccagtctgggcaacacagtgagacccccacctctgcaacaacaacaacaaaaacaacaacaaaacagcattgtgacaacaacaacaacaacaaaacagcatggtgacatgtatctgtagtcccagctacttgggaggctgaggtgggaggatcgcttgagcctgggagttggagactgcagtgagccatggtcacaccactgcactctagcctgggcaacagagaaagaccttgtctccaaaaaaagaaaaagaaaaaagttcaaggcaaaaaacacactttgaagagacagagcaagcattaaaaacagacggtggctcacgcctgtaatcccagcactgtgggaggctgaggcaggcggatcacgaggtcaggagatcgagaccatcctggctaacactgtgaaaccctgtctctactaaaaatacaaacaaaattagccgggcgtagtggcgggtgcctgtagtcccagctactcgggaggctgagaaggaagaatggcatgaatccaggaggcggagcttgcagtgagctgagatcatgccactgaactccagcctgggtgacagagcgagattttgtctcaaaaaaaccaaaaaacaaacaaaacaaacaaacaaaaaccagagtcagatatggcagggacattggaattatcagaccaggactttaaacaactataattaatatggaaaaagctgtaatgggtaaagtagatagcatgcaagaccagatgaacaatgtaagcagcaagatggaaattctaagaagcaaaaaggagtgctagagatcaaaaacagcataacagaaatgaagaatgcctttgatgggcttattagtagaccaggcacagctttggaaagaatccctaagcttagagatacctcaatagaaacttgcaaaactgaaaagcaaagagaaaaaaagactgaaccccaccccctgcaaaaagaaaacccagaacataatatctgagtacagtggcacaactacaaaaggtgtaacatacgtgtaaagagaattctaggagaagaaagaaagaaaggaacagaagcatatttgaagaaataatgactgagaattcccacaaattagtatcagacaccaaaccacaaatccaggaagtttagagaacaccaaagaaggagaaatgcccccaaaactctaccaggcatatattttcaaactatagaattcaaagataaaagtaaactcctttttttgagatggagttttactctcgttgcccaggctggagtgcaatggtacgatcttggctcaccacaactccgcctactgggttcaggtgattctcctgcctcagcctcctgagtagctgggattatgggcatgtgacaccatgcctggctaatttttgtatttttagtacagacagggtttctccatgttggtcaggctggtcttcaactcccgaactcaggtgatccacccacctcagcctcccaaagtgctgggattacaggcataagccaccatgcccaggccaggtaaaagtaaattcttaaaaataatcagaggaagaaagcaccttacctacataggagataagtattacagcatcttctcttcagaaatcatgccagcaagaatgcagtgagatacttaaagtgtgaaagagagaaaacaaaacaaaacaaaaccttctccttgaaaagtgaagaaataaagattttctcagacaaatgaaagggtcagttctctaaaagagataaccttaatatgtatgctcctgacaacagaacacagtggatcttattttcttttttcttctgggacatataggaatgggtataccagatgctggggatttcatatgatatactgagtaaattttaagtgcagacaatccccgtttacagtagttctacttacaatattgcgacttccctatgtgaaaccatatgcatccctatttcaagtacccatacaactattattttattattattattattttgagacagaggcttgctctgtcacccaggctggagtacagtggcacgatctcggctcactgcaacctccacctcccgggttcaaatgattcttctgcctcggcctccccggtagctgggactacaggcatgtgccaccacgcccggctaattttttgtatttttagtagagatagggttttactatgttagccaggatggtctcgatctcctgacctcgtaatccgcctgcctcggcctcccaaagtgctgggattacaggcgtgagccaccacgcctggccacaaccaatattattatttttttttttactctcagtacagtagttaataaatgacatgagatattcaacactttattataaaataggcattgtgttagatgattttgcccaactgtgggctgatttaagtgttctgagcacatttaagttaggctggtttgagctaggttcagtaggtcacatgtattaaaatgcatttttaatttataataagttcatccagatgcaacttcatcataaattgaggaacatctgtactgttaattccaatcaaaatcatgagttaaattagcttaattttcaaagttggatatttatttgagcaacaggagtggaacagggatcaacgtgttacagttaccctccttctgggctagtgagacagcctccagtgtgttctgactcagccacacctctgaacccctttccacatttagccactgttataattaatctactcaggtccaattcacttgagcccaggaggtcgaggctgcagtaaactatgaaggtgccactgcactccaagctgggcaacagagggagaccctatctctaataaaaaagaaaaagaaaaatataagggttatattagatgctctttaagatcctttccagttccaatatgcttataatcaattgaaataaattatgagcaattagggaaaccacaatggtctgtgtccttctttgggtcttttactactgatattataaggagaagtgagtcaagtggaattttataaacacaaatgcatatcctataatgtccctggttactattctactcttcagaaaaacaagttttacagatgtattctcaacagttcccttctcagtactgagggcatttctgtgattacatcttaaccatgggtgactgcaaatctatcatactgcccaccagcctatgtgaactactccggaccatcatttctctcccattgtacaagaaatcatgaacacatggccaaaaatggcatgtggttgagcatcttcaatgcccaacttagtgttccataggtttttctatatttgattcagttgataggaaaactctgaaggtgagagtaggtgatgtgcacagagtaacaccaggttgtaaaaattctaaaatgaggccaggcgtggtggctcacacctgtaatcccagcactttgggaggccaaggcgggtggatcacctgaggttgggagttcaagaccagcctggccaacatggtgaaacccccgtctctaccaaaaaatacaaaaattagccaggtgtggtggtgtgtgcctgtagtcccagctacttgtgaggctgagacaggagaactgcttgaacccaggaggcagaggctgcagtgagctgagatagcgccactgcactccagcctgggcaacagagcgagactcttatctcaaaaataaataagttaaataaaaaatctaaaataaaaaaatagagcaatattaaaggaagaacccatggaattgaaattaccataggcacacttagagcctcctttggtgagtacagtgagtggagtgataatttaatttaaaattgcattcgttatttaaatttgcagatttttttctgtacttgtggctcatttgtgggtatcacacctttgctctccatgggttctgtgactaaagagatatttcagtagcatggctggttttcttttccttctttcctctgatctctgttgttaggcgtgtgtaagtaacagtaaggctgtgaaatttgtcttacgcacaagccatttagccatttagcagccaagccattaaaaatcctgagatgtgaagggctgggagggtgatttctcaaggtaaaatgtatcacattgttttgtttcgtagttcttaaaaaatccccatacaaatgtttcttcgtttctccagttcggaaaatttttatgtaaaatgtccattattctaaatacatcttattagaggttaaaggaccagacagcaccagcatagtagaattaaagtgacttcaagtctggtgggaggtccattgttgggaacactaaagaactcaagatgcacttcttcccttttgagattgtggagtcattttgtttttatttcatcaaaacaatataagtaatcaagtgacagagatacatcagaaatgatgtcagcaggcagtcagatgctcagggtcaccgcctggaaagtgctgttagaagctcaaggcctctgattcctctgggcttggtcactgatggagaagctgacataattaaaccactttattttaatagagctgcttcctatcatacctgtgagtatgtgcgtcacatcgtcccaatatgtatcttttataaatttattcgataatgaaagaaatagaggcacatacagatgaggaaaatgcagatgagtttaaaaagataaaggtccaggtagtaacagtttggccccatgcttgtgttgatataaaaaaatggttttaacaactaaaaagtcattgcttacatgatacatttttaggcgtgacgtcgcaaaagtttggtcatcagttcttccaatatgctttctcttagaggctgagttctggctcagtacattgttacacaggtccaactcctcaaatcgcggcaaacatgcagtaatgtaaatttcaattaaacgttaattcacataaaaggtctgctttgcctcttgctgctggcgtctgccgcccagtgatgcctctcctttgcccgtttctgctcagcagactccgcgtggacggtggtgcggcacggtggccccgacgcggtgaccctccgaggtgcccccagcgggcacccgctctcggctgtgtccttcgcgtacgcagcgggcgcggggcagctgcgggccgcggtgaacctggcggagcgctgcgagcagcggctggctctgcgctgcgggacagcgcggcgcccggactcacgaggtaagcgccactgctggaggctacaggggctcacgaggccggggcgcggccctcgggctgcgagatgcctttgagggagaaaaggccagggtccctcccgtggctcttagttcaaagccctgaccgctctctccttctcttcccgctcttggttggaccaaagagcattcaagagcgccttcctgaccgttgagagacgttcagcgcgttcatatgcaggactagtgacttgtcctttcttaatcaagggaaattttgctaataacttatgccttagctttccgttcacactgaggagataatggctgtagggcaggctgggtctaacagttcttcatgaagaccagtgggaaccggtaacctccttactcttctcaaagtcttcctctaaatctacttggaacctttgtttcctccctttagattaactgaatatgcccttcctcagccccgccactttcactgtggtctaggatgaaataatgactagggttattaaaaccttttgtcagtgggtgtctcatttttttgaaattatatcttgagaaatgtataccttaatcttcatatatggaagtaatgttttggaaactctgcctgcatcaaaaccgtcttctcctaagttaaagaccaacttccccctcctttccggaatccccacagtcccctgcaggactcaccgctgctctccaacagtttccatatagtttcttgaaagcactttattgctaattatagttaaatactgaaatttacctttcatttttttagttttagcaatcccaaatagtatataggcgggaggatcactggagcccaggaagtccaggctgcagtgagctgtgattgcttcactgcctccagcttgggcagcagagcaacaccttgtcttaaaaaaacaaaaacagtgtatgtcggtagcataataaagccacttaaattaaatttcactcttaaattttcaatacaaaatctttaagttggaaagtggtgtatgactgtcatctgaaggtggtttgcgctgatccactaacccatacctgcattgccttccctagtccgtctggccaatcagcccctggaatatgccagaccatttcctctgcctggattgacctctctgtcacccaggctggagtgcagtggcacgatctttgctcactgcaacccgctcccctcccggattcaagcgattctcctgcctcagcctcctgaatagctgagaatacaggcgggtgccgccacgcccggctaatttttgtatttttagtagagacggggtttcaccgtgttggtcaggctgttcttgaactcctgacctcaggtgatccgcccgcctcagcctcccaaagtgttgggattacaggcgtgagccaccgcgcccggccctcacactcttaaatcttacccactgtgctagacctgtgcagtcggcatctgggtcccttcccagggtgatccctctctcccctggatgcctgccagccaatttggtctagtagaaagagcaaaggtctggttgcattcaaagtttgaagttcaagtgctaagtctgtcacttagcagttgtggaaatttaggccattccttaatctttctcagactttgtttcctctttgatgaaatggaccctgtagtactgatctcatggggtttcttttataaatgagatatcttacataagttcagtaagtaagaaactctccttcccagttctccagttttttaaagttggcattacaaaacttaattatttgttagttcattgctgttgaatgaagtgtagccttggctttggaatcgtttaaaaaaaaaatccccaggtgatcttttggaaactactgggctaggggctaaaataacacaagaaatggaatattctactcccatcagtgagaatttccctatttctcctcttttgaaaagataatttaaaaaaaattttgagataattgtagatttacatacacttgtgagaagtaacagagagaacccgaatagccgttaagcagttcccccaccccaaggtgacatcttgtagaagtatagtgcaatatcacagccggaatcttgacatccatacagtcaagatacacagtatttccatcagcacaagaattcctcctattggctgggcacggtggctcatgcctgtaatcccaacacttcgggaggccgaggcgggcggatcacgaggtcaggaaatcagaccatcctggctaacacgatgaaaccccgtctctactaaaaatacaaaaaagtagccaggtgtggtggcgggtgcctgtagtctacttgggaggctgacgcaggagaatggcgtgaacccgggaggtggagcttgcagtgagccgagatggcgccactgcactccagcctgggcgacagagcaagactccgttccgtctcaaaaaaaaaaaaaaaaaaaaaaaaaagaattcctcctattgctctattgctcgttaataaccactagtatgttctccatttctatgggtttttttaaacttcaagaatgttatgtaaatgaaattatatagtatgtactctttgtggttgagtttttttcactctgtgtaatcctctctagattcatttgcataattgtgtatatcagtaatttgttccttttcattgctgattagcaatcggtggcatggatatgccagagtttattcactcattgaagggcatctgggttgtttgtttacagtttggggcaattatgaataaagcttttatgaacattgtgtacaggttttgtgtgaacattagttttcatttctctggaattaatgccccaaagggcaataggtgggtcatatatggtaattgcatacttagttttataaaaagctgccaaattgttttctagaatggttgtaccattcccaccaacagtgtatgatttcatttcctccacatgctcatccgcatttggtgttgtgactattttttattttagctattctgataactgtgtagtaatatctttattgtggttttaatttgtgtctccctgatgtctaataatattgagcatgttttatatgcttatttgccatctgtatatcgttttcagtgagatagatgtctgtgaatgtttttgttgttgttcattttctaattggattgtttggatttgttttgttactgttgaattttcagttctttatatattctagatactagccttttgttggatatgtgatttgcgaatattttttcccactctgttgcttgcctattcatcgactcttaactggaattttttagagcaaaagttttaattttgatgagattcagtttatcatattttccttttatgggttgtacacatcgtgtcaattctaaaaattctttacctaaccctaaattccaattccaaagatttttgaatttttttcctaaaagttttatagttttaccttttacttttaattccatgccctattttgggacacattttatataagatgtgagagttgattctctctcactctctctgactatgaatgttcagttgctccagaaccatttgttgaaaaggctatccttcctgcattgaattgcattttaaatagtgttaaaaattggttgaacttacttgtgtggtgggtctgtttctgcattctttatctgtttcattaatttatatgcctccaccaatatcacactgtcttgaacgtggtagctgtgtagcagggttgagttattcctcctgctttattcttctttttcaagattgtttaagtctgtagcttgcctcattctgtataaattttgtaataaatttgtttatgtctacaaacatcttgctagaatttttatgggaatgacattaaacataatagctcaatgaagggaaaattggtgttttactgttttgagtcttccaatccatgaacatgagatatctttccatttatttggatctttgatttcttgcctcagcattttgtaattcttagcatccagagattatatgttttataagtatgcttaggcatttagttagtttcttgattgattgtaagtgctgttgtgctttaaatttttgtttacatatgtttcttgttagaatatgaaatatgattgtttcatactaatcttataagctcttttttgaacttaatatttttttagattccttgggattttctatatggaaaatcatgtcatctgcaagtagagtcagctttatttcttcctcgtcaatctgtagggagttaatttatttttcttgctttattgcagtagctagactttcaatactaggttgagctagagtggtgagggcagacatccttgccttgtttcctgtcttaggggaaaagcattcattcttgtttcctatgttatgtggaggtagttcccttttattcctggttggctgacagtttttattttgaaaggacattggatttttgtcaaatgtcttttctgtgtcaattggtattaaaatattatatttcttcttttgtctgttgatatgttgaatcagctttgcataactagagcaactcccattttgccataatgtataatttaaaaaatacatttctaatgtgtttgatttattaatattttattgaatatttttgcattcaaattcataagagatattgatatgtagttttcttttttcatattgtctttatctggtttcagtatcaggacaatactgcctacataaaatgaatttggtagcattctctagtctcctgttttctggaagagattatgtaaaattgactttaatttttatttaaacatttggtagaattctccagtaaggcccggcagggtggctctgtgatcccagcactttgggaggctgaggcagatggatcacttgaggtcaggagttcgagacctgcctggccaacatggtgaaaccccgtctccactaaaaatacaaaaattagttgggtgtggtggcacacacctataatcccagctactcaggaggctgaggcaggagaatcgcttgaacttgggaggcagaggttgcagtgagccaagatcacaccactgcactccagcctggacaacagaacgagatttcatctcaaaaataaaaaccaaaaccaaaacaaaacaaaaagaattctccaataaaaccatctgggccaagagattttttttcagtaattttaaattatgaattcaattttcttaataattacaattacttaaattacctatttcatgttaggtgaattgtggtagtttgtactttttgagaaatttgtccattaatctgaattgtcaagttgatttgtgtagaattatttgtagtattttcttattattcgtttgatgtctccagcatctgtagtgatatccacttaaatttctcatattcatagtttgtctcatctttttttgtctgtcagtctttatagaagtttttcaatcttactgttttttagaactagattttcgtttcttgattttctctattatttttgtttcaaattctattgaaatctgctcttctctttgttatctccttccttcagcttgtatgagttaattttgttttctagtttctagaggtaagaacttacattattggctttagggctttcttctttcctaatgtaggcatttagtgctacgttttccctatcaacacagttttacctacatttcacatattttgatatgttgtattctcattttcatttagtttttcatgtagtttcattttcatttaagtattttaataaatttctttgaagcatattctttgacctgtagcttatttagaagtgtattttaaaaaatttctaagtgtttagagattttctttttctctttctggtattgatttccagtttgattccattatgcttagagaatatactttgtgtgattttagttcttttaaatatgttgaggtttgtttggctcccagggatatggtctgtcttgtaaatttttcatgggcatttgaaaaaaaaatgtatattctgctattcttaagtggagtattctgtatgtatttcaatgagatcctgttggttgattatgttgttcagatcttgtatatccttgctgacttcttgtccagtagttctgtcagttgctaagagagacattttgaaatctgtactataattgtggatctgtttatttttccattctgctccatcagttttcttatattaataggctttatattttttagcaattttaagtttacatagaaattgagcagaaagtactggaagcatatgatttttattctttagtttgttgatctgatggactatattaattaattttcaaatgttaaaggcatatctagagtaaatcccacttggttgtggtgtttatttttaaaaattgtttggttcaatttgctaatattttttaaggattgcttcatccatgttcaagggagatatttgtttgcagtttacttttttgtaaggttttgctggtttgggtattagggtaatgctggcccatggaatgagttaagaaatagtcactctgcttctattttctgcaacagattgtggaaaattggtatcatttatttctccaatgttgatagaactcaccagtgaatcatctgggcttggtactttctgtttgggaaggttattaattactggcttagttaaaaaattttgtttctcttgagactttctctttcaccatgttttattatttagaaatgtgtttttaaattttttggtatttgaggatatttcagctctctttctgctattattagtttaattccattctgattcaagaacatgccttttgtgatttctattcttttaaatttggtaaagtgttctgtggcctagaatgtggtttaacttaatgaattgtgcatttgtatttgagaagaatgtgtattctgcagtgtctagataaaatattctataacgctaattgaattctaaagtattcagttagatccagttgattgatggtgctgttcagttcaaatctatccttaatgattttcttcctgctgagtctgtaacttactcatagaggggtgttgaagtctccagtggtaataatggatgtgtctctctgtccttgcagttctatcagtttccccctaatatattttgactcttctgttgctaggtatatacatattaagcattattatatcttcttgttatattgacccctttattattgtgtaatgccctttttcatctctgataattttccttgctctgcagttggctttgtctaaaattaatttagatactctgtctttctttttggttagtgttaccatggtatatctttctctagctcttcaaatctacccgctattttatatttaaagaggatttcagtagacaacatgtaggtggatcatgggttttgttgttgttgttcactctgacagtctcagtcttttattttattattatcataccttaatttctagggtacatgtgcacaacatgcaggtttgttacatatgtatccatatgttaatggtgtgctgcacccattaactcatcatttacattagctatatctcctaatgctattcctcccctctccccacaccccatgacaggccccggtgtgtgatgttccccttcctgtgtccaagtgttctcattgttcaattcccacctatgagtgagaacatgcagtgtttggttttttgtccttgcgatagtttgctgagaatgatggtttccagcttcatccatggccctacaaaggacatgaactcatcctttttcatggctgcatagtattccatggtatatatgtgccacattttcttaatccagtctgtcattgatggacatttgggttggttccaagtctttgctattgtgaatactgcctcagtaaacatatgtgtgcatgtgtctttatagcagcatgatttataatcctttgggtatatacccagtaatgggatggctgggtcaaatggtatttctagttctagatccatgaggaatcgcaacactgtcttccacaatggttgaactagtttacagtcccaccaacagtgtaaaagtgttcctatttctccacatcctctcctgcacctgttgtttcctgactttttaatgatcgtcattctaactggtgtgagatggtatctcattgtggttttgatttgcatttctctgatggccagtgatgatgagcattttttcatgtgtctgttggctgcataaatgtcttcttttgagaagtgtctgttcatatacttcgcccactttttgatgaggttgattttttcttgtaaatttgtttaagttctgtgtagattctggatattagccctttgtcagatgggtagattgcaaaaattttctcccattctataggttgcctgttcactctgatggtagtttcttttgctgtgcagaagctctttagtttaattagatcccatttgtcaattttggcttttgttgccattgctttcttaattggtatatttagactgtttacatttaaagtgattattgatacttggattaatatttgccatattgtaactcttttttatttgttgcccttgtttcttctttttttcctgaattcccctctcacattttttgttttaattgagcattttatatgattccatatcctcacttctcctagaatattaattacatttcttggtaattgttttagtggtagcctttgagtataaaatatacactataacaatctactttcaaataacactattccacttcattaatggtgctggtactttataacacagcatttccaatccttctgtcttattttgtattacattattatcattcattttacttattcataagccataatcacccaatacattgttagtattatttagagctgttacctattacatcaattaagaagaagacactagattttattttaatttttttcttctctaatgctcctacctttctttatgtatttctgtgtttttgacctatattgtttttcttttctctgaggaacttctattaacatggcttgcaaggtaggtctactggagaaagatttcctcaattctgtttatctaagtctttatttctactttactatttaggataattttactggatatagaattttatattagtgtgtgttttctctcaacagtttaaatatttcacttcactttcttcttgcttgcatggtttcttaagggaaatctggcataattctcattcttgctcctatgtaggtaaggtgttttattttactctggtttatttcgagattttatttttaaaagattttattttaattttaagaaagtcttcaattttttgcaatttgaatatgagatgcctaggtgtggttttttttgtatttaacctgcttggtgattgctgagattcctgaacctatggtttcatgtctgtcattaattttgaaacattctcaactgtcattattttaaatatttcttctggttctcactctcttccttctacttctggtattccgattatgggttacataggttacaccgtttgaatttatccaacagggctgggcgcggtgactcacttgcctgtaatcccagcactttgggaggccgaggcgggcggatcacaagttcaggagatccagaccatcctggctaccacggggaaaccacgtctctactaaaaatacaaaaaattagctgggcgtggtggcaggcgcctgtagtcccagctactcgggaggctgaggcaggagaatggcgtgaacccaggaggcggagcttgcagtgagccgagattgcaccactgcactccagcctgagcgacagagagagactccatctcaaaaaaaaaaaaaaaaaaaaaaaaattattgtccaacagtttggatattatgtttcatttttcattctttttctctttgtgtttaatggaaaattttcattgacgtatcttcaaactcactgattctttcctcagcacttcccagtcttcccagactttgatgaggccatcaaagacactctacaatgtttacttttaatctctgtatttccttctgattttgagatttcatatctttgtttatagtacctatctcttcttgcatgttgcccactttttcaacatagagcccttagcatattgattattatttcaaattccttatctgatatttccaaatctgtcataactgcatgtttgcttgattcgtctcataagactgtattgtttggctttagcataccttgcaattttctgttgaaagccagacatgttgtattggcaaaggaactgaggtaaggaagcctttaatgtaaggttttatgtttatctggttagtagttaggctgaatttgctctttgcataactgttgtgtcagaggccaaaatttcctctaaggttattttatttttctttcttccgttttgagttttcccagagactctgtcttaaatagggtctaaaattgacagctctttcatttttaatctcctgttactatacaggtaatgtactgatctgattgatgataaggtgcggggagaggagaagcatcctatactcttttttttttaatgtttttattttattttaatttttttgagagagtctcgctctgtagcccaggctggagtgcagtggcgccatctcagctgactgcaagctccgtctcccgggttcacgccattctcccgcctcagcctccccagtagctgggactacaggcgcccgccaccacgcccggctaatttttttctatttttagtagatacggggtttcaccatgttagccaggatggtctggatctcctgacctcgtgatccgcccgcctcagcctcccaaaatgctgggattacaggcttgagccacctcacccgacccaattttttgtatttttagtagagatggggtttcaccatgttagccaggatggtctcgatctcctgacctcatgatctgcccgcctcggcctcccaaagtgctgggattacaggcgtgagccaccgcgcccggccagaagcatcctgtactcttaggattaggtcagtcttttagagaacctgtcttcctggactgtgaccttcagagtgcttctcagcttccttccccttcccttgggtaagaaaagaagggtagagggggctggttctgggtatttccattcccctaggtggtttaggctctagtaaactagctttttgggggattagaatgttgttaaggagaacataatgttcagcgcttatttcaaaaatgttttctccttccctccccctgctggagacataagagcgtttttttcctatctttattctgagaacttgatggggctcttcctggagataaaactcttgaaggtgtgttgaccctctaaggcgtatcccccactctaggagttttcaatctctgtagcttgtccttgctcagtatccatcaattagtcagttacattttaagtgcttttaccagactccaccatctgctttggcaccattagccgtgatgctgttttcagttgtctctgcagctttaggagtaatgtttgccctatgactttaactgtgtaagaagaactgtttatttttagttagtgcagcttttttcttgttgtgagaatgggagcgatgacttccagactcttaatgtcatatcagattggaaaccagaagtctcaatttttgcctcatttttttaagggtgtattgtttcttgcatatgcatttatgtcttcctggtgatttttttttaaatcattatgtaatgtccctgttctagtatttttgttctgaagtctattttatgagatagccattctgctttctttcaaatttaagttttgcagagtgtattttttccatccttttacttttaacctgcctatgtttattttgaagtgagtttcttataaatttctcgttgtgttatttttttttcagttgattctgccagcatctaacttttgttatattttaaccatttacatttaaggtaatttttataattttcttactcgttgcttggtattatagtgtacatatgtgacttaccacagtcaacttaaatatcttcactctcataatgaaatatggaatccttatgtctatttgggtcctttatcttccccacttctaaatatcattgtcttgagtatcatatggtattacagtttttgtgtcaattatcatatatcatttcaaaaattgataaggatagtctattatatttatccatatttcttctcttttcatttttttcctgatgttccaagaatccttcgttataatttctttttgaaaaacctcctttagccattctttagggaatgtctgctagcgacaaattattttagttttcttttgtgttaaaaaggttttttgttgttgttattgttttggagatggagtctcactctgtcgccctggctggagtgcagtggcacaatctcggctcactgcaggctccgcctcccgggttcacgccattctcctgcctcagcctcctgagtagctgggactacaggctcccgccgctacgctcgtctattttttgtatttttagtagagacggggtttcaccgtgttagccaggatggtctcgatctgacctcgtgatccgcccacctcggcctccgaaagtgctgggattacaggcgtgagccaccgcacccggcctaaaaagattttatttccatttttattcttgaaggatagtttctctggatatataatttatagttgacaattcttttctatcagccctgaaaaaaaatatgccattccttctggttctgtaatttcagatgagtaatctactatcattcaaattagggttcttttacaggcaggtaatgtgttattctctcaggctgctttcaagatttgttttgttttgtttccaaaaagttcaattatgatggatcttggtgtcgatatttttgggtttatccttttttggacttaacttcctaaatctgtgggtttgtatctttcaccacatgtgggaagtttacagccagtattttttcagtactctttcagcacactttgttctctctttttgagattcggatgatattgtctgataggaccctatggctcagttctttttatattccgtctgttttctcttttttggtcaggttagataaagcctattggtgggtcctcaagttcagtgattctgtcctgtgtcttttcactctattcttgagcccattcagagtttttttaaaacgttatgttattgtatgttccagtcctggggtcctaagcttcctctttctacttttcagaattctcttcggttgtcttctgtattatttccagaatctatcattatacttggtggaaatagcagggatagacaagtctacaagatcttttatcagtctagaagttcacccacttacatctttttgttactgtttctaaaaaaatacatttttactactttatggggaatatgggagatttagatgtaaatttacacttgtacattaggatataatgagtgttttgctctttaatctgcgacagtttaatggtgaagtcggtaacttttaaagtggcattccgagaagagtgtattaatttttaaaaatatcttttacgttgtagtgacaagcttttagcacatttttaaaagattcctggtactaatccctctttaaattttcccagattgcctttttttcgttgttttttttgttttttggcagaggggcaggtgatagatagtggtggtggtaatgaatgcagagatcttatctatgaatgagttataattgagttgtaataagcagtaaggtagaagctaagttccagatctcgattcatattccaatggtaacaacctattgaaatttgaaaaacagcaccacatgatcaagcatgtttaaaaaactggttgagttaatccaatttcattttcctcatggcctaatctgtgatgactgcaacttgtggcctctgacccctttccttttttaagataggtggcctgacacctgctttttaaattatcctaactttactgtgatgtgctgtcagtccatcaccccaatcttcactcccaacccctggcagcatcccttgtcctaatatgcagttctatagatctgagttagtgtctgactctatcatttaatcattgtcagtgctgagaaggaggcgcactcgtcagagctgtagttgacccagggcactttgtttcttcgcatgagaaatttctaacctcagagatgagaaaagcctatcaatgtcattccttaacctccaaataaagagtcaggacatccaatgcaataaaaacaaatacctccaaaaattagtaagtactgacagagaataccatatctttccaaatgtgtaatatacaggtagttagcaaaaagatgggatgagataaatcaatgtctttgtataatattaaactttctcaatgaacatttcataatttcaaatagattttatctttagtgtgcaaattaccctggtattaattttaatggtgaatttttttgaatgttatttctatagaaagtatgtatcacgtgcaactgactgatttctaatagaagaaaaatagatggaatcatttaagcctagatattgaaatattgggggaaaaacattggttaggcttaaagaaacgtttcagaggtaaaatacaagtgtttaagtatagtttcattttctctctctctgcctctcacacatacactttacacctgggagtaaagggagatatatggggagggtgatagtgagggacaaagtagatgtcatctttcttatacttgtctttcagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccagaatgaatggtgatttccacatgatttccctgcacaaaaatgtggtttttattctttaattatgcatagttaattaaatgtcagacaagctggtacaataaggtaactagattaaagtatgttcaagcaagctgaaatacaagttttgatgaaatatgatcagttaatctaaggattaaattttatgaccaaagatttactaattcattgtgaatactatataatgtgttttttatttttcgtaaaagagaagcagctgttaagttttccactcactggaaatcaaatatcattctctgcgaagtttagttaattaattaacgtagtattcatgtggcaattcaaaaagcaaattcctccaaatctttgtcttaaattgatttgggatataatgctgcatattctgtctttcttttagaaattaacattaacacaagaaactctgagaggtcctgcataaaaggactgtgtttattttttagaagcaacaatttcccacactcattgaaatctgcagtgcaatagcaaagcttcaagcaccaactgttctgtagaccatactttgaaacaactaacatagaatttccggaatttgaaaattattttgtaagctttcttttgagcagaaacaattttctcatgtagattgcaatgcctctttttcagaagttctttttgaggttattcttgaaatgcatattggttttctttttttttatttgtaatatgtaaatgttttcaacctttgggttcatgtcagcaacttaaaaagcattgtcataaaacaactagatcgtgtagagtacgtgctttaaaaaaaaacttaggccaggcactgtggctcatgcctgtaatcacagcactttgggaggccaaggcaggtggatcacctgaggtcagaaggttgagaccagcctggccaatgtggcgaaaccccgtctccactgaaaatacaaaaattagccaggtgtggctgtgtgtgcctgtagtcccagctgctcaggagggtgagacagtagaattgcttaacccaggaggtagaggttgcagtgagctgagatcgcgccactgcactccagcctgggcgacagagcaagactccacctcaaaataataataataataataataataataaattaataaataaaaaatgtaatggtcattccaggtgtcagtataattgatttggacataaaatagctaatctaagcagtaatttgattcctaaaaattgagttgtttggcctgcatggtagtccacttatttatttggcataaaaagtctactttgcatcactttaaaaaatattgtgaagttgggaaaactcacttgaatctactggagctttctatagaatacatactatacatttacatggatattatttttaatcttcctcaagttcaaaattacaaaatgatcatacagatttatgagacactctttttgaatattttgatatgcaatcttaatacaactttctcttacttaaaaatgaatgcagttttagtgcagtgagtaacaggaacagatctgatccatagtttcaaatctggccaccagtaagtttcaggtctgaagtaatttgccgtcagttaaaatggttttgtaccatattttgtatgatgtacattttaaagtgtctggtatgataatgtgatgatgtgtgttagctttgggctctaatgagacaaacagcgaccttcaaatcttttgacggacatctttaacaatcctagaggttttcatttcctccattccacaaggggctcctgcctgtgagggctccagccctccagctcctggctgttcagaagacctccagctcattggtctgtccccacccccattctctacaggtcagaaaggagagcattggcaggttattacaagaaagccagaatggcatatatgctagtggctttataacttagttcgaagaatgttaaccgttttgttttgtttttgttttgagacagagtctctctctgtcgcccaggctggaatgcagtggtgcgatctcagctcactgcaacctgcgcctcccggattcaagcgattctcctgcctcagcctcccgagtaactgggattacagccgagtgccacacctggctaatttttgtatttttagtagagactgggtttcactattggccaggctggtcaactgtttttttgttacagaaccttctgttagtattaagtgcatactttattgtagacttcacgtatgcttagggcagtaaccagaggaacgtatcacttggagccacctgtattgagtgaccctcccatgaactgagtttgaggaggggatgggaggaactgaggtgggtgcaggtcctctgatacccttagccatgtcacttcagcaccgtcaaggactgcactggtgtgacagaagccctgggctttcatttggaaaaaaattcaggagagaagcaggttttaaaaattaactcccctcctacattcagaagggagcattgtggagtcatttgctttttaaccttattttatttactttgcagcttccagtagacaggtctatccaacagtaagaccacaagcattctgaaatcctaacccaactcttgtagattgttttgtaaatgtgggggtgtgtatgggggtgggaaattacaatttctattttaatttttcaaataaaattgatttttcagtttataaaaatggaatttaccagtctcatgaaatgaaaagatttataattgtaataatttagattaaggtgtagacataagaacataaatcttagtctttattacttattttctattactgaggtgtgcttagtaaagttttcctggtggaaagtttataataaaaatagtatttgggaatgaaagtaaagtgaaagctattttaagtctcttcaggcatatgtccgttaatggggcaggcagtattgttaatataaaccatcgccatttttccataagttgtccctgtaatcagcaactcgtctaagcatattacttaaaaaaaagtttatgatcagacagttcctcaggcacagtaagaatattctatcaaataactataacatgccaaagatttattataaaaacatatatttaaaaggcactataatgatttaaaatattgaactatgctgcaagtcaatatatgtgtataaatgtatagtggactatgttcaaatagaccaatatattctctaaaatatacatataacatataattcagctgtctgcaaaaatccacaagttgttttgctaatataatgatgacacatgtaactgtaatattattttacttaagaatttaaataggacttttgtgtgattatcttagagtctttaaaagtaaccacaaataaaaagcataaaataagatggtttaaatgcatactagtgtacaaataatcataataaatacgagtaaactctgttcatttaaaaaccagatattagattttatcatattggatttttaaagaagctatagcttgtttacaaaagataaaatataagcactcggtgaagttgaaactaaaagaatagaaaatatttaccaagtaaatacaaatcaaaagaaagcagatatagctgtattatgtcagacaaagatgaaaagcattgttagggataaacttgaactctatctaatgctgagataaactcactagaaagatctcactacacttgtgtgtatcatcagattgtttaaaatatataaagaagtggcagggcgccgtggctcacgcctgtaatcccagcactttgggaggccgaggcgggcagatcacaaggtcagaagatcgagaccatcctggctaacacaggtgaaaccccgtctctactaaaaatacaaaaaatattagccaggcatggtggtgggcgcctgtagtcccagctactcgggaggctgaggcaggagaatggcatgaacctggaaggcggagcttacagtgagtcaagatcacaccactgcactccagcctgggcgacagaccaagactctgtctcaaaaaaaaaaaaaaaaaagtatgtgtgtgtgtgtatgtatatatatatgtgtgtgtgtgtatatatatgtgtgtgtgtgtatatatatgtgtgtgtatatatatatgtgtgtgtatatatatatatatatatatatgtaacaaatatgcaaaggcaaattgacacccaaaacagtggaataattaacataacatttttgggaatgagtaagtgaagcaggtaagaatattttaatattataattaacaaacttgatatagcagccatatatcgtttagcaaggaaaaattatttctttatagaatgtattatacattattgttgaataagtataaaaaattttgtaaatggatggaatcttaacaaattttacggaattgtcatgatggaaactatattcttaactgtaatcaataatgaatatataacttttaaaagctcatgcatgtgtcagttaaagacacaagaggaaataaaatagatgtaagtgatgaaaagtttggaaaagaaacaaacctggcagatattgtagataatatgattgcctacatagaaaatccaaaataatataaagaaatatcaggaaaaatgagagttcagtaagtttgctgaatttatggtcagtcagtattgaggaattacttgaatttctataaaatcgtaaaataattaccattacacacctagaaaaattttatttgcaatattaacaaaaatgtaaagttctgtggaataactgcagtacttttatggaaaaaattacaaaacttattcaagagaattaaggacagccaaataaatggattgactcactactgtcgtggatagtatgactcagtatcttaaagcagtagttctcaatcgggggtgatttcgactcttgggacatttggcattgtctgaagacatttttgtcatcacacagagaggaaggttgtttatattagtgtctattaattagaaatcagggtgctgctgagcatcctacagtgcacaggacagccccccccatgacaaaaaaaaattagcccaaaatatcagtaacgctgctgttgagataccctcttttaaagttgacattctcctcaaattagtctgtaattttaacaaaattccaaaaaatgccaagtgtttttacttgtgtggattgcagcaacctggttttaaaattcatatggaaattaaggatgaaaggataagcaagataatttttaagatgaaaaataaagtgaagaaactagttctgttagctgtcaagacatactgtattgctgtagtaattaatgcaggttgaactggccagaagataggcaattaaacagaaactgagaatctagaaattttttaagtgggttagatgtggatcataatgattttattattgctgacctactcccccaaaataatcattaacagttgggctgggcgcggtggctcacacctgttatcccagcactttgcgaggccaaggcgggcagatcatgaagtcagaagttcgagaccagcctgaccaacatggtgaaaccccgtctatactaaaaatacaaaaattagctgagcgtagtggcgcacgcatgtaatcccagctactctggaggctgaggcaggagaatcgcttgaatcctgggggtggaggttgcagtgagcagagatcacaccattgcactccagcctgggcgacaagagtgagactctgtctcgaaaaaaaaaaaaaaagaagaaaaaaaagttaaaaagttgactcaacatttctcccttttagctttctttgcaacctcccaaacttatggctctactttgccttaaataaagttccctggcaaataataagtagtagcttttagaagttttcacacttcctaggaaagtacaatttccagaaccgtaggaatttctaataaataaaaattttaataaaatataaaataaaagcaaaaagtctttgaaagttctcttactgaatttttaatactgctccaagagattatggtacctatgaaagcactatttccaagtgtagactatagtataagctttagaaaataatagggagaaaagaaaaatgagatgtccctattaattaggaagttttgaggaagtctgataactattacaaatcctgagtattctattttgatttccaaaggttgggaatctgcctgtaacaataagaaactggtgaaaaacactggctatctttatgctcagaatgaaaacaccagactttccaaaacaatgaaaaaacaagactttattatagtatctgccctaattaaactgaaatgtggatttcatttacacattctcaatattttgcacagtcagtattgaaaatggaatgaaacttggagctcccgtgaaatagatcttttaaaatacaagcatcctccataaataattaaattgcattttctctactagactatcttgctaaaatgatgatcacagaattggaaatggtaatttttaatggctaccacattaataaaaaatttcctagacctacctcattcagcaggagacatatttctagcttgtctaccatcagtccactctaaagctgaatggtgatgcctttagataatcaatattctgttctttgcattaaaatgaataacagaatcttaactaggtaaagcaacagggttttagtctgaattttagaaataagctttctttaccattaagtgtattttttcagggaataatcttaaataatatagccattttattttagttttatattttccaatttgaaagtttgatacctagtcttttataaaagaagttgattaatgggtacaaaagtcgagttaagtaaaagaaattctagtatttgatagaactagagaaattatagttaacagtaatttattggatatttcaaaatagccagaagagaattgtaatgttcccaccacagaggataactgctcaaagtgatggatatcccaattaccctgatttgatcattatgcattgtattctagtatcaaaatagcacatgtgcccccagtatatgtacaactctgacatgccaatttaattttttttaattcagaaagccttattctgaaaatacaaaagtgttgcaatgatgaaatatcaattattgtgatcttttgccacaaatgcatacaaaagaaggtttgagaactgggcaatttaaaaaatacagtatttactagatactgtggagtttctaaccgtaactggactaagagtgttttgtctgtaaatcagaatatacatgcagttgagacatatatgtaataaaatataaccaaaagtatataaatataagcattttattatatatgcatatatgcaatattattggccaaatatttattacatatacagttacatacacatatataataaaatacttttgcagcagagtagacaaatgcctttattttggccagagacaaaattagtggcatagctaagaccaggaccccaggttcccctaggggatcctccaggtctctttgtattggacacagacgtgtgcatttattttcccagtcacataattaatactcatggtattcaataggctgtgtgctttcagaaggcagagactaaaatatattttttactctgtgtcctcaattcccaggacaatgtctgttcgacaaaaggtgagcgctgagtgtttggggttttttgtttgttttttgtattttttgagacagggtctcactttgccacccaggctggagtgcagtgttgcacacatggctcactacagcctctacctcccaggctcaagggatcctcccacctcagcctcccatgtagctgggactacaggtgtgcaccatcacacccagctaatttttgtattttttgtagagacggggcctcactatgttgcccaggctggtttcgaactccagagctcaagcaatctgcccaccccagtcttctaaagtgttgggattacaggcatgagccactgtgcccggcctgtgtttgttgcctgaactactgggagcagtgtttcacagaccactttcacactcattagtctatgtattacttataagggtgtagtatgtatttggttttgaatctgtgggactcattttgcatttacaaagttaacaaggaaagaaatacccagtaatcataaaaggactttaaaaaataatgataaattaatattctgcaaaatgaatatctaaatccagtgttactatttttatttgtaaagaataatcacttagatattattctaagacaattttagaagggaagttaccttcttgatttttccccttctctgtaatcatttagatcaggaattggcaaacgggtcaggaattaataacctcttgctttgggtgaaatccagaccactagtctatttttgcatggcagtgagctaagaatgttttctttacatttttaaaaggttgaaaaataaaaagaatatttcatgtcatataaaacttgtatgaaattcagatttcatatccaaaaatttttattgcaacccagccatgcctgtgtctgtggctgctttcacacttggtggcagagttaagtagttgctgtgagaagctgcatggcctgcacagcttactgtatggtcctttacacaaaatgtttgcccatccctgatttagattcatggtagtctctgtgctctcaaaatattgaaaatgttaagtattctgttaagctctatgatgttagtttcaaattgagataagagatcagagttaattttgcccgtatgttaatcagaataattttaatggtttcggttgttgttctttaggactagtgacacaatagtcctttcccaaaaggagcacctcccagtcactcagattgtgatgacagacacaggccaaccacattccgaagcagattatacactggggccactgctctgccgcggagatagtaagtagtgtcaagaaaaagctttattttcataataactttttttggttataaaggggtagacaaatgcccttgttcttgccagaaagagaatagtggcagtactaggactggggcgaatatcaggaaaacacacataccataaaggcacagtcagtactgaagatctgtgtttccttactgaagcattagtttatagaaaatgaatcatctttgttttaacttattacttgcttggctggatttattatcaattgattgtattttttccagaacaatcatgagatgaactattttctgaatgctaagggatatttattcattgcccttatactcttcagacaactatagtggtaggaaattattggacactctctattttctgacctctgtacatactgttttacattacatggcaccgaatgtgtattaatctctttcctgcagcattttcgttcatgggtggctttcatggtcaagtcctcactcccccacctcagtggcactataagcccagggttcttagaggatctacctactgggtagcacgggaaccacaactaagctagtaaaaatcttctttccctgagaaaaattgtaatagtgtttcttacccactagcatcatacattgccgtggagaagtctgagactaaatgtatttttatttcctgttctacctcaatgtgtgggggctacttctgagaggggtggttcaacaaggagcctgagcctctctgtacattcttgccgagtgtgccagatggtgtggtgtctccatcccctaataccaagcagtttctgtagccaatcgtgtaggcagctaagtagttcaaagagaacacaacatcactatcgatgtgtactcactccccagagagggcggggaccggcttgtctcctgcttgatgaaggagtcccggacccttgtctgggggctcctcatctgagatgcaaacctacccactgtgtgtgtagcatccacctgggccaatggattgtgttgccctgtgaaatttggagataaggggaaccaatgcaaatattctgacactcatgctgcatgctgtgctgtgagcaataaagttctttaactctgacccagaaattttgtgttttctatcagcatccattaatctgtggcaagctaaattgttagcttgcaagtagggtgaaatctcagattcttcacagctcttgacagatatgttatccttcaatttcaaaaacttatccagaatatgccttagcgttaattattctgttatttttttctaaaatgaaatatgcttattttgaccgaaatattctgttctcttttaagaaaaaatggtttttattatgctttgaatactttgtttcatttggtggattctcttcatctaggactgttgacttgtttcctttgccccccatacattttttctgtttcttccaatggctttaatctctttgtccttctcctatgcattcaatatgattattctaagcttttcccaatgtcagtaatttgttatcagctgtgttctccatttccagatatttccgatttctctgttacctctgtgattttgtttgggtctttgattttttttccttaaaaatcatcttttctgtttatctcatattttagctcttattttactgaattggtttttatattattcccatagtgtgaaactcttatgaaatttttctttccttgtgttctctcttaatttccttcctccatcccattcagatggctccttccttccttcctccctccctccctccctctttctctccttcccttcctccctcccattcagtctggcttttatactccttccttccttccttccccactccctccctccctctcttctttctttctctctctttcttttctttctttttctttctttctttcctgtcttctttttttctttctcagtatgtttgcactgtttctgtgctttttgaaacattgtttatacttgtagtgtaagtctacactacaggtctgtctggcaggtctgtccagacatttaattcatttatatggaatggagttgaattcttctcgacattcatctcttcacaatcagacacatacttcttgtcccttctgaactgcaatagcaggactagagttggtcatcctatcaatattttttcccataatctaagagctcaagggagggatctgttgaattgtatctgatttactggccattctctgtgctgttttatcttcaagaattattaaatgtcctgtgccaggcatcacactgaagcatggagggtatatctgcaggcttcagatgcctcccacagttcagtaataacccctggaaatttgtagctttttcccctgcctattgatactctgacatcaaacactggtttctaggtactctgtacttctcaaaaacattttctagattattttctctctggaaatttacctcagcccttcatttctctccaaatgtggctgtatttgtgagactcttcaggatatgtcattcaccttcagtttatatcctactttcagcaagacttctgaaagtatggagaagagaaagtgtgatatttgaaatattcccttctctttttgggagactgagatgggaggatggcttgagccaaggagttcaacacaagcccggacaagatggtaagaccttgtctcttacaaaaaaactaaaaattagctgggcatggtggcctgtagtcccagcaactaggaaggcttaggtgagatgatctcttgagcccaggaatgtgaggtggcagtgaactatgatcatgccactgcactccagcctgggtgacaaagtgagacctcatctctaaaataaataaataaattgattaatgaagaaagaaagaaaaataaaatattctcttctgtaaaacttgtagcttcctcttcgtttctcttttcctttccttatcttcatctctgttttctttaacataacacttattgattcttttcccttcttttggggcagctgggactaggggatctgcagggatagggtcaaggaatgaccactgggttagaagctaggttccacactggggaatgagcaaatatgtaaaaaaagtgaggagcataggagtgacctcactgaggaaagagttatacatgtgggaaggaggaagactgtaatgaaccctgtggtgctgggttaaaaacggaggtatccacatgaactcatggattttaatatacataatagataactgtagaatacacatagaagagagagactgcgtgtgtgtatgtgtgtgtgagagagagagagagagatacaaatacacatatttcctagctgactactgagagggctagaagcaatgacaccctagtaaatagcctgcagatctgggcttctaaacaccattttctgtcattctctgctaaaaaagaaaccacgactccttgaagaaatggctgattccagaaatgtggcagagaaaatttaagatgagcctggatcattttgttatgacaaaggggaaaaaaaaagctgaaaaaggcatgggtgtcagcttaaaggagctgccacatttgagacaacttaagcatcaaaataagttatagagtataaaccattgaatagaatacaaattcaagagtgacgtgaataaacaaatggataaatacacaaataaattagtaaaagatcaagagaaaagctatttcttggtttgtttgtttgtttgtttttgagatggagtctcgctctgttgcgcaggctggagtgcagtggcaggatctcggctcactgcaagctccgcctcccgggttcacgtcattctcctgcctcagcctcccgactagctgggactacaggcacccaccaccatgcctggctaattttttgtatttttagtagagacggggtttcaccgtgttagccaggatggtctggatctcctgacctcatgatccgtccgccttggcctcccaaactgctgggattacaggcgtgagccactgcgcctagccgagaaaagctatttctaacgtaggcatgtcaaccaattaatgtggaaggaatgacagagcttagaaaatcactattggcagccatcagaataaaaattcaatcaggagccatcaatatattgtaaaaccattggatgaaaaaattttaaactgggtaaagttgtgtttctgtaaccttaaagtgtcaaaaatacatgaaaaaagagaaaaataataacttcatgttggagaaactggacaaatgccactttacaaggcagttgaaactaacaggaccagtgatgggcttatcagcattgctgcctgctgctgcgacacactgaggagaacacagcagcccttctgtggtatttttgacaaaaatgcacaacatgaatccaatcatgagtatgtcagacaaatccaagttgaggaacattctgaaagtcaactgaaaaataccaaaaagtcaaaagtacacaaaagataagaaaagactcacacactgtaccagaataaaggacactaaagaggcctgagtaatacatgtgatgtgcagtcctgtgatgggttttggacagaagggaacaaataagcttcttcttgttcttgattgttcttgccatgaaaggaattaagactgtgtgtgtgtgtgtgtgtgtgtgtgtgtgtgtgtgtgtgtgtgtgcaggaaggaaagcaagagtctgtgttctggcttctggagtcatttttccaactacctccttcaaatctccacttggatgcctaatagatatctcaaatgaaacatgtcccaaactgagctgctgctcgaacctgcttctttagaattatttcccttcccagttagaccaaaaaccccaaagtcacctcagactccacccttcttctcacatcttaccgagttcttcagtaagttctgttggtcgtacctttgaggtgattctgaacttgaccctgtccctactgtgttgctgcgcgatcccctgactggtctcattgcttttgcttcgcttttgtttggccttctctgaacacagaattccaatcctcagcgtaatcaccatttagctcttgatgtcatcagtatatgacatggatgctcagaacccccagtgaaagctcatatacattctattaatgtatttagcagtcataatcctgtaagtatcaaatgtagctgttatttttgtttcatgactttttttccttttgtcgttttctctattgtaaacagagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcggggtaggctggccactctggacaagtcacagggtacccattatttagcaataaaagctttaactcaacaaaatggtagtatttcattcttactttgtgattctatttcattataaaacactaaacttctatgattttaggtaattttttgtttttgagagagggagagaggattttgctgtgtcactcatgctggagtgcagtggcattatcttggctcactgcaacctcagcctcctgggttcaagcaattctcctgcctcagtctcctgagtagctgggactataggcacgcaccaccatgcccagctaatttttgtatttttggtagaggtggggttttgccatgttgaccaggctggtcttcaactcctggcctcaagtgatccgcctgcctcgggttcccaaagtgctgggattacaggtgtgaactgccacacccagccagtaatcatttttaagagaaaataaaacaatgaagcatgaagcacgtaataatccattaaaatgtcatgccttccctagagtactgaacagcagagccagagctttaaaccaaactcatcacattgtttactgaattccaaaaatatttgaccagacatattgttttttatgtacccaaagcttaatttatgactgtcaaaatttacattcagtgtttatagaattagatgagactttgagccgtttgtaaataaaattactgaaacctcaaaaacaaatactatttggtattctagctatgggtacatagctatgggtagtccagctatgggtacatatctctactatttaggacttaacaaggttgaattgtgaactctgaggataaatatgttaaaatccattctgttttcctccaggatacagatttattctgcccccaccccaactcacagtcttgtttttctgcatcgccgtcattatctccttccatcctgagcgtgccttcatgttttcctgtgtctgcacaagactcaattttctgtgaatttgcttgagcaatattcatatctaatatttctagctcccacagaagtgacattttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtgagtgctggtggtttataactgaatttagtgtgagtccagagagggaccaaaagaaaataagaactgtgatgtactgagagcaacagttgccaacaactactgcttattggtactatttgctgataacctggtaggttccaggagcttgctgtgtgcttcttatgtgacatttcttttgtttgtttgtttttgtttttatttttgttttcagacagagtctcactgtgtcgcccaggctggagtgcagtggtgcaatctcagcccactgaaacctccacctgccgggttcaagcgattctcctgcctcagcctcctgagtagctgggattacaggcgcaggtgccaccacgcctggctaatttttgtatttttaatagagacacagttttaccatgttggccaggatggtcgtgatctcttgacctgatgatccacccacctcagcctctcaaagtgctgggattacaggcgcgagccaccgggccctgcagtatctcagtgtttaggtatcaatgtttaggtattgtcatctgtttacagatgagatagccaagcctcagagaagtggagtaaccagctaatgagagagatcccaggatagccgacccccaaacttgaaccattcacattgcagaggattggcatatgtgacagctatattttatcaacactattagtgagatcattagacatttttatccattccttcagtttcacttctcggtggagttagagagcttgtaattgggacagaagtcctccagggtccactcaaaaccagatcgcaggatacccgctgattggaagcagcactgcgcacctcccccgcggccaggcttccaggagcccactcccggttttcctcgctgctgttctcacttctggggctctctcatcacaggctccttgtttataacccggtctggctcatctgttcttgcactccatttatttaaaggtgatagctctggaagtctttcctttagtttgcttacttactgttttatcactgttgtttatttttccccttgggaaaaatatattttgctatattgcttttgaaactattctaacgtaggagctacacagattaaagctctcacttgttcattcttaagtgttttaaagcgaataaggatgcaatctaattaaaactggactaaatcacaaattatcacccaacctaatttacaggggagggtagatacaacttccaggtactaaatgctacacgtgaacccacgtatgtatgtggatgtggatggggtgttataccatgacttcctaaaacctagcttcaggcgtggttagctcttctattaaggtgcagtgaggctttttcaaaggacatgaaaccatcaaactactggaaaggaggactacacggaggggtcaaaccaagaacttgattttctcacttgtaatcttggagattatttaagggaatgcctagaaacacaattagcataaaattcacctagaatcagcattcattgcggtggatgaagcactggcttcagaatcacccacaaagctgattgatagttcagatttggggcccccaccttaggcccaccgaattggaatctctgggaggaggctaaaaactgcattttccagaaactctaggtaatttccatgctcctaacattgagaattgtcgccttcataatggtgtttgtcactacacaggtgttgtaaacctctctaaatggtttcttcagcattcaagtttgacatgacaaaatgtgcatgcatgcagtattcaattactgtttagcactgtaccctctgagaggaggagatcctggggtatggtgtcaccccttccaacttcccctcctttgcttatccatttcctttcacactttatttttagagtccatccaagtaagaaatttatccatatatatttttattattgtgaaaaatttggaagttcatacctaaccattataatgcacattcttattcataaagaaattaaaataatgtttgatgaatgcacattcttattcctaaacaaagtaaaatagtgtttgatgtggtttatattatgtattttgttctttgtaaaggaactaaagtgaaattctttcttacctgaagttaaggaaatgtttttagaaggactatttgccagactcaccatgtttgaaagttatgtaaataaatgttttattcaatgtcatttaaagctgcatatctcataacagttatattttcaaaattgtatatgttcacaaaattttttgacacattgtgattattgccactctccataaggcctgagtttgacatggacataaaatcctgaataaaataccaaggaacacatttctatttgcagtgtttccgttgtaggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatggtaagtgtgaccaaggagcaggttatagggaaagtacatgaaacttaaatagtatgaagaatgcttctggcatttgatattataaagagaggataagattgaattatttgaaatggaataatttctgtaccaaattcctctattgaatttagaagggatatgactgtttttgaaaacttaaggctatcagtcctctctgggtttcttatttagaagatctctgggttaccccagcatctgttcaatgctaatcctctcgaaataatttggttttcaaaactctgtccttgtactgttctaattttaacatcagtaaagcatcattcttatttttgtttttaatttttagagacaacgtattgctattcaagcctctctgttgcccaggccggacttgaactcctaggcttgagcaatcgtcttacccattgtcccttgtgacagtgactttaagtgattcaaaaggcctttatagaaatgtcttttcttataaaacaagcatactaactagaaggggaaaagaatatttaaatattgacagtcattaacaggatcactcaaacactttgctctatgatgtttgactcttcttagaggagtgcagtggggtatcacacagcttctgctcaggtacaatcatgttttcaaaagaaaagggctgggcgtggtggcttatgcctgtaatcccagcactttgggaggccaaggcaggcggatcacgaggtcaggaattcaagaccagcctggccaacatggtgaaacctcatctttactaaaaatacaaaaattagcagggcatcccagctactcgggaggctgaggcaggagaattgcttgaacccgggaggcagaggttgcagtgagtcgagatcgcaccactgcactcactcctgggcgacagagtgagactccgtcttggggaaaaaaaaaaagaaaaggaaaaagggactgattttagtattaagtactctgtactgacttatttaatatatttataatacttttatgaaacctcttacaatattgaatcatcagagctaaaatgtaattgtgtgtttaagtgtctctgggctgttacacttactatttttagcagcaaaacaggctttaatcactataaattgtgtgactttcaaaagaattttgaggattcattatctagaagtcatttaaattttcagaagttcttgcatatgtcttttattagtcctgaagatctctgtgctcacaaatctcatagctctggtgcaaatacagagctctttttatatctcaagccaacatcaggagtaaccactccttcatgagcacaagtgctgatttctaaatcattcccaatccacatttgctaagtgcaatttgaatgttattttataacccaaaattttcttaaggatagacgttatatggtaagtaaatggaaaatggtcctccagtggctggggcatatgttatagttagattacctaatctaataagaatgatctggattttcagtaaattctttatattttatggaaatggaaagagtggagtagtattccaagacagtgatcatcacccaacattttctttttatttacagatatatttggggggtgtgtgtatgtgtatgtgtgtactaaacacatttttggaattaacttgatataaaattaaaatatcaacctttcataaagtgttttaagagaagctgaaagcccttcaacttttctctctcagaatactgtagataccactttggattagcctttctatccagacagtaaatttgagaaacatctttggcataaaagaacatttctaaattctgaccttgaaggagggttggtcttcaaatcaccttttctctagttacttcaggagctctgtttcatgcttcctacaaagtaaatcgatttttaaagaggaggtaacattcaaataaaaaacctggtactctggcatttccaggctggccacataaggagctctgtaaaccctctctcatacgaaacaggcataactagtaaaaattattattttaaaaaacaactattgaaagtctttagaaaatgtcctaaggaaatacatcaaatgaagaaacatttattaatcagtaataacagtgagagtttgaggcatttaagccaagaccctctccctgcacctccccatccctagctcagtatgacggaagctccactctatatggatatagccaagaagccaaaggtttcctctctacccaggtcctactacagagatactgcattaccccaagattgggtgccagcatttcttgtcatccccagttttgtaggacagaagctctgttcacgcagaaacagctgagaagtctggggtttccttcctacaccaactcctcattccaggacataaggtcttcaggtgtggcagctggaaaaatcctgtgtcccaattgccctcactccagcttacttgtaaggaacagtttctccaccaggagaggcaaggcaagaagttacctttcccaccctgtgccctacttgtaagcagaggttttactacaaaggagcaggccactctcactctccacagcttcagagcagtgaggcacatttaaccaagaggtagagggaggccatgaaaatacacagcttggtagccctccccaagtgaactgatttctatttggaacagagcatggatcagtttaagctagtggtatgaagatattggcagtaagcaattaagagaatgttgataactctaagagagtaatgagttaagccagggaagtttaacagagaaaagaaaaaagaatcagcaaacttgaagcaagatcagtagagattatgtatcctgaagaatacagagaaataataatgaaaaaaataaacagatcatcagagaaatatcagacataactaagcacaccaacatatacgtaattgaaaataccaggagagagagaaaggatcagaaaaaaatatttgaaaaataatggttgaaaacatccccaaattaataaaaatcattaatctaagatacagaagctcagtgaaatacagatgacacaaagaagtttatatccagacacatcttattaaaaactttgaaagccaaagtcaagaaggaaattttaaaagcagtaagagaaaaatcatatatacaaggaaacgccaggatcaacagctaacttctaatctgaaagaatggaggccaaaggacagtgagataacatattcaaagagatgaaagaaaaccattgtcatgaagaaacttacacccagcacaaccatctttcatgttcagtagcacaggatgactatagttaacaataatttattgtatatttcaaaataactagaagagtggaactggaatgttcctaacaaaaagaaatgataaatgtttaaggtgatggatatctcagttaccctgatttgatcattacacattgtttggttgtatcaaaatattacctctaccccataaatacatacaactattaggtattcataaaaactaaaaattataaaagatagtaaatatatccctacttacaaaaagcagagaattcactgctattagcctgcattagaggaaataacaaagaacgttccttcaggttgaagggatataacccagacaataatctgaatctacacacaaaaaacaaatagcactaataaatgtaagtgtgcaggtaattataaaagaaagtataatgtcatatttcttacccttttcagtgcttaactattttaaaaagcaatgtataaaactataatagagaatatacaaatatataatgtatatattttcattgttgggcctatagaaatatattacaaaaaaacagcacagaggagacagatggcagcaaggctgtactgaaataaggaataacaccaaatggtaacatgagtcagaggaacaaagaaagagaactagaaatggtaaataagagagtttatagacaaagtctataaatatttatttgatcttgtttcttttctcagattttttaaaaagagaacaaattatataaaataataatgggtttggtatgcataaaaatagttccaaaagagaagaaatagagctatgtagaaataacttttctaaatctcacttgtattaagttagtgtaaacctgaagcagattattgataagatatatataatgcaagcttagagcaatcactaaagaaaataaaacattgtcatgaagtatattaaaaggcctatataccaaaacctagtaggatttatcccaggatttcaggagtggttcaacaaatgaaaatcagtcaacatattacacaagattaatagaatgagaggggaaaaaaaaacatgattatcttaattgttgctgaaaaaaaaaaacatttaacaaactccagtaacctttcatgattgaaaaacaaaaacactcaataaactaggaatagaagggaactttctcaatatgataaacgccatatatgaaaaacctgcaactaacatcatactcaatggtgaaagcttcttccgtaaaataagaaacacaacaagtatgcccagttttaccacctctatttatcatagtactggaagttccagctaaagtcattaagcaagaagaagaaataaaaggcatccaaatttcaatagaaaggctatctctctctcagattaccttatcttatatgtagaaaactcttcagaaaataaaagctgttaagagaaaataaataaattcagcaaagttgcaggatacaaaattaacaccaaaaatttggttgtatttctctacactagcaatgaaaaatctgaaagtgagattaaggaaacaattccatttgcaatatcatcaaaaagaataaaaaacttagaaataaacttaactgagaaagtgaaagacttagacattgaaaactataaaacgttgttgaaagagattaaagaaagaactaaatagatggaaagacattccatattcatgaattggaaaacttgagattattaaaatgacaatacaaccccagcagattcaatctaattcttatcagaatccccaaagcactttttatacaaatgaaaaagcccctatcaatatttaaataaaatttgaaaaagcccagaataagcaaaacaattttacaaaagaacaaagttggaggattcacccttcttgacttcaaaacttactataaactacattattcaaaacaatgtggtactgaatgaggataaacctataaatcaatggaatagagctgagaggccagaaataaacctacatacatacagtcaattgatgtttaacatagtctttgtcaagatcattcagtagggaagtaacagtctattcaacataaaggtaggaaaagtggatgttcacatgcaaagattgaagttagacccttaccaaaattaactcaaaatgaatcaaagttttaaatctaaaagctaaaactataaaatttttagaagatatataggcagatcttcatgatcttggatttggcagtggttttttaaaaatcaccccaaaagcacgggcaacaacaacaacaaaaatagattatttggactttataaaaattaacaacttctgtgtatcaaagaacactatcaagagagtaaaaagacaatccacagaatgtgataaaatatttgcaaattatgtatctgatggaggttcactatctagaatatgttaataatttccacaacttaacaacaaaaagtctaattggacaaaggacttgatgagacatttctccaaaaagatatacaaagagtcaataatcacatggaaagatgatactcgacatcattagttattaaagaaatgcaaacgaaaagtataatgagctgcctcttcaaacctactagattgactataaaaataaataaataaataaataaaaacagaaaataacaagttttggcaagaacctagagaaattggaactctcttttgttactggtgggaaagtaaatgccacagccactgtagaaattgatttagagttaactcaaaatagttaaacatagaattaccttcgaacccagcaattccacttctacatatataaccaaaacaattgaaaacaagaactcaagcagatacttgtatacaaatgttcatagtagcactaatcacaatagtggaaataatacaagtgtccgtcaacacatgaattgattaaaaaatgtagtgtatacatataatggtatattgttcagccattaaaaggaatgaggttctgatacatgatacaacattaattaacatagaagacattatgctaagtgaaataagccagacccaagagggcagatattatataacttcatgtttactagatatcaatagacaaatttgtagagacaaagtagattcaaggataccagcagctgagatgagggggcaatggagagttattgcttaatgaatagagtttaattttgggaagatgaaaaattttggatatcaaaagaggtgataattgcacaacattgtgaatttaattaatgctactgaatttcatattttaaatggttaagtggcaaattatatattatatatattttaccccaaagtatagtgaaatcaagaaagaaattaaaatgttacactccaaaatatccaccaacacaaaataataagtcagaaggaaagtgaaaagaaaacaaatgaaacacatagaaaaagaaaaagaaaatggcagatgtaaatctaactgtatcaataataatattaaatgttcatcgattgagcaatccaatcaaaagacaaatattgtcagaatggataacaaaagaaatcttaactatatgctgtctaaggacatacaatttagattgaaaggggtaatttagttgaaaataaaagaagggaaaacatgtaccatgcaaagagtaaccctagagagccaaagggactatactaataccagaaaaaataaactctaaaacaaaaggtgctactagaaatagggaaacttatataatgataaaaagttaattccctcaaaaagatataacaattacaaacttatatgcagttaataatatagccccaaattgcataaagaatacctgacagaactgaaaagagaaatagaaaaaccaggaataaaacctggaggattcaatacttcactttcaataaaggatagaataattactcagaagattaccaagaaaatagagttgaaaaaaataaaaacgcaatcattctaacacacatctgtagaacacaccacttaacaatagcagaatgtatattcttctcaagtgttcatggaacatattctaggttagacaacatgctacctgtaaatcaagcctcaacacatttaaaaggattgaaatcatatgaagggactttttaaaacacaatgagatgaaattaataacataaagaaattgtggaatatcacaaatatgtggaaattaaactatacactccgaaatcaaaagggaaattagaaaaggttttgagataaatgaaagcaaaaatacaacattactaaaacatatagtaacacagctaaagcagggtttagagggaattttaaagctgtaaacatcaatatttaaaaagaaaaatggttcccaaataaaaaacctgacctgccaccttaagacactgaaaaaagaagagcaaactaaatctaatgtaaggagaaacaggaaataataaataaaacaggagaaatttctcaaatggataatataaaagtgacagaaaaaattaaccaaaccaaaagtcagtcctttaaaattgttaacaaaattggcaaacctttagtacaactgaccaagaataaaagagatgattcaaattactagaatgacatatgaaagagtgatattactaccaaccttacagaaataacatggattgcaagagaatataaacaactgtatgttgaaaaaaattacgtaacttagataaaatggacgaattcctaggatgacactaactacaaaattaacacaaactactacttctgtttcaagaaggaggagaaaatataaattggcctataacaataaaaggaatgtcttaataatattaaaataccacagaaagtaaagcccaggtccagatggtttcaaacaattgatgctatcaactatcagaatatatcaactatttaaaaatatatcaactatttaaataagaagtattaattcttcaaaactcttccaaaaaataaaagagaaaggagcatttttcaacttattctgtaaggtcagtatttccctaataccaaagccagacatagatataccagtatatatattttaaatctacagaccaatatcatttaagtagatagatgtgaaaaccctgaacagagtattaccaaagcaaatccagtcacatataaaaatgactatacatcaagacaaagtggaaatgatcccagaaatggaaagttgttttaacagctgaaaatcaattaatataatatactatatcttagaataaaggacagaaacacatgatagtctactgatgcagaaaagtcatttgataaaatccaacatcctttcatgaatttttgtttaaattcagtaaactaattatagacgataacttcctcagtctaacaaatggtatttttgaaaaactcatagctaaaattatatttaattttaaagactgaattttttttcctaagatcaagaatgagacaagaatgtatactctcactagttctattcagcattgtactagaggttcaggccagactgattaggcaagaaaatgaaaaaaaaaaaaaagaagaaaaacatccaaattagaaaggaaataaaactatctctatttgaggatgacatgattttttatataaaaaatcccaaagaatctacttagaacaattaaaactaaaaccaagttcagcaaaattgcagaatgcaaaaacaatatacaaaatcaattgtatttctacaaattagctgtgaaccatctgaaaataaaaccaataaaacaattttatttacagtagcatcaaaaagaataacatacatagcaatacatttaacaaaagaaatggaaaacgcactgaaaactataaagcattgaaagaaattaaaggtaaataaatggagagatatttcatgtcatggattgaataattaatataaataaaataccagtgttctctaaagtaatatacagattcagtacagtttcaatcaatatcccagctggcttctttcctgaaattgacaagctgatttcatatgaaaatttaaatgatgcagaatagccaaaacaatctttaagaagaagaaatttgatagattcacactgcccaatttctaaacttaatgtaaggcagtatataactggcctaagactaaacagatagctcattgggataaaattgaaagtccagatagatacctcgccatttatggtcaatggattttacaagagtgccaggacaacccaatgggaagaagtagtctctgagactactgagtatacatgcacatgcaaatgaatgaaattagacctctatctcacacatacataaaaatgtaccaaatagacctcaatgtaagaactaaaactataaaactgttaaaacatgggagaacaaaagagaagataacccacagaatggaagaaattattgcaaatcatgtctcttataagggtctagtattcaaattatttaaagagcttttacagctgaataagatgccgtgcgtggtggctcacacctgtaatcccagcattttgggaggccgaggtgggcagatcacgaggtcaggagttcgagaccatcctggctaacacagtgaaaccccatctctactaaaaatacaaaaaattagacgggcgtggtggcgggcgcctgtagtcccagctactcgggaggctgaggcaggagaatggcgtgaacccaggaggcagagcttgcagtgagcggagatcacgccactgcactccagcctgggcaacagagcgagactctgtctcaaaaaaacaaaaataaaaacaaaaaaccaacaactgaataagaaaaagaaatttaacctaattgaataataggtaaagcttataagtagatatttattcagcaaatatgtgtgaatgtccaataaaatcatgaaaaaatagttggcaacattagccagtaggcaatcaaagtcacaatgaaatacctcttcacacagacaagtatagctgtaatttaaaagaatgataataataaatgttggtgaggatgtggagatattaaaaccctcatgatttctgtttggaatgtaaaatggtatagctattttggaaaaaatatggcagctcctccaaattttaaagttggtgttttcataagattgaacaattttactcctaggtatatattcctaagaaaaataaaaacgtatccatagaaaaacttacacgtgaattttcatggaagcattatttataatagtcaaaaagtggaaacaacccaaatgtctatcaactgttaaatagatccgcaaaatgtggcacatccattactatttacatccaatgaaatattattcaataaaatgcataaaatactcatacatgctacaagatggatgaaccttgaaaataccatgctaagtgaaagaggccagattgaaaagaccacacgttatatgattccactgatatgaaatctctcgaataggaaactctgcagagacagaaagtaaattagtagttgcctaggctggggtgttggggagaaacagagaatgactgctagaggatatggaggtttttgtaggagggaataagaaggtgcacgggggaggggagtaaaaatactctaaaattgatcatggcaatgtttgcacatgcctgcaaatatactaaaagacatagaattttacactgtaattgggtctattacatggcatatggattatatcagaataaagatgtttaaaaattaatgatttgggaaaaaattggaaaccaaagatgagataagtcacctataaattatacatttatactgaagaattagttatatgtaaatataagatgaggatgatttagagaattaaaatctctattaagtgttagtcaattctgggttatgagtatattggagtttgctactttttcttcaagttgtagtttttaaaaaactttaaaaagtgaaaaataaaaaataaaacaggaaaggatttcactattactttatctcccaggatatttaaggtttggtctcattctctaaatgtacttaaaacaagaccgttggacttacattttgttaacataacaaaaatgtatttatcatttcagagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggtgaatatcttttgtgtaaagaaaaagagaaccctgagttagaaaaataggactgtaatgacatgggtcttttcagcagtcaaactacaaacgatgagagaaaactgtatgccctccaatgggtttggtttttcagtgcctcccttaatggttattataaaagctagcatttcaagattaaattaagatgcttttctcccattacatgtttgataatttaacggagttgatatgcagttatatttcttattattgataggatgactttaatagtacatgatgactcaaattggttttgcagttcattttgaaataagatatctagatacatgacatacattccctcctcattctaagcaaaatagaggagcatttatgtggatgttatagtgcaactatataaaagccaattcctataagcaacagataagtacagctgttctttatctcgtcagtggctgaaaaactagttatatcacttttatagaagaaaagtgtaatgacagcctctcaaacagtggtaattggggcattgcaaggttttcacagttgaacaagaagaccaagctttaagtttgttaggtacacagcacaaaaatttcatgtctagaaaaaaatctacaaaatctctgattaggctggacacggtggctcacgcctataatcccagcactttgggaggccaaggcgggtggatcacgaggtcaggacatcgagaccatcctggctaacacggtgaaaccccatctctactaaaaatacaaaaaatgagccgggcatggtggtgggcacctgtagtcccagctactcgggaggctgaggcaggagaatggcgtgaacccaggaggcggagcttgcagtgagccgagatagcgccactgcactccagcctgggcgacagagcgagactccacctcaaaaaaaaaaaaaaaaaaaaaaaaaatctccgattaacaggatcttagtataagctaaaagagaattacagataatgagggtacctctgtgtaggagaggggtatgtatattagaagatgtagatactatggaaaccttgtctcctgacaaaaccttttcttgtcctcatttttggattatggcagaagacttaaaataatctggctataaaaaaatctttatgcacatatcagtaatacattaaaatgagccttattaaaagttataattacaggaactgaatgttgatacaatattgcatagagcttcatcatttcataaatatcaaagtcataatgaatttagatctgagttctgagctcatatgcataatttaaaccttttcatttttaaatgaaaagctttggggagactgcttattaacaacacatttagtcttgacttttaaaatagcatcattggactcagagtctggcacaggaatagcatttaagtaatcactgttccaggaaagataactattgggtgcatctaaattgaggctaaatagattcaaaagtgctataagtaaataataataaaagtgctctagaatctgtatcaagagttttataaaataccactttaattttaaatgccatttatttttctttttaggaagtttgcagattaggtacaagctagatagacatcaaaatcctgatgcatttacctttgattttaaaaatatggctgatgggcaacttcaccaagtgaagattaacagagaagaagccgtggtcatggtagaggtaatcccacaaatgcaaaagtcaaactaactaatattattattttgagaacaaataatctaatgaaaaaatttgacaataaatattaatagaagagcaacccattcagtgctgctcttccataagtcaagaagaggccaaatatggccaggatctgggagagaggaggtggttgtttattctgtattgctttgttttgtttgtttagcaatgcaattctgtcaaaggtattattaatattttactatttaaaatatcaaaatatctttatttgttttactttactcaataggggaatgttctctagtttatcatagtgactactggtggaatctattcattgatattgcagtgggaacttgtcttattccgattataaaagaacaaatactttagcaacttaaaaacacggtttaaaagcacacaacatagttattaaaatgggaataagtaagaaaatagacctgagtcaccacagaggaagtaaattacacattgtcattggcattggaaggaaaatacactgtatagagaacagcagtgcttggttttatgtttcatattttctccacagaatgagtacgtatttaagtttaaaacagccagttccatctttttcatggattctgccaattatagatccttccattatgaagaagagtaaagccagcaagtaggtacatcgtggatagagtggtagctgatggcatcataggaattgcttataaaatagcttccccttctaaatgattaattatttgaaggtggcttcttgagcttttgtagtggtacttaaaagtgatttattttcatctttcctttcctcatcttcctttgcttccttatcattaaaattgtactttgtgttgatgtttgcttctcatgggacatctaataggttaaccagagcgcaaagaaacaagtcatcttgtcctcagggacagaattcaacgccgtcaaatctctcatattgggaaaggttttaggtaagtaggagaaagagctttttcccaaaaaatctaagtgtcatgtcacaaactctggaagcattcatcatgctgaaagaagctccttgtcttacttgaataataatttcacagtgagtgacaatcaaggtgcaaactgtactcttgcctgagtgtacatataatcatgagtaagtgctgcctgtgagatgtgcaagggcgttcctggaaaaatacctccacacttaacctctcacttggcaatcatgcataatgaatcacggtatttttctaaaccttcttgaaaagtgaaatgttatcaaagctgacacgaagttcacagattatgtatgtattaatcaacatcaactccggagaccatcattcaatgataaaactacatttgaggtgaacacaagagaaaaaactggtaatcttattacagcagatgaatacagttttatttctctctcaagccctgctttgcctgttgcttccatcctttttgactttagtatctaacaggaatggggaggcatattcataaatatctgttacgcaaggtagaaagttacagtaattgtctatcatattgtctatcataacctgttgtaaaagcacagttagctttacatttaataaaggaactgaggaaagtaatcttttttaaaaaaaacccatcttatgtaactcaattaagaaaatgaactatactttaatattaggatcaaaaagttgaataatatttattatatacatctttgtttccttccaaataaaggagaacatggaattgaaggtgttaatgttttcattcaaggatggtatattcaaaggcttgtaacttacggtataaaaatctacattgaaattcagcaacgaagtatatactcagaagcaattgatctcagaaaattataaatattcattttgcctgtccttggaggtagagataatcatcaaacattaataaaacactttatactttgaaaaactgtattttaggattggttctgctatacattttttgccactctcacatcatttagtaattataccaaaactacaactttatctttaaatttggaattatataggaagtgctttccttaacttatagtaaaatagaccaacaagttggctaatagagaagccactaattttacaaagaaagttacccaaaacactgtgttctaagttaccaatatatttctcttgagtccctgtaaatctttgattcatcccttcatttaaaaatatttggtgagcggctgggtgtggtggcttacgcctgtaatcccagcactttgggaggccgaggcgggcggatcacgaggtcaggagatccagaccatcctggctaacacggtgaaaccctgtctctactaaaaatacaaaaaaaattagccgggcacggtggcgggcgcctgtagtcccagctactcgggaggctgaggcaggagaatggcgtgaacctaggaggcggagcttgcagtgagcagagatcctgcactccagcctggatgacagagcgagactctgtcgcaaaaaaaaaaaaaaaaaaaaaaacttggtgagcatctgctatgaacagtttattaagcacggagaaagcctctgaatgagagaaacactatacctacccaccctcactacactcacatgttaataggtacataggctaatatatgagcaattctaataaaataatgctcatatccagcctaatttattattatgcaccctaacaatgccttagaaaaaaatggcccaaaatccatcataattaagatgctgtttctgagcacctcaatatgattttgccatttctgagtagtcttagtgaatgaagaccattcagattgattatcacaagatcaattcagagtaaacctatttaaatataagctttttagattctgaattttctatatagctttgaattttatccaagaggtagctttaaagaatgcaaacacctaaaatactttataattcagtaaagatgatccatcataaattaagatttgtttttagatactttggtattattggtattctttctgttttgctttgtgtgtgtacatgtgcacatgtatttaaacacttttgagatgagtatcactctgtcgcccaggctggagtgcagtggcgcaatctcggctcactgcaacctccgcctcccaggttcacacgattctcctgcctcagcctcctgagtagctgggactacaggcgtgtaccaccacgcctggctaatttttgtatttttagtagagacggggcttcatcatgttggtcaggctggtctcgaattcctgacctcgtgatccacccgcctcagtctcccaaagtgctgggattacaagtgtgagccaccgcgcccggccccttaaacactatcttaaaaattacatatatatatcaaaaatacagagtgcaaaaatggaagatgcctttttgctcccaaaaagtaaaaaaaattagcctgtaaacagttgcctatgaatacagctgagcttatataccttaggaggtatacattctaggctgaagaaaagaaaacccactgaaggactatatttcaaatagagctctaggtatgtaagaatgccaaatagttttggtaattaaatatttctggaaattgccttttgagttttgtaaggagatgtcacataagacatacagttttaacatttaaaattcatcaacttatgtattttatattacttctatactatggtgtttgtctcatttagaagaaatgttttatgttgggtctgggatttgattttacctgatttacaagctaggaagttaacagcttttaactgttttgtggatgctgtcctggtacagagacaaaggaccctattactcatggcacggcaagcctcgtgagcagcagttcatttgcattgttttcccttggccctgaagccttatggggcagtgatgggtgcagatgaaggctgcacctgcggccaggtttgcactgcagcagaggaacactgagtttggggaatccaccgattttgtaacaagcactaagcaagtctattctttgtcctggagggggtcatgaccttatccctcaatgttgcttgcttcaattataaccttgagaagtggcctgagtaaagtgctgtcagcatcttgcacttcttggcaaacccagcaaagcatgaggagacactcagagccaatggtggattgcctctttcaacattacagaataaaaacacccaaaaaccctataaaaagtcaagaagataggagattttgtggggtttttttcccaagaaagagcaatgattatatcaattagtcctttattggtaaaatgaggaggctgcactaagttatcttcaagattctcttcgatagaaaattctaagattgttctaacttggtccattaaccaggattcagtgggcatcacagatgtcttgaggtctttgaaagtataagtcaacaaaactaatgctgtccaatagaactttctgtgatgatgaaaacgtgtaaagtctgtgctgtcctatgtggtagtccccagacacacttgagataaatgagtttttaagcactagaaatgtggctagtataactgagggactaaattttacattttatttcattttaattgatttgagtttctttttttttttttttttgagatcgagtctcactctgtcatccaggctggagtacagtggcgtgaactcggctcactgcaagctctgcctcccgggttcacgccattctcctgcctcagcctcccaagtagctgagactacaggcacccaccaccatgcccggctaattttttttattttttattttttatttttatttttagtagagacggggtttcaccatgttagccaggatggtcttgatctcctgacctcatgatccgcctgcctcggcctcccaaagtgctgggattacaggcatgagccaccgtgcctggcctgatttgaatctcaatggtcacatgtggctagtgtctaccatattgcacagtgtagaagactgtccacttacttatctagtagttttttcctttagttcaaccaagtggcacccttttgtaaggatagacatctgtctatttggcatgacttcaatgggctgggaagacaaccctatctcaaatattttttttcccacaacgtcaagtgccaatatttcaaattctgtattagagatccattcttttgactcttctgccaaaatacacatgcccctgaaagtgttatcaaaagccatgaccaggaatttgtgcaaacatgaatttactcgggagcaggctttgatggaacagaatagagaattggaagggggctgggtgcaggaccccgaagttgagaaagcccagaaagggaggcagacaggtcaccatacatttttgattagagctatttagctaagagtagcaaaagtgaagggttttgaccatgttgccatgtcaaggtaatagacaggaaactgtatctacatgtcaccacagttaagagttgagttctactgaatattggttaactgataaacaataaatagtagtgctggctaaaatctgggagtacagaatcacgagtttcttcctggattgtggtgtgattgccaggtacacttcagagtgggcaaaggaactcctttctttcagattttccagcttaaacaaagtatatatgaccattttctaattaagtcatttattaaagatgtaagaaagttctactctgtttcatcagctccaaattaaacaattgctcaaggtttttattcagggttttaaagagaagtctggccaggcgcagtggctcatgcctgtaatcctgacactttgggaggccaaggtgggcagatcacaaggtcaagagatcgagaccgtcctggccaacatggtgaaatcccgtctctactaaaaatacacaaaaaaaattagctgggtgtggtggtgcatgcctgtagtcccaactacttgggaggctgaggcaggagaatcgcttgtacccaggaggcggaggttgcagtgagccgagattgcaccactgcactccagcctggggacagagtgagactccatctcaaaaaaaaaaaaaaaaaggtctgccctaaaattatgtgattcttctctaaactacagttacttaatgtaaaaccatcttgtatcatgtcaaaagataaaaatactcttgttaagatcgtgtggcagactttattcaggactatggcaataggtataggaattactggaatggggctttgcagttggggaaagagactgagctcaacttcaaatacaacaaggagaagtgtggattcgtagccaaggagcagagtggctggggtggggtgtctgagtggtaaactacaaaatgggagagtaattcttgctaaactgactcaccaggtttcctggtgatgccaggccagtgttgtcagacatcacctgtggggtggtgagagggatgagaaaggtgattagatattgagagtgatcagatattgagggtgggagatttgggttaaaagcaaattggcaggattcttgctaagctggacgatgaaagaccaaaggtcaggctggttgagcagagagcttagagtagcctgaccaacatctggtcatagggagaatctttgtccatcatgtcaaagttctttcttggaaaaaataaattatgtaaagatccttgaactggaaacatcatagaaaaatagaaatgtaagagaaattgtcattctggtcaggatctaaatgtactagagtaaaaccaaagaagagtaaaaagggaaaagtgagagaagaaaaagaaaaatttcccaagcctctcatttagggaagaactgttgtggggaaccccgcggtggtgtgggagggagggtggggagaaagaaccatgcaatcgctcatctcactgttgggaatgggggaaagttggaaaaagaggatcttgttttcatataacagtgtgaaggaatgattttgattgtgagggctagggaagttgagctctcaaactcataaaagggaaagcaggaaataagaaggaaactgattaaagcagcaaaataaaagaaaaaaagatgaaataatgtgaaataaatagtgtaagataaaaaataaaatcagatatagtggttattactctaaagacaaatggactaaattctgtcaaactaggtttaaaaacaacagttaaatgctcttagaatattgaaaatgaaggggcatgccaagaactagcaggcaacagctgataaatttaagaaatgcagcactactttcagataagattgaatttaagattggaatataatcgaatcttaaatgagataaagagggatattatctgatgacaaaagatacagtttattaagataatatgaaagtcatcatacaaaatagcaactatagtatgaaggatttccagagctctgccctcatctccaagagtcgcttttctgtaatcctccggattattggctgtgagcgccattaaaattttattttaatgctatattgtaaaaattaaatggcagaggatttcttaaatttatgccatgtaactgctttcctatgaagctctgttacttgcagagagccagccatctgcacttgaacaaatctgttaaaaacctgcctttcataaccctgacaatggaaatagttgcctaacaggtaaagattcagggtgacctctcctggagtgaaggaacgaggggatcggagggacctctcctggagtgaaggaacgagggtcgctgtcttgcagatgcggggtgtccctgcgcccccatctccgccgctgcgccctaactgtgtgttccccttctgtcctcagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcggcgggggcggcgtccggctccccggcgcgggaactggctccccgactcgcggggggcgcaggtgtgtggccctccacccctgcgcacctgaaactgcgcttctctcaaatgtttttgaatttctcaaaagccttcttttctccgtctctgtcatccttctttttttcgttttttaaaatacatttttgtgatgttcttattttaattcacttttaattgacaaaagtttgctatgtgtaaattgtggcgtgattaaatcaagctattaaacatcattcttcctttccctgttgtaggtcgttctggaccagtggatgagggagagcccttggttaatgcagacagaagagactctgctgtcatgggaggtaacaaggccctgaatgacctggtgcttgtcattatcgctttagataatgataccattacttagcacaatgggaaatatatgtaagcatcaacactcaatggtgaggtcagaggggtgctatgtattgcggttggtggtggttttttgttttttgttctttgttttttttctatttgagacaagagcctcacgctgtcacccaggctggagtgcagtggtgagatctccactcactgcaacctctgcctcctgggttcaagcgattctcctgcctcagcctcctgaatagttagggttataagagtgtgccactatgcctggctaatttgttgtgtttttggtagacacagggtttctccgtattggccgtgctggtttcgaactcctggcctcaagtgatctgcccgcctcagcctcccaaagtgctgagatcacaggcgtgagccaccatgcccggccttcgttgattttctgaggcagtatttgctgatttcagcttccctgggggtgctcagcatgtaagaattctgctgaaacaattttttttgaagaacagttacaaagctaataatgaaaagttattaatttgaaaatagctgtattccctaggacatgcgggatatttgtcacggtaatgacaactgttggacggacctgaagtaattatgttcaaagcaatggaaacctcagctaattatcagagcatacactttatggtacttttcttcaatgacaaatagtatgatttagatactcccatgacaatgtttcacttatttaagaagtttttgtttgtttgtttgttttttgagacggagtctcgctgtgtcgcccaggctggagtgcagtgaagcaatctcgacttactgcaagctccgcttcccgggttcacgccattctcctgccgcagcctcctgagtagctgaaactacaggcgcccgccaccacgcccggctattttttgtatttttagtagaggcggggtttcaccctgttagccaggatggtctcgatctcctgacctcgtgatccacccgcctcggcctcccaaagtgctgggattacaggcgtgattatttaagaagttttaaaggcacacattatttaaagtgtattgttattttaaagtgtataattccctgtcattaaggacatttacaatgttgtgcagcagtagccattgtatgtttcacttttaatcatactttggaaagaactaatctaataggctaagaatgttttgtggttatttttaattgaagaaaagtgaagttaagcatagcttaaaaatatgttttggcaatgaaaactttttttctaaaatataatttatttagagctggtgcaaaaaataagcattcacctttccttgttaattaatgagtgaattattgaaatctttgtttgtttgagacggagtctcgctcgtcgcaaaggctggagtgcagtggcgccatcttggctcactgcaagctccgcctcccattctcctgcctcagccgcccaagtagctggggatacaggtgcccaccaccacgcacggctaattttttatatttttagtagagacggggtttcaccgtgttagccagaatggtctcgatctcctgacctcatgatccacctaccttggcctcccaaagtgctaggattacaggcatgagccaccatgcccggctgagttattgaaatcttaattgtattcttattctgcagactctccatagcacatacaagagtaaactagttgtgtttgtttccttcaaaatgacaggaaacaattttgacataataaagttctgactaaatttcagttgaggatattcacatttccatcactatctcaattctttttctcttagaaatcagtaaggtgtaaattaaaaatacatgacctgatgaacaaaaactgttttaaacagtttccagtgggattgtggtcaataatgcatatctaaaaggtatactttcgtgttcaattttaaatcaaatccaatcctaaatcaatcatgcctttttaggagatttttttcattgcaatgcaaaagcaatttcaacatgccgaacattttcacgctaggtttccaagtcctacagacgtttacacaatgtcagggttagtacccagcttttggtgagaaggaaatgggcaagttgatcatagaaccagctctttggaattgtattatattgctggtggtcaaatatcactggcaagattgacggagtaaacgtaaggaaacatcttagcagtgttctcttccgctgagaaattcttagcctgaacgaggggatgaaaaggagtctgtggaaggcttcccctgggctttcccaaaggcaatttgcattttctaatagggactggctgaagatataaattaatatttgtgtgaagtactttaaatgtacgatgtaggcagtaaaagcgtgggggaggaaatataatttctcctcatcattcctaactttgtagttgggacagacctctgattaacaagagaaaaacaagcaagtttactaaggcatgcggtccacagcacgtgggagaaacctcagtgaaactcaaagcgcagtggcttagaagtctggctcatcttcaacaatacatttgcggagaaatgacaggacaatggaaagcaattttaggtgtccgaaggcgagaaaccgtgggaagataaatatatgggaagaaactagtggagtacgtgtgtttgtacattcttctgctgacatccctgagctggtaagaatggtctccggtaaaagataatttacatcctgtctttagatgaaaagaggggaggatctagagagctcttcctccattggctgcttcttaattgcctttacttcaaaatatttgtcaaaaaggcatatttgggggtgacatattctgattaccttcagaagcttgtctttatacacatttatttcttttagggtagattttactttcatttgtcactaatatgattgcttcagtacacagcattctgtggcatggcttcatgctttagcactctggctctgaattaaagcctgaaacaatttataaagatactggtatccaggccttccattcatttattctgatttactgacttagtgtgcagctagagtcgagaatcatggacactgctaatggtttcaatattttaaaacattttgcccaggtctttcaaataatccacattccaggtaaaaaaaaaatgaataaatatgcctgcaatatttttggtaatagggattgattacatatatgcgaccctactgcgtttgaaaagtatattatcggccgcgcgcgttggctcacgcctgtaatcccagcactttgggaggccgaggcggacggatcatgaggtcaggagatcgagaccatcctagctaacacggtgaaaccccgtctctactaaaaatgcaaaaagttagccgggcgctgtggcgcgcgcctgtagtcccagctactcaggagcctgaggcaggagaatggcgtgaacctgggaggcggagcttgcagtgagccgagatcgcaccactgcactccagactgggcgacagagcaagactccgtctcagaaaaaaaagaaaagtgtattatcataaaagtatttgaaaacaatttcattaaaatgtacccatttcattgtactaacaataacatgtaatgatctatgatgatgcaaacactctatacttgtaaaatgatttaaaatttcccacttgttaactgaaggatgtacgcggtcttagagacatgtatgtctctattcttttaaatctgaaagcattatctaaaacccaatcatcatatacctgtagggaaaaagcctaacacagccatatccaaaagtcatagtccgtcagaagtatgttaaatgttataaaattacttgacctcagcatttctgagttttggtgttttcaatttataatataataggtggttggtttattttaaccaaacttaaaaagcaatgatgtctgcaaagcctctgattggaccaaaagtcaccatttatactctgacattgaggccaggcacggtaactcacacctgtaatcccaacaatttgggaggccaaggtgagaggatcactttagcccaggagttcgagaccagcctgggcaacatagcaacaccccatctctacaaagaataattgtaaaaagaaaaaaaaaaataagctgaacggtggagtgggcctatagtctcagctacttgggaggatcaaggctacagttagctgtgatcatgccactgcactccagcgtgggcgacagagtgagaccctctctctaaaaagaaaaaagaaaaaaaattatgatgttttattcttttctctccctaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagtgagtcttctgattggcagctgtggctgtctctatcatcgtgactgtggacttccctgctgttgccatcagggtgcacacagcaggtgcagtgctgtcacctggctgaagatctgcagcctcagagcctctgggaggtccctttctccctcggtgaaacacagtcctccacatcaatttccaaacaatgaattagttatggccattcatcactgttcagtagtttccccgtccaaaggctctcttccaaaactgcagtttgatctgtgttaataattgtggggttttagatgagaaaatgactataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacactacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaaatagcttaactgaagatcactaattccttttctaaattttgaactgctctaggcataaatatcattgtgtattatcctttcatctaatcacttttggaatgtaaactgaaggctgttcactccaagttaagttaacatttacatgatgtttattaaatctgccagtctgatcaaaggtttatgaccatggggccaaattcccatagattacccaaaattgaatatgtgcagttaactggaacatgtctcattaaggtttacatacacactaagacagcaaaggattggaattaactttatggagacagttccagggactaatattgaagcagtggttatttgataatgcatggaaccaccatttggattcaataaaccaattacataaaagcaatgatgctacgctcttcatattccagataccaactgcctaccaaggactaatgagatggtatatttcttccacatcagggcaagctgaaaatatattgattcagcgttactgttatgtaaatgaatttccatcttctcatatgtgttatttttgaaagaatgaatacactctctgtcttaaatccgctcttaacaaatgatctcttctcagaatactacatctgtattgagagtacagacagcccattggtcactgcaccttttgcaagacagcgaaacggatgcatcaaattgcattgatacatcatcaccatcaatcttttgcactgatttttagacttaatcttcttatttgaaaataaactcatttttaaataaaataaaaaatattttagggaaagctctataaaattaaaattacagaattatatgctttttaaaatttatgcaaaaatgtgcagacaaatgtattctgtattggtttatgtatcactttgcccttgtatattttgagattattaagatttgttgacttttttggtttgatatttatcatctgttaaatttttccttttaaattattaaatgcaaagtgcaagaa

SEQ ID NO: 2286 - DNA, 1258 bp, Homo sapiens
agtcggctcagccaatgcgcatgcgcgaggcgggagcggtttctcccgtcacagtggttcccatggttgtcttagaaaccagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggctgggacgggggaagcagcacgggatcccagcctcaggcctgcccggacggtgttggttggggtgagtctccccaaaagtcgtgccgccatccgtgatctcgaggacaggtcggcctgcgtgcccctgggctgctctctcacccgagggtcgttctcgtcgtgagcagaaccccgcagcctcaggggttgcctggtggtgtgtgtttcaatgcctctgctgtatgacgctgtgtgtgtgtctctgtgtgtgtgtgtgtgtgtgtgtgagtgtgtgtgtgtgtgtctgtgtgtgtgtctcccagtctctcttctctctctgtctctcagtctctgtgtgtttctttccctctctctgtgggtttgtgtgtgtatgcccgtgtgcgtgtgtgtctttggccgaatgtgccctgtgcgccacaaagcggtttgtcgcatggcggcctgtctttggtgagcctctttctgcgtctctacctgggtcatgaggccggctgtcaatcgttttcgccgcggcggatccgctttgggtgcctgaaagcctggcccacgtgaggagatgcgtcgctcccggagcaactgaaatctcatccccatcctgagtggcctcttttctaggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgtctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacacttcctgga

SEQ ID NO: 2287 - DNA, 1368338 bp, Homo sapiens
tttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgtttttttttttcctgctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtgggtaaggtcattttatatatgcaaacccatcagtggcatgagcaaacttgggcatttgtaatgggaatgggtgacttgaatgattgctgcatcgcattgatggctgtgatgtggccgttattggcactgaatggaataactgcagttgggtgtgttgatatgtgtgtgtgtgtgtgtgtgtgtgtgtgtgtgtgtgtgtgtatgtgtgtgtgcgtgtgtgtgtatatgtatgtgtgcccgtattctgagtgcaattgaaaatcaaagtatcactctctcccccaattattttgatatggaagagtgtcttgaattaattctgggtagacactctttgtttgaatgtaatatttgtggcccctgcgttctggaaggggtagcagcagtaaaagaaacacttagtgaagagccccatttaaaatgaaacgagctactctctatgcattaaaagaaatatgttttcaactcagtgcagcattctgctgcatttcacagccgcaatgggaccagggacatcccacttgtcaagttcttaaactttaaggtgataatcatcgttaattgttctctaggttgtggttactggagattattaagcgccctgggctacttttttatctactggattatcactcagagtgaaaaaaggaaaagaaaagaaaaagctaaaaatgatggctaacatagagaagaataaggcaacattatcttaaatatcaccacagtgctttctttctcaagttcaattgcccaataatataattatttacccaatatcctaaatagctgaagctgagacccacgtgcaggggagtcgaaggtctgaaagcagagaccgtccttttattgcaatgcagccagcttgggaaatgcaggcaattaattacatacttcccctaaccttaagttgaagatgtgtcctgtctgctacatctattttaccctttcggtaaaaagttagagactagaacactaaggatgtttaagcatattctgcctgggaaatgggataaagaaatcaatattgatgacgtggttcagtgcactgtactgcaatgctaaagttccatattcagtgcctgtgatgagagagtggagcatttacatatgttataaatctcacctggtagattgatccaaaggggaggggagaagatatgtggatatgtaggaagatggatggaagtcgtgcataatcggtgattatgtaacttcattacatcagcgagtttcagtcaacgatagtgagatgagatgattgtatagagagaggctccatcaccctgttaacttttgaaggcttgtaacagctaacagaggaggagggcagagagagattagctccaagggtcctgtaaaccttgatctctatggcaaattttgcatgagttttctcatagtgagtttcggagggacatcagatcatataagctttagggctggacaggaccaattttagccacacccgtggagagtcaaaatgagtctgcgatgtttcagaagtgccccattgagtaactgggactgatgattccagccaaggtcatagttctttaccctaggattgaaatatatgaccccaactgaatggaaagttaaattcattgaaatgatgactgtgaacggaatgaatatttagggtcctttcttgcatttttcctggtagagcttgatgcagatttcagcctggtggttccctcataaaaatgatgattgcttccacagcgtgtcagaaatgactgttttgtccctttatcttaaccatgacaatctctttctgggccattttaaccttctgggaaaagagaagtaaaagcattcaaaggtaacagtaccctgttaaattacaaattaaatggcactggattcattattaacacaaatcccagaaaaaaagagcaatccatgttcaagtttcacttattgaatggcttaaaagacaggttgcagctgccaaagacttttaccatcatatgagataaatgtactgtgctcactgtgcagagaagggaatactgcagaataaaatgtcattttccctcatgttttatctggagttgtgattttttttaaagaagatacacatcaggtccttttggccttctactgttttaggatctgttttctcctcaatagatcacatattcacaaaaaatgaaacttctgaaatcctaaccctgttcagttgaatcaccttattatctagttgtgctatttcctatttctctttacatttattttacaaagagggctaaacgacttttctgtcagggagatgagatgatttttttctgtttttcttttatttctcatattccatttccttccagtcctaaggagtaagatgcagaatctagacaccctctaagtaactttgaaaagatttgctcaccctgagtcagaatggtgggattggggaatgaaattctaaggtctgatatttgaggtgactttcatacttctgcaggacatgcacaaacattgatgtattgtgccagtggattgggaggtttggcgttcatattgtgtaggaaattgaatgtgaatttaactcctgattccttccttcaggggtcagggtagcacaacagctgcttccaggctgttggtttccaactatgtgcacaaatatagtctgtaatgatttttcctactccttctttcaatattttataaatgacttcctcagttgttttctgacgtaagccacacatatgttaccaagcagggcataggttttctaagctcagtaggagatggaaataatagcaggatggaaaaagattctgtacaaaaagacactggttgtgaagcaaatatacatatgtaattgctaactccttacttgaagactgcatatacttctattaggaaagatagtttcaatcatgttaatggcactttataagctgttactttctttaggaagattatgtaactaaggcaggttatggcatttttcttaagtatcctacacattagtaataaaaagctttgtctaataggaaagcatttaaacatgatggcagtgggtaatttgaaatgtaacatctattttctattttatttccattttgtcagccgcagtcatgtagttaggttagaaaatatttgggaaaaaaagaaataccatttatgaatatgaaagctatcaattttgcttcctgaccagttgcttcagcaaagtaaggagatttagcagataagtaatcacggtattcctaaaactagagaaaattttaaattgaattttcattatgtttgcaacatatgtgaacaaatcagtattacttttaaaatggctattagataaaacattttaaagaacagttgaactttgaagatttatatttcagaatttgttagtttgttacacactgaaatgtttgggatgtactttgacttacaacagatatgatgtttggtgtttggcaaatcttgtgtttttataaagcagactactctataatttgtagcaacaaaacaagtgttgattattgagatttaaaagtagcaagttttctggtgatgctcaagttataaagcataattataattgtaccggttgggcagctataggtaaggtcgcgtcagcctttttattactaaattccaaccctatttccattaggtttatcgggaatctcaaagaggagagtccagttctgtgagacatcaaggcattgtagaattccgggctgagtcagagggctcgaaactgtacttccggctctgtcaattactagccttgtgacctctgacaccacatttgatttctcagtgttccagagaatcattttttaaaaaaataaatagttgcacattgctctacagaaaggagataatatgtgtctaagtacttaccaccatcctatgccttagaaatatatggaattattattaaggattcccttaagtcttattaatttagctgtgcatgttttttacacccttattgtaaatctgaataggtgctttctagtagcaattacagttagctgtacataatactgttcagtgattaaccaacaaagacaaattaaaagctttgttggttaactttcactcagtactcagttttttccagaagtactcatatgggaatatagttgtcttaagtaattaaaaaaatagttgcttttgaataacattcaaacagtggtaactaagggttttatgtgtgagagtgttttctgcagattgctttttaaaaaatgcttctgagtacttaggagtttctgtttctgctaccaagagcacacaaacaaatgtacacaaacttgatgctacttcacagactgagtacattgaccagaaagtgactcttgtctttcagtatattaacaaaagcataatgagtttgaataccaagtgtaatagagaaaatgagaatataaagatacccggtctgtttggaattttctagttgtaataattactaactttctttagggggaggcaatcccccatgtgtcactactaaaactgcatctctttaatgttcttgtatcttaacagaatgatatttacatatatgcaaagaggatagtttagtgatatgagcttccatgtatgtttttcagtgactgaataatcaggttacagagtaagtttttgtattttggttaaaatagaattggaaagtgcaaaattaaccctgtaataaattagtagtcctgggcttaaaataaagaattttcatgttgtagagcaacctcctcttcgtaacttcccagtgtcttgcttttcttttcaaggattcccaatatatttttgtttcagatgaatttcattatgcatgtttatctgacttcattgatgcctattaatagcaagcattttcttggtttcctatatttaaaaaatgcatgttctttatgtcttatggcaatactttagatttgctctggcagatttatgaaagaatattgtatgaatgtagacaggcttgtttatttgacaaattcagctaatcaccttacaaatatgcttttaattttcacccagaaaatgccaccctggagtgtcttatactgcatataacattctattacagtccaaccacatggctcagtggacatacttatccattaagtatgcttatcctgaccattggtttactaggaaagatccttaattgacatgctttttggtatccttgtgtagacacaatattcaggtgcccaaactctaaaactcctgtcttttagctacagagaagggatgactaggtggcttgatgttgctttcttatcacatgatctgaaaatcccaggcactgaactgtgaataaagcaaagggagaaagaaaagaaagagaactaaaagaaaattttacttctgaaaattttgctctttcccattttaatatcacaatattaaaagcaatcttttttatcacaagctattcaaatggtttgttatagttactatgctcatatatatcaaatacgataaatggcactaaatgagctgctttgttcttacaggagctacacctctgtgaacataaatttaagagttaaactagattgtacgttgtaacactacgtcaggatattgtgtgtagaatttggacttactgaaaaattgaaatggattgtggattgtaatcatataattatagacttttactctttcgatgtttattaggtatcttatactttatttgaattataattataataaatcagcatatggataatcataaaattattcatagtagtttatcttcttatgacctaatcaaaacgagttaccttatcgatgttttagattaatatgtatgacttggtatagtgatcttcatcattttctggtgcaaagttccctttttaattaaaaaaattcactggaagtccacttagtcatagttatactttcagtatccattaattgagaaaatgcatgataataatagtaaattattatgaatataataactctttaaaaatgaatttatgtatagtcacaacagagtctacttatatctttgaaatgcatggtttattctatctacatagaaagtttggtgtttatatagattctagattccttggagtaactcctgcagctgtagtaaataaaagatccatatgtctagaggcaaaatacttgcattacatatacatattaatcatgttcatcttacagagaaaatgaaaggtaagtgcgtatggtggtggtttgtggatcaaaggagttgaatttcggtatagatggacttaagagtatataattttctgaggatgtacatttagagttccaaaatattcccattcgagttttaggattcaacagttgtaatttaaaattggttgattttggaaaataattgcttttttaaaaaataaacattgtttttattgtagccaaaataaaaatgaattattataaaagccaaaggtgatcaaaatctcataaaaacctaatagaattatatgcattataggagtaagggatgccccattatgtgattttaaacaaggaatttgcaaaccagagaaatgaagtgaagtttccaagatcttacaatttgttggctctctcatgatgcatgatttcagttccttcatataagccctcagctgggtgttctagttatatagcaatatgtcctggcatacagcattattttttattagtacagctaatgttggcatatcgaatcctttggcctctagcttactttaccgatttgtgatcagtcgtctgacttctgcactcagaatctgtggactttatttttcctttacgcacacctgatttttgacctcatttgatccctggagacacaatacaaaggagagttgagaacataggtcactggtgggtcttcttgtcttttccatactgtgcttttcccattagctttgtatctttccacctgcagggaattgctcttctttggagcctctccactttctggactttcctgaacatccctggccatctttgtctcagtgctgcatgctaccttcttgcttccaggggattccactaaggggtcctatcaaaatatcttctagctacactttatcccactttgacgatattgaatttcatatttcatttcttcatcaacagggtcagtctgcttacataaacaatagtgaaccaattttggaataatgaagacagtaatattttatcaagtttgccaagctacaatcatataactactactaaatgaacaagatacagctggtgtgtgtgtgtgtatcctcatatcctaatgactgcattaatatgtgtatccacacacatacatgatttttgttgaaatgtttgacaaatgaatcatcgttaatatgctaaagaggaaagtttggaataacaggctttatccctttgtattataatagtgacatttctagaaaagatgccattaacttctgaccccgaaaaatagcttgaaaggactgcattttagatgataaggtggagacagggctgtggaggacatacttttgttcaggctgaatcccgcagtgccctctagagttactgggtagggagctggtagcatacctgtatgaagaaatgacactggctatgaacactatgatgcttacaacctctctgccaactttatttcagaagagacacagtcaggagagctaaatacagtggtaaaaatggaaaaactgagagagttagaatggtatcaagtattttgtgtaaacaaagcttcatgtggccaagggagaaaatttgaatgtaacaaatggatctggtagctctcagtgtttggtttttggatacccctattaaagctcctaattgttctcaccatgacagaactcctgaatggtactcaagaggcacccagctccacagtgtgcagagtaaatgcattcaagggatctctaggggtttttgactctgctgttttttcttgtcgaggttctcctacagggcccttaataacacagccacagagcaagccgcttatgtcagtgggtgtgctcttctcaatgagtgaatggtttagcttagctctaggaggcaagtgcctgctggtcttgtatttccagggcccaacattgtgcacagcatatagtaggtcatcagtaaatcattacacaagcaaacgcttaaacacttacggataacaggtcagttttagatctgtgttctccaaaactcatgctacattatacgtagagacaaaagcttctgatttaaaaaagtaaaaaaaggaaaattgagtaataaaggagagagaattaatattaggtagtttaaaacctacaaatgaactgaaggagaagaaatcacctgcctgcctgtctccctccctcccttccttccttccctccctccccttcttcttcctttcctcccccttccttccacctctatcataggtatttaagtgccttcactgttcaaggggatgcaagagggactgcaaaggtccctccctacagagatgactgatgtcatgtgtctgggcccaaaaatggtttagttagggatatgactactaaacaaaatcacatataccgacatcccttggtgtccatggggattggttccaggaccccttgtggacaccaaaatccacagatgctcgagtccctaatataaaatggtctcgtatttgcatatgacctatgtacatcctcctgtataaattatctgaagattacttatacctaatacagtgtaaatgctatgtaaatagttgttacattgtatttttatttgtattatttttaattattttgttgttctttttaaattgtttttaaaaaatattcctgatccatggttgcttggatccacagatatggaaggccacctgttattataattcaagatagtctaccatacatacttctaagagagatgccaagtatgctatgggctcaagaaacgttcaggacacatgcacgtagagggattaggtgaggcttgctgaaggaggcagcctttgtattggactttgaaggagttaacatgggtatggagatgtgaccttctaaatagaggggagatcaaaaatatactgtaaggaggaccaaatggagcatggttaaggaagatccaatgttcttgtttccccagagaagggggtatatgatatgaaatgtaagaagataaggctggagccctgagccttcatgtctggcaagcaggagccaatggaatggtattgcatgagcttaaggaaaacagaacatttcatgacccgctcagatttatgctttaggaagaagggggatgaattaagagtgtgtatctccaggttaccattgatttcaagttgtgtgaatttcccagtgactcctgagtttcacgcttattccaattttctcatgtagaaccccaggcctcaaacaggcatcactggctctcttcattttcctctttctttcttcctttcaaagaagaaactgctgggtgcagtggcttcacgcctgtaatcccagcactttgggaggcggaggcaggcggatcaccggaggtcaggagttcgagaccagcctgaccagcatggtgaaaccccgtctctactaaaaatacaaaattagccgggcatggtggcacatgtctgtaatcccagctacttaggaggctgaggcaggagaattgcttgaacctgggaggcagaggctgcaatgagccgagatcacaccattgcacttaagcctgggcaacaagagtgaaactctgttcaaataaataaataaataagcaaacaaaccactgctaccagtgctggataaatacagaagccagagtttaacattagcttttacttttttcaagcagaaggcaagattctgtaatggggctgatccattcaaactatccttgcttggtagtattagaaagttgccacacactgtagcaacaatgctaagatttaagtaactctttaatgagtacactggataatgtttaaagtttatttctttactgtgatggcaacagcaaagtgactctaaagtgacaattcatctggaagaaagaagttgaaggaagcaactgggaaaaaagaaaaaaggaaagtgctttatataatgtaatgccaaggtggaaatatagatttcaaaatggttttatagtaagatcatatggaataagaatattgctttcgagtagaatgtacattcagtaataagataataggatttatttctaacaagtgtgaactcttttgctaactaccaataattataacaattttgaattgtagctggaaattggaaagtgagcctcctagtaataaaaaatccccatgctagtttagtttaaattatttttcttatcaaatactttatctacacttctaataagtggaagaaaagaaaccagtaggtatagttttttttcccatactgtatctgatcattctatattggaagatgtagtaagctggaaaatagccaaacgttgaagacaaaatgagaaaaaatgcaatttacttaggcacaaactaaatgttatgtacatcatccttaggattcaggtgaaagaacaagtctcacagtctagctgttgtcaaaactcactcccctatccctgaggatcctgattcggtgtttggaatgcagtatagaaatttgtaggtttttttttttttttttgagatggagtttcgctcttttttgcccaggctggagtgcaatggtgcaatcttggctcactgcaacctctgcctcccgggttcaagcaaatctcctccctcagcctcccgagtagctgggattacaggtgtgcgccaccacacccggctaattttgtatttttagtagagacggggtttcaccatgtcggccaggctggtctcaaactcctgacttcaggagatccacccaccttggcctcccaaagtgctgggattacaggcatgagccaccgcacccagccgagaaatttgtactttcaaaaacatttgagggccaggcatggtggctcatgcctgtaaccccagcactttgggaggccgaggcaagggaaacagcctgagttcagcagttcaagaccagcctggccaacatggagaaatcccgtctctactaaaaatacaaaaattagctgggcacattggcaggttcttgtgatcccagccggctactcgggaggctgaggcaggagaatcgcttgaacctgggaggtggaggttgcagtgagccgagattgcaccatgcaccattgcactccagcctgggtgacagagcgagactccatctcaaaaaaaaaaaaaaaaaattgaggtcagtaggatcaccaagatgttccttgggagggcttcagcagaaacctctcagtctctgtcagtattactttcctcctggcgtcataagttacaatggatattggatgctttcttgatgttttccaaagtgcccctccaactcagcttcaactttcaagtaataagtcatttccaaccacaatggcacagggtaggcccctactatgctgaaatcctcacactgccactgtctcagttgattatcatgcagcaattgtggctcattgtgggtccctactaaccactgtccttcagtcctattacgtgatcagaattgccccttcccatatgtattttaatgaactccttcatgtgagtgaatgagaaatactacttgagggccctatctgttgtaagaatggtgcttaacacaggctgtagatgctcaagacagttcttgccatctaaagcttatggaccagtgggaaaggcatatgtgttcaattgggctccctggaaacagactccgagatgaagaattgcatacaaaagttttagttgtttctgaggcagagaaactgactgcaatgtggttgcagctggggccccagcagttccaatgagaagttctaaagatttgatggtccttcaaaattgtctcacattgagtcaagggggttggggctttctgttttcacgtcaggcagtgactggcggggggctgccccacaggaaggagcataatgttgggaagacagttacttgcagctgagggtaaatcccgatgagggactcggctgtgagccaccaacggcaggatgggtatacaggccattaagaggggaatgaaagttatttggagtctctgacaagatcgtattttttctctcaccccttgaggcatgatgcaataataccatatgaaattactgaggaaatgctgtgaaatcgtaaacatttgtttaaagagataaagaaactaaatacaatggagtataaggccttgctctatgtagttttgcttcagagaatgtgattttctcaggaatgtagttcaagtcacattatagttactctgttgtaagttaccaggccacaaatatctaatgagcacgttctatgtgtcctggacttccagagagagagaggaaaaagtggaaaattcatgcctggagaatttacataggacctttttttttttcctcggtggttcatgtgcctgattttgagtttaaggaggggatttgggggtgggggtcaaggaaggggcaaggaaatggaacagagtagagtggggccaagttttctgaattccaaggataataagacaattgtttgggttgtacaggaccaggctacagaggaatattgaaagttggcggaaggcacagacttgatgaactgagtggtagtggaataagtcgaatgtagatttactggtacagaacagacagtgaaagcagtgtttcattagcattagccagtctatgatttggactggaggggaactagttttgaatacgatgaatttgaaatcatcgaaataatatatcctagagttcaattttcactgaaaggaagcatttcatataacactattcacttttatattatgtggaaatattaatttccttccttaatgcaagggaagtgacattacttagatttttaaaatgctttcttcaaccctagtgaggtaataggagcaccttctatttttatcctataaagattttcaatcaagttaaatacactgacacttaattttgccagtaagtttttaaagtactggctgtgtctaaatgggcaaccattcattaaatcatagaaaaattgaatagggatgaactaagtacatacctttacagatataaacatctctcggccaggcacggtggctcatgcctgtaatcccagcactttgggaggctgaggtgggcggatcatgaggtaaagagatcgagaccatcctggccaacatggtgaaaccctgtctttactaaaaaaatacaataattagctgggcgtggtggcgcgtgcctgtagtaccagctactctaactagaggctgaggcaggagaattgcttgaacctgggaggcagaggttgcagtgagctgagatcatgccactgcactctagcctgagtgacagagcaagactccatctcaaaacaaaacaaaacaaaacatacaagcaaacaaaaaatctctcaactaccaaaaaattatccattaactgatattcactttaataaataaccactttggcaattttttccctcacttgacctaacattgactagatggtcaactcaattcagttcaacaaatacttccagatgatccacctactccatgcttaattcaagcacaaagctagaatgaggaatttactcattgccacagcaactgaggatgcacattgttaagcattttaaaagatctgtcttaaaaaaaaatagtaatctttgctaccagcacctagcttgctttaaaagcatttgttagattccttctctggctttggcttggtttttttggaataataataataaaaaaaaaagttggccaggtatggtggttcatgcctggaatcccagcactttgggaggccaaggtgagtggatcacctaaggtcagaagttcgagatcagcctggtcaacatggtgaaaccccgtctctactaaaaatataaaaattagccagacgtggtggcgcacgcctgtaatcccagctacttgggaggctgaggcaggagaatcgcttgaacctgggaggcggaggttacagtgagccgaaattgcaccactgcactccagcctgggcaacagaacgagactccatctcaaaaaaaaaaaaaaaaaagaaaggttcatggtatttttaaaagaccaagaattcaatcaaggtgacactccttttccatcacaatactctacttgtgtgtatggacctatatattttattgtttcaaatacaaattgtgaagcttattaaggagagtccaacatttctatatattcactagctgttttttcattaaatataacttcaaggctccaggctcaaaaattgttccatttttactgattgcatcatgctatttgtgcacagcacacttttatttttgtccgcatagatttgaagcaatggtttttttactctgccacacaatgccacatccctgacagtaggtaagttatgttcttttgcattttttactcaagagctatgtaggtggtatgggagatgagtggcggctattggaacagactgtgcatcagacgctatttaaacctcatctatatgtgcaagttaagagttactatttcctgtttccaaagtgaaaattagttttaatttcttaaatttgtaatcagagaagatgtgggttattgttctaagcatcttctttggactcttccaatgttttggtagcaaagattcaaatattagtaagtctaaattcatcttttattaatttgggtactcctgctagcccaatcttattatttttaatattagtgttaatgttactattggctatgattacaaaagtataaaaataatatatttaataaagcctcatcatgtggcttcagtctagttttgggaacctgaaagatattatgaaaattaaaggtttagtattgcttcattgaatcattacttaagtcaaagatgttaagcagacttagttattatgattaaatcctttccactccaagaattacagtaccagaaatgtgcaatttgtatacacacaaatttactttttgagactattgaaaggtaattggaaataatttcatacctgaggacagtctcttagaaaacatatttgtgtgagtccttgtttatttggatcatactggagttgtaggcaacatatttgtgtgactaatatcatcaccattgtctccatcataatcattatcaacaagctggtattaattttaaaagtgttcattatacaatcaaaaaagaactatataggacaggaccctgactattgaatataatgagcttgaaccaaggattatgtggcttgcggaaatactgtgaggtaaatgaattttgcctgtgacatacttctgtgttcagtttcagcaactcccacttcgtttgaatcccaaatgctcacgtgaataactttagtttctgaatgctaagagtattctgtcacagagaagactgttttcttaaaaatatatgctcccaagctaccactagctatgtatttttctcatcaaatttattatttttaaatgtatttctttgtgtcttcctaactttagtataaggctgagaggatatgacctcatttatctggttcaccacatatctttggtgcccaggagagtgcctgtcacattgtgcaatttagttcaataattatcaaaggaaggaaagaaaggaagaagaaagggagaaagaaagaaaagaaagaagaatctcccgaggtgtcctggtctaagcaagataataggagaaaagagagtttgatttaaaaacacactaagcctagcttggtagatatatgacatttgcattgtaaaggtgttgttcatgatgcaatgttactggtatagtaaagttagcgtttattccatccctcatggggatgggtacaggtatatcacatgctctaaattgccaggtctgttgacagaatgccagaatgccaagctgatagcttagaacctatagccaaagattttggttgcatcaataatgcagaaagcgatgtcttaaggaccattattctgacagtatgtttttaaggtgagcaatgccaagatagactgaagcctacagttagatggcactatatattttataaattacaaggtgataaaagttctcattgttttagcttcttagcttttttccctacttttccctatatataagtatccattaagaagaagctttaaaaaaacactaatttcatttttatctctttcatagtatcaatataccttctcccaattgcagaagacatcatgttatactagaattcacatttggatcaaggcaagtgtgagttccaattttggctttgacatttactagctgtgtaaccttggataggttacttatgtttcagagtttcagtttccagatctctggagagaaaagaatacctacctttaggattactggaaaaagtaaaaattgtatttgtaggccaggtgtggtggctcatacctgtaatcccagcactttgggaggccgaggcgggtggatcacgaggtcaagagatcgagaccatcctggccaacatggtgaaaccctgtctctgctaaaaatacaaaaatgtgctgggtgtggtggcacgcacctgtagtcccagctacttgggaggctgaggcaggagaatcacttgaacccgggaggcggaggttgcagtgagccgagattgcaccattgcactccaggttggcgacagagcgagactcaaaaaaaaaaaaaaaaaaaaaggtatttgttaagcatatcgtgcagtgcttgacaaatcatagctacataataaatgctaatccttattttaatattttaacatgttatattaaaatataacaggaatattctttagttttctccctgtacccaatggtcaatattccatctttatcatacttgacctgtgggtaacaattgcacaatggatcagtccttgtccttgtttatttggatcatacttgacttgtgggcaacacttacacaatggatcactcctcctcagtacattttctttacctggctttggggacagcacaatctcttggtttaacttttttgctccttttaattctttgctgggaaaatgctccatggtttaactcttggctgtcttctcagtctacactcaccccttagtgatttcattcactcactctcatggctatcagtatcctttttgtcaccacctcttaaatttatatctaccttggtaacttttctgatttccaaacacatatatctaaccacttatttgacatcatcagctatttgacatttgtcacttactttgtccaaaactaaacttcttttttccctcccaaatctactttgttcgcaattttcccatctcgattgatgtcagtttcatccttgtatttgttcagacccaaaaccttgaaatcactcatcatttctctccctctctcacaaaccacatccagtcatcaagccttgttggtactatctttacccagatctagaatttaaccacttctcatcacctctactgctattatcctgtggaaccctccatcatctcttttctaaattactgcaaaccgccaaactgactctatgcctctgttattgttttctacagtctgctctcaatatagcagctacggttgccttttgaaaatggacaggttgtgtcactctacttttcaaatccctgcaaaggttgctgattttacttggagtaaaagtaaagttcttataatggcctaaggaaattcgcctacattacttccttgatttcatttccccgactcattctctcttttctagctctctcatttctcaccactctcaacttgctgttctttgaaggtgacaggtaagttcttgccataggaccttttcactggctgttctctttgtttggagcattatttacccagaagtctcaaggctaacttcctcacttccatcatttttggcttacctgtcatcttctccatgagacctaccccgaccacaccctctaaaatttcaatacactcacctccacactcctgatctccttatctggttctactttctaattcttttaggtacttcttaccatgtaacttttttataagttatttattattcttattgattattgctagagtttaagctccacaagagcaaagatctttgtccttttagttcactgaagtatcccaagcactgagaatgctatatgtaaatttggtaaaataaatattgttgtaaaataaagataattttcttacctagtgttactattgtgaaggtttaaataagataatgcagttagagcattttttcacagggcctgacataaattaagggcttaataaatggtcgccattatgaagtgtctcatggcgtaaacacacatggtatacaccaaaaatcaaaagtattacagcatgaaccctttttctcacattgaagttttaccaataccacaggcatataatatcttctctaggtatacacaagcatatcttattgtttcatgctcatctagtaaagataaagatatgctagcattcagcagtagctgacagttcacatatgtcagtgaaataaattgacactgttcttttttactttataccaattaaacttcatataatttaaaaagttggtgacaaatattctctaataaggataattttaaaaatatcactataagatgatattctctaataaggataatttttaaaatatcacaataagatgatttataagattcctgagagctccctaagaattaaagagctaacaaaaaaatgatattcccattatgcattttaatgaacaaccaattttcttctttttgtagatttcaatgacaacttggagagttcaacatgtttaacatttttgattcttttccatgttttataaatagaaaaaaataaaaatgattgtaatgaggtattcttatgtgcatcacaaatgtaggttttagtgtgcgggattcaatagaaaataaatactttctttttccatcttcatttgtgaaaatactgaaaaatagttataacggaaagtcttttgtaaatcaaaacaaaaagtattatttctgaatactgaatagatgttctcatcttgtctattgcctgatcatctagttgcttagtctaatcaaatacatttattcttctatgtttcattcgcatagcttagtcttttccagagaatttacgaatgttttactgcatgccaaaccttgggtaattaaagtcgacgacagaatgtgcccatagtttattctgtagatctgactgtagatgcagaggcttacattacatttggggtgaatgataagcttatattattttcttcttctactaaaaatattttaaagatatagattctagaattcactaaacaggtaatttgtgaataaatatattgccattttttaaaattgctcttttgttctctcatatgttcatcatgcagcttaatttcctttctccatgtttgggatggtcaggtagtcaccacttcccactaaagttcgttaatttttcaaccaccagaaaaaaaggtgaggaatgaaagaaggagaggaaaagagaagaatggcaaactccacgtaattgcctgaatgctaccttagatctaaatgttgtaagttttcctctaacattttagaaagaatcactttttttcaagcatttttattgccactcgtgcctactttactttgttactcctctgctgcttgtgggtggatggaatttgactatttcagaatagttactggtgggtgggttcaagaatctctagtgggttgaggaaaaagccatgtttatatagatagtgatccttctattaaaatcctaagagtgagtaatatttaatagctatgttcaccacgcacatagcagagtccatctgtacagaaactgagggtatctgaaaagaattccacgggagttttggcttcctatagagtttgcacgcagaggctctaatctcccaaattaaattttgtgacttgatggatagacaaggtttctttcctgagggcatgacatggacctggatgcctactggtctatacaagtgtaagatgctatgaacctgtcaagacttagctttcccactatagtggatcataacacacagctttagtgccttgtgtacattgctttgactacagatgtaaaacgtttaggttgactggctttaaattgtgggtagctgtggtaagggtaatcacatgatctacttagatgccaagtgagtgaattctcttctttgatttgaaatccagttcttttatatatatatttgagtacagagctggtagcagccagtgatgcaatgtacacattgaaagtgccataaatttagagatactttctgtatggccagaccacgggaaatgacaggcctttcaaactatagactattttagatgattgttcttgaaagaccacttcacttaatgtgatatttggattacaataaattctaaatcattgtgttctcatttctttcttttctatactgaagaaaatgccttaccttaatctttaccacttaccttaatcttcagagattgagtagtcattgatgttcattacccactttattgcagcaatgctactatcaaagcatgagatttgggtagctgcaacatgtgtacagctgaattctaagttttgcaggcagaacaccagtggtcaaattacatatattgtgtcataattattaaaaaatgtaacatatgaggacaattaaaggtctaaataatttgagatagacagcccattttaaaataacattttactttcattttattggcaagttttaagaccaaaatttaaaaggaccaaaaatggacataatttagatgtgcattttaatgaagaaagagaaaatgctaaatgatttggaaaaaaaagatatttagcatgatgcaacttctataaatgttttttttctcctgttctttaaagaatgaaataaagttacatgtaatggacggtattaaattcagactggcattaagatgtgaatgttttaaataagtgacatattttaatttgaaaatttgaatctaatataaaatgcaaattgcaatagcccttaatgtagaaaaagggaaaaatgtagtgattgagtttgggggaattgtaacttgggcagctctagccagctgcaatgatgaacaaggcttcctttattattgcttcaagaaaagctattgagtgtctagcacaaagtagctgcttgaatacgggaatatccaatatccctttgagaggcgtatttgattatacattttccctttaccctcttgtttctttctaactctccaagttccacaaaaagccccaagatcactgttgttattatcattggtgttgttttttgacccagaggttataccactgacaactactgttacctatgtaaaatgatctctatcaatctttgactaaatttatacctgatcctgttgttcttttgtttaaaatcttcccataaatctttggtccttacaggattatctgtaagagggttagcctggcaggcattttttttttttttacaatcagattcaacagagttcttttttggcttcatttctcactttgatcaaaatgacttctcagcatgcatgttcttacacacacacacacacacacacacacacacacacaacatacctacctctctgatatatgcttcctattaatttctgcctagaaaactcttactcatcctctaatacccatctcagatatatctcttgttttaacccttccttaatgtctctggtagaatgtgttatccaataaccctccctgtcccccgaccccactcaaccccaatgatcagagaacatattcctgttaaatcacctattttactgaaattatttcatttgtctctctcactttttagaatggaatcttcataaggcctgagatgctatttatttagctctgaaaaaactagccttgcatacaagtcttgtcataataagtcctaatgaatagttgattgactgaatgaacggatcttcacttgtggattttgcacaacctacagttgtgggtgccaactcaatgtgcagagttggaagctgtttgtagctctgccagtcagttttatgttctgccagcacattcttggttgttgtacattccccactgataggattttacccaacagtacttggcttgattacagtgttcaaaattgtttttcaccatgtctgggtttttttcccctactcgacttcattctctcagtttctgtacagcaggcttctgggacatcctgttgttacccattcccctcctgtacctcgcccatccaagtaactttgtgaggaaaggctgggagactggccaatttccagcatcttgttgctggtgatcctgtattactgtaggcatataagtggtgaacctgggcatgctgccatggctagcagtgaaggtgaatgcattccggtgccaataagggctaaggcatggaagtaaatccatgcagaattgactttgtcagtgctttctagtaaaggaggagtttatacatggaaagtatatcggtagcagttagcatcattttgtcccttatagttctagatgaaagaacaccaatatttttttaccttaattgcctagtaagaatctgatgttcgtagaaagttctgtacccttgttgcatttgctgcctagctcagctccgagacaggaaactgaattaggtatacagtcctagaagtcactgttgctcaaacttgaattgcacatggatcattaagggattttaattcagtaggtctgcggtggagccaagattctgcatttctaataagctctctggtgataccatgatgttgatattgttggtctgaaaaattcacattgagcagcaggatgtagagggcagagtgagctctttgacaagcagtgccagctaatgcgcgtaccctctacatcttgagtgcctcaacaatgccacaggatgacagagcatgccaaaacacaaaataaatcagttccctcatcaccactgcatgttagttcagaatgttactgacggtggtggaagcatccctgagttagtgttctccctcccacagagctcatttagattctttgtggagaagggaagaggttggcttccccaccaaatctttgttgaaaatgatttaacacattaaaagagcaaatcagtatcttaaggtttaaacttcttagctgcagaggaagttaagttcagttcccaaggacttaagggttcagtgaattttcaccaggttcttttttcacctaaacttcaagagcgcggtaggagagccatcatttattgagttcctgctatatgtgggcactgtttgttaggtgctggaggtacaaagaggcatcacacataatctcttgcccgagggagtttacaattgactccattaaaggttcaaattttgaggataaaggtgtgtcttatttgactttatatttcccaaagtgtaaaattaataactgcctattaactaaaatgttgctaaaccacagcataagaagagtgtattttaaggctaaatcatgccacaaattatgacatggttagtatagttacaagtgacaattgcatgccatttccattctgtaaatcagagcttcctaatactgctttaaacacaaaatgtgccgttgggcaaatgctgtattagcaccactagtactctgtttttcaaactgcaaagggcatcccagagttttaattttgtttcttggtgtaaatttatatgttctttggataaccacccaatttgtccatgtagccaagcttctcataggagagatgacagaggggaacagataactgtagaacacaagataaaatatgatgagggccaggacactgaaacacagataacgtaggtatcaataaactactacccatgacccaaatccagccagccacctgtttttttaaataaagttttattggaacacagccatggccattcatttaggtattatctatggctgccttcatgctacaactgcagagttgaggaattgcaccagaaaccatatatggcttgcagaacctaaaagctatgccttagagtctaagaagcaggctttctaatatttgtggggtcagggcaagaaaacaaaaagataccttccaactatgacccgccactctgctgttctcaccctggctctgtcctgcactgcgagaggtctcaaatacaccctacttatatgtaagttccatctactatcctcacactcctgcttcacaaacacctgtatcttgaccttctttcaaagaaaggggtgcacacacaaacattggtgtctgccctcagaaagtaaaccaatggaagaggcccatagaggccctagaagtggtcccagggaccccgggcggggcgttttaaattttggggtggcagatagtgttctgaaagataaaggacaatggctttgggcaggcacacctccttggttcccctagactccttgtcccatggctaaggcatggcaggaatagggccagagtagcaccccctaaagggaggggcaggaaacaggtttctctgcctgagtatgagggtgatattgttaaggagtcctgtttaaattggctaggcaaggacactattattacaaacagcttttagctagtgcttgatgattatgagaacactgttgtgcacaaatggtgaagagaggtattctaaggagaggaaactttatgagcaaagtcatagagatgaaaaagctttaaacactagtagagaatggctataaaagatggatttttacacctgtgaaaatatatactatatcattttatctttgcaacaggctctaatggctagtatggaaacttttctcttcagtggggagaaattgaaccatatattagttaaaattagaacctggaaacctgaatgcttgtttgaatggcaatgctatcaaaaatatcttgggcaaatctcgtaacatttctgcctatcagtttggaagattagggactcttgtcatatagatctatgatgattaactgtgtggagggtatcactgtaaatactaggaatttgttgtgtgctttaaaagtgtttcagtgtgatttgggagagaagagaaagaaaacccagctgtaagttgagaaccagtgctcagctgagataatggctcaggttgcctttattttaagattagacttaaactaaaaatcttctgttaattagtggctgagctggaattagcaaatagtcctggtcctcttgactttgggccctgttgtttgtcctgtgtatcagatttgataatcagcaacatgggactggatacaaaatctattagcctgtgggaaacagggcatgtattagaccagtggttttcaaatcttggtgaaaacagtaatcccctggtgagttttctaaagtgctaatcccttaaccaaaggtgagggactctgattcagaaggacggcctgaggcctgggaagctgcattttaaaaacatcggtagaaatttggataaaggtagtccttgggactcatgttgaaaagcagtggtttagaatgtgctttctttccttttggacagaagctctgtactgaagagcctttagtctgtgaaagacctgagttatttctccagggaaggtgactgtctttggctgaaccatccacattctcttgcccagttcctctgaggtctatggagtgcccatatatgagactaaagttaaggagtcacctccagccacgggacagaaggcagttttctgaccttatcagattttatcattgccatactttaacttgctgagctaaccagccacagttttgttggaactcaccatggagacagattaattttaactctgagagaacatgggcttttcaacacaagttaaatataggctggcacagaacatcacagaagcattaggtcctcagaaattttctttagctcccaaactttgagctgccactaatttatgctactcatactttctcctggtcatttttatgtttttgtcttcctttgatcactgaaacagagaaggcagtacttaacctgctggaaacaggtcatctatgagcatgtttctcctaaacaattacatggaaaattaatggaaagaataggctatatgtcttaggctcttgggcagaccataagctttcgttcttgtttttttatgttttcttgggtgaaaaacttagcttaaagaaatatgaaatgcatttaaaaattaatttccacaaaaccaaagtgctgagatttgaccaaatgaaaaaacttggaggtaaaaacactgcacggttccatgtgtaatagttttttttttcctggaactaaagagagcacacacatattcacacaattcctacctttagcagatatttcattaaaacaccacacaatttaaatgttgataagaccttttcaaatagagaaattaaaatgataccttattaactttcattatagggcattaataatttttgtatttctgattagaatatggatttttgttaatgtggtgattttcagtggcagtcatgttcagtgcaagtgtgttctacaataatattgagaaataggagatgaaagttaaaatactggtgatgatgggccacatatgacctacacgacgatacacagtagtgtttcaaaataccaataatttaataaattactaatactaacaaatctgtgataagataggaatttttagtgcttcgaatattgacctccctaagttacatttcaatgccagttgtacaatactagtattgaactagtgaggataagagtactagaggccattgcttgtgttacagttcacatcccggctttatgacctttggtgacttacataaactgtcgtctgtttttgttttttgttttttttcgggacacagtcttgctctgtcacccaggctggagtgcagttgggagatcgtggctcactgcaagctccgcctcccggcttcactccattcttctgcctcagcctccggagtagctgggactacaggtgcccgccaccacgcccggctacttttttgtatttttagtagagacggggtttcactgtgttagccaggatggtctcgacctcctgacctcgtgatctgcccgccttggcctcctaaagtgctgagattacaggtatgaggcactgcgcctggccaactgttgtctgtttttttttttttttttttttttttttttttttttacctacaaattgaatgaaattactcatagggttgatattaatattaagagagatcacatatgtaaagagcttagtacagtgtagtatagtgcaagtagttaataagagttaggtattagcaatatattatagtttcataatttttcttctaaaaaccaattgccaaaggatgtattcctttagttgaaatactatagctcgattgtgtatataaacatatacattaatttgtaaaagtcagtttaaaaataagtataatggcatttttgaaacatagccctataaataataaacatgcttccaagttctcaatggatgataaaagccatcaacaggcccttgtcctgctgagtttccctgtgaagccaacagctcagccagcccctcaaaggccatggaagcttgaaggtcagacactgcgtgtaggggtcacctgcagatttaactcttaaatgcgagtcgcttagatctgtggctgcatctatttctgtgaggtaccagacgtcttctacatttggaacattgatgatatgataaaggaagtcatgccaataatcatacccaaagctgcttaatgaaaggaagaatggagagtcacacaaacatcacctcttagtaatagaaacttgactgggagacccaagcgaggccccttctaccaccagcattcaagctgcattaaactaaaatgtcaaaaatacttaaataatagtaataataataattgtgtttaaggccatattcactgatcagtggtcctttattgatttagatctttacagaagtggagctcctgagttcattgcttcatccaattcctcgtttttattatttgagaaaggcactcccccaggggatttgacagattcacatatgtagttcaaaatggttgattagcatgtcatatgaaaacatatcagaaggactaagggctcttggacagattacatttgtagttttcctgatgtctttcaggcctatcattttgtcataaaatgaagttgaaagggtctgaatatgtagacttcttacaggctccatggagacttctcaccacttctgttttctggtacgtgcttagaaaacgactatttgttcctggatttatgtacagatcaaagcatcctggctgatttgttattttctagaatttacatttaaaagcgtgaaggtttctatttgtagaaaaggcatttttctttcttttttttttttttagatggcgtttcactcttgtcacccgggctggagtgcaatggcacgatctcggctcactgcaacctccacctcccaggttcaagggagtctcctgcctcagcctcccaagtagcggggactacaggcgtacgccaccatgcctggctaatttttgtatttttagtagagacggggtttcaccatcttggccaggcttgactcaaactcctgacctcatgatccacccaccttggcctcccaaagtgctgggattacaggcgtgagccaccgcgcccggccagaaaaggcatttttctatttgtatttgggtatttttcataatcccttactcattcatcagtttagaacaatatctaactttaattggaatgaatttcagtgtaaattaaacaattgcagcaaaaaaggagatatccataactaaatccacagtggaagacaactaatgagaatgcatagagagctaaagaatacagaactacatcagtcacagggaagtattcaaaaattgtgaaactttacaagtttgtttttcatatcttggcttcaaatttgtgttgctttcctccacaagggatttcaagagatgtttcagagaactttaaaactttcaataatgttttaaatacctggggaataaaaacaaaaccaacagtaataatgttggaggaggaggcagtggaaaggaacagagaataggagcaaaaagaaaaagatgttaacatccttaggtgctacaatggctgattcatctgtagtctcctattataaaatcttatgtggatttgggagtaagccccttactaccccttcccacccccatgccattcctatcactagtctttttggggaagaggctgtcattgacaagtccctactttcgccatactgttctctacagtttctaaattctattaaaatgaaggattgtatgataattctgttaatatttttattcttgaaatatttcagctctgccatgtattatcaatatggccttatctttaaaatgaggatgataataatactggcatcaaggcatgctttgagaattaaaagagtcaacccaaatatgggacctcaaatatagcctttagcaagcagaggctagctcatagagcatgcttgataaatggcaatcctcattgataaagctcattcaatggaatcacttatttttaaactgtagtttaaccagatatgggatcttactatccaattgaacctaggaaatacaaatgattataggcacagcctttccttggctttgtttagaatagttacagaaatagactaatattttggaatttcatatgttgatagattcaagtaatttgaatgggaaagaggcaggagagaaattattattattttttccagtcttgaaatttttcaaagcattttaatattctcaaagtaggaagcctgattagccttatcttcatcagttctttatacacatccctatatcactaacattttttcttatcccattcaaccttccagtccacttgtaaggctacttaaaagatgctagattaaagaatggtttgtgtcatcctcccatgtctttgacatctccatttttcttgaacctacaggggtaagtgagcactgcatgacaatattgagagaatagatatctttttttcacacctgtctcttcaagtgtatgattctgcttatctctttgtgacatttcagtggtatagtttctgcaaacatgattttatcaggactttgctttctgctttagacttgaaagtgaatttcttttgggatagttacatcttacttgttcaaggtgtgaaacataaaacgatatctgatttttcagtgttctactgatacacaataattctaaactgaagcaatatggtactcttgcctcctgcttttatcttagaagaatgaaaattgaatatttgggttaagttaatatacacaatacgtggattactaaagttattacattttcaatatcttatagtgcagtaatacatattttaacaataaagctcttaggagagtcacagtgtagggaagttatcttatctttacaacaataaccattatgtattgctctaacatgactttggtttaattgtactttctgaccatctgggtaacaaaaattattcttattggattggaccaagtgaatatttgatcaagaacaactttaattttcagcatttttttcaaaattactagggaaatgtaattgtaaacatatttttataaattatattttatttcctattctgagattataaagttaacttttcaatttcttattaacagggtgttgagaagccagattccacattaagccacttaaatattctgtgggtggactacagcaggaggtggaggagctcccatgtttctgaagatagtttgagataatattgtgggtggtgaaggggagggtacttacagtgtgtggagtcacggactcagcaagaatgtaatcctgctggctgcaccttcttttcctcacagggaattccaacaaagcaagaaggggtgaagtggctgagaagggccagtgccagtggtatgtgactccaggatctactcaaagaagtttgcaggttcatttgtagactcaatagttattttactcactaagttaaaggatttatgtatccaattttaacagatgcaataaaagttatttacattaatctttaccatatgtccctcttatcctttacattattctatacatttagaaatttataaaaatggtggtggaaaatacagaacatgatgtaaaatgtcaactcttatctcttttaaagaggttagaataggagatggttgattagtgcatctataaaattgtttacctgaaggccaggcatggtggctcacgcctgtaaccccagcactttgggaggccgagacgagtggatcgcttgagtccaggagttcaagaccagcctgggtaacatggtgaaaccccatctctacaaaaacaaacaaacaaacaaacaaaaattagccggcatagtggcacatgcttgcagtcccagctacttgggaggttgagatgggaggattgctggagcccaggaggcagagattgcagtgggctgagatcacgacactgcattccagcctgggcaacagagtgagaccccgtctccaaaaaaaaaaaaaaaaaaagataaaaaaaattgtttaactgagttgtgccgcacaaataccaatggttgagtgtgtcataatacttacagaatgattttgattgtgtacgtttgcttctctttacatgattcatgcataatttacaataagaactaccatggtgagctaaattaagtttaacattttgaagttttcttatgcagtggttatctgagtctccaagttaacttacattgcatttgttcactgtctccatttcctaagtcatattttagtagatgataccatgtagttttgcatttctatccaaatgcattttgcttgggagattagttgtatgaaatattctaaggggggcataaagaaggttctttgatgaaataactttggaacatgctgcttctatgtctcttacatggatattcacaatgataagtataaccaaaggctctgagaagtcctgcagtttaaaaaaaaaaacactaaagtgttttaacccaggattttgtagacacatttgaccataggcactctctttccataatgctttgttatatcctactgaactttgggaaatgccatcttagacatccagtaagatcatatacacttcaaattgcctaagtatttttacagaaataaatctaagaacataaactaaggtttgccagaaatatattacatttctctgttaaataaacgttttccattgcatgtcaatatctcacatgggaatgcctcttgtctccccagtatagtcaccagacagtcttcctctctggagtcctggtttctttccaagaattaggcccccatctctggtcttgccagattttacacccctcaagcccctcatgtcagggtaatctctttctcctctgggcgatggtgaggaagaattgggacgtgatgaggctctgtgagtctcaagcccattggcattcttacttttctaagatattctgcgtcttccttcagacttttcctctatttctttcaccacggattttgatggctcattaaacccagagcctgatttatccccttttggtttgtattcatagagggcttaatccttcaatgctccaagaaggtgagaaagcagattttcattccatctttccaatctagtacagaggaaaagaaaaacaaattcccatatgaaaagagtctgaaaatatttagaccatgatatagttgaaaaggcatcaacttcatttaccttttgctcttacattattttatcttgggcccagtctatctatctcatatcattgtatatcactctcctctttgcctattaatctccatccagaccagtctttaatccactttctgcttttgggccttttccctagctgtcctctctgcatcttccctgctcttcacattggctgtcccttgaaatacaaggcctcattaagtgtttcttccttggagaagtcttctctaactaccagactaaagtatctgactagtccctcacatgacatcttaattctcttaattctctgcagagcacctattgttatttggtattttattatttgtttatctgtttgtttcttccatcaagaatcaaagttccgtaaaagctcggacactatctttctccttctccattgcttccccagtacctaatacagtgccaggaaaataccacaggctacatagataattgctgaatgaatgattgaatatttgacttttcatgtctgttacttccttggttatttcttggcctttttttactgaaaatttcagtcgctctttggaggcattcgttgcattgtttcaatctcctccctctactcctgaccactctatgccacatttgacatggcaatgcaccttcctctttcttacctcaaattctgtggcacttttgaggctctgacttagtcttttatgtctctttgtattatgctaccttggagaccgcattcttttgcaaacttaaaagtacaaattctatggcaaaaacctttctgtaaattcttctttgacacctgtatcttaatcctgtcactcacttctctgctttactgtttcaatgttagcaaaattgccaactaaatctttagtttcttattgttcattgtggattaatattaagtccttaagcagactaggaatgtctttagggaaggaggcataccatgtccattatttatttatttttaatagcacacaacacatttcttgaacttaccatatttcagtggttcaataaatgcatgcatgtccatagatagacaatgtatactgaaaacacagcatcagtattaatttacgatcttagatgagccacttgtattgtttaatatattattggaattaggaaggaagaggcaggtggcagatccctatcccatactcccttacccccttcttgctttaatgtgctttcttttgccagtcttgcttcctattgtgcctttcccttcacatctaaatatacaacgttaagctagaaaagtactataagaatactaaacctagttgagaaaataaagagaaaaaaatataaaccatgggcaaatcgtcttcttgaatattcttctctcaatattttaaaattaagatgtatgattttgatgatctagaataaaaccaatctccctaacatattttgcatatagtatctgttttggccttttttcagatacagtatcatttcaagttattattgcttaagaaatttatgtttgtggtcacaaattcaaacattaccaaattgcaccaaataaaaaaatgaaatgaccttctctggttagattaaacttgtagcacatttattcctctaatatacaaaggttttattagtgaattgtttttttaaaaaaagaagataaatggaatccaacaacagcaatatatattttccagtaaaattttatctatgtgatcataaaattcatttatgctttttattaatcagtgagagaagtaatgctgtcagcaaaagtgggttatagctctatcacaaagttctaaaagcagccatggaacctatgcattttttcatgttttcagttaacattacttggggtataaaatgctattgtgttgtcaagtgaattgattctaatcacagctgttttctgtgaattaaatcaccaagaaaactcaatcaccaaccaaagacttttaaacaataaaatcccatttgtggttgaagatcaaatttaagaacgctactggatattcatttattttgtcacgtttaattttctactctgactctcagtttcttaaagaaacaaatatttaatatctccccaaagccaatatctgctgtgtagtgggttcatatcttagcactgagagttaaataattgtgtgtagaaaaaaataggatatacagtgattgaattttcacttcatggaaaatggcagaaaagctagctatttgcttgctttcattcctttactatttcagaaacaaacacatctctaacttcaagtgaaattaattagttacttagggagatatatatctatatatctctctatatatacctttgctttttgggttgtggcacttatgctaaagttatcctctgggtttccttatatgggtcatgccataaaaatatccatttgagggctgctcaggtgagactctctgagagagccgttatactgtctgtgcatccttcgtccttgtcacatcataatgttttcattcaacctctttgtacagatcaaggagagaattgttatgtatgtataaagttatgaattgttttgtactagcgaccaaactcagggaatttatcgcaacgggtattccataatggcttggcactaggtcagaagccattgtcagcaaatcaatttatgttacttagggtgtctcttgcagcaggacaggcagattcaggctgaaggtgttgagaaggctaaaaccttctcaaacagcagcgatgtttaaagtgtagctttattacctgcatacgtggcactgtgctggtagaaatgagaatggaagaaaaacagaacattggattattggttaaggaatggcattttattctttccttcataagttttatcttaaaccttgaacatctggctttgtgaaattgagccctgtgtctgaatgacacaacagaagagcaattgcaaagtcctgtgttcagacaagtcctgaatatatatctatttcattgtcatggattgtttatcagtggctggaatgattttatatgtcctttaatttaacaagcagtaccaaaagcaaaacagaaaaaaaaaactctttgaggctgcattttagaaattcttcagtgtcatctggcactggggacatttggtatttctttcatttcttgctgctataccctcttacacaaagtcacaggcttaagctgtttcccttcaactgtgggaaggaaaaaaattaatttgaacatttcatatattttaggaagagtttagaaaatagggtcacatttttcaaatgtgcacgtcagttgcttctcctccttgcctttttctatcttcaaatttgttttcctttagtagtttttagttaattgtgaatgtttacagtatggttagagataaaataattctcttacttttcttttccatcgtcacacctgagacaaatgggggaaagcagacttcaaaccacacacgatgtgtttgatttctgctcctttcaaatatccattttatttaccaagaggtaaaaacactctgaaaactggcaacatcttatgtcccacagcattacttttgatgaaatcctgctgtattttagccaaaacttctttagacaaactataactgagtcacgtcgaccctcagatgacatcaatcttcactcctcttctatccaactaccgactagacacacgtacacatgcgtatgcaccccacagatcaaacttatttcattttctctacctgttggtcacggccttttcttcttatagcttactttattcccattattagacctgtttccatgttactgaaccttttccatcaaacctcaagtcctttatctttgtcaacaactccgtgaagcttttatcaatctgcctgtcagtaatctctctcttatctgaactcggaatctataatctgcaacacggcacagagtatcaaactatgtacttgtttttgttatccttttagctgttttgtgtatgttgatttcccctgtaattcctcacacattttttgtagtccccaatgactctgaaccgacagcagttagtttttaaatatgaataccctatttaaggatcaatttctgcacactttcaaagctttctttaggataattatgtcaccataagtgaattaaggttcctcaccttctccatggagctttgcatagtactttagttggatcataaagaaatgccctgaattataggatgggatcactgcaaagtcctacttgcatgtgagcaaggagcagagtctctacaaggtaacctgttacttggatatctctgaggatattaatgataaaaaggagtggccagaggaaagacttttcgcttctcaattgcagcactgtaactaagtgacttctggtagatcaaatagactattttggggattcctgctcacccatctcctctgtgttttcagagctgctgtagagctgttagaacagtgaactgatgctttttgacttgccaaacagtgggagctttctatttaaatagttatcccttagaagagctatattagggagctcaaaggaaaggatttaagggcccacacagagtagagaggcagcagatcagccacctactgggcccttgttccttcgaatgcttcaaactacatatttgtaaggcagaaggcctcctgctcacagaactgtatgctcctcacctgcccttttgtatttagcaaacacatgggaagggcagctcttccctgctgtctaacttgtctcttgttgttcttcggaagcaatccctcacagcccagtgggcagagagccaggtgtgctgaatgcacctaggggatgtggtcatgggaggagatccttcaggggcaaggggatcaaatttgacttagtatgtggtcattttccaagtgacagatgtgtaaaatgccagtagactaagaacccaaaggagctaatcaaaatgcgtgtgtgtgtgtgtgtgtgtgtgtgtgtgtgttttaccaagaatctatataggtgctttcttatgcctttattaatatctgttcaaattctactaagtcatactgccaagcttattttgataagggaatcagtttatttatttcaccaaggttataactatattggatagagaaattgggattattttcttagcttttaagcccataataactttattaagtccacagagaatagtttatgctctattgttgctgtaataatttatttttcttgtacccattccatggggaaacatacaaacaccaggaagatacagaaaatatgagttagagttgggagactcactgtcctgccagataaaggtctctttctaaatctcattgaaacctgacattcagaagtaggccagaaaataggcctagctatctacacagatatctctttttgtattatcattaaacatctcctaggaggcagcaagctctgtggtgggctgacataaattctgccattacatttttgtttcttttttattatatgtgtattattatgaactattttaaacataaagaaaagctagaaaaatatgacaaaatcatttcaacacccagatttagcatatgttaatgtgttgtcaaatcttctccaactttctttttctctctttttttaaagcaaatgaatgttaaagatacagctaaagcctccctctccatcccctctttatgccactgtgtttcttatataattattacatataaggttgctaactcttaggagtgaatttctttcttaagtccaaggaccatctcctgtcttaggtttttcacaaaggggcaaatcagaacagtactactctactgagtgtcaaatttaattgtctcctcctctggtgtcactggtgtgcaaatactttcccccttgggaaggatatctggggttgtctaaagggcagcaatctctatctagcataacagtttcaaagtgcaagagctgtttatgacctacctgaaaccatgcaccactgtcattcagaccttcgccttttgttctgagccgccctgatgtgatcattcattttgctctgtgcctttttctttttagcatcctatcatgaatagcttgattgactcttctcatctcttgggtcctggatctacagaataatttaataaaatgaggtaaggtagattaataactggcttaaaatcagacttttggctatccctattttgtaactgatgctatactctccccactccctgggatacatcatgttctcttagctttgtgtcttcccaaatcaaaatatagaacaaaagtgaagaagtggaagttggcagctatgtggtttgggtattgaattgttcccacatcaaaagatttatgaactgtgcattttaaacagttctcagttcatggctccctttaactaaattgagaaaacaggtaaggaaagtgaggcaaatgctaaagaaaatggccttgactgttcaatctagcattaaagataaagatttaatgaaggtaggtttaggacttataattttgagtcttgaaaacccaacttttaaaggattaaacgggagggtggggagtaaattcaagtttatgtggtggttctcctcctctgtcgctcgctaatgcagctcttctgaaggatagaaatttaaatagaaagctctcactgcttaggaagcaaaaacattaagaaattgctttaacagctttacggaatctgccattttcatcctgactacagtgctacaaagtgagcagtaatctctggggtaggagcacggcccacagtcaacacctatgctcactctgtgctttttacacttttagttttcattttccttaatcaatatttaccaggcgacagtcacagctttagcagcttctgttttctaccaatctttctgttgctgatacttcagacatttaataatttccttgtctataataatttctgtgctagttccttttataaatatctgcagtatgtgtacctaatttctgggatcaggtgcacatctgaaaaattgggattccttaatgaatgttggcattcaaaaatctcctccagtactcttactttattgggtcacatcattttctttctttttttttttgacatcattttctttgttgtttattttaagcaatcctctttcagacaattgtcacttacaaggttagctactgctgtgaagcaaaccatcacaaaatgtagtggataaaacaataaggtcgcccgtctgagcagttcttctgatttgggctgggctaaactggatctcgctggagcatgtccaagtgtctgtagtcagttatagaggggctgcgggctggctcatctggctgtcacctgggtcatgtagctctgataatccagcaggtcagcctgggtttgcttttatctgatggtcacaatgttctgagtgagagaagaagaaacatgaaaggtctcttaaagggtaggctcaggactggcagattgtgatgtctgctgcaatctattaaccaaaagaagtcacaaggccagtacagatgtaagggcaggggaaatggactctgcctctttagtgagaagaatttcaaaatcacattgcaaagtgtgtggacacagggaggggcaaagaattgtggtgtttttgccatctgcctcttgcacttaaccttctcccatgacatagttgtctcaagtaatttcccttctgggagcagctgttttgatatacaggaaatattgatccatcatactctgaagaaaattgcagcacagaaaggattatttaggcatcataggtggtcatgagaataagaaatgctgaagccttaagcagatgagctttaagcagctgagccctttatgttcttaagtgaagcatttttattcttccaagcatcaactgtagtcttgttttcaccagatgaaagcaactccaagtcaaatgcatgaaactgcactaaaattgtgatgcatttggttactctgtatcatgtgtggacaaaataaataccctgatatggagcacagattatacacacatcgtttctctgaattcatagctatgcaaacagttccttacggttgacgggttttattttttatctactgtgattaagttgcagtttagccttgcattatctcatctaaaacattttagcttttctttttaattcttattctctaactcattaaaacttttttagggctttgctagccgattccatttcttcattttatcctaggaagaagaccagcaaaataaatgtggatattaaataatatgtattatcattttgcaaaatcaaaatgttttacatgagactactaaatagcaagttcatagtttgagggacgatgattttgccaatgagacagaattctctcataacacacttagggggcatatcacatgagggtaccttgcatagtacacaattggaaagtaggagaataaatagtgtgagtaggagacatttatgcaaagaaaaggcgcccttgtttcttgactttgctttagtatagaaatataaagtttgtggcttgaagggaccttaattatttcatggtttattcctgctaaaacttctaatgatgggaaactcactatacctaaagaagcaaagtccatttatctaagtggacgattgggtggtcatcactgggggaccttactatgtgtcattgtttttatcttcatgaaagacatgatctattaaagagatggacatggaaagtatcacagcaaaatatgctatgtaccaaaatataatacacacttaccttggggaccaaacggaaagtgaatttattatccagtttactagtcagaacttgataattctctaaataggtaggatagtggagatggaagagctaaagatggtagatgctgtctactgaaattgggactatctaataagcatgattaccgggagcatgtcagaacattctgtgtatccatggtggtcaatgacttaaatctacatccattttcagagatcaaattccattcctggcccattacagaaacactacctgggcctcgagtgagcaaatgccaagaagctatttaacaataggcaagcacggcaaagagaggcttaaaattggcgaaaagtgcttcctttgcagtcatcctattcaacttgtggcagctttgaaacagcatcatgaattattattttaatattacaaataaactttattcttctcagcaacttgcctcctgatatgttaaaaatatacaaaactcagtttgtcaattcctgggaaattattgtcatagcggggagccataccaaggaagtttaaaagaacaatgataacaatataaaaaactgcaggagaaaagccataaagataggtttcaaggcacacttttctatcttccttttcactgttgatttgcagtcagtgatagatcgactttttttttgtttgtttcatttgtcctcttcctttcactaatctgggctttatttttgtttcaattttccctagctttcttcccagataataactatttccttttcccaagccctaattcacactttatcattctctcactgaagtgcctttcacagcaatccaatcaggacacttctgttcagtttgttccaaggggcttatttgatcatcatcaagaagataattgtctatccttagagctgggctaaacaaaagggtgaagcaggttgtgcacaaattcacaagactccattatcattcccctgcagactcccagctgcacttttactcaacccgtctgccttcttccccttcaggccaccttggttgagcttcttcagctgtccctgcttctatttcatccacctgttttcatccttcatgctttcctaattcaggttttctattcgtctactgcaactgatattttctagcaattttaaggaggataaaaataattcttgagtgaaataattcatactaggctgagagtgaatgatttcagatgtataggaggtgtgttataaaatgatttattaaatgtgaagaaattcctagtgaaaatatacatcgatatattatgtggggatcatgggtgcctctatgaattaattcattcagaaatgttcattaaatgcctaactcattgctaacggtgaagaagccaaacatattccctttcccacctcttctcatggagcttacattcaaatgggcaagataggtagtgtcttagcctggatttccctgtaataagcagcgctaagacaaggctttagatgcaggtttatattgggaaaagaaaccaaaggatcaggagtagaagatggataacagtgagagaaacagaaggaaggaagggtatgtcactgagctagactcaatcccatcaggagcctcttgagaagccatacagagtgtacagtgggcttgtctgccacagatacctattggctccatcccccattggtcacaggctgccccacacatggttcactgtcttgtgcctgtgctttttggaatgtgtcagttggttcctgaaattgtcccactaagatatggcagagaaataaatagtataggtgaggagagacattttcagaataatctgcacaaagctgatggttgcaccaacagctggaatataaaggtaaatgaagaagatataagaaagggctcaagaggtgtccgatacaaagagcaataaaataaaataaatatctaattgcacactgtaataagtgctctagggtaaagggtaccaggagagcatatgcacaacacaatccaaaatagtggtatagaccataggggtgaaaaattccttcaaaccgtcatggttccttgacatgaccaaatgtttgtagtgctactaagtaaaatgtgttgaagattaaagcccatttttaattttactatttagctatcctgttcctaggtaaacgtcaaatcccccaaatctttaagcttttctccaaagtagattttcttccaaagattaagaaggtttcaacactattttagacaaaggacttctgactatcctaatacctccccaaactactacattgaaaaccttattgggagacataagtactcctagctttgtttaacgttaagtggaaaaaatgtaatatagttgagaggtcaagagcctgtgctcaaaagactccgatttaatattggcaagactcatgagctatacctctttgtatctgaattccttatttgtgaaaggggaataacattatcacttgctcgcataggttaaaaggtgattaagtaaggaaacacagataaaacttatagaaaaatgccaggcatatggtataatctcacttattagcaaatgtattaatttactagggctgccataataaaataccacagaatgggtagtttaagcatcagaaatttatttctgtacagttttggagtctagaaacccacaatcaaggtgtcgttaatggtggtttctggtgaggcctcacttcctggttagtggatatctatctgccttctcactgtgtctttatatgatctttactgtgtgtgtgcatcctttggtatctcttcctcctcttataaggacatcagtcctattgtattagatcttcacccttacaacctcatttaaccttaattacctctttaaaagccctgtttccaaatacagttacattggtgggtagggcttcaacatgtgattattatgggcccacaatttagtcaataacagcaagtggtgtaatttttacatgaaaatgtcatttcctagaagggggcttttaaaaactttttagtctcaggattcctgttatacttccaaaaattcttgaaaatgccaaaaagcttttgtttatgtgggttatatctatcgatatttaccatgtcaaacattaaaattgagaaatttaaaatatatgtatttatttatttgaaaataccaataagacctcccattacaaattaacattattttagggaaaataactacattttccaaaacaaaataaatttagtgaagagtggcattgttttccagttttgtaaatctctttaatatctatctttatacaagctgctgaatttgcatatctgcaactatagccaacttgttatgatacctcatgaaatgtaacctctagaaaacttcactgtatgcttttttttttttttttttttttgacggagtctcactctgtcaaccaggctggagtgtggtggtgcattgtctgctcactgcagccttcgcctcctgggttcaagtgattctcctgcctcaacctcttgagtagctgggactacaggtgcccgccaccacacctggctaatttttgtatttttagtagagacgggttttcgccatgttggccagaatggtctcgaactcctggcctcaggtgtcgtgcccaccttgacctctcaaagtgctgggattacaggcatgaaccaccacactttgctacactgtactcttttgaaagaatgagagcaaaaaaggcaaatagcattttggtattattatgaaaatagtacagactttgcagagcctccaaaatctcctgaggaccattggtggtccctgtagcacacatttgagaaccactgccttaaagcttaagaacactcccaaatcaatgaggtttgtaattttggcatcctacttttgaaaggctccccaactcctttaagttcaataccacattttagtgttttgtgctaataatagtaaatattgacttttttccacttgcagagaaataccaaaccatggcatacagatggatttcacttgcaagttatatttgatgatatttttcactttatacttcttcattgtccacaatgagaatgagacagaactatttttgtgatatctgttgggcaatccttcagtgaactggttcaaataatgtgttttcttgaaaactgctgctgtaacatatctgttttgctactaaagaaattcagcctatgaatattattacatctttgaagtgaacttcatcctaatggtcaaaaagttgggagccaactgtattgaacatttattttttaccattatgtaaaacagaccattcatttactcttttgaagatgacaatttaatttgttaaagttttattttatttttaatcgaaaaataattgtgtatatttatgggatgcaatgttattttaatgaccacattaggccacatttcaatagctgataaaaaagttcccaacacttaattgcttttactaaaaatactaaatatttaaagattgattatatcatagaatttttttttttaactgagacgcaatctcattctgtctccctggctggagcgcagtggtgctatctatctgggctcattgcaaccttcacctcccaggttcaagagattctcctgcctcagcttccctagtagctgggaccacaggtgtgcaccacaatgcctggctagtttttgtatttttagtagagatcatgttggccaggctggtcttgaactcctgcaacctcaagccatctgcctgcctaggcctcttaacatgccgggattacaggcatgagccaccacgccaggtctggttttggttatttatatatatatgtgtgtgtgtgtgtgtgtgtatatgtatatatgtgtatatatacatatacacgtatgtacacgtatatacgtatacacgtatgtatacatatatacgtatgtatatatacacgtatttatatatgtatatatgtgtatatatgtatatatgtgtgtatatatgtatatatatgtgtatatatatatgagctcctcaagcacagaaataagtcataaatactgtttttattttccccaactcctgccaggttgaatttcagagttgatgcttaataagtaattttgaaattaagtttaatagaatatatgtaattattattttgtgtcacaatgattctaccatattccctgtctttctaattttttagtccttcttttgttttattttcccctcattttatcacgtttttctcttacttttattctttctattttttttaacctcttatcaatcactttggactcaaactttctgaaatcacgttctttactttttaattaatatttgttcctggttttacaattattttaattatatcatttatacctacttttctcagatattttcaaatgatatttggagacaattctccatatggcttagcttttctgtatgtcttgttagaagaggcaccgaatgccttttttatgaactctttgcactatcttgggagatagaaataatatctccctttggagcaagaggaagacatgtttattgtttactgtgaaagatttgagttctctaagatcaaagtttctctcctataatgtacctattgcatgtgcaaatatcatccatctctcttcatgtcaacctgtaggaattagaccttgggaaactggcacaaaatgtgagtactctggctactgtttttgctgtgagtaatgtttaagccattttttgtttctgactcaagagtttcatgtcttctgttggcatccatgaaactgtggcaggctaacccattaccttgcaagtagggtacaatctcagattttgttatagacatcaatgacttacgatgatttgatctttgacttatgatggttcaacttcgatgtttttactttaccatggtgtgaaagtgccacacattcagtagaaactgtacttcaagtacccatacaaccattctatccttcgctttcagtacatgaggtaatcaataagttgcatgagatagtcaacactatttttttatatataaaataggctttgtgtcagattattttgcccaactgtaggctaatgtgttctaagcatgtttaagataggctaggctaagctatgatgtttggtaggttaggtgtattaaatatatttttgacttactatattttcaacttacaatgagtttattgggacacaaccccattgtaagttgagttatacatgagttaaacatggttggagtttgcggctaaagcttttggattacttttaccccatcgtaactttatcatggcgtgtgtgtgtgtgtatgtgtagcccggcaggcatggccatccactgaatactttgtcttgtattataattgctcttatttttcatattacataggcaagtttccttcacaagtacagtgttttcttgtcttcctccaagaactttttactctcctttcattgtcaggtctcattataaggcttagcagattcattttaaaaagcaaacctattattttttgtatatttatctagtctattggtctatccgtatttttccatatctccaaaagcatcagcatagccattcttacccacaaagcactgttgaccaacttatgtttagatgtggcattattttcccacctggaatgtcatctctttcttttatctatgtttcttccatttcttttaaaacttactttctctacagaggcttttgtgagtaatcccaaataagtttactcattaagcatttattttttgataattatattactaatattcattgattgcctactataattccaggcagagtgagcaaaccaccacagaacttgaataccatcttggaagttagtatcttataaatcaacatacattcaatttgatctatgttatttggatttaaagatacataattttttatttttcatgttgcctccctgatttcattggaaattcttccaaggcaggcaactgtgtctttttccttaactaataatagtttaagcccataaaaccttttctctctcttcaagcaataagaaaaaatcaggctgtccagcagtgcagtgcaatgattccatcagggacttgactaccatctggctttctgctccaccatggttagtgtgtggctttcagcttcatgattgtaattgggctgatatacctctggacctcatggccatgttcaagggaggaagaaggaataagggatagagcaaaaggggattgtctggggtcaaaatccttccaacctgagacatcaatttcagaagttttccccaaaatgctatataacattgtctcactgatcacaactgggtcaatcaccacccctagctacaaggaagtttgagaaggtgaatacgcttaactaagcatatggacactttacacaaaatcagaggtttttttaaataagaatgggacaagatatgttggttagagactaacaatgtttgccgtaccaccaaactcaacagtggcataaggatccttaaagctacaggataaataaaaagcatcttcttagagcatcttattagaaaatttgaaggaaaacttctccctaaaacaaacatggggtagaatacagataagatatgaatatttaaggttgaaattgggtgagataaaaaaattctcaccttttgccatgtcccccacctccttcatgtgccacagccacactggtgtctttcatttcttattctaatcatagccctttctaatctctgatttttctgccagaaatgctcttccctccaaattttaaataaatgggcagatctcaactttaaacttaacaacaacaacaaaaaaggttctcagagagatattccctgtccaaccagatataaaatcccagtcactttctgtgatattttcaatttagtatttatcactacatgtttattgtgtgccctccaccccacccccagaataatgtaagcttcatgcaagcaaatgcagttaggtgctgtttatcctagcaaagggcacaggaaaaggtaggctctcagtatgaagcagggcacaagaagtattcaatacactgttagattttcactgagatatttatgcttgaaactaatctggagtctttcttctcctctcttagaacattgcatcaaagaatatcaagtcaataggatattggatattttcagggaaaaaagacaaagactaggctgattgaaaatcactgtaacatttgttgtaaaacattgtgtttgcgtcctactgttgctgtataaatatattttcaagctctttttgtgaatatcaaatgaggaacaatagacaaaccactagcttgtgaaaacattttgatcccattttagtcaatgattaattttgtaagacataaggctttgcctctgtcttctcactgccaggccattattttagtgttcatccccaaaaccatactttttaaaaactggatattaatgccatgtaaatgttaagaaaatatttagctcaggaattcatagacaagattcttgttgtatatatcttggaatttttcttgggacacaactggaagtttctctatttattcaggacataaaataacccacttcttagggggaaggttccaggtcaacaatttaatgatttttaaacaaatatcctacagggaaagggaagatttagaagaattttttacatccctttatacttcattaaagcctttttggtgtatattgtgaaattatatgcctagtccagaattaaggacctggaataggctaaacaagaaaatacaggttagtagagttataattaatcctcataagtcagagaataaaatgggcaagaagagtagtcaagtacattgaatagagtcttccattaacgtaattcagaattgccctggcttcccaagagcattttcatgtttcactggtcaagtgaaatacctaccctgtcttatctcgatcttcccacattacttacttccttattaggttcctctgtaattctattgactgaaaattcactgctgtggaaatatatctactagtggagttaatccaaacaatttgggcaataggaaaaatacatgcttaatgatgtgtttgccttctcacttaattttatttcagacctactagatagtcaataagggatgggaaatgacattcttgtgaaggagagatgaaaatattaatatattaatattatgtatttaagcgtagggatgatctcgatataggcatatcataaagtaccttaatatttcattggctgattcatcagagtgaatctatgtggtcgtaaatgaatgggaagcatgtaaaaatcttgtttatctaacatgcacactaaaaagggtcctccaggaattagaatcactcaaaattgtaagttgtgccgcaatttgttgatgtaattatatcaacatttttcttgacgtcagaccattgtgggtgggaagattatggttttgatgatcacacagacataggcttgaatatattctcttattgctggctgtgtgaccacagacaagttacataaacactctgactctcagattcttttgtaaagtgggactcctttcctttgaagcatgagcacaaagattgaaagatacataaaacactttaacatgttgcctggcatgaaacaagtgctcattatgtattaatcttcttcccattctccctctgggagcaatgagtgatttagagtttgtaattcagttgagaagaaatttcagaattgtataaaaggcagtgtgcttatatattcattcattagtccccttattatcagagtgtgttatttgcattacatagtttagccatggtgtgtataatttgaatttaactggaaacaacattcctttcacaaatgttgtttccaactcaattacctgaccttcagctaggttagaagcattggcatttctagtaattttgaaattccaaaaatgtaacccccatactctatgctaattttcaaatcagcagttgaattggctgctcagtcacatttgttcctaaagacggaaaataaaagtgtctgtgagagggcaggcctggcttaaattctgtcttaacttgaaggatctcagaagcagactctgagccagggattccagcgcaagtaatttattaaggaagtactcacaggaaataccagtgaaggatcaaagaagcagaataaaaaagggaagaagccaagcaagggttcaatttcaggtgaagtctctgactcagtctgatcctgtggtgagccctggaacaaaaattgtacctctgagtttgtcttgtctcaagacataggaactgtcttcttataatccagagctagtcaatcatgaactgtagtctgtcccaaggaacataaactctcaggaacttctggttctaaattagggtgagacaactctagtatccaaggtcaagttttagaagtttctgctgtaagcccttatcatgaattacagaacatatgggataaaacaaagcactggtaaaggaaatgaagggtataggagcagatcactaattgtgtccagtacactcttctaggtcccttgcattttctgaaccaggaacatatagtggccatcatagcattactagttcccagtaaggtaaattgttttagtaagtgaacagtgcccaaatatttaggacttacttgaactgaacgttgcatactatgaataggctatttcattgtaccttaagggtttccaaggataatgtaaatatatgaacaattagtactgttatgatgaccaacatttattaaacacataggatatgccaagccatatattagatggtgtatatagtttcctatggtctgttttttgtttgtttgttttgttttgttttttgagacagagtcttgctctgtcacccaggctggagtgcagtggtgtcatctcggctcattgcaacctctgccccccaggttcatgcgatcttcctgcctcagcctcctgagtagctgggatgacaggtgtgcaccaccacacccggctaatttttgtattttttttttagtagagatgaggtgtcaacatgttggccaggctggtctcaaactcctgacctcaagtgatccacccaccttggcgtcccaaagtgctaggatcataggcatgagccaccccgtccagccatatatactttattatcttatcaaacattagaagcctcattttagtgatgaagaaactgagcctcaggaaattaaaaaaaaaaaactcataactagtaagtggttaaactaaaactatattcctggtgtaatccaaaaccctagatccttccaataagcaaaattttgccctttaattgcagtaatagaatctgtgaaacactaggaagctaccagtattacttatctatgctgcatatcaaatccccaaacttaaaacaacaacaaacatttatcatcctcacagtttctttgggtcagagatttaagaacagcttatctgggtagctctgacttggtgtctctaataagatggccataaagattttggctagggctgcaatcctctgaaggcttgactagaaatgtaggattttttttttttttaattatactttaagtactgggatacatgtgcagaacatgtaggtttcttacataggtatacacatgccgtggtggtttgctgcacccgtcaacctgtcatctacattaggtatttctcctaatgctatccctcccccagcccaccactccccaacaggccccagtgtgtgacgttcccctccctgtgttcatatgttctcattgttcaactcccacttataagtgggaacatgtggtgtttggttttctgttcctgtgttagtttgctgagaatgatgatttccagcttcatccatgtccctgcaaaggacatgacctcattcttttttatggctgcatagtattccatggtgtgtatgtgccacagtttctttatccagtctgtcattgatgggcatttgggttggttccaagtctttgctagtgtgaatagtgcgtgctgcaataaacatatgtgtgtaagtgtctttatagtagaatgatttataatcctttgggtatatactcagtaatgggattgctgggtcaaatggtatttctggttctacatctttgaggaatcgccgcactgtcttcctcattggttgaactaatttacactcccaccaacagtgtaaaagcattcctatttctccatatcctttccagcatctgttgtttcctgactttttaatgatcgccgttctaactggtgtgagatggtacctcattgtggttttgatttgcacttctctaatgaccagtgatgatgagtgttttttttcatatgcttattggccgcgtaaatgtcttcttttgcgaagtgtctgttcatatcgatgtgctgtattcaggagacccatctcatgtgcaaagacacacataggctcaaaataaagggatggaggaatatttaccaagcaaatggaaagcaaaaaagagctggagttgcaaacctagtctctgataaaacagactttaaaccaacaaagataaaaaaagacaaagaagggcattacataatggtaaagagatcaatgcaacaagaagagctaattatcctaaatatatatgcacccgatacaggagcacccagattcataaagcaagttcttagagacctacaaggagacttacactcccacacaatagtagtgggagactttaacaccccactgtcaatattagacagatcatcgagatggaaaattaacaaggatattcaggacttgaattcagctctggaacaagcagacctaatagacatctacagaactctccaacccaaatcaacagaatatacattcttctcagtaccacatcgcagttattctaaaatttaccacataattggaagtaaaacactcctcagcaaatgcaaaagaacagaaattataacagtctctcagaccacagtgcaatcaaattagaactcaggattaagaaactcactcataactgcatagctacatggaagcagaacaatcctctcctgaatgactactgggtaaataatgaaattaaggcagaaataaataagttgtttgaaaccaatgagaacaaagacacaacttactagaatctctgggacacagctaaagcattgtttagagggaaatttatagcactaaatgtccacaggagaaagtgggaaagatctaaaattgacaccctaacatcacaattaaaagaactagagaagcaagagcaaacaaattcgaaagctagcagaagacaagaaataactaagatcagaggagaactgaaggagacagagacacgaaacacgaaaaaccctttaaaaaatcaatgaatccaggagctggttttttgaaaagatttttttttttttagactgagtctcactctgtcatccaggctggagtgcagtggtgtgatcttggctcaatgcaacctccatctcccaggttcaagtgattctcctctctcagcctcccaagtagctgggattacaggcgtgtgccaccatacccacctaatttttgtatttttagtagagatggggtttcaccatgttggccaggctggtctcaaactcctgacctaagatgatccgcccgccttggcctcccaaaatgttggaattacaggtgtgagccaccgcacccggcagtatgtattataggatctcctatcagggtgtcccactcatagcattggcaaattaatgctggctattagcaggaagcctcagtttcttgccacacggacctccccatagtactgcttgagcatgctcaagaaatggaagttgtttgatttttttccccagagtgagtggttaagagaggacttttggaagccaccatgcattctgtgacttagccttggaagtcacataccatcacgtctacaatatcctattagttacaagatgaaacctattcaatgtgtgagaaaactacataagggcatgaatagcaggtggtaaggatcattaggagccatcttgaagaatggttaccacactaccattcctttcttcttaatcctaagtatagaactcctgctgtctcctgaggatttgttaagcactttgttgctcccacatccccctcaaaaaaaaaacttaattaaaagtagctaagtagaaacaaatattcaacacactagtaataaatgtagatgttactgaatatttagaaaggagatcaagaagaggactgacatcacacatcacttgatagaaacaaaattaatttttcttttacatctgcctgctttcccttcccaaatccctctcttcagctgccagctgtctcattcctctttatctctttcccacatagcctcaaaactctcctttgttgtgccaaataattcagctctggtcctgagtttacaaacacattcttggcaaaacaaaatcctgatggccattctcactttctttagaatgcaaacatctttgccctattatggaaaatagggatcaaagtagcttattgatatttactcaacaaaaagtcctatttcctaaggtggagggagagagacaaatatgttctcttgttcagaaaataagtttttttctcctaagtgttatatatatatataatatactcttctagcttccagatccagggaggacagtgatccttctgtttcttgctgattggttgctatacctgtttgaaattatagctcttacatttttgtcattgagttagttgctgatcagttgctatacctgtttgaagttacagatcttatgtttttgccattgagttagttacatcctttcttattttgtcactgagctcttaaccagctagcctacatctcatcttgtttagaaatattcttatgatttctgtttttcagttcacctgattctggaaaagaaaagaaaactttgcccctgaaggacgcaagcaattatgagtggatactacataagggccctagctttgtcatgctcgttgatacacactcccacctagcgccttgcactcagaagattcagttcatatatctgttaattgactctaactgactgaggttccctggatgaggagagcaatgagaacagaggcttgtcagcctgcataatccctactaataagctctactatactttgatgcttatcttcattttcttaaactgaaaaaaaaaatcttttggcaaattccaaaggagatcatcactgaaatcttgctgagttcaacttataagcttgtgggcattaaaaattatatcaatgaggtcgctgccctgtaactgttcacacttttatttagaggggaccagcaagttatgactgtagaatgttgataccagttttgagaggacaggtttaatgaagcacatcttatgcctcttcatccttttcatactcatccataaaatatgagctctattggctatgtagtaattaaaggctgaaaacaagaaggggctattatgagctaagaagaacggtaagacatttatttttgagggtggcataatctctttggggaaaaaaagtatggataaaagggagaggggccaggcgcagtggctcacacctgtaatcccagcactttgggaggccgaggtgggtggatcacctgaggttgggagttcgagaccagcctgacctacatggagtgaccctgtctctactaaaaatacaaaattagtcgggtatggtggcgtgctcctgtaatcccagctactcgggaggctgaggcaggagaattgcttgaacccaggaggtggaggtcgtggtgggctgagattgtgccattgcactccagcctgggcaacaagagtgaaattccgcctcaaaaaaaaaaaaaaaaaaaaaaaaaaggaaaagaaagagagagggaggtagaaatgaaagggtctattcagaggtgattgcaaagataaatctagatgtcatagagggaaaagtagtgagagggaaggctggaaaaggaggtttctctggattctagaggctcttgagttgcagatcaaagcttggattttatgctattggcgatgagcagtcattgatgacctaaagtgacataataatgaaaatactgctttgggaaaggtaacccgggtcaccatgtatatgaaagattaatgtaaggagaaattgaaagcaggaagagtaacaggaaaatttcagaaatttagaaatgagagagaagaattgagcctatgaatattccaatgcaaattaatgttctattttttctttgcagtttctagtttctcaaatttaggcttcatgcaatatgctttgaaaatatgatgattatattaattcatagaatcactgattcctcttctaccccaccaatgtttgtaaggtgcattctgataattttattaaccatacctcttcgtaaaggtggtaaaatattgaagctcttaaagtggccttggcaaatgcatataacctgtgagtgtattgtgcttagaattattataaaatgatttttaaaggatcttcacccaggcacagctaatatgagtaagaatcctaaatgtaagttacttctagaccagtggtccccaaccttttaggcacccgggacaggtttcgtggaagacaatttttccatggacggggtctggggggtgatttaaggattaaaccgttccacctcagaacatcaggcgttagttggattctcgtaaggaggatgcaacatagatcccttgcatgcatgtgcagttcacaatagggttcatacacctatgagaatgtagggcctcccatgatctgacagtaggcggagctcagactgtaatgcttaatactggctggccagccactcatctcctgctatgcagcccagttctgacccaggctgcagcccaggggttgaggacccctgttctagacatattattgcacttgtatcattttactgctaatatattactgtatcattttactacgaatatattgtcacattataataaattccagatgatagcgcaatcacagcacaaatacttatcttttctaaaaaaaattccagttgtagatttgttcaatgcaatgtggtatattttatctttctaaagagcagagcagtgtggcaattctgaatatacacgtgcttgctgaaagcgataaattggtgattttctccttcgtgggacagaaacaagtgagatggatataaagagaaaatcctacaagtaataattttagagcacttcttagtagcaatttcaatttgtcactagcactctatgtattcccaactgttactcctttcattccataatttttattctcagatctttccatttcatatcccaaagataacatttgctcaaacataaaaataacatttagctgcctttgcatggcccttgcaaatttatctctcacttcttgtttcccttagttccccagtagccttgaaaaacacccaagttggctgaattctaagccgaatgactgtgatagctccacagtagcataattccaaatgcttatttgatagctccaattgatggctaattggcccttcaaatttaacatacttaaaaggaaatttctgtttatcctctactctcagaattgattcttcttcaacttctcctcctagtacatggcactaccattagttggctgcccaggttaagaaaatcatgctaattttaaaaattaataataaataaaaatctagataacatttatttttcttctcattccctaaacctctacctacaagtatacaatcttccagaaacttcaaactgcaaaatatattccaaatctaatcacttgtctccttttctgctgcccccaaccttagtttacatctctcttcagctgtccttcaggtgtttcctcatgggtctctgttctcttgtttggcctttgatccacactcttcacacagtagtgttgactgtaggctccccaaatgaacaacagaaaaaccttttgatcatacatatttaagtttttggaccttctgctgtaagaaaaaaacataattctacagagtcttagtaggatctcaaaatgggaaaattagaataggttatttattatattttacagcttggtctgggttatttcaaggtgggtcttgttaggcagggattggttaagtttggacaaatttcattgcatagttttgaattgtcggatacatttgagtgaatggatttggattggtgggtactgtgagacaatggttttgaaatgagttgtgacaaatatgtcactgagtcagttcatagtcatcttttaggagcaggtgtttcttggaccaagcatctaggttattttggcttggagtaaatattctttaatatggagcagaaatgtatgcctggttctagtttcatagagagagaaaattatgcttcataggtatttaaacttaaaacatctcttcatatccctgcttataatccttggaaagcttcatgctatgatcagaataaaatttaaactcaaattagaagatcctaaataggctgtcccttgtctcctcactgacttcagttcttaccactcttccccttactctccacattccagccacactagcctttcctttccttgagtaaaccaggctcgttcctgcacttgcgaattgcctctgcctggaatgggtctttctctttcatcatttgaagtctcccacaaatatcatctcttcagagaagacttcttaaggctacccatctaaatcagctcatgactcccatatctcttcactttagagttcatggcactcatccctacctatacaaaattatggtcttttaagcctgatatcctctattcaaatctttcttctgctacttattagcagtagaaccatgactatgttactttgactatctgtgcctcaatttcctcatacattaaaaaaggacaatgatgatacatatgtcatagggttgtcatgagccataaatgaatttagctttgtaaaatgttgactctctaaatattagcaatacaacttgttggtaaaataactgtgataaggaagaccactacctcaggagaactactttggttttgtctcccaaaggtgaaggcaaggtcgggatttattgagaattggaagtttggtttaaggtggggttttttcaaaaagaggattttattaagattgggtatgaatcaggatataacagtctaggattggtgaaaacaggaaagccaggattttgagacaggatttcaaaaaattgtactttgtaagttctctgttgattctattgaaaagttgggaagagatgggtcttttggaaagtccctgtaacgaacaatcaaaccacttgcttcagccagaaactcagggaaagtaatgacagtgggatacaaagttacattatcgtggaggtatgaggttagggagctttagtcctcaatatccaagctgaatatacaggtagatggttttggtgctcagcatgtaaagcatatagaacagtgcctggcacataataagagcttaagtaaggtgaatttcatcattaacttattattgtcatggaagccacaagggtggtcatttgtctgtatctccatttcctggcacaaacattgcttagcacaaagtaggtactcaataaatcattgtggaatggataaatttatttatttactggttttctgtttgtctccctaattaggatataaactctgcgagagagaaaaacatgcctttattgttcatcaaagtattccaagggcctgcggcggtatttggcccacagtaatcacacaaagtgtatttgttgagtaaattaataagcttttaagtatcacaaaagaatcttgagtgtaaaaccagctcccagtttctttcacctccactgaaaggtgtgagtccagaaaacgagaacaaaatgaagaacagaagaataaaaaacccagttacattctaaaataaattgggggaaatgctggtttaaaaagttaagtaagatcctttcctgtaaggtttctcagatcctttaatctgccaatgtgcattgttgattactaatgggaaatagtgtgtatacttgtttgatcagggaacttgtttttcccctttttgatttgagaacacttatttgcatctctggaaatacaacattagcgttatttgagatgttctttgggaaatgctgtattaagcagttttatccaaagtcagggatgccatcataggaagccgaatgagactccttggcagtgatctggtgttgagtcacttcagggtgatgggagaagcacagatgaaggcagtcccatcctgatagggctagggctcctccagagactgcacataagtgccctgtttgctaccagaaagcactcacatgtgagggagagtctggtttaatgtccccctagttggtgaacactctccaatcttaaccacaagtttcccacgtgtctctgacatggagtgccatgagagaagagttttctactagatactcaggcagcattttgttcttttacttggccctcacgtgtaccttcaacttgggttttacccctaaaaacttatgttgttgtgtttgggggaagtcaaaaccaggacacatgaaggattcatattctggagcttgtctacttaaaatgaccaatgctttcaaacaattatttcatattcgtatgcctcagattcttcaggaagaaactgagtagcttgaatgatagtcatgggttctgaattgtacattgtattagtccattttcacattgctgatgaagacatacctgagactgggcaaattacaaaaggaaaaggtttaatggactcacagttccacatggctggggaggcctcacaatcatggcgggaggcaaggaggaacaagtcacgttttacatggatgacagcaggcaaaaagagagcttgtgcagggaaactccaccttataaagccatcagatttcatgagacttcttcactatcacaagaacagcatgggaaagacctgcccccatgattcaattacctcccaccatgtccctccgacaacgtgggaattcaagatgagatttgggtggggacacagacaaaccatatcatacattgaggaattttagtttgggcaaggcagggaggtgggcctctgggagcagcaaataggcaactcctgttagtgcctctaagtcaatgcaatcttgctcttatttgctctatgcaactttattagaagagaggaagttcctacttaaaaggtagtttttattagccccacctgtgcaatttcacttgaagacatctgctactaaaagtagtttgaaaactactgtactaaaaaatggagtccactgtctttttttgtatggtctccaagctaacaaaggttttgatatttatagatggttaaaaatgtcagaaaagaggaatacaaattaagcattcctaatctgaaaatccaaaaatctaaaatgctccaaaatccaaaactttcctggtgctaacatgacttcataagcggataattccatacttggcctcatgtgactgggtttcagtgaaaatgcagtcaaaatttcattttgtgcacacaattattaaaaatactgtataaaactaccctcatgctatgtgtataagcggtatatgaaacataaaggaatttcttctttagacttgagtcccatttctgagatatctctctatgtaaatgcaaatattcaaaaatcagaataaatcagaaatttgaaacacagtctcaagcatttcagataagggatactcaacctatattccattatgcacataaattatatgagattcggattttagtgtccataaatatagtcttattggaacacagccacacccatttgtttacatattgttaatggctgctttttattgtctatggtgcttcagcagcagagctgactatttaccacaatgactatatgattcacaaagcctacaatttttactacctagtcctttacaaggaaagtttgctaagccctgacctagatgattattaggatccttttctacccccaacatttgatttttgttcatctttgtggaaccatattgactggctatgtaagattcttctcaaagcaaattgaatcaagccaggactctttcactatgttataaaatcgatttaattatgttacaacaatccttctcatttgagaacatacactacctaactaatccatgtctttcaatctgccttcaccttcattctgaatggcgtttggtatattctactttgttatgttgaacatttctttttttatagtattttaacggggcagcataaaattgcatggctcctctgcaatgtaagtactttagcacgacagagttatagggttgtaaggaagcttgagatgccatctaatctctcctactccttctggacagaattatacttaaagtaccctggaaaggttttggtttactgtagtctttaaaaatccctccacaagaacatttccaaatactcactttgtagcacatcagctgtcaaatgatttgtaacttgggtgcctatgtctgaccaaaagtatatttagagttgttccattttaaggctttaaaatggtttattaatagggcagtacttccagctactcaaaccttgatttttattccagccctgagtcttaaatctgggcaagcacggcttctcagacatggtatcttctaagggcagtgattaagaggcaggacctgggagactactctgttgttgcatgctctattctcccctccacactgtaaaatcctcgcggataggagcaggatttcttttttttcctaactcccatagcacacacagagtgtattgaagaatgttcagcccaacctctttgcaagcatctttattacaaaagatgaagggagggtggatgtaatcaaatatgtactttatattggaaagcaaccaagcctctctgtgcatgcactaccctcatacaatcgataataaattagcattttatttatactgtataatgccgttcttttcaggagtctgatttggaagccaactactgtttgtgttctccaaagtggtttttgatggagtgctaattatgtttcacctcaagagcaatgctgacgggggaccacaatcgccttattgtagtagatccagctgatgaatctccaaggatagcctcatgctatattctggggggcaagtaaatataaaaatacatttttgatcaagaaaatgataccatttacacaacagtagcaggattcagcctttgtaaaacagctgcatagctgcataactgtgacgtgattttttttttttttagtagagaaaaaaacatggaggaaaatatatatcaactcaggaccctagctgaatctggggtttagtagttcatggtgggggcaggggactatattttcaaataaatctagcctaagtgaatttttgttccagatagaagaccaacttaataaatgagtcctgcgtagagaagtatgtcacatttagcaaaagaagacacgcgcaggtagagccaatcttttcacttgtgcgaacctcattaatcctgtcacataaagttttgcacttgtattttagctcaactcaaggaagcttgatccagatattttttcagtatatttttcaatacaacataataaagattggagaatattttaactccacctttttttctttaaagctttcttggccaggtgtggtggctcatgcctgtaatcccagcactttgggaggccaaggtgggcagatcatctgaggtcaggagttgatgaccagcctggccaacatggtgaaaccctgtctctactaaaaatacaaaaattagccaggcgtggtggcaggcacctgtaatcccagctacttgggaggctaaggcaggagaattacttgaacccgggaggcggaggttgcagtgagctgatatcatgccactgcactccagcctgggcgacagagagagactgggtctcaaaaaaaaaaaggctttctttgggtcaggctgccctttgcaaacaccatttttaccaccaaagtccctgcagctcatatactaggctgagatatatgtatgtatgtatatagtatataaaaatggacgtgctctcacattgctagaggtacatagactctctgcatgacttgggattcagaaagtgtgtaaaattaagtaagatgacaatagcaatccattaattattctacatctaccagagcacacttccatgtttggtcctgtgcttttaaggaaagacctgccttttagtgtcatgagggctctcaggaatggcatcttgatgatcacaacattaaatccaactcctctgtcaggcagctaaagtgttaatttattttgtaattagatctctcaccaaagctcacaggaacctgcatttggatctcatttgattatgtatagacccttttatatatgccatcatattaaaggttcattctatgtggcctgccttatgtgctcagtaaacatttgttgaatgctgaaacaaatcaccctggggttaaaggaaagcgttgagggtcacagaggttgacttgccaaacgttactaagctactatggggctaaggcaggagtgaatagttgctgctttaggcaactccacccacccccgaccccgtttgtgctctttctttttttctaaattgttctagcagtctatgatttggtgtacttctttggttaaaaaaaaaaacacacacgaacaaacaaacaaaaccttaagggtctttaaaaaataataagttatctgttattgaggacttaattttgtgcactacactgtaccaaatgctttatatttattaacctatttctttttaagcaataaatctaaaagcttggtattcttatccccattgaaaaattactttaaataaaaaaaacctctccaatgacttttattatattcacataaagctaatggggccgattaaatgtttattgttaaatatccatgaatcatttcaaatatatatgtatttttataattgtaactcatagataataatacagttgggctacaaaagctatttggaggaagacaacaattctaaatggaatgtgatttgtgtttgtcaagattatgtcagcaatctatgattttagcaatttatttggtccatacgtggatagaaaatatcaagcacagggaaggaaagtataaacatttgttcagcaactactatgtgtcagacatcattgatgtttgccatatttagatgtcacaaggaccctgtgagatcctttaaacattttctgtaattaaagatgaagcaactgagtctcatggaaattgggaaatttgctcaaatactttactttgacccaaaggaaaatgcaagtaaacccataccactggctgaatattgggttttaagggtttatagggagaaatatttttcaaaatgtatctgacttgggtgggtcttgagtctagatagaataaagcactctatcttctgtgacctgggaaaggggtgccgttgggggtgggaggagtcgggatggaaaatcaggtctgtttaggaccaaatttagttcccatttaaaacactgaactgcttccaaagaaattaaactcatgaccttggtctacatgaaatgaagccagataaattaacctgacatacacacttatataagaaatccttgaaaaggaagagctgatgaaaccagggaatcatatttcctgtaagaaaagttggtaaaaataccagtgaggtactttggtgtatcatattataatactatcagtagtataaatgaaacgaacaaaaatggtaaaaaaaaaaaattgatctagaataatgtcatcaacaaagtatgcaaccatttcttttttcttctttccaacttttattttaggttcaaggcatacatgtgcaggttgttatatgggtaaattgcatgttccaggggtttggtgtacaaatattacatatcctattctaagtgctgaaaaactaaagtttttaatgctcctatcagcaaaaagagcaccaagcaaataaacatgtcctaatcatttgccatggtagtagatcattaaaaaaatacatttatcttaattacagaatacatgctaagcagaggttcagaaataaaatttctaatgggaactgacagatcgacaaaaggctaacataatatttgcttcatttgtaacaagtattggttgaagggtccaggtaactcaactagcctcagaataaaggatgtaaaactgaaaaggagattttaaacattcttttttagtagcaaaattacacacatgttttatattaaaaaggtaatgaaagaaaaggtggaattttaaaattacgtgaatttctttgggatgaaagcttctggaggcctagtgactgctgaacatttctagaaaagaagacaggtgaccaaaaagcaaattggaaacaaaagacagaatgtttgaagatgaaggccagaggtaatcgatttcattattatattacatcatgtaaaaaatttcttatttcattttaaacagatacacggccatgatgtagaattagattttcttaaaactccaaagaaaaagaaatagcaatttagaaaagcaaattgtaggataagatatcaaactagttagtcatccagttgcttctaatgtcaagtgttttctactttctggcacacacccttgctattgcttttccatttctccctggtcattctcctcctttagtgtccaactcagacttcagccacccagacaaagtattttcttctcctactcttctgattgtgctgagccactttgctgcctctagccctgccacagcacctgttgaatttgcatttcaggtggccgttgaaattgcatttcagttctgagctctggtggataggaaccaggtgccattgatgtttttcactttttcatatattctcagtgccttcccagttgtttagccttcacctgtcttgcccttctctgaattccagtcccatcagctttctttctgtccccatccttgtcataaagccccatccttgtcataaagccccatcacagcatttgccctatgcctgggctactcttacttctctttgcctaattatttcctgcgtgtccttcacatcccatctcagagaggccttcggtgacctcttcatttagatcaaattgccttgcgttgatagtgttgtgtacctagcattgggcacatttgcaattataaatttgtttattaagattttacggccgggcgtggtggctcacgcctgtaatcccagcactttgggaggcctaggcgggaggatcacgaggtcaggagatcaagaccatcctggctaacacggtgaaaccccctctctactaaaaatacaaaaaattagccgggcgtggtggcgggcgcctgtagtcccagctactcgggaggctgaggcaggagaatggcatgaaccccgggaggcggagcttgcagtgagctgagatcgcgccattgcattccagcctgggcaacagatcgagactctacctcaaaaaaaaaaaaaaaaaaaagattttacacccctaccagactataaatgtaatgggggcatatactatgtccatatttcacttaaggttatatccgtagctcatttcatagggctgtacgtatagtagatggccaataaacatttgtgaaatacattgataatatggggtgtgtaacatttgtacttttgaatctaataaatactcatggtttaagtcaattatcagtggtttatggttcaagatgtttgctcttaatttttcttcactgtatcaaatagagatattgaaatttcacttttaccattttccacatttttttccagttccagtaaaattcagatttagtaaccctttcctacattatttctttccccagttattttaagagcatttcagtagataagctggtaacaggggagaaggaaaagaaactaaagggaaggaaaagatattcctgataaaaaaggtttaactatcttgccaaaatgaggttctaagggaatttgattaaagaagtattaaatatatggacatttgtatatttgatactcaattttcaaagaccttttccctttaataaagtagtcaagtgcttttacatgtgggctgtctgaccccagtaggggcataaaaaggctaagaattctggcttgttggattatggcagttggacatttgaaacctacaattttgatgtgcatccaaaatgccactggctaaagagacccccctctaaccctgtccttgcttgtgctacagctagaagcacacaggtgagagcagaatgaaacacctaagaaatctaaagaattggagtttaggaccagaaaatgaaggttggtgttcgagaggctaactggagattttataatgtctggcactctggggaagagaacccacagtgtaaagtttaaggaagtaaaatgtatctactcctttatattaggcggtagtgtattttgcctgtgtttttgttataatcaacaacattgtgttatgattgatccattttaggtctctcttttgcaagactctctgggttccttggatgatgaaaaggttgttttgtattttcatatgtccagcactgagcaatgtgcttaacacttaatagatgctccagagatatttgctgaatgaattcccatgtcctccaaatttgtcctatcctctctgattagtttatttaattaatttatttatttttgagacggagtctcactctgttgcccaggctggagtgcagaggtgtgatctcggctcactgcaaccttcgcctcctgggttcaagtgattcttgtgcctcagcctcctgagtagctgggactacaggtgcttgccaccacgcctagctaatttttgtgttttagtagaaacggggtttcaccatggtgatcaggctggtcttaaactcctgacctcaaatgatccgcctgccttggcctcccaaagtgctgggattacaggcatgagccaccatgcctggccctccccaattagtttttgtctttttttttttttagtttaatgtattttaatagcaaacttacaggaacagcacagaagacagacaacattcaaaacatgtacttggatgtaggacaactcagtcagaaaagtatagtgaatggatggaatctactgtatgataaaaatgctacaaacaccatttagttgccgtcaataagaaatgtacttgttttgaaaaaatccaaatgccggcattgtccagaaaaatttaacgggtttatttataattattttaaagttgaaccgctgaaacttgttcactgaaacattttaacttgcattaatgctttatgactccacatttatattaaaaattcacacacaaatgaaaatggaaaaactgccaatacctaattactgtcccctatttttccacttgcaatcacatacttaggtacattttgaccccatggaaaaaaattaacgttcagaactaccagtaacaggaagaagagactttttttttttattgagaatgaaatgtttcccatcatagtggattcttaagcacgttctccacgtatgcagcctgctagcttgatgtcttttggcataattgttacacgtttggcatggatagcacacaggttggtgtcttcaaaaaggccaaccagctaggcctcagttgcctcctgcaaagcaccgatagctgcactctggaagcgcagatctgttttaaagtcctgagcaatttcttgcaccaaacgctggacgggaagtttgtgaatcagaagttcagtggacttctgatgactaatttcacgaagtgccacagtaccaggcctgtaacgatgaggtttctccacccctccagtagagggcgcactcttgcaagcggcttttgtagccagttgcttcccgggtgttttaccaccagtcgatttgcgggaagtcagctttgtaggagccatgatatagagacctccttgcttaaccacccttctccttcggctggagctcggcgagctagaggcggcgctggctagaggcgagctagagactggctagctggcgagctagagagcgacggtggcggtggcgcggcggcggctgcgaacacaattgctccaattagttgtaagcatattttttaaaccatgcttacctatgttatactatagttgtgtaaagataatttaaagcattaacaaaggatttaaccatttagtaatcagagaaggaaaaacgtgttagaaaaaaatgaagagattaatctttgtactttagctcaagaaaacctgggtttcttggtaaaaaaaaaaaaaatgtagattcttgggtctaatcctggatctaatgaacaagaattttttggatgatgcccaggaatctgcctttaaaaagtcagttacttttggggaccagtgttttgagatataaatgttaaggagatgggcaggaaaacaaatattcttactagcattgttttatcttgactttttcatgtctgagtgtgggaaaatcactctataacacttcacttgtgataaaccgctccagattccaaagcagaagcagagtgaggatggtgtgtgtgtgtgtgtgtgtgtgtgtgtgtgtgtgtgtgtgtgtgtgtgtgtgttggagttactgggttgccattaaacttaattgactctagttatttctgttttctcatgtcatgcccaggataaataatgagtctcaaaagcattgaaatacttttgacccctaaaaaacaatctattagtgttttgattttataatacatgtaagagttatttgttacacctgtttcttctcttttttatcctccactcttgtcaaaatgtcagtcattaaataataggtattttagataagaattaaatatgtagatatttattcacaaagaccctgcaattttccccaaaatagaaaaagccaacttttgtcttcagtgaaagacagaaagggtaacatatgatatgaattattagatataggatactcaaattcaaatttgtttattataaatttgttattttagaaatgacagctaggacatggaatgactaaaaatatgtacattcaataacacatttagaaatacaggaaattttagaactaggtactttgagaattaagagattaagaagggattattttctatctgcacagttctcagggaatagatatgatgagtgatcctaactatttgagtaaatgtcaactgccagcagacaccaccagcttatatcgaagaaaagtcacaaaaaatatgaagagattcatcacactgggaatggaaaacatcgaataagtcagcaagtccagcaaaagaagaaagtattacaagtataatttaaaaatagttttggcaagaggaggttggggagaaagcagagtaggctataataataattataactcaaagatgggccagacctaaatgtacaccttggcctctttccatcctaaaatgttctatattagcaaaagaggtgttatgatttatactcagctccaagtctagactggtttaggtttcctgtgtttaattctgcttctttcttaacaaaaaaatctagtcatctagatctcaagtgaaatgtgcaattgaaggtataaaaataaaattcaattgaggaaggcaagtttgtccttaaaataaaatttaaaataccagcatttatttttaaaaaactacctaattacatctagtcccatacatatgttcaagattaatatgcaactgatgcatgaaaataaaattcagctgagggtaactactgtctcattaaaaagaaaatagaaaactagcatttctatgaaaacgtctagctaatcatataaaaactcatatacatgtgcattgacaagtaaatgctggtgatatattatttgattgaggtcaatttttattctaaatatttttgcatagtgggaatttgttatgttaaataattttgggattggatctctgagagggcttagtaatatattttatattaaattaatcacagtgaaaaaatctttgaaataggcttgatgtttataattatagtattctgtgtttaaacgtgaaaacattgtctccttttaaaaatggtattaactctaggagacaggatatataatgatcaattctttctaccatgaaactctattaattactaaaagtgttagtatgcaaaatacaatataagttgataagaaaaaccaattcacatttgatacccagtggacaaattagaataaaatattataatgttcaaagaacactctatattccataatgttctctgttaagcctgtgtccttctgagtatggtgagtggcaattctggccttaccttcaaacatctgcttcatgtttaaattaaattatgctacgtgcttgtccctgcataagagtagcaaatactgaaagtacagtgaaagggatagtaaaagacttctaagtaggagaagtattaaaaatattctccagctggtaaggctggaacactgatgatcaagacagttctgttgaagggtgggaggcgccctcttctttgctccttcaggtgttaaccttttttttttagatggtggttgattgcagggcctggaggagggcttgagtgtggcctgtgtggcctgggtctagagaagctgttatttaccaaccaatttggaaagagtttaactacggtatttaaaactgtggcagctgtatctgaccaaaagttaagcttctgaacttttccccatagatcacagagggcgggcctccagggaaggtttcaagcaggaggctgacttgaggaggtttttgttttagaaagagccttcaggtagcaatgttgaagatgatggattgcatgagtttgagaaaacattcaggaggattggttttaaaacctaagaaaagaattgaggtagtggctagggagcagaagtgaagaaatggatgtgagaactactttggaggaataattttacagagtcagtgacagttttagaattggatagggtgtgagtttgactcccaggattctggcttggaccactgtggaaaatagtaccattacctgggagaggataaagatgtagtggtgtctgttacttgtttgtctggtttgctggctgattggttggctttatttaattaattttctgagaagagccatgtttataagctgcaggcacaactgcaaatacattaatttaaacatataatagtgcggctttctctgtcggacaacaaaaaagaaccagaaaaggaagggggtgaggggctgaataacattccatgatcacctattatactcttttaactaattttggaatcacattcatgccatacagaggatagtactgttgccatttcacagatgagaattctgacttaccaggtttgaatgactggcctactttctcatagtcagaatgtggcagcgtcacaatttaaatccatttctgtccatcttcagggtctcagtctttaactgtatgaaaatacctccaaaatggaaaagagtgaaaaagaatgaaagggaagaaaagaaaagaaaagggaaagaacgaagaaaaaagtatttagagtgaccaaagaagaagaaagcaaattccaattgaaagggaccaagcagagatgctcatccatgagcaggtcttacccccgcctagacaagttcatagtcctccctaaaggtggcaggaagtttacacagaatattagttcctcataggtgtccctagccttcaggtgacctgaacatgcagccagtaagtgaactggtatcagtttatggccaaaccactgctctctagacttctgcttttagagtggtgcttttcaacctgggctgctgcagatcctcacattctttccggtctgtggagtaattgagagtaggctattagaaacttttataggaatctgactgagtactgttgtatctgctggatccagtaattttaaaacgggattgtattttgtatgtctgtttcatttttcaagtcattggcattgcgttttatgaaataatatatctgtgatgaatcagaaacaaaggaacaaaaactggcccttcaccacagataatttgagaagtaagctttagagcatcaaaagaaaaaaagatgatgagaacctgataggtgtttttgtgctcttggtaacagagactttctcttataaatgtgatggtttagtgaactgcctttacatagcgatctattggccccatatacaaatataatcaaatgatttgtgtcatttgaagctacacaatagatgaacctggtttttgtaatttaacaaaaaatccaatttatgtaacatattaaaagaagcattatcaacttgttttctcctcaaaagactgtagctgttaaactccttaattacttcattttcactctcagtgtaacattagcagtttagcacttcaagtacaaaaatgattaatgagcctgagaattcattcgcatacatatcactttgcatcttgacataaccctggagcctgttctctattctagccatagacatacttccctagcaaatatcttattgcatattaaatgcctaatcattgcaaagtatgcataattatagtcatctttcctgtttttttctacgcaaacaaaaaagacaacaaatcaaatgcattcaaatgtaactaacattttaaaccaaagtataaatccatagggagcatcatgatttttgcattgtaactgtccccgaaaattcaattgtgatttgagctgaagtgtcattcatctaaaaatgtatctttaaaatttttttgaacatgaaggaaaagactttcaatttctatatttatatgtatgtgagtactgtgacttgggaaaatatgacgagagtaaagactgcattgtggattcagagaataagattttatttggagttactgtaagaaatatctgcagggggctatttctgtctaaccatccttggcttgcattggtgacatgtgcctacatgtttcttttagctttagtgaatttcttttttgatctcctccaaggtgatcccacagtgctgactttgtccaatcattcccgaggcttaatcttttaagtatgatcaatggttctttgtgtctttgccttcccttgttttttctactgtattctgtggagttcagccacagctctgtgctgtccctacctaataatcctcttttccctacatgctgatcacctctaagctacactctactacattcagtatggaatcaggaagactaaatgaactttttctcagaactcagagaactgcacttgtcaggcttgttgccattacacaacattgtagttactggaaggtgaaccaaacaacttccaggggcctttcatgtgcaagggaagagcagaactgtagactacttgctagactctaaatctggtctccaattgtttttgttcatgtaggtaaagctatatgctctaaatttgtacctgtttccatttgcttttagagggagacatttagttcggggacaaaataaataatgtccattgaactggacatagtcaaatatttccaataaatttttaaaaccatgtgtgtactccggtaaagcacaggtatcattttctcactgcacaagtgtatactacaaatgcagtcttgcggctggacatctctgaccaacaactagaccactgaaattgcaaggcaatgcagtcaactaaggcactgaggcactgttcccaggaaagatcgtttgattatgatacaatcaggactccttatctagacccatacttgataaatagggttggcagataagttacaggacgcccagatataaaaacaaggaatttaaaaaagtgtaagtatgtcccaaatattacatgaaatatatttatattaaaataaaattactccttatctgaaatacaaattacactgggtgtcctgtatttttatttactaaatatggcagttctatttataagtggtactttttttttgtttgtttgtttttgagacagagtcttgccctgtcacccaggctggagtgcagtggtgtgatcttggctcactgcaacctccacctcccaggttcgaacaattctcatgccttagcctcctgtggaactgggattacaggcatgcaccaccatgcctggctaatttttgtattttcagtagagacagggtttcaccatgttggccaggctggtctcgaactcctgacctcaggtgatccacctgcctaagcctcccacagtgctgggattacaagcgtgagccaccatgcccggctataagtggtactttataagcagcaaagatcatttgaaacagtacacttcctgaggttagtgactaatgagattattcctatatccctaaatgtcatagaagtgggaggaaatgtgaaaaaacagagactcaagagtgggtgtcagctatggagcacgcacgcgcactctggtgcttgcccacgctgcactggcctacactggcccacgcaggcccacacagacccacacaggatcactcagaccgacactctccaggttagagcacttatccagtggatggttcagctttctggaggataggtggagcgttcttaatgccagcccttttctggtccccactaggctgtggtaccctcagaagtcggaaggcgatgttacatactaaggattgcttcctttgtgctgctgcaggatgcccggtgaaaaaaatctgtaaaatgacatccaaataacccaacccttacctgtgtggattttgaacttgctaaaagacacagtggaccccacctatttgtggattgagctaataaaaataatttaacaaacaatgtgataaatatgatggatatgggaaagctgatagtgaagatctttgggtcttataagactgtcaaagaggatatccaagaagaaacgggacaaagaagaaagatgaattgcatttctaagaaggtatttaaatccagtacctccaaaatattaatataaagataaatgcattactaggcggtttttgaataaattttttttgtttacaaactaaactattattctgtaagtaggactatattaaagtgaaaaagagtagcaaagtatgaatgaatacacaaacacacataaaactttctaattagaacaaaaaaaccatatttcttttggtccttttgctttgtttgtttaaggtacataattgaaaaatcagctattctgaatgaaagctttctatcaagtagatgatacttagatttatttttgctgtcacctggcttagttggctatataaacataacaaattgctaattgatattagtaaatatacagtatttgtgacttccttcagtcattatacctttcctcgagaaagtagacttaattgcaccacgtattgggggctgaattttactagtactactaatttatccagcagtggctttctatttgctatatattaacaatttgcatcttgaattagacagttttcttgtagtgtggagatatttattacttctaatgacatgtcaattctactttacttttaggcctaattttaaattcacttaagaaaaccattttttattgaagagatgtgtacatattttcaggatggtcatttaaaaaaaattccaagcaagtgaatgaaatcattcttgggctgtgaattaccttaaaaaatacatttgggaaatatacagtgcctactacccaagatagttatggtgactaattagcttcttacctagatttacagcaccgttaccctgtaaaataatctttgtaaaataggtcacaaactgggtctgcctgaatcttaagtataaatttcatgtttcatggttttgtactgcagctctaaagtaaaacaaaacttattgtcaatcgaatcactttggaggttcatgttgcctcgcatgtcttttgcttaaattcttgtctacagctgcctgcctgatttggatcttgtgccctaatcctagtaactggactcctgttttgctactgtgaacacatttttgtctgttcgcctcatgctagtaactccctttctcattcttccacatgtctggttctgaacacccttctgatgactacagctctgatccctcctctcctggtgaatgatgttctgaacctgtcttaggctgttgtataacaaagtgccatagactggatggtttgtaaacaacagaaacttatttctcccagttatgtaggcttgaagttagagaacaggatgctagcatggtggggttctggtgagaaccctcttcttgtctgcagaatgctatcttcttatatcctcacatggtggagagcagagagcaagttctctggggtctcttttgtaagggcactaatcccattcatgagggttctacccttatgtcctaattacctcccaaaggccccaccctctaataccatcacattctggattcagatttcatcatatgaattttagagggacacaaacattcagtccatagcagatcacagccttcagcggtggcagccttagaatttctatgtagcaattaggcggtgcttggagctgagctgtttgggtatgggagaaaagcagcttgttttaaagccatgtgtgcattgcaattaccctttttttagtaaaagttgcatatttagttgtggtggcttgggggtagtaataaaaattcatgaaggagcaggtttctttgtagccaatcataggcaatgccactgaattcaaggctgggaatccaaaagaattgttttttttttcttttttgagacggagtctcaccctgtcgcccaggctggagtgcaatggcgtgatgtcggctctctgcaacctctgcctcctgggttcaagtgattctcctgcctcagcctccagagtagctggtattacaggcacacaccaccatacccggctaattttttgtatctttagtagagacagggttacgccgtgttggccaggcttgtctcgaactcctgacctctgcatccgcccacctcggcctcccgaagtgctcgggctataggcgtgagccaccgcacccggccaagaattgttttcttacttagttttgtgtctgcagctttgtatataaatagcatatagctgtagtaaataaatatctttgatgattgatctaatgtcatgaatttctagtcctggattccaaatagccacatctattcaactgtaactcttgggataccctatttctcctccttgaagttttctgttggaaaacgcttgctttagccactgtctatggcctctcatgatatcctccagttatgaaggtgtttaatgtactgtgagccatggatagcataatatagtcatgagatttatcataaaacagacctggaactgaatttgtgtcataccaatggtctggttacttctctttgcctgttttacatttcaataaaataaggataataataatattcattctttctcacagtggttaagaggattaaattaggaaacttaagtgtttgacacgtatttgataatcaggaaaattgccctcatctgatatgttgaacttataaaaattgccctcatctgatatgttgaacaaagatggactttgttcaacatactttatccgtgttttagataaatatagatattcaaagtgctgagtcattcattcaacaaactgtctcttaggtgctactttatttcaggctctttgctaagatgaactggaccagaaatttatcagaaaaagtaacagggcatatgacatattagagttaaggatggctagaagagaaatggggatggttcaggtagaacaacacaattaaaaatgtagccccaaggccgggcgcagtggctcacacctgtaatctcagcactttgggaagctgaggcgggtggatcacttgatgtcaggagttcaagaccagactggccaacatggtgaaaccgtgtttctactaaaaataaaaaaactagccccttgtggtggcgcatgcctgtaatcccggctactcaggaagctgaggcaggagaatcgcttgaaccaggaggcagaggttgcagtgaacggagattgcactactgcactccagcctgggtgacagagtgagaggctctatctcaaaaaatattatatatatatatataacttatatatataaattatttatataatttataatataatataattttatatataaattatatataattatatcatttataatataatttataattatatcatatcatatataatttatatatataatcatatataaattgtatatatatatatcccctccaaaattgaagagaatggagaaataataacaattcgagttaatttcggtgatcttggagacattgctgaggctggaaaggatagaactttaagagacttgtagttatgtggactttatggataaatacaaaagttttctcaggcaaatgtagagaatctctgctttgtttccactgactttaagtatatcaccatgataaacactttggtgctattctaattgcatataaacatgcacaactcccatcctgaaggtaggatgaccaattatcccatttgcccaagcctgaggactttcccaagaaacaggactttctttgctaaagctgggagtgtcctaggcaaactgggacaagttggtcacccgctttaaagcaaagacaagactgtgtcttaatctttatgcatcccagaactttgtgtaattccttgtatagtgctttggaggggatcaatacatacttttgctgactcatcagttttaaaccagacccttgtgattttgtctggatagttaaccagaatagacgttggttgaggctgataaattagggaaaatagagctgtttggctaaaagtaaaactaagaagaagaaagccagcctcatctgcaatattgaaaaaaatatgtgttctttctctagtctgcacctgtaattttatgtttcaggtttatttggactctcagaattttcacaatatagcagaattgttccttgcactcagttaaggagtaatgcaatcagaacaggggttggaatggtaataaccaaattcctgccacagctctaccaccctctaataatataaacttaagtaagtcacttaaactctcaaagcattattgctttcaaccaaaggcatgtgtataataacaacttccttataagaaacagctccatatgataacttttataaaatagacttaggaacttcaaaggatgagataaattcgaattattctaatgaccagtcatgccataatgatagtgatatgctgatttaaatgattcagattatggttgtcaacatgtgatagtgaaaataactaaactaccaaagttgaatttccatgtacacactgaaaggacaatatctataaatatctatagcacacctcaatggtcacaatttccagtgagtaacattgattaagtaaaattaaattcttctgaagtttaagtctgtagtctcctaaaatgcccacactggctcaattattcatgaattacagttatattctttttctcaagtctttcaaaaggactaatttaaaaaccagaaaaggtattaacaaatcaaaagaacaaagggacatgttcatttcaagttatgccttgaaattgtaatgaaaacttaatctcaagggccccacatattttctaactgctaaatggaatatcctagttgtacttttgtatctagactgaacaaaacttataaaattcattccaacacacttgccagctaatggatctgagtacatttaatagtaaaaataatgctactgattacattcagtaatgcattttgttttttgcatttttttctattccgaagattgactgagttagtagtccaatgctgatgtgttacttatcagctatgatgaaattactagagtttttcccagttagctatgatgtctaccaagaaactatgatgacaaagaagtctggatttctagtccagctgggcagcacaataataagaatcattcaggagcgctgtatggactgaatttattgagcaagaagaaaactgcatgaacaaactgtggaagcttaacacatctggttagcaaagaaatttattttggccggagagattaaaaacctctttttccagtaacttattctgccagaggtactagaccagaatctgggccatcccacagatcttagcatatgggcatttttcagtagaaggagcattgaagttactgaactgttttctctgcctagccaatttaatatgaaatatgattgaaaccagtaggtccgcactggtatttatttatttcccagtgctttcctaaacgagttttatagtattcagagcatagtgttaaattgattcacctttctccatgtgagaattgtaagcaatttgattagcttttctctattttcatcttctgacatatactgttataactaagaaaaattataacccttttttcttactgaaaataatttatattcagtagtgtttttgtgcctgcacagaatataatctctacaggcttaaatatcaacatttgtaactgtatgggtatgatggtattaagaacaattccaaagacaaattacacttttaaatgttcatgatactgaatttatccctcagaccttataattgaacgttgcaaaccagacacattcctgtgtgttttatttagtgaaggaaggaaagaatgttaaaaaaaaaataaaattagggttttttatatgactgctaaacatgataaattaagggagtcttgttaccctgagagatgtaactttattgatctctcagttaaaagctgctaaatgagtgaatgaaaagatagaagctgggggagggggactgctatctttgctcttcaagaaatggtttatgctaaaatttaatgaccacctactaagagcagtgatgcatgcggaggcttgggtcctttttttcttcctttccatgcctttcacagcggagtctaccactgctgctcatccttagtttcacctgccttactttctgtccagttttcttcctggatcagggccctggcaccctatctaacttctattaattctgtttcctggctgtgggtcatgttcctcatatctaccacctgctttctagtggcagtacaacaattacagctacctgccagccccatcaccccacttgaaaggaatccattatttccagggtcctgcttggattgccttatttcaatcctttaaaaaaaatattcattcttgtgggcttttgactttctcatttccaaggtcttctttttttaacctttaaattcaggggtacaagtgcaggtttgttacataggtgaacttgtgtcatagaagtttgttgtacagattatttcctcacccaggtattaagcctagaacccagtaattatttttcctgatcctctccctcctcccaccctccaccttctgaaatgccccagtgtgtgttgttcccttctatgtgttcatgtgttctcatcatttagctcccactaatacgtgagaacatgtggtatttggttttctgttcctgtgttagtttgctaaggataatggcctcctgctccatccatgtccctgcaaagcatggtactggtacaaaaacagacacatagaccaatggaacagaatagaggacccggaaataaggctgcacagctacatctatgtgatctttgacaaacctgacaaaaacaagcaatggaaaaaggattatctattcaatgaatggtgctgggataactggctagccacatgcagaagattgaaactggaccccttccttacaccatatacaaaagttaactcaaaatggattaaagacttaagtgtaaaacccaaaactataaaaaccctggaagacaacctaggcagtaccattcaggacataggcacgggcaaagatttcataatgaagacaccaaaagtaattgcaactaaagcaaaaattgacaaatgggatctaattaaactaaagtcttcccttaaaaggtcactactttccaggtgggtagcacattcagtggctaatatcttagtttgaagggcatttccctggccagtgtcctctggagttagaaagagctgagcagcatggcagcactggtcctctgaaaggggaaaacatggagtgggatgtgattaactgagatataaaatctcggagggtgtgatccatgacccttgttgacccatgtcttcctcacacctaggagtgcctgcaacaatgtagatcctcagtgttgaatatatgaatgtgtaaatgaaggtacctatttcacaaatcgtctaggattgacatcaccctaaggatggatgttgtttatttcaccagcagtttgggattgtgaaagccctgtgtatggtcacaggctttgaaatgtgtgatgaatctgcatctttaattgggtctctatagtcaaatgagagtcttcatttttctaaaggttcatactgagaagcacaggctttctttcagtgtattgaaggtgcattgtattagattaacactgaaccaaaccattgtcctttgaattgcatgttgtaatcaaacaatgcgattgttttgttaaatactttaaaaattgtattgacttctcaaactaaatagaaacttacttagcttaatagtcagcttatatcatattttatctcatcacatttttcttttctaatgactgtatttgctttattattctgtggctaagtaagatttaaaaaaaaaacccaaaacaacattaaaatgctcccttttgaccaaggtacttccttctcattgtggaaaatgtggaaaactctcacatcaattgcaccaccaccccccttccctatgcactcaatgaaacaatttaaattaagtatctattttgtgtcagctatggagatagactttggggaaataccgttccttttttcattcttcattttgtgccaacaaaatattttgagggaggaatatttttatatcaattattttcattatctaagttaaaataggtacaatggccatttaccctagatttgttttaactgtcctaattttcaaatagtctgaattatttacctgcatttaaagctatgagtcctaatgttggttttggaacatatggtcctcttggagatatatttattttcagagaaactacctgagaatttttacgttttttcttgagtcaaagtagacttatgttttaatagcttgaatagaagaaaatttcaaaactcttagcccattgtaaagttaaagagtacataagtttatgtagtattcatgatttacgaataattggatttttagatcaaaattaactaattgaacttgaaaaatatccaactctatttttatgtcatgtattcaatgcatacacattttatatacccaaatctctagacactgtgcctggcaatatgaatttaaaataataagtaaatatttcttgattttagttttaatgcacaataaaacactaagaataaatagcctagttggtgtatatagaaaaatccataagtaatgattcaaaattatttgaagatggacatattatttttagtagtgagtatatatgggatgtggctgaaattactagacatataaccataatattatgtgaccatttggtgtagataatgcctgactgacaatagcagcaatgtatggttgttttttggtgtttctaccttttagacttacacattttaaatgcttaagatgagtaatctcattcatctttcctgttgcttgcactgaatatttgttgctgctaatccttcttatttccatagtattgttcaaaggtacattccagggcatctttgaagcatattttttaacccccgctgtgtctctaacttgtcatgtaatggttgcttgagcatgtcagccattctgtgtgtgtttgccaagccccagtgtgctggtataagtaggcattgcaattaggctgagagacaagctgcattacaagaactatttgctgcttatattgtcccaatattttaacccaagccaatacagatagcattgagcataatactttacatatagtattaaatatagcatacattacataaagcataatacaatatatataacattgcgcataatatattgagcatgtaccatatgtccagcttttgctaactactgtggagaaatatgggggtgggatgaggaaggcagtattggatgggaggctggtaagaagtataaaggagacctgctcttagtaaactgcagttttgttgaggataacagtgatatacaaaaataattagaaatcatataaggaaaatatacaaacagcgatgcttaggttgtgctgatttaactctttatgatgcagaacatgtaactgggcagctccaagtcctaaagtcttgtaggagttcagttgtttggggtaactacatttcattcatgagttgtatgagtgtagctatcttcgtgtcatgtcttactaccttttgaatcattggtaatcattgttaaacacaatactttggtagaagagatcagtgacaattcacctctatgattgttaatgaaaacgtttgactactgaaataccttcagtggtaatagcttcactattcttaatttttttttaccacaacacttaatttttaatctacgatatgatcattttattgctccatcctctaaatttagccactgagatgattttaaagcatccttaaattccttaagaaaatttaaaaatcaggaatagacagaaggaaggattcacatctatatttatcccaatatactttcctggtgttttggaggatgtcagcttcatcacagattaaacaccaagaaaaggagaggtttaaaagttcacatggatgtgctgcactatgcaatatttttttattttctgtgtgcatattagtaacacttattttatggctgggtgtggtggctcacgcctgtaatcccagcactttgggaggctgaggctggtggatcacctgaggtcaggagtttgagaccagcctggccaacgtggcgaaaccccgtctctactaaaaatacaaaagttaactgggcatggtggcgctcgcctatcctctcagctactcgggaggctgaggcaggagaatcgcttgaaccagggaggcagaggttgcagtgagtcaagattgcaccactgcactccagcctgggtgacagcctgagagtctgactgaaaaaaaaaaaaaccaacaaaacaaaacccgctttctttaggattttgccttttcttgaggacttatattgtttttgaggattttactagcattttctaggtctaaggactcaaaaatcctgaccccaattctttttctcttatacgtagtgacagactgatattattgtaccaattatataactcagcttctcatcattttgatgtgcagaggttagttaatttttagaagctacacagctaataaatagtgtatttattttttacaaaggaaagttctaccttataaaagaatagttctgttatgaaatcttatacatcagttatagaggggaggacatataaattatattacttatacaagtcaactaattttattgtatgataatgagacagatatgttattaaaatttcttcattacatcagtttttccaaaatagacagttttattgacttttctttttctaaaggtattatgaatattatctttaatgccagcatttaaagatctttatgttttgtgtgcatattatagttttttctgtgtgtttgtgtgttatataagaaggatcatgtgatatatacagttttgaaactggcttcaactccccctttcacagtatgtcatagacatctatcagtgtagtcattgattacaaatctgcatcatgattataatgactgtgtagcagcatattgaattgattcgtatgtctttgtttatttgcttaaccaatctcttattggtggacacttggttttcacattttctctctgataccaacacaactctgagatgtgtatactttctatgagactgtgtgtgtcatgcatactttcaaagatagccttctgataccttttttttttttgagacggagtctcactgtgtcacccaggctggagtgcagtggggtgattttggctcactgtatcctctgcctcctggattcaagtgattctcctgcctcagcctcctgaatagcggggattacaggcatgtaccacgaagcccaactaatttttgtatttttagtagagatggggtttccctgtattggccaggctggtctcgaactcctgacctcaggtgatctgcctctcttagcctcccaaagtgttgggattatagatgtaagccaccacacccagcctgattacttcttcaggataaatttcaggaagttgcagagcaatgtcatgttgcagcctctaccacctccttcttttcctcctccttccatttttttttgttatctgtaactatctcaagtctgactgctcgccagtcagaggccaaaaacatgagaagtgagatatggtgaaaggaaagcaactttattgattgaatgctagcagatgggagatggccaggcttctgcctcaaataagccatcttagttttttgggccggatgaaggagtttgagagggaaaaggtgtgggaagtatgctagagtggtgcaggaggttgcaagtctatgttttattccgatggctatcaagtaatcgcccgttggaagatccggtttgcatcaccttgactttggctcggtagtggtggactatctgtatctgtaattcctcctaagcaggaggattctgcctctgggtctctctctgcctgatttgtttaaaaattggcccctggaattttaaggcaagcacataattacataagcgagcactgttcactgaaatgcctggtgggaaaggaggaaacagagtttcaaagtatgtttcaaggctgaaagcaagaaaggaaaaaagttttaaaatgcattttgaggctgaaatacttggttacctgcttatttatatttataaattggtattctaaagtcccaatagaccatagagagaaaaatagagagaaggaaagtttcttttttctaatactctgctgtatgttaggtactgtaaatatagtatttaatcttcatgttaaccctgaaagctgagtggagagtttaaataatatgccaaaggctacattatcaatgtcaaggctaaaagggaatttattaatagttctgtctaatcgtagaacattgttttaaaatttaagtgaaattcatataacatacaattgaccatttaaaaatgtgcaattcaatgtgtgtttccttgtcttggctattgtgaataatgctgcaatgaacatgggagtgcaggtatcttttccagaaccaaatttcatttcctttcaatatatgcccagaagtgggatggctggatcatatggtagttttatttgtagtttttttgaggaatctccatactgttttccataatggctgtgctaattcacattcccaacaacagtgtgcaagggtccccttttctccacatcctctccaacacttgatatgttttgtctttttaataatagctattctaacaagtgtgaggtgatatctcattgtgattttgatttgcattttccccataattagcgatgttgagcaacttttcatattatctgttggccagatatgtcttatttgtatgtcttctttagagaaatatctattcagatcctttgcccatttttattcgggttttttttccattatttcgttttcattattgtatgagttcctcatatattttggatattaaccacttattagttatatagtttgcacatattttctcccacttcgtaagttttgtttttgtttttattttttttactttgttaattgtttgctgtgtagaagctttttagcttgatgtaatctcacttgtccttgattttgttgcttgagctcttggtgtcattacaaaaaagtcattggcaggagcaatatcaagaaacttctcctctgttttcttttaatagttataaggtttcaggtcttacatttaaatatttaaccactttgaactgatttttgaatgtggtgtgaaataaaagcacagttttattattctgcacatagatatccagttttcttaactccatttattaaagagactatcttttccccattttattttctgggcatctttgttaagcatcagttgaccataaatgtgtggatttatttctgggctattttgttctattggtttctatgcctgtttttatgccatcgccatactgttttcattgctgtagctttgtaatacattattttgaaaccaggaagtatgatgccttcagttttaatcttcttgctcaagattgcttcagctatttggagtctttgtggttctatatgaattttaagaatttttacatttctgtaaagaatgccattaggatttagatagggattgcattcagtgtatagatcatagatcattttgggtagtgtgaatattttaacaatactaatttttctaatcaatgaacacaggacatcatttctttcatctgtattttcttttattttcctaatcaatgttttaaattttcagtggaaaaatctttcatatttttagctaaatttattccctagtattttattctttttattgctagtgtaaataggatttttttccttgatttcctttctggatagtttgttgtcagtagatagaaatgacagtgatttttgtatgctaattttgtatcttgcaactttactgaatttgttcattattctaacagtttttttgttgccattagtgttttttacacatatgatcatgtcatctacaaacagggatagttttacttcttcctctctgatttcagtgccttttatttcttgtcttattgctctggctaggacttcttatactgtgttgaagagaagtggtaagcatgggtaccctagctttatatcagatcttagcagaaaagctttcagcttttccccattgattatgatattagctgtggagttttcatatgttgtctttattatgttgaagtcagttccttctatacctattttgttgagaggtttttcttaaatcatgaatggatgttaaattttgtcatatgctttttgtttttgcatctattgagatgatcatgtagttttatcttagagtctgttaatgtggtatatcacattgatcgatatgttgaatcatccttgaatctaagggataaatcccccttgatcattgtgtataatccttttaatatgttattaaatttagttttctgatattttgtggaggatttttgcattgtctgtagttttcttgtagtggctttgtctagctttgatattggagtgatattggcctcataaagttatttctgttttttgaaagggtttgagaaggattggtattaatatttctttgaatgtttggtagaattcacctgtgaaggcatctgcttctgggcttttctgttgttgttggaaggtttttgattactgattgaatctccttatttgttattggtcttttcaggctttctttttattctcaattccttcttgttaggttgtaggtattcaagaatttatttatgttctctaggttatctagttttttgacatataattcttcataatagtcctgtatgatccttttatttttgaggttcccattgcaatgtctcattttttcatttctggacaaatggataaagaaattgtggtgtctatatacaattagatattattcagcctttaaaaagaaggaaacccattttcaaaaacataaatgaacctagaggaaattatgctaagggaaataagccagatactcatcattgctgaatgatctcatttatatgtgagatctaaaataggcaaacttctagaacaagagagtagaatgttgtttgtcagggttggggggaaagaggaattggagagatgttgttcaaagggtacaatgttttaattatgcaagattaataatttcttgagatgggatctaatgtacagcaaggtaactacaatgaaagatacttggaatttgttaagagggtagaccttaagtgctctcgccacaaaaaggaaaataaagaaaatggtaactatgtgaggtgatgaatatgttacttaacttgattttggcagtcatttaagaatgtatacatatatcaaaacatcaaggtgaataccttaaatgtatacaatttgtttttgtcgagtatccctcaataaaatggaaaaaaaatcctaaactattcagcggccttgaatacatttgtagtgttgtgcaaccatcacctctgtttagtaccaagacattcttgttacaccaatatcaagccccacatgtattaaatgagtcttcatttccctcttgctagcctctgacagccatgaatctgctttccgtctctatggttttacttattctacatgtgtcatataaatggaatcatacaatacgtgacttttcgtgtctggcttctttcaccaaacaggtttttgagattcatttatgttgtagcatgtatcagtcctttcttatttttatggctgaataatattacatcatatagatataccacatttgtttattcattcatctgttgatatatatattcattgtttccactttttggctattgggaatagtgctgctctgaagattaatgtataagtacctattttcaattctgtttttttttgttattgtttttgtttgtttttttgttttttgtttttgaaatggagtctcattctgtcgcccaggctgaagtgcagtggcatgacctcggctcactgcaacctccacctcccgggttcaagcgattcttctgcctcagccacccaagtagccaggatgacaggcgtgcaccaccacacgcagctaatttttttatatttttggtagagacagggtttcaccatgttgaccaggctggtcctcccaaagtgctgggagtacaggcatgagctaccatgcccggcccctgttcacaattctttaggtatataactaagattggaattgctgggtcatcttatccatagaacttgtgtagccttctttcacaaggctgtgggtattgtctgataatataatattttcttactatttacaaaatagaaaattcaagttattttaaaagatttgaataatcacaaattttattattgatatgaactttgatgtttagaaatctaaaatcttaatcctctagtacgtttcttcctggaatttgagactcctgttaaaactgttacaagttaaagttgaagaaagcacaaatatactttctagctcctggctattgatatatgcgatttagctgacccatttcattcaaggtcaggagtgttagtgatcttatccagagaaaccacagattcttataaattccctagtttacaattggggatgacaaatcacattttttcgaatcttgaagctgaggatgggctttaaaggaatcatcatgatgagaacatttttacatataattgcccaggaaactattctctagggatcttgagttcatattggattcctatataatttcttcctgtgtattttgagacctgcaagatagaactaaggggaaattagagtgggcaagagaagttcccttcttattgccagtgaagtatagcagctgacatggcttgtcagggtaagtgagtctcattatccctcagtagttgctaccaggtgagctagcacaaggaattaccttcttcctgaagcataaaatacaacagagaggaaatatctcttttttttttccaagaaggggaaaggtaggaaagatgggaaaaaagaaagaaagaagatagtgtacttaattataatatttttgaaatggaggagacctgaggaatcactttagttcaacttctttactttaaatagaaagagactggtttaaagttacccagccctgtggttataaccccgcgggctagaagccaactgtgcactctcctgtggcttgtgttactagtttcctatggctgctgtaacaaattattacatacttagtggcttaaacaacacaaatttattattttactcttctggaagtgagaagtctgacataggtctcaccgggctaaaatcaaggtattggtagggttgcattattttctggaggctctagttaagaattattttctttccttttctagcttctagcagctgcctgcattctttggcttctggggcccttctgtcttcaaagccagcagtcacatcagtctgacctctccgttcatcatctttgactctgactcttctgcttctctctttcacttttaaggattcttgtgggcccacccaaagaccacaggatgatttccctaactcaagatccttaacgtaatcacatctgcacattctcttttgccatgtaaggttacatgtccacagtttccagggatttggacatggacatctttggaggacattgttctgtttaccatagcttgaccactcgttctttaaggaaaaacataaagaaagaaacaaattatataccccctcttctgaggactttgtagatttatttattgacaagtattttcactcatttaaagatggcaccttatatttgttatatttacaaactgcttttgcatatgctatttcatttcattgttgcccttttcacagtggcaacaaagactcaaaaacttaagtgaattttcagaacaaatagtggtcttggcatatgaatcccatgtatttgagtctgtctagtgtttacaacattctactcactatctcatgaaagtgattttcagcactttctaacttaattccttgagactttggatgtcatatgtgggttggtttgtggacattcttcatcatgtttaacatcctcgaagcctctcctacaaagaatgcactgctccttctggatttatgttgtaaaatatgttctaaaactaacttgaattcctatactttcttgcctattttctattcagaaaaaaacaagggaactgatatatttgtctacataattgtgagttgttagaagccaaataatcagtgtgaatggtatgccatgctctatgaatggttgttcagcagtccataaatttggtcttcttcttgagggtaggagtagtgttttgtttactttatggttcttagctattaactaagtaccttgcatttcatagggctttagtaaatttgtgatgtttttaattattgaatgctgattatatcttaagcttagaaaagaagtgaaacttgtggttttaatttaatttttaaattaatctcacattgataagtgtaactattaactacgttataaccttaaaatgagtcatttcatgagtctccaaaggctctttccttgtgtctaaaatgagcaacaaaacaaaccaaaataaaaccacagataatggcagagcttttaactttgggagactgaagaattgatgggagtaaagaaatttacaatttaaaatatcaaactagtttaaccttctaccaattaaattatgtactactggaaagcatagcttttaaaatactgtaactagttaacaaaaatcagctacaatgactgaatcaacaatcttctttcccctaattacaacattaactgcttcacttccttggtgaaaccccagctgcctctcagctccacctgaatctggtgaggcccaccatctcaagccatctttatcttttaatattttagtcaaccaaaatcaatctccatgtttcatttagctatttaggctgatacttacatttgtaaatcataacacaattgtgattatacttaacaatactcttttctctgggattttataggtaaagtagtaatttcttaatggttttctaatttatggaaccaggttgagtttaaatacttaaataaattaacttgtaaatttccattgggttgacttttagatgctctctatgaggaaggtgagcaaacaaaaataaactcacatttcatcaattctaagcacatttttaacatctctgaaatcagggtttaatctgatagtataaggtttgtcatcttttagttagcagcattttgttttttctctcttactggtacataggagatgacggtgcatcttttattcattggtttgccccttagatttcatgaaatgtggtcatttaggtgactctaagcaggaatcttttgcattctgatttgcataatacttttttaggaatgattacaaagcaggctttagaacttctcccttctcaagattttcttcattgatgtatttttctgaagtatggctctttaaaataaaattaagctggaaacaaacctgcttatgtgacatagttcaaggactatatttaacagagttgagtagattcagtggcatcttgacactaacagtggtgggaatttctcttctatattctgcattttcttggtgaacttacattatcctaaacaattgattatttgaactgaagtgaccaaattaaatgattctacgtggcctaaattttcttgggatcatgtgttgtgcacatcttgcccactgttttttctatccatatatcaactctgcctgggtcatacatcctcaataagtctataacatattgagttgaattaaacaaaacacatcatcagggattgaagtttttatcccagaagacttctgaaggtatttaaaacataaacaaaattttaaagtgaggataaataattaagggaaccactagaatttgattatcacccacttaattttcatagctttcttctagacccccaaaacagctattttcttctgtctctttcgattttctctagtgatttttctaagcaaggctgaatggaagctaccagtggtcatttgtgattgacacactaaaaatataatgtgaacacttggaaaagaaaatgcccttggacatttggttagctgcatatctcttgtctcagatgacacccatatactctttcactttccagacaacataaaaattaatgctgtttgctatagcagaaaacagtcagaattattttcagcttttaataaacagctcaatagcctcagggaaattgggcatattacttcatttcttggttttcaaatgtatttctatcacttaattatctaatgaaaatggtattatttatttaaaatatttaagaaggtttttgactcagattttctcctcatttttacctctctctattctgccttctgcatcacctgaatggccttgcaaaagacagtaagagatgttgtggacaaatctggagcaattgatgatatacattttgcatttatgtttgtagaatatgaggaagtctgacaaacttaaaacagctattcacaggctgaaatcccactttctcaaaaaataaaatgaatttttggaatggatttttagagcttataaagaaactagtttacttgtatgtttattttaggtaattactgtattaatactcttttaaattttatagtggtgtatttcaaaatgtctctattttgagatgctgagtcaaatatgtttttcattaaaatgaacctctgtgtctgctttccagtataattatttgtctactagctagaataccatattccattttatttttctttcaggattattctcctaatcccccaagaccatccctgttcagcgtatatttagggcaatgataacaataatagtattaaaattttattaggtaagccaatctgctgaattatgaatttaggtcttgttggaaggacactttttctgaatttgtatttctagctttccttatttatttgaatagttgagattttagtatatttttactttatattttgtagaacaacgtgaattttagcatggaccaaaaaattaacgctttattttaccagtgaacaactacttgaagaaaatatggggccgggcgcggtggctcaagcctgtgatcccagcactttgggaggccgaggcgggtggatcacaaggtcaggagatcgaggccatcctggctaacacggtgaaaccccatctcttctaaaaatacaaaaaattagctgggcgtggtggcgggcgcctgtagtcccagctactcggtaggctgaggcaggagaatggcatgaacccgggaggcggagcttgcagtgagcggagattgcaccactgcactccagcctgggcgacagagcgagactccgtctcagaaaaaaaaaaaaaaaataaaataaaatatgggggcagggggtgcgcggtggctcacgcctgtaattccagcactttgggaggctgaggcaggcagatcacctgaggtcaggagttagagaccagcctggccaacatggcgaaacttcgtctctactaaaaatacaaaaattatccaggcgtggtggtacatgctacagtaatcctagctactcaggaggctgaggcacgagaatcacttgaacccaggagttggaggttgcagtgagccgagactgcgtcactgcagtctagcctgggtgacagagagagactctgtctcaaaaaaaaaaaaaaaaaaaagagaaaatataggaaccactctttgttgcagaaactaccctttgtgaagtatctattaggttataatatatcacatttttttttttgagacagggtctcactctgttgtctgggctggagtgcagtgatgtgatcatggctcactgcagccttgacctcccaaggtcctccacttgggaggctcaagtggtcctcctacctcagcctccagagtagctaggactacaggtgtgcaccaccgtgcccagttaattttttagttttgtagaaacaaggtctccctatgttgcccaggctagtagtgttgaactcctggcctcaagtggtcctcccacctctgcctcccaaagcacttggattataggcatgagccactgtgcctgacctacatcatgtatttatttaactagacattaccacttacagagcactttttcattttattctcatcacaattctgtgaattaggcattattatttgaaaacagggaaacagggtttagaggggctctggggcttgtcaaaagcaatcatatttgaactttatcaatactttaatccacattttctgattttatgagtgctgccatttcccttatatcatgctgcttatttggttcgtgcatggaattgttattatcaattaaatataatctctacagaatgaatgataatgaacattatcatgtgacaataacattgtgcagccattcagagggcacttcaaactttggattttcagaggcagtatctccagtaattagctgtctttagaaaaatagcatctataaatgcttcttagtcctgcccataatgagagagttattgacaaagctaggatgtgaaccacgttctagccatgattcatttttaaattaaaatatcattatatatgttagggaagaaaataagggcctttaatcatgaatatgtcctatatagaaccaagataccaattttctcacgtcagttcgctcagtaaatggtaaatttgaatgcatttgccataaagacaagaataagtcctaatatgagaatgaaatttgctgcccccatgttatggtttggctgtgtccccacccaaaatctcaccttgaattgtaataatccccatgggtcatgggtgggaccaggtgaagataattgaatcatgggggtggtttcccccatgctgttctcatgatagtgagttctgatgagatctgatggttttataaggggcttttccctacctttgctctgcatttctctcccctgctgccacatgaagaagtacatgtttgcttccccttctgccatgattgtaagtttcctgaggcctccccagccatgctgaactgtgagtcaattaaacctctttcctttataaattacccagtctcaggtatgtctttattagcagtgtgagaacagactaatataccccattaatttatctcactataaaattatttaaaaatatttttactattgttattttatccacttatgagaactcaaaacgtcctttgaaataaatagggaaatatttccaaaaataaaacattttatttgtagagtttcttttctcaatgctacataatcaagctccacttgaggaccttaataacaatctttatcaaactctaaaaggaatttttatctttcattgctaggcagaatactcacgacttaccctggttgtctgagcagtcattatctagaatgttaccggttactatggcagaaaaaagagagcattagagagtctcccattggtaattaatttttctgtcaaaaaatgccatgttacttccttccacaagtcattatcagaactagtcaatgatgactgtgttccagtcttttgcctgtttactctgaggtcctttcccttcccttttcaaccttgccctggttttcaagaactgcatttcataggcctttttgctctctggattccaggtagttttggccattgggaggtactcatggcagaatgcagagggggtgggggtagtggataaattagattatttcatctccttctttcagccttgggcagtatctctagcagcagtggcttctctgtgatttcacctcccaactgacagcttgatatagttccaacttccacgaatggcttccggggtctgttaatcgtactttctctttgaccttcttcgcctaaagatataaccaactcctaggtggctttccatcctctatttggcctctcagctcttttaacacatgcataaacatttccctgtattaaattctctgtattgaaatgttaatgtggtttatgtttttgaggagctcctaactaataaatccagattaggacattcaatcttatcgtgttcccagaggacacagaactggaaatatttggtgaacagctctcatgattgctgtactgcctatttacatctgacttgcaatctacctctctccagccagacctctactctaaactataggaccgtatatatacatatatccaataaactacctgcttttgaatgtttcagagacacagtaaactcagcatgtcaaggtggcaacacatgctcaatcccccagcaaacctcatcctctcctgctccctccctcatgcattttgttagtcgagacaaacataattaattcttgcaacttcattccctttcagcctgcacaaccataattttaaccataatcataatcataaccataaccataccaataattaaaacccacaacctttacaattatgtaacctgtgataccctgaatatctctcacttctattcacttctctacattccactgctatcaccctattccaagctcctgccttcaactgaatgattgcaataacgtcttaaccttgtactcaatgttatattctcaaaattaaagttaatcatttttaaagacctccaaagattcaaaccttcagtgaacgaaggtcgtgaccttcagtggcttctaattgctcttaggagaaaaacaatactccttaacataatcctagaagacctagcaaaaacttcctcttcagccttatctccctccccacccctgcccctgatatgccatcttactctctgaattctggcctcaccaacttctttaagtcatttataagtgtcagtccttcccaacccccaacataacctcgggcttttaaatatacagttaccattgtctgaaacacttttcttccttactctctatgttaacatcatttagtaaggatttacttcagtgttatagcctcaggaaaaacttgcctgaccaccctgactacataaaataccctgttacacacattcaattgtgtcatgtacctctgccaggaagcattaacagaattgtgattttacatttcttcgtgtgattctttggtgagcagtaatctcctccagtcacaattgtctttaaactctttgaggtgagagacaatggatgattttgctaaccattatatccatagctcctatcagtgtctgggacataactagctcttaataagtatttgataaattaatgaatgagagcactcttcttcttccctcccttcttctatcctgtctttctctctttctttctccctcccttctttccttcctttttcattgtgtatttactattaggaaatgacaggtctggtactgaacagttaatttctacctataatttttaattcctcaccagtactttctttggttgatgtggagagtattcagacagtgtctaagttaattttgtgttgctataaaggcatacctgaggctgggtaatttataaagaaaataggtttatttggctcatgattctgcaggctgtatgagaagcatggcactagtatctgctctgtttctggtgagggcctcaagctgcttcccctcatggctgaaggtgaagaagagctggcatgtgcagagaccacatgatgagagaggaagcaagagacagacagggggaaggagcgaggctctttttaaaaacccccttttttctggaactgacattctcacccaagagccaatccagtctcatgagagctagaacttaccaccatgagaatgacatcaagccatacatgagggatctgcccccatgacggaaacaaacacctcccatcaggctccatctcccaacaacaccacactggagatcaaatttaaatatgagatttagggggacaaacttccaaactatagcagacaaaatatttgtggtcatgggcagcctatcattagcagagagagggtgcagattttcacatcagaaggaataggtttcgagtcctagctttgccacttgcttgttttgcactctgggctattgcaatgatctatctgaactcagtttccttcttggtaacataagaggataatcagtgccagcttgtgggcattacattgtagtaattatatatctaatgaaacaaactcacatgtagaagccactcaataaatagtagtcattttggccgttgtcaaaaaattattaagtaattatagattttaataagaactattaggtagcatagtgtataggaaaacctttactgagtgttcatatgtaatgtttgaatcagacaatgaaacataaataatggataagaaatataacgtacaattttggaggattaaaatgcagttcatttagtaaatactatgtgaaaacaatgtgtgtaggtgcacgactatatatacacacactgcgcctgtttctatttgcctatatattctttttttacctgtatactcttctattaatattatttaaattgacaaatcatacttgtatacctttatggagtacagtgtgatattgtcatgtaggtatacaatgtggaatgatcaaattgaggtaatggataggtccatatatcttaggtgaaagtattgtaatagcacccactgctgtcaatttttttcattaacttttgtgttgtttaaaacactgtgtttcaatacttttttaagtgtttttaattctttagaaagacaattccactggaataccttgatctcttacttcatagaggaaaagtagaggaaagaaaaagcttgtgcctctttactggtacccccaacaatgtctgtctttgtggggtgagaactgatgtcatctttggcagctatatggctgatactgttctgtgagattgcaacatatccagcacatgcctgataggaaacccttttccaaatagtaaacaacccttcacaaggcagctctgccaaagctatgtattgccattcaacagaagatcaacaggacagtccttttctctttactttaaaaagcatatgcctttaatgatgtgttatcgttcaagccatctgcagatgtactgtccatccaaattgccagggttaaattgttgattattagaaattgttgtgattgtctgattatgcttgtgtcataaaatgactattttctgtcacaatttgacgagcccctgctttagaatagcaatacaacacattttacccatttgcaggtatttcaagtattaaattggatgaatctttttaattttcttctactgaattgagttcaagtgaatttgataggattattagagcggctagtgtctggaataacaatgatgacttacagaaggagccagcagggctgatgttattgacgaagagatactttagaccctttatttgtcagcagggagccctgctctgtggttcctctatgagtccttccctgtgtacggtgcccgcctgttttactttgaaggcactaaatgcatcttttcaatcaatattcaattatataagacaaggaatgctggttaagtaaccatgcctatctgtcaaggaaatgcatttctccaaataatttgtcagggcttctgggttagttcatctttcctacctctggttgagtacttgcccagttacacttgtcgaacacgtgctttaccttcctgcacagagtctcctttggtggcgtgtttcttgcttttcttctggaaacacccttctcagctccattccttgcagtatttgactctcgctacccaggaaaccagagaacattcttcctagtttcacttcattttcttgccttctcatataggccactgccaatcagctgcctcatttaaatcctgcagtgtatgtttatattggtcttaccttgtcctttcttcctaaataaacctggggagctttggtcatgttcatttttcaacaaacctgactaggtattctaatttcgtaaattaaccatcattcttgttttattccactggaaattgacttaacatattattcactttggcccaatctgccaggcaggcatgaggatattgctttctaagctaccttctaattgaagaaatatgaagatttcacaggtcaacacataggcagtgtgaactggggagcttttagcatattaattgggctctgaataattcactatagttaatgaaagttgtgcttgttatctaagatatatggagggcactgctgtacctttcgtaggacaattcaaaaaaacaaaataaaacattaatgtaaaatagataagcaatgcataaatgggttgcagctcatattataagagttttgaattcattttatttcattcccatacttctcaaccaatccagctacacccacatcttatttaattgacagatttggactgtcttgctggctaggaggataaaggcaacaaactttctgactgatcctggattttcctcaagagcaagtttccttagttattggtgtgtcctctgggtatcctgcttcctgaattccacctttgatcctcctggttcttaaccatccatgttgtcttcagagtctgcttgtctgctcattcctgttaatttttttttaacttgatcttcaattgtgagtcttctcacttcctgcctgttctaacttgggctcaaccttgaccccagtcttcagctctgcaggtgggagatgtatggaataactgaagtactccacacggtgttcctgcttataacacaaaagccattgtcatttgacaaacagatgataaagaatctattgttattatttttactttttacctcattattactagtattagaaaatgctttactaagcttttgccaaatattagaccgtgtgctgggagttctacgtgtcatatctcttttaagcctcacatcatttacagaggaggcactgagaggctgtgttgcctcccctggccacatacttattaaatgaaggggtaagaatttgaatcctgacagtctgactgcctagcatgtgcctttatatttgatgctgtatcacactaaattaacaccccatagatccattcttaaatacaaaaatctatatcctcagactttcagggtgttaactttgcactgtaagttggagtctttacattttaaacaaatttcttactttctgtttgttttggattgtcattgcttattttttacttaggagtataaaaataagatagtgaaagtttggacaaccttacatacctttatcatcttcagaagtccgatttttaatgatacgttaaaatagtcacatgtaatcattcattctacaaattcagcaactgtttgctgagtatctactgtatactagcaatgatggaaggcactggggatgtaatggtgaacaaaaaggagtctcttcttctatagagtttacacatgtaagctgggcattggcccagccatgaagagtaagaaacaacttatgggaatttgttgagcttcaagttaaactctgttaaaaacaaacaaaccagaaatatatatgtagagtgtttaatgtgttctgtggctctcaataaatgatggcgttgaaaaataaaatgtaggtaatttgatttaatattcaatcagatgcttgcatcaatcagatgcttgcaaacagggtataacaagataatactatgatatttcttggaaggtaatttaaatttcagtttaaatattttattcagcttatttatcgctatgtaattatacataaatatataacttgaatcataatattctagttttacttttcttgcttcctattgggcttctccctctccatccctttccctcttgatgcaaaccagccatcccttgcagtcacccccaacaatatcaaagtgtgtgtactttcatttttcctccctatgttcttatatttctatttaggaattacagccacacacacaaatacagggttttattatgtcttagaaaaatttaattatcaatattggtgtttctgcatcttgcttttattaataacactcaataatgagtcatagataagttgttaattggtataaaaatacagttagaaggaataaattttagcatttgatagagtatggaaattatagttaataatttataatatatttcaaaataggtataagaggaggagcataatgctcccaacacaaagaaaagataaatgtttcaggtgatggatattccaattaacctgatttgatcattacacattgtatacaggtatcaaagtatcacatgtagcccctgacatctgtacaactatgatatgtcaacaaagacatacaaaaatttcacattacttttgtattaaataagtataattttataagtaaaaaaaatagtcattgaatctgtctaactaaacagacatagctctgttttctttttcctaataggtgcctaatattccagctgaagtggcataatttattttgttttaccctatttgccacaggcacattgctcccaggctttggcattacaaatattgctgcagtaaacatccttaaatatatgtccttaaataattgtgtatctgtggaatagattccaaagcatgagcatgattgggtaaagaagatgagtcttaaaattttaaatagatgttgagagattgctttaaaagaagaaaagatgtctcaattttgtttttacaagtatatgcggacatttcacatgttgtagattgatcagttgttgttacttttaatttgcctaatgacttgtacattggacttttttttgataagttgcttggcttttaaattttctcttctgtaaattatccaatttaaatatcctgccagtttttttctattgtactatttattctcttgtcaatttgtaagtatattttatatattgtggatattaaccctatgtgttttctgcatttcaaattatttttcaaatctagcattgccttgaattttttaatgatgttttccataaataaacatttaaagatttttgtatagtaaatttgtctgttttaggcatctaccatcttgtttaagatggattttcttgtctcttagattttatgtcttgttttctagaatttttaaaaacatatgtaatcttttaatatttttaaaaatttgtaagcctttgatagatcaggatttttaaaaacttgatttaaaatagagttactctttaaatttcctccagatggaaggacagttgtgatacaatgatttaaagcataatttatcatgttcccacaaaatttaagattgtttattaaaagtaccccctctttttatagatacaaaaatatcttcatataaatatttgatcaagttgtcattcatacattcaacaaatattaagtacctcctgttttcctggaattctgaaagaagcataggggtgggggaagcacaatcttgaaatggccactgctttttagagatacagcattcaattttgataacagtggtgggtccagaaatctcaaaaggctgaaatctgttgatggctctgtcactaagagtatgacaggtttctgacactcaacagtgctgggttttagtttcatctgaaacaaaatgaggaagttatgtccaatgatctccaaagccttttctagtcctcaaacatgacagcagctgttcaatctcttctactacccagctatttaaagttatcttctgccaaaacaagcaaaagctcatagctgagagagaatgaatgaatacaaataaatgaatatgaatatgtaaattggatagactgaactcagccaatctgaaataaaggtgaaagtgatttggtgatcaagctctatgtcatcttccttctctgaattatggtgatgggacaggggtttgaaaactcactttaatgaaagaggtgaatcactccatggctgaaaacagataacaaattacttgagaaaactggcaccatgacattttgcaggtaattaagcattcaccttccctgagctctcaccttgacccctgaagagatattcaggatttaatcacaatatatacattatgtgtagattaaccaaattttaaaattgccattcttaatttagtagtaatttgttagattattctggttcaaatcacctcaataatatcgactttaattaaaataatcagtataatcacaatgattcattttagtgcttttgttttatataaaaatctgtgaaaactttcttctttttggaagacaatttaaaaaaataggctacctgtcttaatgtatataacaagttaagtgtaaaatcctttacaggtacatattctttgtaatttatgtctagcatagtcatatatttgaaatcgagttagccattgaaatgaaggaagaactttgtcatgcaaagccattgaaacaacatacaaaaataagttgaagtttttataagtgaccattcgtggtcatcttatatgtttgaattaaggaaacaaactgaaatagccaagtagataaaggaagagcttgcctggcatgcaaagctagagaatactacacagaaagaagttcaagcacagaaattacagttcatgggaatgtcagaatacaaattctgtcctcacaatctcttttattcggtgagtttaccagttttaaagcattaatgaaattatttcaggtaattactgttttactcccatttttattgtctggtgtctctttagcacaacccattgaatcattctttcatcttaagtcactattcataaatgcacatgcaacagatggtttatattagatcatgtgatcctttgagccagagaatgaatttctatttgggtttcattcgaaattatctacctcagagataactgaaacctaacttgatagtattccctgtattctatttaatactttaaaagagtatgctttctgtttttctggttgtgtaaaatacaccttgaacacattcagcagactgctatgtacaaagaaagtgttcaataggtgtgtctgctgccgttttaaatttgggtgttagatattctaggtttcatcaaaataaggcattgtttcaagttgtttccacaataagagcatatatgcacaggcaaaacatattttgaaatggataaatggatacatatggatatgggtgatatttcttaatagcgtagctggattgactcaggcagacccttcagccagacgttttctttgaactggatcgtctctcctgtagcagaggactccagccaatgaagttaattagtgccagattaagatggtctcagcaggtggctgcttcagactctctctctcctctgtttgttgaagcctcatcgttggagaagggcttgagtagtcttgtgttactgacagctgtctactgttaatggaccatatgcaatgatggtaaagttgccatcaactgttgatgaaccatatgtaaatggtgaacagagtagcagatgaatacttagaaacaacgaaaggccttcactgctggactgagagtcagaaccttaaaatgattttaagaaaaggttgctaaaactatgtcatgatcattatacctttactgcacacaccctctgtcactcagtttgaggatctaagacagatatgccaatggaaagattattgtcttaggtcttacaaaacctgacatagaaggctataataccccacagagacatgatttttcagtttcattaatgaaaagaaaattaataatagcaaattaatcactaagctcaaccattttgaaaagttaaaagtattatttaagggaacatacgtagaagaaattcattatcaaatgaagagtatgggaggacttttttttgaaaggcagtttgattctacagggatgccctttactttctgttaagagtatgatgttctataagctgagatggggaagaagtagctacttaatttacagagaggtgattaaagattatatacaatgaacatcctcttaaagtaatataataatgataattgccaatataatagctaggtattttggatgtcctactcatttcatccactcatcattcttatgaagcagatactatcattatctttattttatagatgagggaaactgtagcctaaagaaattaagtaacttgctcaagattacgcagctgagggttttaacctcagtctgtctctggaacctctactctttttttttttttaattttactttaagttctgggatacatgtgcaaaacgtgcaggtttgttacataggtatacatgtgccatggtggtttgctgcacctatcaacctgtcatctaggttttaagccccgcatgcattagttatttgtcctgatgctcttcttcccctttgcctcccaccctccgacaggccccagtgtgtgatgttcccctccctgtatccacatgttctcattgttcagttcccacttacgagtgagaacatgcggtgtttgattttctgttcctgtgttagtttgctaagaatgatggtttccagcttcatccatgtccctgcaaaggacatgaactcattcttttttatggctacatagttttccatggtgtatatgtgccacattttctttatccagtctatcattgatgggcattagggttggttccaagtctttgctattgtgagtggtgctgaaataaacatatgcgtgcatgtgtctttatagtagaatgttttataatcctttgggtatatacccagtagtaggattgctgggtcaaatggtatttctggttctggatccttgaggaatctccacattgtcttccacaatggttgaactaatttacactcccaccaacaatgtaaaagcgttcaacctctactcttaagttatgctctaaactgggtacggttagtttaaaggtgaagtgattttgccccatttggaccttatttccaataattggaccagttattcaagtgacatccatggaacatggtatatgtttgctaactcattttttgaggtaagaataactgaataaatgggtaaaatatatgtgtaaggaagctattgttattgcattgttatgccacagggggcagttattttcctgccatgatactgatgagagattaattttactctttgtaaaatgtaagaaattacaagaatactgcaaagctgttttgcaaactccataaagcaacatatgttaagtgtcttgactgcagaagaaagttgttatacacctaaattttattgagtctgattctctgatttccattttagaaataaaatgtgtaaatctaaagacaaaaatcctttatgcaggagttagaaattattactcttggccatcctgcttacagcccatgtaggaagagattcagcacccaaaaacttcctccttacggctttatctgtggcttttaagatcagaaccatgtgtcaaagtctagtgatcttgttacttttctacagaaaagttatacagcagaaaacgtaggagggtaatttaaatgaggttagaaagggaagataattaaagaaaatctaatgatttactaaaatgaaggcataatttacaacatgtattatacatcaaatacctttaggttaataaaataaagcaagacatacttattttcaaataaccattctatactacttctgcctatattataggagttttaccaggctctcgtatctgacagtgaaatgatgctcatggactaaagtcttgtattgagagtttggaggctgtggtgctagatttccttttactatagtaacttgttttgtgatacttgctaagtcacgtaaaaagttgacctttagacattccttctatgtaactggtttagaatccatgacctcaacattttttgttagttatgttgtgtttttaatgctacaaaatgctatgattcagggtcaatgggatcttcaaatatttagttattaactcagcttaagcaaagactgtattcataaattgtatataatattagtagaaatttaaatacaattgtaaaaatgaaaacaattgaaaaatacttaaaacatttattacaaaggtgtttttcaaggttatgatggcacaattacacagattggaagaactataattggcactttcaactttaagaatactttcaatacaactgacaggttttcaaaaggaagaaactccaatacatcaagaaaccattgaccttttcaagtaatcatttccatgctagtgttaacaaaagaaacatttcaaatgcataatctcatcgtgtagtttttagagaactgttgcctaagtcactgttaatgtaaaataaagtcagaatgcttttgacttgatgctgaaatatgttggatttcagcaagtctttaaaaaaatattttcccacttgtattattgatgaaaataagatgatcgtagacacaccattcacccatttagtgacatttcacataattgtttaacatgtttttcctgtatttattgtttccactgttttacttccatgttgtgttttttttttacttgaaatgaagactgtagcttcaaacattcaaaatggaattgagacctaaactattctacctaatggtggaggctcaaagctgattatttgaagtatctgaataatcttctcagttcttatcataataagactgtccaagaatgcagattgacattgatcagttgtgagtctcttccttatgcccaattctcttgcccttgcatcagacaagctaaactttggatacttgtacacaactagtttcagttttggtggttagctttcaggaagttaagaagatagagttcttatgaaagcaagctaggaagtcttactttctacctgtgtggccctgggcaagttacttggcagattttaaggccagtttcctcagtaggcttaatgatattgcctacatcattaagttgatgtgaatatttctggagcgaatccatgtgaaaatggttaatccactgcctcacatttagtaaactattcaataaatgtcagtcattctgatgatatagatgattattgatgatgatgatgatggcagtgaagatgataatttcagagaagattttatctgtgcagttcttgtagtatcattcttaacctctcttgaaaaagcataggttccattgtataattacagattctgggacagaaaattaatggaacaggcttttgtaggggatgtgcagttattttctcaagtccccaaccccctaaagaatatctgatttttaagagatcagagtgataatcaccccaaagttggtcacagtctactagcaaatctcacaatcattgctaaacaattgcaacacctctgtaccactcttttttctgttattagcaaatcacagttctcccattagtgagagcaaacatcaaaatcgccttacatgtctactctaaagcaaagcactttgctgatcttttcaaaagaaaagactgggtgcttctggaatactatcttttgtctactacatgaatacatgtcattaccactagtctttctctaatttttatttttccaggacctcctatcctgcctcccacatttcctacctagcttgctctcttttctgttcatttgagtttccacatgcttcaaagaccttaggctatgagtggtagaggctgtgaagccttacctaatagcaaaagtggggaaatggagtatataattggatatccaaaaccaattattatgatcaattctttgcatgaaataataggcaacactcagatgaaaagtatcctagtatcaaatattccatacatatagattcttgcatgttttaacccttatttatttataccttgagatagctctaagccttctccagtctattaaactatggcaactaatatcacttgtacatttgttttccatcagggaattacatatatctaattataatctcccttttttttcatttttctccaaccttagggaatcatagtttcttttcttttcttttccctctttctattcccaatttcatcacgttccctcagaatagtattacttccacatctgcatatatttttattcattaattcatttaaaacacacaaacacacacacacacacacacacacacacacacacgcatgcacacacacccacagtttcttcatgtatcagaaaactatagtagattttggagatccagaagcaattccaacataaaggtcacttctctcatgaaacttatattcaagcgggtaagtagatcataaggtaaaagcaattgataagccctaacaataaacattacaaggagattaacatcaattatggtgatgtaatggagagtggctagataggcaaggtttttctggggagatcatatttgagcccagacctgaataagaaagcatcagacaaggaaagatatagggaagaaatacaaagtctctctggcagcggcaagttggcaggtttgagttcacacacacacacacacacacacacacacacacacaaaaaaaaaaaaaaaaaactgtgactggagcatgacaggcaagagtaagaatgagacaatactgggatggagaagtagtcataggacagatcatattgggcattggcagtgaacttgcattttgttctaaatataataggaatccattggaaggttgtaagtaggatgtgtgatatggtttgatttgccattttagtttgccactttgactgcttttggaaaatgttttgtagcaagtcatagtgggtatagtgagatgtgtggttggacgttgttacaattcttttggattgttctaagatggtgacattgtaattaaagagaaattgacaaattcaggatatattttggcaacagaggcagtgagactagcagatagtcccattgtttgtaatctaatagaattaccctaattatatttgacaaatctgaccacagtgcctgggacaaatgtgaatcagggattgggaaattaagtactgagtggaaattctaaccataaaaaaagagaaaaaacagtgtagtcaaccttaaaaacatttaaaattgttcataaatccccttcaaaatgtctgcaagactttccatcagacctaccggtgtcttttaaataggcttttctgtaaaaacaaattattcatattttgaaaagaggaattctttttccattcctaaaatacataattagatacaaaataggtaaagaaactagcaacgtgcacatgtgaattaggcaccataatagacgttgtaatataaatatagtgtacattcctcatactcaaggatttcatattccagtggagtggccaacatgtaaacaacaatacaaacatcccaatgcatctcagagggtggatataattgctcatgaaattctgctcaaggatgtctttctagaaaccggtatttatcactgatgactgtaggcacatgaattccaaagaaaaggcccaacatggaccactctatgcgtatatggcatgctgtatatcagaattatccagtagctacaactagtaaaattgtgataaattaataaatgaagtgatgaaagagttgagatgtggcttgctgtgtaggctgcaaaagattctgaaaagcccaggtgctgtggtcaaacgtttttgatgtatttgaacctgtaaagtgccatactgtttttctcagtggctgcatcattttatattgctaccagcaaggcacagggttccaattgctccatgtccttgatgacacttgttattttctattacagtcaagagccacataaggatgtttcagtcaatgacgaaccgcatgtaggatggtggtcccataagattataatgctgtatttttactgtaccttttctatgtttagatacataaatacctaccattgtgttgcaattgcctacagtattcagtacagtaatttgctatgcaggtttgtagcataggagcaataggccataccgtatagcctaagtatgtaataggctgtatcatctaggtttgcataagtacattcaatactgttcacacaatgaaattgtctaaggacatacatttcttttttctttttcttcctttctttctttcttttcttttttttttttgagacagtctcactctgtcacccagactggggtgcagtggtgtgatctcggctcactgcaacctctgcttcgcgggttcaagtgattctcctgcctcagcctcccaagtaactgggattacaggcacacgccaccatgcccagctaattttttgtatttttagtagagatggggttttgccatgttggccaggctggtctcggactcctgacctcaggtgatccacccaccttggcctctgaaagtgctgggattacaggcgtgaaccactgtacccagccattaggacacgtttcttagaacctatccccatcagtaagcaacatgtgccattaagtgacacatgactgtactttgataatagccacccaaatgggcatgaagtatctgttaagtgttttaaattatgtaccagatttgcaaatatggtgtacgtttttgggggccagatgcacaaatgtgaatcaggattgataacacaagtaaaagtgaaaagaaatgactgtcttcataaataattcgctcatctaaaaaatattattgttatgtttgtacaaggcactacgttagcctcaatgtatacattagttagcaaacagaacctgtcaagtccagtgggggattatgggcatttgttaactaactacatgaatatatagtgtggcagatgctcttggtgcccatccacatgcctttggcagtgtaaagcaaaggctgtttacttcgaacgcctgtgaatctctgcctgaggggttttgttcctggtaattacaacatacttggcccacgcaaggggtaagccctccatgctgaggcatttatattcctgggagaagccctcaagcaatgatggatgagaaatggtaaataaatagttcagtttctttgtccctcatttgggatacctctgagatgtgttctatattttctcccagagctccatagcaggattaagctctaattgctcatggtgctaacatacttgtgcaaatagtacatatcatgtagttacctaataagtctgcacatcaaccatatgattgccacataagttagtactccagaaacatctcttacactttaaaggagctcttagaactttttatagggtcgcctaaaatatatagaatatattataccacggactactcttttttcatctattaaagtttcagagggcaaatgcctgaaaatctactttggtggcaatgctgccaaggagaaatggtgacattgctgtgaatgagcttgacccgaatgatgttaactacaatatattgcttcatgtttagtccaaagtcacagagaaggctttttataaaactactaatctgagctgatgactaaaagagaaatatttaaaggtctttcctcctctccattgactcagtataaataggaatgacatgcacatagtgaggggagaatgtggtgccatgaatagagattttgtagcacatttttcattgactttaatgagatgcgtgtggataaatgtgttagtgcggttggcagagtgtcttttttttccaaagcatcaaggtttagcctaatgtctcagtgaatctttgaaatggagctggaattttaaagataacaagtagtgttcagagagcccattgacccagggagcttgcaaggcccctaccagtttcaacagtaatggaaacatttggcaacattgaggaattaaggcaagtagccctggagttgtgggcatttataaacaagtgcaaaggtaattacaggaaagagaatgggagaggtactctagcagtgaataatttttcattgtgttgattttgttgctgagaaaaatctcagaattcctagatttccatgtttagttacaggacatgcctttccataggaaaggctttgctgatgtccttagggcaatgcctttaacatgtccttggaactcttatatactgttggtatgaatgtatagtagtacagccactatggaaaacagttgtggagatgtctcagaaaactaaaaataggattaccatttgatccagctgcttaatatccacccaaaggaaagtaaatcaatatatcaaagggatacctgtactcgcatgtttattgcagcactattcacatggaatccacataagtgttcatgaacaaatgaatggataaagaaaatgtggtatatatacacataagggaatactatattgttcaggtataaaaaagaatgaaataatgtcatttgcagcaacatggatggaactggaagtcattaagtgaaagaagacaggcataaaaagacaaatatctcatggtttcacttacatgtgggagttaaaaaacttgatcacatggaggtagagaatggaaagataggtaagagacactgggaagggtgacttgagggagaggatgaagagaagtgggttaaagggtacaaatatacagtaaaatggaataaatacagtgtttgatagcagagtagggtgaatatacgtcacaaaaatatatactacttgggtgatggacacactaaataccctaacttaatcactatacgtagatacatgtaacaaaattttacatgtacccccatacatttgtgcaaaaaaagtccttaaggcaagactaaaaaataaagacagtgtaagtcagtcagtcaacagtttgattgccttctatgtacagtaaacagtgttagctgttgtcaggcatgtaattataatgcataaactcgatcctcgaggaatttgcaattatctgagaagattaaaaaaagtctgtgagggtaattgatgatatctcaatgccaagtgtgttataaatgagggcatttaggatacacatatagaaaatagacagccccaaatgttccacatattatataattcagtcaatcatcattacaaatcagtggaatgtactgtttattactattttacaaatgaggaaaatgccgggggtggggcatagaaagcttagttaactttcacaaggtcactgaatttaatagtggagcaggaatttaaacccaggtaatctgacttcagagtttgtgtgcccaaaacatgaatctgtattgaaagaagagaattgccagttttatcagaacaggaaaaaaaaatgttcagccttgaatgaagggtgtgctatagatgaatgaaaagagaatggggtggggtcgtgggagtgtgtggatctggggatgtgtttgtggggaggtggcacaaaatgataatgcttcaagcagcagcttgaaggtggaaattaaaatggcacaatatgcgtgtatatgtgggtggaagaatgagtagcaattcaaacctaggcgattttatgtaggaggttagttgatggtaggtgggaatgtagattggtacaggtttttaggcaagcaattttgcaacaccttaaaatttaaaaagtacatggcttcttattcagcctttcccaaactaggaatgcattccacagacgtacttatactgtattgttttaaaagtgaaaaaaatgacatagatgaccttcaaaaggagaactgttggattgtattttagtgtactctgaagtatttaaaaagatggaggctcatctatttttatagacagcgagagatgcttgtaatttattgtacagtggaacaaagtgatttgatgaacaatatgtataatatgattctattttaaaaattaatcaagtcaagaaacacttatggaagcctcactatgggctgggcactggttccagtatatgggatactgtagtggaccaaacatgcaaacagatcatactaaacaaatctctgacttcttggagcttacattcttgaggggagatagacaagaaacaataagcagaataaataagtaaattatataacagaagtatatcagtgcatgaaaaaataaaaagaaaaggagatcaggtaaataggattgggggtgctgattgggggtggggtgggagatagtcttaaatggggcagtcagggtaagactcattgagtaggtgagattttagcaaaggcctgaaaaacatcaagaggaacagcagtgggtcaaacataggccttaaattgggaatatgtctggtgttcaaagaacaccaagaaaaatggtatggctggtgtgggagaagtgaggggaagagtagatgagaggaggttgtagagttattgtggggtctggattatataggttaggactgtccaaaacaaatattatgtgaacctcatatataattttaattttttagtagctactttgaaaaaatggaataccaggtgaaattaattttgatagtatattttaaggtaatatattcaaaatatcatcattttaacatgtaatcaataaaaaagtattaatgtgatattttatacttttcgtactaagacattgaaacctgcggaatatttcccatgtaccacacatctaaatttggactagctacatttcaaattctcaatagcctcaagtggctagtggccatcatattgaacgacaggtatagagttgtgtaggtcacttgttatgatttggcttccacgtggagtgaaatagtcattgtggaagtttgagcagaagagtgacttagtctaatgtacatttaaatggatcactctgattggtgtgttgagaaatgcccaagtttggaaggaagaggggaatcgtgcatagaagcagggaggcctgttaggaggctgttgcgccaatccaggcaaaagatgatggagactcactcagatccaagtgttagcagtcaaaatggggagaactggtcagattgtagatttattttgaaagtagaaacagtgtagtttactgacatattgaatggggaaaaaggttgaaaggtgaaaaaggaatgtcaaggataatatcaaggcttttggcataagtggaaagatggaatttccatcagttgaaattgtggttctgcaggtggcacagatttggaggaaaaacttaagtgtgagattgctattatacccccaagtgaagatttgagttgtcagttggatatatgagtctaaatttgagaaagaagtctagactaaagatacaaatttgagagctatcagcgtaaataaaaattatttaaagctgtgagactggatgaggtcattaagggattgagggtagatggggaagagaagaggtctgatgactgagtcttggaaccctctaacactatggggactaataccagtctggatggatttataccatattgatgattatttttaccattacgtaggagaatttcaagggcctggccaagaaggggaacttttaatatataactgtatttttaataataaatatatataatatacatttatatattatatatataataaatgtatataaaatagaattttataataaatgtataatggttctggaatttaaaaatatgtgagcaatacagagaggacttacagctatagctcagatatataaagaagttgtgaacttatcactgttgtccttacaacaaggaaaagcttgacaactaattatcaatggatattgatgttcttatacacataagagaactgaatttgcagggcgaactttcatcgcaaacctaaagaggcaggtacctgcaggaagtcataaactgaagcatttgcttacctggggctgaagcctccagatgccatgaaaccatatgaggaacattaaactagaaagtctgatgaattgctggggtggttaagtatgggctagcaagagtgtgtacagctccttgagggccacagtcatgggtgtggggtgtggcttatacttacctaggcttttccttcagttagtacactaggctgtcattaggaagattggggataatccagagaaacctacctactgactttctctctgccttggtgattgtagaagtttctaaaggatattttcactggatataagattctgggttggcaggtttttttttttctctcactccacccaattccccgaatgactaagaagagcatagcaccctgacaacctgtgatggacatacagtgtgaacaagaaattaactttttttgtttgtattttagcaaaaacaaacagcaagttgtcagtacaatcatgttgattctggaaagcaagcataaggaaattttatgttttatattacatacagattggggaaaccattggatgtcttgaagaagagtagtatttgatttacccaataaaatcatgttctttgaatattaatccagtagcgatgtataggcaaagattctccactttctgaactaattctgacccttggctctattatgtgtctgaagttatttaataggaacaataataagaacccaaaccaagtgataattaccagaatcctattcatactattaaatagaattagctttgtgtattgtttgaggctattttttttaaaaaaagagaattttaatagtatcttaatgctttatataatttcccacaaaataatataaaaatactcatattgagtaattctacctgtttttacaattaaatgtccatcgctaaataatatttagctaggaatgtagttccttattattggctgttatgccaaaagataaaaaatttcttgttctataatgcctttaaaaatagttgtctattgaaaatatatctattttttttttctgagacagagtctcactgtgtcgcccaggctggagtgcagtggcctgatctcggctcactgcaaactccacctcattggttcacgccattctcctgcctcagcctcccgagtagctgggactacaggtgcccgccaccatgcccagctaatttttttttgtattttcagtagagacggggtttcactgtgttagccaggatggtctcgatctcctgaactcgtgatctgcccacctcggcctcccaaagtgctgggattacaggcgtgagccaccatgcccggcctatatctattttttaccggacttttaattaaataagaatctagagattttacctaattaaggaaaagcatgttggcttcagaaataatttttatgcatgccccataagtctttgaaaagacaatttaatattatgcctaatgttatttttgctttgggagaaaagtaacctatagccccaaaaagtcttatatatgatgggttgtcactcatggcaacttacagcaggaaggattgggtctagattttccttactttgcctcagatttttcattttcgaaaaaatgccccttttcatgtgttgcaactgaggagagttatgagtcaaacgcatcctgttttcaaactcatacatgatattttggttaataaatgcatcaggacctggaggacaattgacatataaaagaaacatagaaagaaggcagccaattgtgtctgtttacagactaaatatgacaaaaaaaggtctgtgagagttttaagttctgcctgttccctagaaatttctactcatttgaagatgaaccttgattgaaatgtaaagtttcaacttctaagaagctgagtaacatacacagcaggaactgccaatatcgttttaatagacatgtcttgtaaaggtgaatttcaatgagttttcagagctttctgaacagtattatcacacgttttaagtaaataggtcaatgttatcatttatgtataattttattgctttagtgctatatttttatgattattttacaaatactttactaagaatatactgaagtctcctgatgattttatgctctttcttattcttgttttactcgagaagttttaactttgaatccctacttagctactttaaaacctgtctcatttttccaacttacaccttgcatcatctctctttccttagagcccagacatcttgcggagccattcacttcttcctaacattttagatactccaatcttttttctatatttgattatttatttgtgaatctcaagaacagaagtagtctatccccaaaacatgcagagagctggaaaaagtatagacatatacaatttaatggaaggaaggaaggcaggaaggaaggatatgaattatatctctaaattggaaacttcaagccttatgtctttataatgatatatcataatttccttttaaaagtcaggaactcagaccaagacacaaactcatgcacatgctaaactgtgaaagcatacatttacctgtggtgacgttagctggcagttttagttggctcagaaaaataatcttacataaggaaagagcctccctccatgagcagccttgaaagtagaaaatttaggaagaatgtgtcaatgatcaaatctactgaaaatcagcaatatcttttgcatacttgtggagtaaggtgtgacaagttattagtggtatggatggctgagcttttctggaaagaagaggacatttttcaaatgtgccttgtattgtgcatggtcctttccatggttatacctacatactggccagttgtaaacattagatcatattaaaatcattcatggatctttcaaaaagacttagactcccacacaatagtagtgggatactttaacagcccactggcaatattagacagatcatcgagacagaaaattaacaaagatattcaggatgtaagctcagctctggaccaaatggatctgatagatagctacagaactctccacccaaaaacaatagaatatacgttcttctcattgccacatggcatttactctaaaattgatcgtataatcagaagtaaaacactcctcagcaaatgcagaaaactgaaaccatataaaacagtctctgggaccacagtgcagtcaaattaaaactaaagactaaggaattcactgaaaaccgtacaattacatggaaactgaataagctgctcctgaatgacttttgggtaaataataaaattaaggcagaaatcaagaagttctttgaaactaatgagaacaaagatacatcgtaccagaatctctggcacacagctaaggcagtgttaagagagaaatttatagcactaaatgcccacatcaaaaagttagaaagatctcaagttaacaacctaacatcacaactaaaagaactagagaaccaagagaaaaatcaagccacagaaatacaaacaaccatcagaaaatattacaaatacctctatgaacataaactagaaaatctagaagaaagggataaattcctggacatagacaccctcccaagactgaaccaggaagaaatagaatccctaaacagaccaataatgagttctgaaattgaggcagtaataaatagcctaccaatcaaaaaaagtccaggaccagatggattcacagctgaattctacccgatgtacaaagaagagctggtaccattcctactgaaactattccaaaaaattgaaaaaaggggactcttccctaactcattctatgagaccagcatcatcttgataccaaaaccctgcagagacacaataaaagaaagaaaacttcaggccaatttacttgataacattgatgcaaaaatcctcaataaaatactggcaaactgaatccagcaacacatcaaaaagcttatccaccacaatcaagtaggcttcatccctgggatgcaagcaagcttggttcaacatacacaaatcagtaaatgtgattcatcacataaacagaactaaagagaaaacacacatgattatctcaatagatgcagaaaaggcttgtgacaaaattcaacatcccttcgtgttaaaaactcacaataaactaggtattgaaggaacatacgtcaaaataataagagccatgtgtggcaaacccacagccaacatcgtactgaatgggcaaaagctggaagcattccccttgaaaactggcacaaggacgcctgctctcaccactcatattcaacatagtattggaagttttggccagggtagtcaggcaagagaaagaaataaagagtattcaaatagggagagaggaagtcaaactaacacttttgaagatgtttaaaaaaagcaatggggaaaggattcccttttcattaaatggtgctgggataactgtctggccatatgcagaagattgaaactggaccccttccttacaccatatacaaaatttaactcaagatggattaaaaacttaaatgtaaaacccaaacatataaaaattctggaagacaacctaggcaatactattcaggacatagcctgggcaaagatttcatgatgacgacaccaaaagcaattgcaactaaagcaaaaattgacaaatgggatccaattaaaataaagagcttctgcacagcaaagtaactatcaacagacaacctacagagtgagagaaaaatttttgcaaactatgcttccaacaaaagtctaatttataaggaacttcaacaaatttacaagaaaaaaacaccaccccattaaaaagtgggcaaaggagatgaacagacacttctcaaaggaaggcagacacatggacaacatgcatgtgaataaaagctcaacatcactgatcattagaaaaatgcaagtcaaaaccacaatgagataccatctcacaccagtcagaatggctactatgaaaaaataacagatactggtgaggttgtggagaagaaagaacacttatacactgttgatgggagtgtaaattagttcagccatcgtggaagagtgtgacaattcctcaaagacctaaagacagaaataccattcaatccagcaatcccattactgggtatatacccaaaggaatataaattgttctatcacaaagacagatgcatgcatatgttcactgcaatactattcacaatagcaaagatatggaatcaacctaaatgcccatcaatgatagactggataaagaaaatgtagtacatatataccattgaatactatacagccataaaaaagaatgagatcatgtcctttgtagggacatggatggaactggaggccattatccttagcaaactaacacaggaacagaaaaccaaataccacatattttcttttagttgggagctaaatgttgagaacccataagacacatagaggtgaacagcacacactgaggcctaccagagggtagagggtgggaggaggaagaggatcaggaaaaataactaatggatactaggcttaatacctgagtgatgaaataatctgtacaacaaacccccatgacacacatttacctatgttacaaagctacacatgtactcctgaacttaaaataaaagaataaaaaaaatcgttcatgagtctttacaaaatcttaatacctgagtctcaggattgagattcgaagtggggagggggactggaggactttttttgagttgataaagaagaaactggtactttgaaagaaggtatacgtttcttccttcctcctttttggtaatattctggaatcactgatccttaagactcccaggattttcaagttgtattctgttgcatttagatgcaaaataatctaatgtagtattttccacaatgagcttcctgaaaggctgatcttctctgaaaatgttagtaacctcatatgataaataagtaaatactaatgagtttcttccaaaatatgtttagaactctaagaaaatcactaaagaaatgtaaatagttcttactattatgcaatactttttcattagaaatacagtaccaaatcaagaatgccaaggagaatgagaaatcattcattactttaatctgttcaattaatatttttgagcatctactatatgcctggtatagttgtaggtgcttgggatacatcagtaaaatgcattaatacatgactttaattctgcagcatttagaaaaaaactctctgatgtttgatgggtttttaaaatatcgtataatgttctttattcatttttcattcaaatttataaatgaattaaaaaataaactaaaccagactaatttgctttattcatatgtaaagttaaaaataattagatattgatcatttcttacaagatttatttcattgattccttttattcttttgctgtcaaatacaagagtgaatttctatgaactgtggagattttcaatgcatttgaattaaaagactatgatgaacagaaaatgacacatccatacatgaaacttctctgtaagtgaaagctttattatatatttctttggggaaaccttttgccatgaagaaatgaagcaggttctgaaataaatttgaaacaaaatttttatgcaacttaagcaaattttacattggtaaatcacgtgatttattagaattttacaaatattacaaatgtaacatcttacactttatcaagctaaacaagaaatagaatcttttctggttgactggctgacatgaaatagtttttgattcaagcaaacttctgcaagtagctctttgtaaacagaaaaataagatagatggatatatatagataaatacataaaactaacttatttgactcttatttggtcccaccagttgggcttttagggatgttttctgcattcaggaagtttcttgaaataaagatgagtatttgttgttatgtttgtctgcagagaacagtctgcaaatagtcatatgtgtttcataaggatcgcctcaactttcttttttgtttctgttttgtttttgcatataggtagggttagacataattgtaaatactccttcttaaaaaggatatatatgcatcggaatttaggaaatggtcatataatggctttgaatcagattaacctggatttaatacaggtccctaggtattgtggaccctcatacccaattctctttgactttgttttgtcatttgtcacataaagatattaatatttaatatacaaggttgttataaatcaataagataataaaagtgtaaagagcactgcactgaacctgccttatggtaaggattcattggaaagtaattatttgttattactgttattattattaagcatctattatgtgttagggttgggaataataaatggaatattatattgggcataggtttcaagtgtagtgtctagttggagaactaaagagtatatgtttgaggtaataactaaaaataaaaacagtagtatggatgagaatagacagtttttttttaaatgtaagctttggaggtttttgtgacataaatattataaatggtcctgaagaaatctgaacctaaatttcttcatgtatacagcccatttatactgttcattaggtagaaaccagctcgtagatgaccttcaataaagtttgtattgattgctaggtttttgaggaaacaaaaacaagagacaattcaattttcccagcttatttctttttgaacagtagaaaggtgttacatcttgttgctgccaagtggagcagattaaaggtcaggacagcatgcaagatctgtttctctaataggaacattccagcacacaggaatgggggatggagtaatttttagtctatgtttctcatgaaagtcaagaatagcataacattagaggtacttttttggtctcatgtttattcagtagctttgaccgtagagttttttcctatttagtgactatattctacttggaaaatatgatgtaaaagaaattcgtagagaaaaatgcaaataccgttgcatatccccaagtaatttatgctttttcttacccccaaattcttgaaatatattcatttgtaataaaaaaagtccctgcacctggagttatcttttattttcctttctttttttaattactctgacatataattgtaagatacatatttatgaagagttgagacaggccagaatcaaattttcttgtccagcctacccagctgctgatggccatctctgagataaccaacttgctcacacatgctcctaatgatttctgttatatagttgagagggagtgtccgtctgtcagcactaaatgctatttgtgaaattaatggcacaaggaaacaatgtagctctgatactagttgcagctatacatgttagctgattttgaaaaaaggttggaatttagtaatatctttcagtcacatggtatttttccctctactcttcccctggttcatggcattctaagcatatcaaattacctactacttgttattgcaaatgatacttttaaatttctgatttgagatattacttgacccatataaaaatacaaaatgactgatttttttttattattatactttaagttctagggtacatatgcacaacgtgcaggtttgttacatatgtatccatgggccatgtgggtatgctgcacccattaacttgtcatttacattaggtatatctcctaatgctttccctcccctctcaccccaccccaccacaggccctggtgtgtgatgttccccttcctgtgtccaggttttctcattgttcaattcccacctatgagtgagaacatgtggtgtttggttttttgtccttgagatagtttgctgagaatgatggtttccagcttcatccatgtccctgcaaaggacatgaactcatttatggctgcattatattccatggtgtatatgtgccacattttcttaatccagtctatcattgatggacatttgggttggttccaagtctttgctattgtgaatagtgtcacaataaacatacgtgtgcatgtgcttttatagcagcatgatttataatcctttgggtatatacccagtaatgggatggctgggtcaaatggtatttctagttctagatccttgaggaatcaccacactgcttccacaatggttgaactagtttacagtcccaccaacagtgttaaagtgttcccatttctccacatcctctccagcacctgttgtttcctgactttttaatgatcgccattctaactggtgtgagataatatctcattgtggttttgatttgcatttctctgatggccagtgacgatgagtattttttcatgtgtctgttggctgcataaatgtcttcttttgagaagtgtctgttcatatccttcgcccactttttgatggggttgtttgtttttttcttgtaaatttgtttgagttctttgtggattctggatattagccctttgtcagatgagtagattgcaaaaattttctcccattctataggttgcctgtgcactctgatggtagtttcttttgctgtgcagaagctctttagtttaattagatcccatttgtcaattttggcttttgttgccattgcttttggtgttttagacatgaagtccttgcccgtgcctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggaattatttctgagggctctgttctgttccactggtctgtatctctgttttggtaccagtaccatgctgttttggttactgtagccttgtagtatagtttgaagtcaggtagcatgatgcctccagctttgttcttttggcttaggattgacttggcaatgcaggctcttttttggttccatatgaactttaaagtagctttttctaattctgcgaagaaagtcattggtagcttgatggggatggcattgaatctgtaaattaccttgggcagtatggccattttcatgatattaattcttcctatccatgagcatggaatgttcttccatttgtttgtatcctcttttatttcattgagcagtggtttgtagttctccttgaagaggtccttcacatcccttgtaagttgaattcctaggtattttattctctttgaagcaattgtgaatgggagttcactcatgatttggctctttgtctgttattggtgtataagaatgcttgtgatttttgcacattgattttgtatcttgagactttgctgaagttgcttatcagcttaaggagattttgggctgagacgatggggttttctaaatatacaatcatgtcatctgcaaacagggacaatttgacttcctcttttcctaattgaataccctttatttctttctcctgcccgattgccctggccagaacttccaacactatgttgaataggagtggtgagagagggcatccctgtcttatgccagttttcgaagggaatgcttccagtttttggccattcagtatgatattggctgtgggtttgccataaatagctcttaattattttgagatacgtcccatcaatacctaatttattgagtgtttttagcatgaagggctgttgaattttgtcaaaggccttttctgcatctattgagaaaatcatgtcgtttttgtctttggttctgtttatgtgctggattacgtttattgatttgcgtatgttgaaccagccttgcaccccagggatgaagtccacttgatcatggtggataagctttttgatgtgctgctggattcggtttgccagtatcttattgaggatttttacatcgatgttcatcagggatattggtctaaaattctctttttttgttgtgtctctacccggctttggtatcaggatgatgctggcctcataaaatgagttagggaggattccctctttttctattcattggaatagtttcagaaggtatggttccatctcctccttgtacctctggtagaattgggctgtgaatccatctggtcctggactttttttgattggtaggctattaattattgcctcaatttcagatactgttattggtctattcagggattcaacttcttcctggtttagtcttgggagggtgtgtgtgtccaggaatttatccatttcttctagattttctagcttatttgcatagaggtgtttatagtattctctggtggtagtttgtatttctgtgggatcagtggtgatatcccctttatcattttttattgcaactatttgattcttctctcttttcttctttgttagtcttgctagcagtctatcaattttgttgctcttttcaaaaaagcagcttctggattcattgattttttgaagggttttttgtgtctctatctccttcagttctgctctgatcttagttatttcttgccttctgctagctcttgaatgtgtttgcttttgcttctctagttcttttaattgtgatattagggtgtcaattttagatctttcctgctttctcttgtgggcatttagtggcataaatttccctctacacaccgctttaaatgtgtcccagagattctggtatgttgtgtctttgttctcattggtttcaaagaacatctttatttctgccttcatttcgttatgtacccagtagtcattcagaagcaggttgttcagtttccatgtagttgggcgattttgagtgagtttcttaatcctgagttctagtttgattgcactgtggtctgagagacagtttgttataatttctgttcttttacatttgctgaggagagctttacttccaactatgtggtcagttttggaataagtgtgatgtggtgctgagaagaatgtatattctgttgatatggggtggagagttctgtagatgtctattaggtctgcttgttgcagagctgagttcaattcctgggtatccttattaactttctgtctcattgatccgtctaatgttgacagtgcagcgttaaagtcacccattattattgagtgggagtctaagtctctttgtagatctctaaggacttgctttatgaatctgggtgctcctgtattgggtgcatatatatttaagatagttagatcttcttgttgaattgatccctttaccattatgtaatggccttctttgtctcttttgatctttgttggtttaaagtctgttttatcagagactaggattgcaacccctgccttttttttgttttccattttcttggtagatcttcctccatccctttattttgagcctatatgtgtctctgcacgtgagatgggtctcctgaatacagcacactgatgggtcttgactctttatccaatttgccagtctgtgtcttttaactggagcatttagcccatttacatttaaggttaatattgttatgtgtgaatttggtcctgtcattatgatgttatctggttattttgcttgttagtgggtgcggtttcttcctagcctcgatggtctttaaaatttggcatgtttttgcagtggctggtactggttgtttctttccatgtttagtgcttccttgaggagctccagacctgccctacaagaatgactgattgttagagacttttttgtgtttctatggaaaaattaaaacatatgtgagagagtaaactgctgattattctatacaaagccttctagcatatctttctgactttctgtaaatggaacatgacttgacgtctacctccaactcaatttgttttttttttttttttttctgagacggagtctcactctgtcccccaggctggagtgcagtgatgcaatctcggctcactgcaagctctgcctcccgggttcacgccattgtcctgcctcagcctcctgagcatctgggactataggcgcccgcaccacgcccggctaattttttgtatttttagtagagacgaggtttcaccgtgttagcaaggatggtctcagtctccagatctcatgatccacctgtctcggcctcccaaagtgctgggattacaggcatgagccaccatgcctggcccttggtgtgttttttaaaacacaatcaaacacataaacattcacaaagaactacttcagaaaaacaagaattcactggactagagaggacctttaaaaaatctgaaagcttctttgacaagaaaggataattgctgtatatctttcttattgagtataattttcgtttacatattttattttgtgtgtttttaaaaattattattaccgggtaattatgatagatataactcagaatacgcataggtcaaggcatgggatagggattgtatggagcttccatactccccactgtgtgccaccctcttagcacatctgtgttttcaccaacccagaagttcttcatacaattttaaaacgtaattaataaaagatcttgcaagtctctgaattttcttaccttcttactcataggatcaggcaaatttcaatctctttgtgaaaatgctaacatgttgagaatgagcaaggcagagcagtggggtggataattctaataataaatcatgaacaaaagtaaatggtgatggctgtgatggtgtgaaataacctgatggtggcataggcctcttgaaggaatactctgggaatctcccttgtaacacttttaagagcaaatttaaaaaatcgagactatttatgcatttttgttgtatttagaaaagcatcatgtacttaaatggaagaaaaaaagtgagggatacttccagtgttggatggttaagtttttctgaagtctatgtttattttcaaagttatttatgacaatgaaataatatttaatgctacagctatcacagtgcactcatttatttttttctaaattgtgaagaatacatggttaataataggtttcagataggtatctggattcatgtgaatgaacttaaaaagacagttttgatgatcattctgttgaggatagaactgtggtatatgtgatcatgggttttatttttctcatgtgtaaaatgaggtatataatctgagtctcaggtgactccaaatttttaccattcttcacatattgatattatgttcaagaaatcaatagggataagggggaattaaggataataatttggttctacttaataacacacactacttgattattaacaacattgcacgcaagtgttaatacagctcatttgctttggatggaagctgtaatgtctaagattcaagcataccttcctttggtgatggccttcattcattcaaccaatatttttgtagtgactgttgtgtggggattgtggtagaattaaaactttaaggaaaaacctattataaaactccctcacaaaaaatacgataaattgaaatttaaacattatttaagaaattttattacttggcagataataaatgatacttactgagtgctaccacacccaggcactattcaattcactctacagttattaattgacttatatcatcctcatagtgttcctatgaagtaaatgtcattatttcccccactttacagatgaggaaactgaggtatagagagaataggcagtttgatcaagcttttaagattggtgaatggaagagtgtgatttgaccccagagctctagtgcctgcatgcttaaacactatattgcacagcttcttcatttagatacattgcagaaacagaggaatctaattgtagatgcatctggctcaactcctttgtgaacatagtagtaatgtaatcagaagacttatatcctcagttttattcttttatggattttatatgggaccaatgataaactttcttcatttaccccagtctcttaataaaaataattttccaattctgtgaagaaaggcattggtagcttgatggggatggcattgaatctgtaaattaccttgggcagtatggccattttcacgatattgattcttcctacccaggagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtcttttgttggtgtataagaatgcttgtgatttttgtacattgattttgtatcctgagactttgctgaagttgcttatcagcttaaggagattttgggctgagacaatggggttttctagatatacaatcatgtcgtctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctcttattattttgaaatacatcccatcaatacctaatttattgagagtttttagcatgaagggctgttgaattttgtcaaaggccttttctgcatctattgagataatcatcattctcagtaaactatcgcaagaacaaaaaaccaaacgccgcatattctcactcataggtgggaattgaacaatgagatcacatggacacaggaaggggaacatcacactctggggactgttgtggggtgggggaaggggggagggatagcattgggagatatacctaatgctagatgacgagttagtgggtgcagcgcaccagcgtggcacatgtatacatatgtaactaacctgcacaatgtgcacatgtaccctaaaacttaaagtataataataaaataaaataaaataaaaaataaaaataattttcattagagtgtatatgagattatgatgatggatttcttattatatcagaattatattttcataaattcagataacactgtacagttattgttgaatactatactatgtataaatgtccacaaatcaaattttaactattcaagggtgctttcctttcaaaattagcagaaagattacgttttcaacagttaattaaaccattttgaaattacaagagataatgtagaattgtatccaaagtcttatacatttgttctggcaatacctttattcagcaagagagaagaatttattctctgcagataaccgctactcacccacaaacagtccaacatacagcccagagatgtaggcttctcattttggaaatacaaactgtttacaatgagagtatctctaaaaaaattgtttcttaggaggaaagatcgttctatcttccaggaaagggaaactccaagaagtttctttattctaaaaaattaagaaagaccctcaaacctcaaagcacataaaggagacttagcaaacaatattctgtaatatttgcagaaaaacataaacacagcatctttactaatgtttattttccaaaaatatggtaataatagacatttattgggaacttccggcattgcaatgcagaacacttttttataatgaatataaactcattatatagatgaagaagctgagttgcaaagaagtcaagtaggaaactcatttaaaccctctggagtcatgtccttccacagtgttttatatttactttcttgtagatattatggctattctaaatatttggatatttgctgctctaaaagtctttttccttaaagaaaatttttcaagttgtatttctttttcactttaaaagttattttaaacttaaagggaactttacagcccattctagctatgttactctgtattatcatttgcttatatcaaacattttgcatgctactatgactataaatatatcattttaaactttaatttgtgcaaatttaaaatgattgacttttattttgcagttagcaaataagctcccagactgaccaaaatgcttttaagggtcacatttatgttaaaaaattatatgtataaaattcccattgggaaaagtttgattccagtattcttatgtaatagccaagggagtgccagttaagtacaaatttaatagcttttctaggtaggactccagaattagtgcatgaagggaacatagttaatctgtttgaagagttcattaaattaggttatatatgctattatgaaatatagaggagcataaaagtatccagaggaaagcatagaaacaatgcaaattacttagaaccaaaaagattgatttatgatgaattattaaagataaatggatcttaatagtaaatgctctataaacagagtatatgtctaatgccaagatgctaagttcaaagaagctttacctaataattaatgaggactggaaatactctagcattctagatatagttgcccaattaaatatgttatagaaaattatctgaaaatgggaagctaactgagctcatccaaaatttagatgatgacttatttcttccagttagaagatagggatgaggccgggtgtggtggctcatgcctgtaatcccagcactttgggaggccgaggcaggcggatcatgaggtcaggagattgagaccatcctggccaacatggtgaaaccccatttctactaaaaatacaaaaattagctgggtgtggtggtgcacgcctgtagtcccagctactctggaggctgaggcaggagaatggcgtgaacccaggaggcggagcttgcagtgagccaagatccatctcaaaacaaaaaacaaaacaaaaaaaattatgacttgaatttcaattatgacttgaaattatcttatgatagtttctaataggtggttttcctcatttgtttcaattataattaaaaatagttttataattattatgacacttgtaaagatagtaaaactctgtttcagaaagcttatccatttgctgaagtttgtattgctctctcatctattccttgaagaactttaatattgaaggaaaacaatgacaacttttatgataggaaattcccctgcttaactaaaccagcacatattggtctcaaaaattgagatgacctgaatctttgaatatagtttttttacacgttgagcattgtatatagttagaaagggctatagaaactgtttcatgtttaaataattatttctttccttttataaataatataaagagtatatatcagttatgtattcagaggaacacttccgaaaaacgactaaatagatacttggccatattttctacaaaattatctaacatagaatgaacatatttattcaataaatgtatgctgaaaaaagctacatcataagtaaaatgaacaataaaaaaactaataatattttccagttttcttgataatgatttacacttgttgaactgtgatgtgtgatatacttgttgaacatgctaaggaatattaagccatgccctaattttcattattttacattcatgcattaacttgagcaagaccctaagatttatttataggtgccagttcagaaagtttttcttgctgtgaaatcctagacctgatgttttaacatatatatggactttgaaaccatgttcatttaatgcctatgaccaatagttttaatgaatgcctaacaacttacttaaaccaaacaaataattagtgtcaattacagaagtgtaaatttgactctaattaatgaatgtgccagactctacgcattggtttaagtgtaattgatcttagggccactgagatcactttaagggttggaaaaatgacaacaagtaggaagtgactcagatgtaagaatgctcactcctagaaagattaattggtgtattagtgataaactagtgggtggctgatgtaataatgatatccctatattaagatgcctcaaaataggatcaccaactctaaagcttgtaagtttatacaattactatgtcaaatatactcttttaaaagaatatctgtcacgttcatttgtccttttttcattttgattttttttctttttcatcattataaaaaaaacatcctaagggaagcatactgatgttttactttatgctttgaaatgttctcactgaactgtgttggtaggcctgggtgtggtaaattaagtggcttgtattaaaaagacaatgattgctagctagtatttttccattttctttgctgtcagcaaagtctgcttttgttgccatgataacttctccccactttgatggtgaaatctggaaggacaaaaaagaagggcatttctattgtgctattacatttcttctcttttgaagaacttctaatactttgaatgatgggttaaaaagccgagatgatgtgatgaagctgaatggtgggcaaaagctaaattatggcatattcatttttttatcagtgcgtgaaaggtcactggctgagggagagacaggcaaagtcctagatcaagagagtgagaggtggctgctaagtggggagttgagaagatcagaatactacggagtctttgtcctttttctgactattccctgcctatgttttttccctcccttctttctcccctacctcctaaccccagacaactgtcctaatgaaaagatttttaagaaagatgtcaaagaaaatagagtttttaaagaaagatgtcaaaggaaattgttgaatgaggcacaggggcagcatgagaccagagtggaggaaagtgataaaggcactttttagaagttaagcccagaaaactggggcaagaatcaaagcgacgctacaggcagggatgaggtaaccagggtcctgaagataatcataaggagctggagtctgaggcaggaaaaaaggcaagtctggttaagaggtttaaggcagaggatgacctacttagaaaaagatcttttcaacagccagacttcggactagaggggaagtaggtcaagaggcctgagagtaggttacattcgtctgagaggaagttgttttgactaaacaagaagttgtaattataccaaattatgagatcgttaaattaagtagtcatgtgcaataacatttcctccttaaatatttttaaacatttttttagcagagttgttcatcatacatcaaattttaatttgcattatgttgtgtagtacaacttcatttagactacttcagtggaagaacaatcgaaatttacgaacattctgaaagagttggaattttgcttcttgtccgtatataaataggatcaagttaacctttcatactgtgtgaactcctttgtcttatttcttcgagggctttttaaaagataagaataatgaacgtgaaagggattttataaaaacatgattaattcaggtaattgaaatagtttgatatcctaagtagtttaagcattctttctgctacctcatttggattaatagtttgtttcatcccagcactttgggaggccgaggcgggtggatcacgaggtcaagagatcaagaccatcctggccaacatggtaaaacccatctctactaaaaatacaaaaattagctgggcatggtggcacatgcctgtagtcccagctacttaggagactgaggcaggagaattgcttgaacccgggaggcagaggttgcagtgagccgagtttgcgccactgcactccagcctggcaacaaagtgagactctgtcttaaataataataataattaataatttgtttcaaaatacagcaggatggtatagtgttaaacacataaattctagaggcagattacctggattaattcctagctctatgattttctacccgtgtgaggatattggatcttaatgtttatatgtcagttctctcacctgtaaaatgggctaatagtagtgactatttcatagagtggttgtaacaatttattatacaggtgtgtgtgtgtgtgtatataatatatacaggtgcacacacagttatatatatatatacatacttaggacagtaacagaaacagagaaaatgcttatcaaatatttatgattattatgagcaatgttaacagtaattatatgtatcctaaaatacttctaaaatagtaatgatactattaatccaatcctaattttaatactaatcttaacaatatttttgtataccatcccccagctcctcctgccatttcttttctcccctttatagtaaaactcagaagagttgcctgtgcttgctctcttctcatttctcttagacctcttccagtctgggttttggagccaccactccaactaaactattcctaccaaggtcccgaatgtcctccacattgctgaattagacccaattctcaatccttaaggcagatagttgacctatcagcaacaatttatcacctacttctttgatgatgtactgtcttcacttgtctttcagaattgactcttggtataccttcagatttagttggtctttctcagccttctttctgattttgtcgactctcgtagacttctcgatgatggaagaagccagtctcattccttggtcctcttctcaattcacttccttagtcatttcacctagtactgtggttttaaatatcatttgattgttgacaattttgactaatttattttctgtttccagctcctctcccaaattccagattcgtacatctaactccttactcaagattttcactgaaagcacttatagacacttaaaatttaatatgtccaaaggctatagagccaatatcctcctcagaactggttccacaaacacccattcccatatcagttgctatagttccctgtgtctggttattcagaacaaatttctttgagtcatccttcactcctctcattttgttatactccacatcaaacagttctcactttctgttggcttgaccttcacaagagatccagatggtgaccatttcttaccacctctgctgctacaaccctactttaagtcactatcatttctctcctgaatttatgtgatgacatctggtctgcctgcttctgctcttcccctcttcaaatctattctcaacacagaagtcaaatgtcagtaaaatcctgtcagtcctcaccttgaaaccctgcagtgaaaccacaattcattcattacaaatgaaaagtgtttacaatggcttccatggatttatatagtggcccccattatttcttcttatgtcatctactcctattttccctgtaatttgtgttactctagccacagtgacacctcactgtttctgaaacatgctagacatgtgcctaccttaaggatttgcatttgctgttccctctgcctaaaaccattttcccatatataatcccacaattcctttacttcttttaggtctttaccaaagtgtcatttttttttttttttaatgtggctcttcctctagttttaaaactataactctctaactcctgactgtcacctctggcatttcccatttctcctaccctcctctagagcttagtatatgttccaacatcatgtaccatttacttatttgttatgcctgttatttatcagtcttctactagaaagtaagctccatatgggcagggaacatttttcatttactggttggatcagtacctattattttgtaggcactcaataaatacatgtcaaatgaatgagtgaatgagtattctgttgttttttcctctcccctacaaatattatgttgaaaagggttttcctcaaatgcagatcttatgcaagatacctgcatgatataggcagtgaacatcatctgctactttcgtttgctaatacaacaggcaagctcaacgtgaaaattacttactgtggcatccagtgttgctctccacatctggaatgtgtttccttaatcttatgaaacattactttcctatcaagttctgtaccacctatgaagtttttcttctctggacattcttgccaactgtgatttccaattctttagaattggtatagcacttatttttcttactatacaatttagccaatacattttatattaagtttcattgttttgtctcttcaactagcttgccaagtcttgaagggcagaaatcacatactatgccttctggtaaagcaatgtacatgttcacactccaatctatagagtattttttttttaaatcttcaaaataggttttgtctcttcaactagcttgccaagtcttgaagggcagaaagcacatattatgctttctggtaatgcaatgtacgtgttcacgctccaatctatagaatatttttcagaaaaaaatttaaaaataattttccaggaagattcctcagaatcttagtggtaacccaggagcagtggttcatgcctgtaatcccagagctttgggaggccgaggtggaaggattgcttgaggcccggagttcaagcccagcctgggtgacatagcaagaccccatgtcttaaaaaaaaattagctgggtgtagtgacacacaaccgtagtcctagctgcttgggagcctgaggcaggaagattgcttgagcccaaggattcgaggctgttgagctatgatcatgccactgcattccagactggacagcagggcaataccctgtctccaaaagtataaaattaaaaaaaaaattagaatcttagggataaattgcttaaaaacaagataaagtttcaaacaaatacctaatatacaactgtcttcaaaagacattttttagtattaatgatttaaagtattttccctttcatatttccttccttatgggtaaggaatgtggaatgtcaagccatttttcatgggttttataaatactacctattgattattcatgaaataatatgtccttttatgctttgttgttaaattcaagatattatatagcaataaaacatttaagtatttgctgaatcaaatgaccaaactggaaagaagtgatggtcaattagaatgtatacaatccttgttcattaaaatgatggctcacaggctgggcgtggtggctcacacctgtaatctcagcactttgggaggccgaggtgggcagatcacaaggtcaggagttcgagaccagcctggccaacatagtgaaaccccgtctctactaaaaaatacaaaaaataagccaggcgtggtggcgggcacctgtaatcccagctacttgggaggctgaggcaggagaattgcttgaacccaggaggcagaggttgcagtgagccgaggttgtgccattgtattccagaccgggcaatagtgtgagactgtctcaaaaaaaaaaaaaaatgatggctcatagatgatattcatgaaaaggttctctcttgccttacaaaactcttctacttatctgttaatgtatacagttaattttctacaattgcataaatacatgcacattaaacattaaaatgacttagtttatgttccaaacttacaaagccaaataaagtcagtggtaatgacagacctttaactctccccattgttcttaatggcaaccattgctactaagacagcctgtgcaattattcagtatctcaggagtacaaaccatatgctggataaaaaagtaggcaaaataagcttgatgtattaacactaggagactgcaggttgtattttgtttcatagatttgagagaatatttttattttgtttttcactattttttttccttcaggagtgtgttgcatgtttattgtcttgtgttatatatgcaacagtagattttcttaactctgtttttataaaatgtcatggattctttcattccattaacttctttgaatgttatgaaaaatgagtgttatgaatagcttaggagacttgagtgtttggagaaactgaggagacttggaggggctgctcagccctgaatatttccttttcttttcttttcttttcttttcttttcttttcttttcgttttgtttcttttcttttctcttcttttccttccttccttccttccttccttccttccttccttccttccttccttccttccttccttcctttctttcctttctctttctttctttctctttctttctttctttctttctttctttctttctttctttctttctttctttctttctttctttttttgagatagagtctcactctgttgcacaggctggaggacagtggtgcgatctcggctcactgcaacctctgcctcccagacttaagtgattctcctgcctcagcttcctgagtagctgggattacaggtgcctgccaccatgcccagctaattttttgtatttttagtagagatggggtttcatcatgttggccaggctggtcttgaactcctaagttcaagtgatccacctgcctcagcctcccaaagtattgggattacaggcatgagccactgtgctcagccagccctgaatacttctgaagtcctttcatttctctaaatattaagagagcaaacaatagaaaagtaataatcaacaaacttgatttcttacaagaaggcttatatgccaatgttttaaagttttaacattttaatatagagattttacatggtttatgttatttcctttttagtatatctttttaacttcttaaagacacaacaaatatggaatattaaacttggataaacaactctttcattataaaacaattcatccaacaaaactgtatcaaatgcctcctcagtgctaagcgttctgctagtcattggtgatacaagttgaatgaggcaaccaatgaccgaggcttcttactgttcacattcaagtggaagtgtgagaaaataaaaaatatgtaatgtagaaaagaaggaaggaaggaaggaaagagtcagggagggagggaaggaaaaaaaaaggggaaaaaagaagggaaataattatccattcagataattgctaaagcagaagtacacaggtacagtgaatagcaatttgcagccagaaaatcactattatatacatttctttgcatgtttccaaataaataactcttccaaatatctaatctctttttttaaaaaaaaaaaatcttagaacattattgaaaactagtttatgggaactagaattgtcctacaggacagaaaaatttggcccaagcagcccagttttagaaatctacttcatgttaacattattttacttagctgacaaatatttactaaatgcttattatgggccatgcactgattttggtgatatagcagagaacaaaaataagtccctgacctcatgtatcttataagaagtaggtgatgattgtaatagatcagtggatgataagcactctggacaaaaattaaaactgggggagagttatgtggtgtctgggtggaagatgttggagttctctagggtggcaaaagaagacctcactgagaagcagtcatttcaactaaatgctggaaaaggtgagggggtgagttatgtgtgtattagatctagagaaatgcaggtgcaaaggccataaggcaggcaccatactggttcaaggaaaaccaagaaggcttgtgcggctgcagtagggtaagaaagagggaggttagtgcaagatggagttagaaagataatgttgttaggagtgctttttaagggttttggagccaagaattaaacaaaaatctgcttgatggcaggaggcagcagatgacatctgtttgctactgtccttccatgtgggttgtatcattcctaggtaattgttctcatttctgaccaggagtgttagtcttttctaattagcatcctaattattttctccaactcatcttctacttggctgtctaagtgatctttccataatgcatgtcccatcttgtagtctcaatttaataccctttggtgacactccattagctttgcaaaaagacaaaggtcttaaatggtgttcaaggcccttcataatttgatgtctccaagatacctacacagcattcctcctctgggtcttgacacttgtagttccctctacctggaatgttcttttcccatttcttcccatgacagctttcttttaatcttttaaattcctatttgaatgccaccttcactgaaagacattcctttcctgaccactctttctaaagcaggtgacacggagtctatattttccatcattatcatgctgtaattttcctccttaccacaattagaaattatatattttgctttactcttttgatgtctgtctgtctcagtagtatgacgcttcatgaaggcagtgatctcgctgtctttacacttctgtaccaacaataaaagctaacacatatttaatgcttgttatttcccaggcactattcccagcacgttgcatccactaactcatttaatacttaaccatacgaggaagataccatttattaatctagactaggctatcaaggcacagagagactaagtgcctggactccaattccatggctaatagagtagaagagacaggattttaattcacacaatctgcctccatgaaatcaatgtacactctgtgcattagacaaatttgattatttattttaggtaccttatactttctataagctgaggctttcagtagtgcttcctctgccaggaatgcttatatcttcttttccctggccatatgctatctctctttctagttttcatccactcttcatctcctttccaaggcttttatgatatccccctccttccctgcccagactaaatagaagcttctctttgcctaacctctttgcttccatatgatagtttagcaattattatgctatattttaattattaattttcttatatcccctagacactgaactcccaagatggggacagtgtcttttttttttaattcccagtgctcattatagtttatggcataaaaagttggtgctcaataatgtttggttaaatgaatgtgtgacacagaacatttcaacagcatactcattaatatcgtagaaatcttacctggttcaaaaaatactaagacatctgtccaagtagaaatcataaatccaataaacccaggataatagttttgaaggaagagagatgtaggtttagaaattgtcaacagccttatgtcactgaagagaagaataagaaagctgctgtctcaaccactgaatttaaactaagctgctttagacaaagaaactaattttaagtgagaatgaggaaggacaatgagcagaagttagaattagcagaaggattggagatagggtttgactttgtgtatatctgaatctttcactaataggcaaaatttataaatcattaatatctctgatatgagccatattttgttccttgaagcaattttctttttttaaccctataatgtcataaatttattttttttccttccaacttttcttttaggttcaggtggtacatgtgcaggtttgttgtgtgggtaaattgtgtgttgctggattttggtgtaaaaatgatttgtcacccaggtagtgagcttattaccctataggtagtttttcaatcctcaccctccaccctcaactaggccccagtgtctattgtccctctctttgtgtccatgtgtactcaatgtttagctcccagttataagaacatgtataatatttggtttactgttgctgtgttaatttgcttaggataatggcctccagctgcatccatgttgctacaaggatttgatttcaatctttttatggctgtgtggcgtttcatggtgtatatgtaccacattttctttatctagtccaccattgatggacatctagattgattccacgtctttgctattgtaaatggtattgcagttaacatatgagtgcgtgtgtgtttgcacacacattggtctgtcgtccacaatgatggactacataccgtcgtttgattgaacaatgttttttttcttttggatacacatacagtaatgagattgctgggctgaatgatagctctgagtttttttgagaaatcaccaaactgctttccacagtggctgaacttatttacattcctatcagtagtgtttaagcattcccttttctccacatcctcaacaatatctgttatttttttactttttggtaatagtcattctgatgggtgtgagatgttatttcattgtggtttggattttgcatttctctaatggttagtgatgttgagcattttttcatatgcttgttggccatatgtatgtctttttttgagaagtgtctgttcatatcctttgcccatttttcactgaggttgtttgatttttgcttgttgatttgtttaaattccttatagattctagatattagacctttgtcagatggatagtttgcaaatattttctgccattctgtagggtgtctgtttactctgtttatagaccttcaagtaattttccaaacatgcttcacaaaccttgaagtacgtgcaaatattttagatggacaaacagactatattaaaacattttccaagagattccttatctcattttgttgaatgtgagaaagcaagacgaagaggatttgtaacttgtgatacaaaatagggcacaatcaaatctaatctcacctgagatcttcacctcacctttgtcagcaaatagattctttcttttgcaccctgcactataagtattctgcatctattagttttcttatcagcatgaataaataattttacaacatagttcttgaattaacaaactattttgctccaaatacctatttcataatttctctttagttaaagtttgattctgttctttgtgacattcatagttctgaatttatatttttacttcttaagcaggggatttatattttttgtttcaaactagtggtattctttatctgatcaatttcagactgaaattagattggcgtaagtgaacaattaatttggatgttagtaatgggaaatttgagttctctgcgcagactggcagaacgtctcgttgggacatgatctgagagtaaaattttgcagtatggaaaatgactatgccttctgactatacttgtcagaagaaggtagcctacaactagccgaaaatggtcaaactaagatttatggaccaaacaaattaaaataccagtaaagggcactgaaatccattaagtgacttatccaagctaatgccagacaagacggcaaccaaagactaaaaataattatgtttagtgcaagctcttggcaaataaggagacaatatatctgcagttcaacaaaatcaatggattttgagtacctgcatatgttaggcattgtaattgataataggaatacaaagatgaaaatgtattttcctatttttatttcccatagtcttcattggaagacatttgtatttccaccttaaacttttatttttaagtagtgaaagcagagggactccattatgtagtagaaaacacaatggatgttctagattcaatttgtggagtcaatccgagtcttttttggagaagaacaacagaaatattttacattttttgccaagaagtataaagtgcatatttcaaatggctgttattgcaagaaagagtggattaatcatataagtattcaacaggcacttaaggagaccgattgtgttcagttaaataatttcacttctatagatgccaaatcactggattctataacacatggtaagaccagcatgatttgttaagtgacagagacaacttgaagagtgcaaagaacataccattgtcaaaagacttgaggtttagtatttcttcagtcattactcaatctttaggaacctcaattcatcttcttataacatggatatagtaatctgtatatcttggggctttggtagaaaccaaatgtaattatatacatcaaagaacattgtaatctgtaaaatattattcctgaaaagaatgcgcttaatgaagcatcataattgattacatatgattcttccttatccttaatttaactttcaaaatatcactcaatttgtcgttctcttctcagcccaaggaattaaatggtgaatttcaaataacctctaatggtcatctattttcaaagtagaatttatgattctgtgtgcccaattttgttttcttcccactatacctgggtgcctattgatactaacctagtttaagcacttatcacctcgtatttttaaatcttacaatcatatccttatcacttcaatttatctaaggtctctcttttcaaatcatccagcatgtaatctttaaaatgacttttccgaaacataatttttacaatattacggaaaatatttgttgtttgaagtcatacagacaaagctaagccctatgtcttactagttacaagacctttcttcttattcacttctctgtgaataatagtgtctgtctcctagggttgaattgagaacaaccaagtatatagtttgcacagtatctggattagagaaatgctccaattggacctctaccacctaatcctgactcactttataactgagtagtttatcgtcatccatgggataagtatgaaaatacaaactcctttgtgattccgtatactccaaaatgtttctagtcttctccatcaccgattcttttcctgctgaaaccattcgtttgcttatttatttatttatttatttaatggcgtacaacataatgttttgatatatgtgtttgttgtgaaatgattatatcaagctaattaatcaaatcctctatttcatccaaactgttttaattttctgaaatccctatactattcacttggtctcatggcctctacaatatcttgccctgtaattatgtgaatcctatcaagtattcaagtctgagcatttgctaaccttttttaataaacctgactactttcaactcaaactgctacttctaagtatcaaaaatatttactagatccttatcatttatatttttgtttatttccctctcttctttcctccctccccttcttctgccttcctttctgtccttccatctttcttactttcattacagatttcctttcaaaatgtatatcttatacgcatatctatgctatacgttcctgaagggtaaaaagagtctttacatctttccatgcacctatgacggagagatagggaccaatcaatagttgttaattgtctgtactatgggtttaacaaaaacacattaaaactaatatatgttaaaagttccaggccttaatttaagaaacttatttatattaatgcatgtaatctgcctgacaatcctataaagatgggcagactgaagctcagcgacattaggtaatttgcccgaggtcacacaggtcttaaattttataagcagtatgagaacccaagcacattcctgtcaaagcatatgctcttaactataaaggtacagtgatgcttttgcagttttggaaaaggatccttgtgactctgggtagcgttttcaaaagatggttgcctgtgtgtctatactcaaaatgccaatagtgattattatgaattcatttagcaatgattcatagagaactattctaggcactgggaatgatatgataaacgcagcagaacaggtggttaattttgtgaagctagttggtgagagatggacgctgagcacataaattagaaaatataaagtaatgatcagttctataaataaaataaaccatggatatggattggattaagttgagtttatactttgatttgtgtggtcagtaaagtcctctttgggtaagtgacttcttacctgagaccttatattaggaaaataattctagttagtataagcgcaaggagacttattaaaggcaattagatggcttactagaaaattaaacctggatgcttcttggaaaggatcagagtgccaggagccacacacctttcgtaaatatacccaaccacactaagaaacaacttagcactgatacttgtggttcccaagttacctcagtttcttgagatacttgaaatggagagattattagagtgatttcaattaagatggaaaggggggtaagttgtgttttgcatgtaaagcttactacagaatttctcaactggtggcagaacaggttaatgaaataccatgatactgatcatctcagcctttagggtaggacccagggcagcccaaattctcacgttcattaccttcagccttgagcagccctgtttccttcagtcttccatgccgtggaaaagactggggaccactagcctatagtattggcttaagaatgtgggatagagaagaatcaaagatgaattatgggtttttaacttgattgacttgttggctcatggtgccacttactagtaaggaaataggtagggcagagcaagttatagaggaaggggaataaaagggatttttttgtaaagatgtgaggtttatgaaatttagtctttaatatgtagatgtcaaataggtagatggctacataaaacgagttcaggagggcagttcaatttggagatctacatttcagagttattagcataaagatgtagtgtaggagcatgggactgaatgaaattactaagggagaaaacagaaaacaaagagaaatgattttaagactaaggccttgtgcacataaacattttgaagtagaacagactaatagtgtgctatatagtgtatgtacaatataggaagagaattcttgatgtgatatatattttaaaaactggaaaacatactgattacacaaaactaatgcatttctacatgtgtagttgaaagaaaaaacatagttgggaataatccagtaaattataaggaggactgaacatgttggggaagaaaactttcatactaggacaaacttttttttaagaaaaataactttttaaaaatgaagcctaagagaagatattatcaaagcttataaaatcaaaaattgtatgaatagggtcaacccattctttttttaaattattatactttaagttctagggtacatgtggaaccaacccaaatgttcatcagtgatagactggattaagaaaatgtggcacatatacaccatggaatactatgcagccataaaaaaggatgagttcatgtcctttgtagggacatggatgaagctggaaaccatcattctcagcaaacacattcttatttaccaaagtcaaaatactagaactagtgctttaaagcactccctgaggctttaaagaattactctgaggacaaaatgaaagtaaattctgttttaaccagtgggtagtaaacttaaaaaactctttaccataagcggtagaatgggttgaaaatataaatagtttcaaggtggagttcatggacaatagatacacaataggttgtttaaggaaatggaatattttaatgagtggtacatctccaatcttttaattttgatatcctattttataaccactttctgtaaaaaagattatttcaagccagagttggaatagaagggatataatctgatataatatgaatttttgttctgttagcaaacatttttaaagtgaatgttctgaatagattccaattttcttaaaatagttattatgccttatgaagacctgcaatatccgtgtaagaagagcaatgctttttatatgttgtaataagtaatttattagaacatttattcacaatgatgaatcaccttaattaatatggtgagggcaaaataatttctgctatcaaatatcagtatgtacttgcaaaattcttataaacttcagttcatatgtctgtttttctttaaaatatccctaattactgacctaattttattcattttgccatttaatttatttataacgccattcttttcttctaatgcgttctcctgtttgaataatcatgttctctttattctctttttcgtctttctactggttggggaattatatattctatatacattttctgagcccttatccttaaatttatatcattcataattaatgacattctagtctaaacatcgcaagagcagtagaatgtttaaattctgatttccctcctaccatatttcatgttattgttgcctgatattttgctcctatacattgttacccctcccattagtcattttttatggtagtaaaatatttataatactattttcttcttatgagttctgattcttctttctggttcaaatttcctccttccccatgtacacatgttaacaagtacctttgtaaatctatatttcattcttacccttgaataacagttcagcaggggccgggcgcagtggctcttgcctgtaatcccaacactttaggaggctgaggcgggcggatcacttcacttgaggccaggagttcaagaccatactggccaacatggtaaaatcccgtctctactgaaaacacaaaaattagccgtgggtggtggcgcacacctgtaatcccagcgactcgggaggctgaggcatgagaattgcttgaacctgagagacagaggttgcagtgagctgagatttcactactgcatcccggcctgggcgacagagtgagactccgtctcgaaacaaaattaaaagttcagcaaggcattgtattctatatataatattctttgtgtaattatcttttgaggataatgcatcttttctttttgctgctcttaagattttgtctttcatgttctgtatttccataactatgtgttctgagtatttatacattggaacttggtatgcatcttcaagtgaggactcttgtgtttctatgattctggaacattgtctaccattatcatttcaaatattgtttcccagattctctctagtcactttttctctgattccactgtatgtgcattgaatattctcctttcatactaccacgtattttaatttctctttacatatcttctaattcactaattctctagttcaatctaatctatggttcatcacatattttgagagctttgctaaattccttaatttgtttttggaatttatgtttggttattttcaaatatatgtgttttatatgtcctctttttgttttctattttctatttttatttctctggccatttgaatcatatacacatcatgaataaaaagaaaaacaaattgttctattagtaatagttttattttgctgtccgtaaaatcaaaatacgatgagaagccatatgacagtaagatggaaaaaacatagggaagaatgagaaaatttaaaaaatagagtaagtggatggatttgaagtagcaccttatttctctttcttgcatttgggtttgcccatttttaaaaacaatccccatcccttttaccacagtatttccatgtgtttggaaaaaaagaggaaaggtttttgtgggtatatggtgaaggagtactcctacaatttcttaggactgtatgttcaacaaaatttgtttttaaatttgatggaacaaaccttttcacaaaataatattaatataaatataaaatgactgattcatgaattaccaacaaacaacttgaatttacaaaataaaccttcaaatgtatttttcccttgaatagtattttatttatatttttaattgacatgttataattgtacatatttatgaagtatcttttgatatttgaatacatgtatacattgtgtaatgttcaaatcaatgtacttagcatatccataacctcggggatttatcatttctttgtagcaagaacattacaaaccttcttctagctattttgtaatatacagtaccttactcttaaccatattcaccctactgtgcaatatgataccatattcctcttaccaaatagtaactttgcactcattgaccaacttctctccttcctcccctccctgctctctgttaatcactgttctatatctcaatgagatcaacttttaaaaaacccacatgaatgagatcatgcagtatttttcagtgtgcctggcatactcagcattatgtccttcaggtttgtccactttgtctcaaatgacaggatatcatcccttgttatggttaaatagtattcgattctgtagatataccacattttctttatccattcatctgttgttaggcattttggttgattcccagtcttggctgttgtggatagtgctacagtaaacaggagtgcagatatctctttgacgtactcatttcagttcctttggatgtatatacccaatagtgggatgactggatcctatggtagttttatttttaattttttcatgaaccttcatactgtttttcataatgggtgtaccaatttacagtcccactaacattttgtaaaagctcccttttctccaaatgctcaccaacacttcttttcttttgtctttttgataatagccattctaataggagtgagatggtatgtcgttgaggttgatttgcatttctctaatgattagtgatgttgagcatttttttcatacacttgttggccatttgtatgtcttcttttgaaaaatgtctattaaggtattttgcccattttaaaatcaggttatttggtttttgctgttaagttcttatatattctggatattaactccttgccagatatatagtttgcaaatatttcctcccattttgtaggttgtctcttcactcttgtttctttgggtttgcaaaatcttttttgtttgatgtaattccatttgtctatttttgcttttgctgcctatatttttaagttcttatctaaaaaaaaatttgctcagcccaatgttgtgaatcatttcccctatgttttcttctagtagtttcatggtttgggattttacatttaagtcattcatccaaaaaaaagaaagaaaaaaaaagaaaaaaaaagaaaattaatcactttctacatttttttttttttgagatggagtcttactctgttacccaggctggagtgcagtgacacgatctctgcttactgcaacctccgtctcccaggttcaagcaattctcctgcctcagcctccctagtagctgggattacaggcatgtgtcaccacccctggctaatttttgtatttttattagagagggggtttcactgtgttggccaggctggtctcaaactcaacctcaagtgatccatctgcctcagcctcccgaagtgctggaattacagatctacattgtatcttgatggcagtataactattattttttaaatttttggatttttaggcatcttatgtattatacaatgcctttacttaaaagtggaaaaataaggtgaacatattttgtgacttgtcccaggtaccattgtttataaatagcactaaaactaaaatgactgaattagtcactccttgtttttgtcattgctctaagtatgtgttttcttccatttatagtatgagataactcagccattttcattaaatgtcagaaaaaattttatatagatctttacacagcatgctaattttaatagttatatttatatcatatttggagtattagctttcatcatagtcctttgttatgttactcatatttttcttgatactgaatgatggaatgagtcatttctatacacttagtattaacctttcagtagttaaagaagtggcatttatttttaggacccacacaactgtttctgaacttgtaaggaaaagccatacattttttctttagttcaaataactttacatcctaatatgtatatttggttgataagtatattgattaggacaaatcagtttggaaatagttatatatgtaagaggatacttatcaggaagtgagccaaaaatgtttgtcagtagtactggttaaatattgaaattatatttcttaatttgtcagtctgtaagtgtgagcacaatgtcttagcacttgggataatttagaagcaactctggctctagattacctagcggatttctcaacgctggctgtagactttaattcaaccgtgattctgtattacgttatataataggacactatttccacaggcctatgaattttttataaatttggaatcttcactttttcattgtttttattttacctacttaatcttttttgtagtatgttttattctcccagagatcttttgactcttaaatatttatagagcttttgcactacctcagaatatcattagcaatatgatagctgttacttctgaatacttttctttttaactttcttttaataatcttccataaaagtcttctttgcatgtatgtttaatctattaattaacttctagagtctgctacttaaataggtgctatctttcttctgtccaaacttgtatagtaattaaaaccagcagtgtgtagtagaagacattttgcataccatcaatttccgaaaaatttccaaatattatggtttctagtcatatgtctacaagtttatgttttgtaattaaattcttcccttaaaatgtttatgtaaaaaaagttggtctttccttttttagtcataaatatttgatttccagtttttcataagtaatatatacatttatttctacttcagcagatactccattataatcaatgttgctacagcagtagataaaatacaagctccatgagagcagagatcatgtcagtcttcggtagttgctgcaaaaccagttttgagtaactatctttgacaaataaatgaaagaataagtttgatttcaatgtacatcttcaaaataatatctaaatgaaattcatctgtgcaggcctaaccctgtttgagtccagctgcaaatgtacaagtggtttttttttggtatagtagagtggaaagggtgaaagctttcaagctaggcaagtcttgtttcaaatcctagtgttgctgtgtaatcgctgtgtgaccttaggtatatcccttaacttctctaagccaaagtttcttaatagaaaacttgtgatggttttaacaattatgaaaaattgcattgctgaaagaagatgctcagtatatatcattgtattttacactgtgagataatgggatccacataaactggcatgcacatttttaaaataacttttatttttaaaaaatgggctttagaaattgttcaattacctaatgttctaatgcatttttaacattctctccattttcttttatttctgctatttttatttccatattccagtttatttgcgcaacttatgtctgaagcataagcaaagattcttccccagcttctcctcttattttacatcttcagttctacaataatactgtattagtcagggattggtcacaaaaagacgagctgctctatagatttcaagcagtgaagagatttaatacaaagaattaagtgctttactgaacccctggaaaggctgggagaataggattcaggtgacgatgccactagctctccacttagctacaatgttcagaaaatgagcaaattgtgcagaccacaggaaaccactagcagttttcactactgcttgtgttatcaaagcaggtgatgtttaggaagtacccagtggccactgtaaaattctcatgtctgcagaaatccaaacctctgcttctcacccccaggggaagccctaataaattttcagcctctccttagcttgcaaatctggtacaaggtttgggaaaaggtgattgatgcccaggcttccagcccctatgataacagaggagagcatggcaggtggaatgatactgagatgccaacagagaagctggtacagcttcacctgtatatgactgttcattttcattccaatttcaggcatactctctattttcagttctgatccctatgcctcctattattgcaataattattacttaataaataaatggctccaattgcagaaagaggtttacttatgtttagcatacatactactctctcttaggcatctttatatttcatttatctcagaaacttatcctttttacaaacaagtctgtagactataggtaggcaaactatgacgcagaaacgaagtccccgaggctgcctatttgtgcagataaagcttacctggaaagcagcaacacccatttgtttccacattgttagtggctgctttcacaccaccacagcagcatggaatatttgcaacagaggccatatggcacacaaagcctaaagtatttaccatctggccctttatagaaaaaagttgctgacccctactatggatattatgtaaagaaaggaactactacaggtagatttttctcacgtgcttgcctattgaatttctttcataattgatttaatgaatataggctttttatcttatgggaaaatatcatcatactgcacgtacttgtgtgggactctgtcagtgatcttaaaaataaaaatgtcatgcacccaagagaaaagtattcattcaaccaagccaatgaataggttccgaatcttcctcctgcactaggcattgtgatttcacctacatttccaaacatctgatttttaataatgcatcgtataatcttgattctcacatgcttcacaggacagccgaattctttttcaaaacttatagtcactgttgagtcataccaatgatctttgctttctagtagcttccatatcttaataacatttttaaaatatgatacaatagtaggtctattttactcccagtaattaggccttgaatcttattagcaacttgatcatgctggtcactattgagccatgaaggcaatttatgaaataaaaggcttttcattctttgccaaccaatgattcacccacatcttttcccctatcctcctgtatcttttgtatttttttctgctgtgaagtcatttttttaagacgggaaggctggcagggagggaaggaaggagggagggagagagagagagagagagagacagagaaagagagaacgagaacacaccctaaaaggttttcttattaactattctcaagtattatttcttatcagctatcatcagctatttcttcttcagcatcatcttcaggtatttttttttaatcttgtaaaacagaacacttttttctcacacattgtaacttctcccgaggtagtcctttattcttgtatgacctcctcctttgctcatcaccttgggtcttattctgcatacttctctcacttgctctttgatttctactcttcttgctccaattcttacaatttcttaacctctattttaaaaaatcttttctcttcatcattaaatgcttttacagatggaaacattcattttgttctttaaggcatttcaatatttttcttcccttgagtacatttcttatgccattttaacttgctcctttaccatctgaaatcttgaaaggggaatagttcattcttcctcttgaatatatattttcattgaattttcttcctgttaaacaagaatttatgcctgtcaatgcttttgataaaaataccaatttttttgagaaattaatttaactgtaaccaagatgtgggctttcagtttgtattctaccatgtctatgttcacctgcacataaatctattaattctggggaccattcccatccatctctgtttttattataattctgatagcaagcatctaaatatacaatctcaaattctatattcttaccagtgtatgtaagtgtatgtattgtgtgcatgtattgtgtaagtgtatgtattgtgaccacggataacttccagttacttccaacattttcatctttttctggaacaacgttggaaatccctttcaagacagaaaattccttcgtgaatgaagcacggatataaaatgcttcccctctttgtttctttggatgtagggtagctacatatataaatgtgataggccctaattcctaatttatttctttgattacatattttccagtgcaaagcatagattattaaatatctgcacaaataaaaattcatgttcacatttttttgttttgtttttttttgagatagagtttcactcttgtcgcccaggctggagtgcaacggcacgatcttggctcaccgcaacctctgcctcccgggttcaagcgattctcctgcctcagcctcccaagtagctgggattacaggtgcctgccaccacgcccagctaacttttttgtatttttagtagagatggggtttcaccatgttggtcaggctggtctcaaactcctgacctcaggtaatccacccgccttggcctcccaaagtgctgggattataggcatgagccaccacacttggcctcatgttcacatttttatcccatttatccatgtgaaattagctctaaatgtgataaccactagccacatgtggctgtgtaactttgaattaattaaaattaagtaaaatttaagatttagtttttcaactgcactagttacattccaagtgttcaatggtagcatgaggctaggagcttccaccttggatagtgcagatagagatcattttcattattgcagaactctctactggacactaaatattagaaaacatacatagttccttcatttgtaacacatctctccctatcacattaagctctcttctttgtatgaagagtgtgtaaatttgattcatttcatgtcggaatccatgggttgtacttctaaactttagtggtaatttacactttgtattatgtactcctatttctgatttcattttttcccattgtttgtcatttaattcagccaaattttcttttcttgcattctcctattctatgtattccttagatcagtggttctcaaattttaatgagcatcaaaattacttggagggtttgctgaacacatattgaagggcttaccctgagaatttctgattcagagagtctaggatttggccgagtaatttgcacttctgttattgctactcgttctgggggctcctaccctaagaaccactgcctagggaaggcttctacctctctttgcccacttttctatgcacagagctattttttatacaccctgcttcagtattttctatacagcttatttatttcttcctctatttatttaatcattatgtatttcccccataacttgaaatccatctctcttaactctacctgtctccccataccctttctgtctgtgttctctcttttcccttgcttctccaggagactttcaagatttcatttttacagacgtttcttgttctgtttccttttgctcttgcatgctggctcttgaagatggcccaactatgccttccttcctttcactataatgtgtccttggcatttaatttttattttactagtggctctcttctcagtaggcactgtggtatcactgcactccagactgaaaccacatttcctaactgtgtcctatacttaagtgacctgggaagtgacagttatatcatgtctttagctgtcttctgtgtagaagcaataatatttctctgtaacttactgagaatctctcagcaggtggtcagcacgctcaccattttgtcacctctcttgttaaaaattgctttttgcagctcaattctccaaatgtcccaacctctactggactggctcatacttaatcactttttcaaaacggtgtcacagtatgtttattttgtttctaaagctttgactcttttccttcttgtacagtctcaaaataagtttccatttttctgtttaattggaacttacatcaaacttcttacttcccagcatttgaactgctgcatgatgtgtaccctggatccattccaaattgaattaataagcagacctcaattttatctcttgctagactgtaactctcatcccctgttaagcaactcttcagtaacagcctagtattgttaaagggggggcctcttgagttagaacaacccttttcacattccacctctgcttctcatttttctcacctacacaatgggctaatattagcatctatcttatagaatcattgagaagaacaaatgaaagaaggtactttgcacaatgcctggattatggtaaatcttaaatcttggcctttactaatgttgctatattaatcacagtttcccatgaaggaagttatttctttctttatccttcaatttctttaccttgcagtagatgcaaaaaatttgcaataaatattttccagatctttattctacttctctactagcttttgccttttcctctaagttgcctatcccaactttgaaagtctttacctctgtttctcatttgcagttgaacactgacacaaaacaagagaaaacaacaagcgaataagaacacaaacacaacatcatctcagcactttctctcactgtgccaaatgttcttaaaggtttgttagttttttatcaaatcacagcttgatttatttccagcctgtgctccacaccagttgactactgttatctttgtagtaaccaagcaaaacaagtagggcaggaactactgtgcctcttgtgcagacttggaaagtgaggccacaatgacagatgtgacttagcaaggatggtgcagccatgtagtgtaaacagggctgctgttctaggctgtgaaggtggtgcaccgcagcaggacaccacagttaaagggatacctccaccttgaagacatcactgatttgttttttatagtaaggcagtttccagcactgtcatggagagaggctcctatttccaatttgcccaaaggtgctatgtgggctctcattagccaagaaaactcaactcaacacatgtgctctgctttatagcttatttactctttagtcgacgttccatacaacatagattactatgtttccttttctaattcattttatcctgttattttctttatcactctccccctctaccctgcaacaacccatttacttttcactttactatataggaaaagtaagcattaaaattcagttggacgataaggtgaaagcatgtaaagctgttgaaaagccaggtgaccattattacatgtgactacattctagactaagtgggatgactaatatattttaaatgggaagaaataatttagatagctttatttgctaatgtgagataaatagattaaagttgaaagccactcaggctattgcaaatattatagcaggagaccataagaccctgagtaggcataccacaaagtaataatgtagatgattggctttggataagaggcccagtgaggaagctaattgcagaagcttgtagttgattagttataagatgacaaggggaataaaagcaagagtttctgagtctagataaccaggatgatgatggtgccatagagagaaatggaaaaatacagagaaagaacagatttcagaggaagaaaatattttatttgaagagaggagtggtgttctggtaaaaatgtcctctaggtgatagaaaaatgtgacaggaaattagaggtaaattagaggtggagaaaaacattacatgtagttgaatagagctacttttgaaagatatcaaaggtattcagttctcaatggccaaaagagggaagctgccattgttaaggttccacagcgtaggggatctcctgcaggtaagaaatagaagaaggatgaagagcaagcacatgatttagagacagaggttctcaagaaaaaaagggatgctcagcattgtagaatgcttcttataaattaaaatgaagactggtaaaacctattctttttttctggtgatttgttacaatttaaaaaaattgtatcttccttttactatcagtgaaaattcccatgatagcttcccattttggaggcacccaccaaaaatgtccttttatatatctccttcagtcttagatttccaaattccctttttctgtaacctgacctctttctatgaaatacaaaagtttgatttaaaagatgcctttcacactccataaaatagtatacattgtcctggctgggtgcagcggctcacgcctgtaatcccagcactttgggaggccgaggagggcagatcacctaaggtcaggcgttcaagaccagcctggccaatatggcaaaaccctatttctactaaaaataccaaaaattagctgggtgtggtggtgggcacctgtaatcccagctactcaggaagctgaggcaggagaatcgcttgatcccgggaggcggaagttgcagtgaggtgagatcacgccattgcactccagcctgggcagcaagagtgaaactccatctcaaaaaaaaaaaataataataatatacgttgtccttatccaataacgtggagttttttggtttttaaagcaacacagagattcattagcacctcattagttcttgaagggaaggagctctgaatgcaatactatctgtcttccattaaaaatggaagacatcattcccataagttgggaaaatttgagatttaataagaataacaactacagtgaattgagacacatcaaatatttaaaaactgatgattttataaacatactaatcaaggaaacattgttagtttacagcattgcagcatactaggatcccgactcattattctgcaaagagacaaataaagggaaggaagcatacatttggcctgccttttttcgtaccaactgtacgtattttaggataatcacattggaaatacataaatattatttttgaagtatagtttcagctaataaatgcaggaaagaatatcacccttttgcagcccataataaaatggtacgaaatgatcaccaagcctttggctcaaaggttggtggagatgcttgagtatggaaggattagggtgaaacctcctgaaccactgctaaatcttggtgtcactaaagtgtaacaaccagaaatcaggaattacgtgagttcttgtacctaggaagtatttttgcctaattttaaaaaaagacaaatatcctctaaatcatgcatgcctgttttcattagctactttacctgactttttcatgaggaattaaaaaagttattcttctgtacttttaggactcaaattgataaaagaaaaaagtttttaattttttaaatacttcgttccctttgtcgacatgtagaatgtgagatatgagatcacactgaggaaaagagaagccagcttcatgtggctttctgaaaatatgatattattatgtgaataataattattatttagtgaaaaggtaaacaaaaatgctttgtttatatgctattagtgcaaccaaatatttgtgtcagaaatgattaataattggaaactgacagaataactggcatatgaactcttaggtctattatctagccctaactctccttgatttttattgaataatacaacaatgcttaaataatcacaaaaatgaataggaaacaggggtcattgacaatttgtaggtcaaccaaacaaatgtcttagctgtagaacattttacaatccaatagagaacaaactttatcttagattagtgaatgccaaagtgactattctttcatcagggccaaggtggcactaacactttattagcccatatggatgggtctcaaaagcagtaatatagaaactttgcagcttagctgtataagaataatgcttataaataaaataccataacgtgtaaaagtaaaaatgtctctcttctttttaaatatacttcagtctattcaagacaaagaagtagccaagaaacataagaaaaaaatgctcaacatcactgatcatcagagaaatgtaaatcaaaaccaccataagacaccacctcacattatccagaatagctattattaaaaagtcaaaaaagattggctgggcgcggtggctcatgcctgtaatcccagcactttgggaggccgaggtgggtggatcatgaggtcaggagttcaagaccagcctgaccaatatggtgaaaccccatctctactaaaaatacaaacattagccgggcatggtggcgtgcggttatagtcccagctacttaggaggctgaggtgggagaattgcttgaacctgggggggcagaggttgtagtgagctgagatcccaccactgcactccagcctgggcaacagagcgagactccttctcaaaaaaaaaaaaaagtcaaaaaagaacagatgctggtgaggctgtggggaaaagagaacacttacacactgttggtgggagtgtaaattatttcaggcattgtgggagcagcttggagatttctccaagaatttaaaacagaactatcattcaacccagaaatcccactactgggtatataccgagaggaaaataaatcattctaccaaaaatacacatgctctcatatgttcatcacagcactgttcactgttgatatgcccattaatggtggatttgacaaagaaattgtggtacatatacactgtggaatactatggagccataaaaaagaatgaaatcatttctttacagcagcttgggtgcagctagaggccatcatcctaagtgaattcacacaggaacagaaaaccaaatgccacatatactaacttataaggggaagcaaaacgttgtgtatttataaacataaagatgggaacagtaggcactggggattactagaggaataagggaaagagcggggcaagagctggaaaactacctgttgggtaccatccccactacctgggagatgagatcatttgtactagaaaccccagagtcatgcaatgtgctcatgtaacaaacttgcacatgtacccccgaatctaaaattcatacaaataaataagtaaacttcgatatattcagaagaaacacagatacctgcttataatttaaaatagaaattttgagaaaagaaaaaacggagatagttttatcagttcttaacagtgtagtcataagagtcagtcatacctgggtttgaatcctggctctccggcttactaacaagttaccttacatctctaaacctgtttcgctatctataatatgagtctaataatagcaccaacccttagacaggtgtcagaatagatgagaaaatttatgtaaacagcttagcatagcgcctaacagattgtgatacttaataaatagtaactatcatgattagtatctgtcatcataatgaattccagatgaattaaaaatttagatctgaaatgttaaaatataccaaaatccagaaggaaatatatgattttcaattgctgatctataaatagaagagaacattataaatgatgaaagacattataaaaaaagaacataaaacaatgactaactggaaatataattgccatgaaaagtaacacatttaatatccttagtgtataataaaattttacaattaagtaggaaaatgtaaatcaaaataggaataaaagggcatgaatttaaaaattttatgacacgcatacatccacaaaggaaaagacaaaagaaatgcaaaaggctgcatggcgttcagaaaaggattagtataaagaagaaaaaagaagtaacgttatctgcaatcttacctcttattaataatcactgtttaaacttggtagagtctctttcagacatatccacatgcatgtgtaaatacatacatacacgggcacacacacactttgcatcctatctgcattttgcttcatgtttttccattattccatggtaattttttcatgcctaagaacagtctttaaagtgttttatttggctctgtagagtattagtatgtcaatcaggtctctagttgaaggttcctgaaactcaacttgaactagattgtatatatataaaatctaatacgcacgcgcgcgcacacacacacacacacacacacacacacacacacacagagagagagagagagagagagagagagaagcttgtttcacgtaaccaaagcagaggaaagacttgatggaattacagaaatgaggtatttttacaccattaataatcactttgatttggcttagctttttatgccagctttacatttttaggcaagttttctctggtatgtcagggaacattgacacaaataactccaagctagtatctccatgtctccaaattcagagaaaagatgaacaggtctgcccttctaactctaattaggggaactccagggaagacctctgttggatatttgggtcatctgcttattcctggagcagttatgtggccaggggcataggataagtagcctagactcttatcaatccagagatgagttaggagaggctgttatgagaagaggatggacaggtgctgagcagccgaaaacaatgattgccacgatatgaatgtcccacaatttattcagtgttttgtacgttaatggatacttaagtttctctaccatttgatcttataattaatgttatgataattgtcgtcatgcatgcggctttgttgaaatttttattggttttctcttgtaggataatttactagaattgaaattattttatgcaatcccatgtagctatgaatacatagagtcacatctttcatgtacttaacctgtataaattcaattatgttgaatcagaaatacagggtagagaaattaagaaaacagtagtggagatagagtgagtgagaggaccagtgagaagaataaaaactagttgaatagctcagccgtacttacctcagaatcaatgaccttatgcttagagggagcagcatgaactaggagtctctagtcctatgttatgtcagtttttctcaatgttggcctgcttcttgtagagtgagattgtgcctagctgagtttcattctagtggtaagagttagattttctttttttgtatgccatggactccaaacacatggcaacccttaatctagtattcctccaaagaaaacagcaatctgttcaacaccagaggaaaatctgacgggcttgtacttaccaagtcattatattatattttgtgtgtatgtgtgtgtgtatgatttagtgatatctcaaggataattttgagtatgccctattttcatatttcataccaattctaaagcctaccccacaggaacttgaaactctgctcaattgctaaattaccattaccaaataatttatgtcaatttaaactcctaccataggatatgtacaggcacatttcacctcatccttgcctgttctgggttaaagcactttagagttaatgggaagaaagaaaaataattatttaatataaataacaaatacagaggtggtcagccacatttcattttaatgaaatggggccacgagaattccagtaaatcacaattctacttctataaataaatggaaaagaaaatagctaatcttgtcgcacctggaagcctcaaacctaagataacaacaaagctgattatttttatagtgatcagatcttaagaaatacaccagcatcttatgatgctatgctagaattattttaaaaaacatacagccggatgcagtggctcacgcctgtaatcctggcactttgggaggctgaggtgggcagatcacctgaggtcaggagtttgagaccagcctggccaatatggtgaaacacgtaaaaatacagcaagggatttattctacaacattaagattttcaatttaacagacatattctatgtgtacatatttgcatgatactagcactgagcaatactcttctgttaattcaagttactctgaatttaaatccccagacttccagaatattaagtctgcttatgatcagtgatcatttattaacttttttgcattgtattttagataatttcacagttgtaaagaatttcataggttattgcataaaattcatgcttttgaatataaacacacatgcacgcaaacacacacacacacacacatatcccccatgctcacgtatgtttattgagacacttttcacaatagcaaagactcggaaccaacccaaatgtccatcaatgatagactggattaagaaaatgtggcacatatacagcatggaatactatgcagccataaaaaaggatgagttcatgtcctttgtagggacatggatgaagttggaaaccatcattctcagcaaactatcacaaggacaaaaaaccgaacaccacatgttctcactcataggtgggaattgaacaatgacaacacttggacacaggaaggggaacatcacacactggggcctgttgtggggtgggggtggggggtagggaaagcattaggagatatacctaatgtaaatgatgagttaatgggtgcagcacaccaacatggcacatgtatacatatgtaagaaacctgcacgttgtgcacatgtaccttggaacttaaagtataaaaaaaaaattcttaggttgtgtgccttgcaaaaaagtcagtgggctagatttggctcatgggctattgtttgcttacccctgccctaagtcatagtttccaatgattttaaaattataaaaattataatcatataaattatgttggattgatcatatactgataatttaatgatctttatgaaaaaatttaaggtaatttgatacaattctttaagttacagaagaaaatgatatcatgagcgaaatgaaaaaaatgggataaaatagctaatggtgacaatacttttttggtatactatctggtatttatctttatttaatctttggataatatgtacattcctaagatgaaaatgagaatgtaatttgaccatttgaaaatatatattcttacactgacttaaaaagataaagtattgataatttcacatcatctctgtctttgcattaaaaagtatcatggaacaatagccacactttttggaaattcaagattccataaaatatagtttgaaaaacacatggacgtgtttattaatttctcctttcaatattctttctgggcatactggaggaaaattgacatgaagaatctttaaatttgttatgaaaagtagaaggtggcatgtaggcaaaactttcccctctgagagtgtttctgcattatttctttgcatgggaagatctcaccaccaaagtgtagcatgtctgtacccaataggaaaatgcataccctgatattcattttaatgaaaaatttcaatgacgtataatcctttgtcattctttcccaaattgaccctctgatggggtaagaaaaaaatgaattctacctttttcatagatagtaaccatagaaagctctggtttctagagagattcaatcctttaaaaaggaacataaagagaaaagggatttggagagaaattaattctaagactctagacctgcatgtctgtgtaacccaaattctagcaatatctagaaaatagaaatcaaatcaactaggaactggtaatacaattgctaagacttcctttatcttaggtccagcagattcaaatgacacactctttaaaaaaaaaaattattatttttagtttttgtgggtacctggcaggtgtatatattttggggatatatgagatgttctgatacagacatgcaatgtgaaataatcaaatcatggagaatagggtatccgtcccctcaagcatttattttttgtgttaaaaataatccaattacactcttttagttgttttaaaatgtacaattaagttattattgagtatagccaccctgttgtgctatcacatagtggtcttattcattctttctatttttttgtacccattaaccatcctcctctcctcccgcatcccccattacccttcccagcctctggtaaccatccttctactctccatgtccatgagttcaattgttttgatttctagatcccacaaataagtgagaacattcaatgtttgtctttctgtgcctggcttatttcactcaacataatgaccttcagttccatccatgttgttgcaaatgacaagatctctttttttttatggctgaatagtagttcattgtgtatatataccacattttctttatccattcatctgttgatggacgcttcagttgctttcaaatcttagctattgtgaccagtactgcaacaaacataggaatgtagatatccctttgatatactgatttcctttcttttgggtatatacccagcagtgggattgctggatcatatggtatctctatttttagtttttttaggaacctccaaactattctccttagtggttgtactaatttacatttccaacagtgtataaagggtccccttttctccacatccttgccagcatttgttattacctatcttttggatataagccattttaactgaggttagatgatacctcattgtagttttgatttcaggtgacacatgcttgactttagtatgaaagtgtcattgacattggctgtctagtcagtgtctaatagccttttctctatctttgtcataaaatctatcatcatctgtggtctactttgactcttttttttaatgacccctgagatagttgatatggaaaatacataaatagttgaataattgtatgaacttttcagtgtcttctcaggtgacctaccagaggagaagtagggtatagaatgacaactttttaattagggattttttttcccttaagaaacagctatggaataatggaaggaacctaggttttagattttacatatacacacacaaacatacacacatgtgtgtgtatgtgcatgtgcgtgtgtgtctgtgtatttatatatatatttgaaatccatttattccacctctcaatcttatctgagcctgggggatgtgtgtgtgtgtgtgtgtgtgtgtgtgtgcatgcacatgtgtgttcatattcaaaagctaagcatgaattttatgcaataacctgtgaaattctttacaactctgaaattatctaaaatacaatgcaaaaaagttaagtgatcactgatcataagcagactgttgctattctggaagtctggggatttaaattcagagtaaccttgaattaacagaagagtattactcagtgctagtatcatgcaaatatgtacacatagaatatgtctgttaaattgaaaatcttaatgttgtggaataaatcccttgctgtatttttacgtgttgtatttataaagatataatgggctctaatttttagagagtcctgagaagtccatgaatattaaacacatcgtgtggatttttatttatcatcatctctgattttatgttcgtgaaattataactcagtttcgttggagttctaactacaggcctagttcaacaaaattctgatttccatcatcttgactacattgattttgtgcactttgatctttactttgtattatataaaagtcaatatgttgatctataaacacatctgctgcttggatagtagttattttagaattggctctctttccaagcacagttatgacactgagaattggtactgtatgctccagtcagcacttcccagtcacaaaccttatgaagaatttaaagaactatgtggaggaaatactctttgttctaattcaacattagtgtatagattgtgtttgtgaaaaactgtatgagaaactggtctttttaaaaatgtttttccttcagttctggagtgtcaatatcaattttattctgtgattagaaatcgcatgactacagcctgtgtgtcaaatcattaattcattgaaattcctaatcaatgtaatattgcttttaggataaagttttagtaacttactgagtgggctctctctgtctctctctctctctgtttctctctctctctctctctctctctgtctctctctctctctctctctctctctatatatatatatatatatatatacacacactatatatatacagacattatatatataatgtgtgtgtgtatatatatatatatatatatatatatggcagtctaactataagagctatactttttagtgtaaaaaggttgtatattcgtgcattggatggatacctaaagctgagaggttagccctacaaagtattaaaaaacaactcaagaagtaagaaatcaagaaatgatcaagagttccatagctagttaaaacaaatcagcagtctcaaatgagttcgagtgtgaagtgaaataccacaaagatgaattattttagacctgatgtgaaaagaaatgatggtgtaagaatatgagttacagcttacacctatatgtgtgtgtgtttgtgtgtatgtgtgtgtgtgtgtatgagtatatatatatgagattatatgggaaaaagctaaagagtatatatggaaaaagtactttccagctatacatgggaaaaacaatacatgggaaaaagttataaggagttttagtttagcataagtgttctagttatctattgatatataacatagaacataaaatgtcacttttgttacattttactgaaaaggtaagacaaaagggcagccagtgttcaagaggaagggaggaatagaccccaactctcaatgaaggaatgacatgcacatatggaagggattgaattgttgaaccatattggagacagctatctaagaagtaaatattatttaatgatacttttgtatattggatatcactatcatgacaaggacatattgaaaatagtttacctgggtaattttactctcatctacttaattaaagtaatacatatagattttgtccattcatttgatgacagagagtatgacacagtgagtatgtccttttgggtttcaaattgatgaagcaggcagacctgttatcattctggggacgcttcccagtttggaggttctgagtgcaagagggcattaggaagacagagttccctactgctgctgcatctgctcattgcagtatgggattgggtctaaaattctatgactttgaggaatattaccagattatataattttaaacattccaagaaggaattgtagtgatcttcttgtccaattgttttatcaaaaagatacgaatactaaagcccagagaagttgacctcacaaagatcttaatgtatgagctatatagactctgaatctaagtcttttaactgctgagttactactcttattattccatatattgacactgctttccaaaagtctgtggtgtaattatcaatctggcaatccatgtaggaggactgttttcaccaaacggtgaataaaactttgttatttcattatattttcatgttttgggatctctaacagagtgaaaatgtttagtcaacttgaaagaagtatggtagtgagtaatttaagtgcatatggtgagctggggaggatctagttttgatgggccctgaagcttttacaagtttggctctactctgtaagaagaaaggatgtaaaattacaactgcaaaataagtacatggctttaaaagaggcctgtgtagtttaagaaccctcaagctcaagcttcatcagtctctgtggttgagttgattagtttaattgaaatactagagtttgggaaggacttaagaacaaggtgttatttcttcaaatcgttgtcgcctttgaaaagggtaaccttttttctggacttaaagtgctatccttccaacgtgtataatagtttttaaatgcaatcttgctgacatgtgtcaacatatgcaaagaaattgagaatactttctagctcttagtggtatgatactgccttgcataatgatttagacatgcagctctgccttttgtatatctccagccaccaacatttaggtaggaagcaagtactattgatctttgaaaactaaagaattgtgaatgatgcatttgattggtatgttaaagctatcctttgtatgcatatttttgtaagtcgttgaaatacagattatttgacctcaatttctccatctacaatatgaggatcaatgaggatattatatcatgtctgttgaaaatggttggatataagtggaggccagtggaagtattcagtgaaatgatgcatttccaaaatattgttttccagccaatgtccagtgttagtattccacacatggaatgcatgataggtatagagaaaataagggtagtattttacatcacagagtattttgagataggcaagaccattattatgtttgccattcttgtgaagaaaatcagttgcaggatattaacttatttaccttaagtaacatagctgggagtcaagcccaagacttaggacacaaagggcagcaggctttttaatcatcccactctgtctctttgagaggccaatagaagtttctaccatctccactgtcataccccacctggaaacgattgcattctcaaagtcttgtaatttagcttttcattatgactgcttttctctgtgttacttaattagaatctgcagcttttggcaggaaaatagtcaaccaagcagatttctaataagcaatgtctttaggggagaaagtcgaagtgagcaaagagaagagaatgaatgcgtgatagtagctgctagaatatattagttgcagacaaatttcagtgagagtgtcagtcaccgtgaattaaatttttaagtgaagtggccggaaaaacaagaatggaatggagcaaagcacatatatcatagttcagaagatttggaattctcccaaacttgtcatcctttaatggagaacctgttaggaacaaaggcagagcctgcattaatagaatgatcttgggaaatgccttccaaggacatctttttaacattcttactcagacttgatattttgaaaggtttttctgttagataaataaacttttaaaaacagtaattaatatgtatcttatttaaaaatagtcacatataatgtaggccaatggataataccattatgcattctgaagggttgaaaattgctagagacccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaaaaagaaaattgctagagacaatctagtctagcttttggaaacaacttttacagaaaataaatgttaaatactgggtgaaaaaacagtggtttcactgttactgacaactatggattaagagcgctttctacccctttctctcgaaacatttcattgttggtagatgaaaaagagagggatggtagagtctgttgagaaatgctctcaacagagaaagtgagttcttcctactgggatgataacattaatatggttctttatcatgttgcaccttagaacatttcagattcctattttgtctagtaaatagttgatcacatggttctctgcatgatgttgatgagaaactttaaaaaaaatctattctccttaaagcccatagttttctcaaaattagcttttctgctggggtgattgcaataaactactactggagtttaaaattgtgcctatttttccaggaacaagcttaaatcctgttaaactagtgtcaagcccatagtttgcattgaagttaacatggagggagtggcagactagctttccgccaggaaatgtgagggtatttagaccccatcatgctgtaaaacatttttcttaaggtgtaaacattggatatattacccaggaagttaaaacatatgcagctaaagggaactggattttctcagtctgtcaaattatgtgtgtctgcttcttaatcattatcatgaaactgttctatgggactacttgaaccaagttagctttcaattagcatgacgttatattggcaggtctaaactgttagacaaaatatgattctggcatggacagtacatacatgaacaatttattggtacatttccatggtccagcactatgacaacttattaaacccttaaaactctaaaacttgcccttctattttgtgttatactcacttgtggaaaagaactccaacctgaattaaattcaactatctacctgctcctcaccttcacccaagttgttcagcattaattaaataaatcatattacctttctgacttagtctttgtgatcacatatctccaatgaacctgaaatggtgtcaaataatccttttttcttataatatctctctctctctctctctctcactttgaagaaacaaggtttcattctgtcgctcaggctggagtgcagtggtgtgatcatagcacactgcagcctcgaactcctgggctcaagatatccacccacttcaaccttcctagtagttgggactacagatgtgcaccagcatgcccagctaatttcttgtttgttttttgaagaggcagggtctcactttcttgccgaggctcgtcttgaaatcctggccttaagtgattctcccactttggcctaccaaaacacttggattacaagagtcagccaccatgccttgaatcacacaatccttttacttctctttgacattcactttaccactctttgagatattattttgttaattctcctctatctttaaacttcttactctttgcacaccctgcacactcagctgtgaaacagtcaacttacctttcctcccatttattattttacaaatgatgcattgaaatagaacaagctcatatttctatcactaaatttaccactctacctttacctttacctctatttagagtagatgaactctgctactatctgaagccaactctgaaggttatgttttccaatgatctctcgaagactgctccttcaactgtctcctcccctatatcaccaatttatctctcaatataaagtcatccccatgagtatacaaatatagcttttttcacatgttaagtaaaatgtcccctcatgctatggccctattgacttcacagaaatatctgtctaaaagttatctgtatttgatatctttgctctctcacattccattatctccttagtcaaaacaatgaggtttctgttcctcgcaaaatgtccacgttaaagttactaatgaacgttgtttaccaaatccagtggtcaattctcagttctcaccttagctgatcctttatataatttgacccagttgaccacaactttcatttcaaaactttttctggttttacgcctacctcattactttctgatttactttactgattctttttttcgatttgttctcattatgttgtagttcaagacctcaatcctgagccctcccttatatttttccctctttagatgactgcattgagttttttggctttaaataaaatctgcctgttgatgactcctaaatatgtacctgcagattatatttatcttatattgtttccatctgtattagttatctattgctgcataaaaagttatccaaaccttagtgtcttaataacatctattatatcatactttctgtgggtcaggaatctgggcatggattatccgggtcctctggctcaggatctctaacaaggctgcagtcaatgtattggatggggcagcagtcatctcagggtctgattggggcaggacccactttcaggttcactcaataatggtttacaaaattcagttccttgaaagttgagccacctgcattttcttaccacatggtcttttccatagggcagctctcaaaatggcagctggcttcatcaaagtgagtaaacgagaaaatgtcagcaaaaggtgggccagtgttttataacttaatctcagaaatgacataccatcactctggccttattaccaagtcactaggtccatttctcactcaaaggtgggggattacacaaggtaatgaataacaagaggcaagggtcatatatggtatgataaaagcatctcaaactttatccaaaacaaaacgacttcctgacttcccaaactttctatgcccctagccttcctcatctcagtaaatggtagcacaatacccctttactctctgaccaaacctggaagtgatctttgatttctcttttactcactaaccatacccgatgtattagtaactcatattattgttatctacaaattattcaccaagtctgatgaccttccatcattacctttgttaaaattgtagtctaagatgatataaattcttgtctgaactactgcattagccttctaccttattaatatcttttcttcctttcttttgttccattatagtacaagtgaacttgttaaaaatgtatattatcttattagtacttgtatttgtctcctagggctgccataacaaattaccacaaacagggtagcttgaaaaagcagaaatttattctttcacagttttagaggctagaagtcaaatatcaaggtattagcaaggccatgctctcgcagaagtctctagaggttgattctttcttgcctcttcctggtttctagtggttaccagcaatctttggctttccttgacttgtagctacatcacttcaatctctgcctccattgtcatttggccttcctcctgatgagtgttagtttgtgtctcttcttctaaggatacagtaattggatttagggtacaccctaatctgttatgaccccatcttaacttgattttatctgcagagccactctttccaagatcacatatataggtactcagagttagaatttcaacatatctttttagaggacaattcaacctgcaacagtcccctaccttaaactacaaatggctttttactacaaatacaataaaatacaaaatacttactctgttaataagcctttacatgaattggcctcagcctattctttgtgtctcacttagttccactctcacccttattcaatctactccaaccacattggccttatttatgttgtacaactatgccaagcttgtcctgttcttatggcctttccatatgttttatatctttctggaatttttctcctgtatccacctgtgactgccttctcctcatgatttaagtcctaagttacagacaacttcttggagaaattaaaatagtaacttctgtactccatcactctctaccctcataatgtgtattaactgacatatattttttatttgttcactcatgttttccctggcaagaatgtaagcttgatgaagataggatatgggtctgtcctgtttcttcttatgtctctaataccctaatatctaggacagtgcatggaatatattggtcaatgagtttatgtccccattataacctaaaagagcaagatgatatgcataatagctaagtagattctggaaagtagaatgctaatttacctctgatcttctgaacttgtggaggtggtaagaactaatgtgtagtatttctagatgtggtgggaagaacagtcaatcttagaagtcaattcttagaactccaagcagggaaaaccatatgctaagtactgggaagttaagaagcaacaagatcaaacagacataaagcaatttatattctctttgaggagacagtgcagctcctgcaataaagcaggaacctcagatagtgaaaatctttgagctgagtgactatagccaatacctagttgaaagtcacataaatatcacttagaatttcagtccatgcagagactttgcaagcccacagtttccagagaaatagtagcatagtctgcaggttgaacattggatatagatcatttatgtcctttgtgtatatatttgcatcagaggtttcagaactgttttatttattattgactatttaaattattgtcagtagaaaacatagaacctaattttctagctgcatgaccttgggaaagatactctaaatagacaacaatagcatctacctgattaataatttctaaggattaataagatagtacatataaagtgctcagatacatgcctggcacatagaaagtgctcaacaaatgttggcagttattattaataatgcttattacttacaggcattgaaaactgaatgtgaaaaattagatatgaacttgtagataatatcacaattatctgtaaatgctaatgataaacaaaaatattcctgttagctttctggcttttcaaatattttactagcttcctattgctgctgtaacaaagtatcacaaacttcgtggctcaaaacaacatagatttattcttttacaattctgtaggtcgaaagtataaaatgaaatttatggagctaaaatcaaggcattggcagggctaggtcttctagggcttcaggggagaatctgttgcttgcatcttctagttcctagtctttgatggaattccttggctcatggctgcatcactctaatatccacttccatcatcatatggccttctctctaactttgacactcctgctactctcttataaggacccttgtgattacaatgagcccaccttgtaatctggaataatctccttatctcaaaattcttcactgaatcacatctacagagttccttttgacatgtaaggtaacatgttcataagttctggagattagggtgtggatatctttgcaagccattattctgtctagcacaaatgcagtcactatcttttaattttaacagttattttgaaacaaatacattctattattgctttttcctctataagaggattctattgacacattggcacataggacaaatacttatatttcttttccttgaagcttcagtggtcatgttctcgctgagtaacgctggggtgactatggagctcttttataaaaggtaactagtttttctgtgctccatggcctcagaatggaatttttattgtttgataaagctaattattgtgaatagtgattaaacttgtgatctgagggtaccagccatgccccagattatttggaacattaggagatatttttgcttgtgacaactaggtgaaggtgctactggtatctagtgaatacaggccatggatgctgctaaacatcctacaatgtacaggacagcccacctccccaacaatgaataatctatctcaccagattaatagtaccatgtttgagaaaccctgccataggcaattttaagaaacagtattattgcttgggcctttgcttttcaaaagtgtggtgcatggaccagcagttttggcatcacgtgggtcatcagtctctttgaaatctccccaagtgatcccaaaattcagccaaggctgaaaatcactgccttagcttttctcccattatcttaccctactcataagttgttatggttatggatatatagagtttaactggaaaaataaaactaaaaaatttgccacgtgtaacaaacatcatatattagagctctaattggcataaagccacctttttcttgagaattgcaataaataataaattcctcagtgtactgaattgtaaacacacagatatgtggtaagagtcaggtttatccaactattcgttaaatatattggcagggagaactcacaaaggagggcaaattcactcagctaggatcatgtttgcagcctgcaagagcgatgatggaatatatttgcttttcctccctggctctgtcacttgcctcatccaatctgctgactttagaacccaaaaagtttctttggtatgggcttttggagctgaattacagtggagggcatgatgaatacgaaaggcgtaagaaaggtgaattagaaaagtggcagatagaaactgtgtagtgtttttatttatgctctctattcttcagcacagtgcactttccattttagctagtcaggttcatccatttacagtattttttcttgtcaccaaataagtgtgagctctattgaatttcacagaattttctggcagtgtatgaaacatatcaatttccccagtaattcccagtaatttaagtttggaattattatacaaattaattcaattaagactacagttatcagcatagccctgttaatattctgtggcttataaaaataaaaggtaacatggatctaactagacaccaatgtttaagggtaatcatacattattgtattcaatgtttgcagtaatcctttgagatacagactattcatctggccattttacagatgaagaaaatgagatattagatattggaatgtcaagtattagtaatttttccaagtttgcatagctagtaagaagtcgagctgggtttcatatacaaggacttttactcctgagtgtgtgcacttaaccactttcattgtatatttcttcaggtctgtcttcacaggcaagcatcggctagtgccagggattttctaaactatattggttacattaggcaactctagattttgcaagggatgattccattgtttttaatgaccttgattgaagccttttcctagccactattcccctaagatgggtagtttctctgctttgccaaatctgagagaaagacctagtgtctcaaaatacatttagttgctcctgttgatgataatgttatggaaatggactttttctatgcacctttgcagttccactgatctcttgtttagcagccttgacagtgtctttatattgttgttcacatggtttctgattaaaaccccatgatactaagctctgactagaatacgaaatctaacccgaattagtttatcatgatttcttttgtttaatttcctttttaacattttattgaacattgacaattatacttgtatatatttatcaggtacagagtgatactattatgtgtgtgtgtgtgtgtatatatatatatatatatatatatatatatatatatatatatagaatgtggaaagattgaatcaagctaattagcgtattgctcatcttaaatacttaccttgcttaaactgtaaaaaatactttatcttaaagcatttattgactaacttgattttaataaatgaatgtagtattaagtaaattaaaaaagaaattaaaacttgactttcataaagatataaaatgaacttttgtcaaagttttatttacatcactaattaatgagggaactagacaagatgttacacctgacttgatggagttgtcaaagaaccacaaatttatatgcaataaaggaatattgaactcaattgaacacagcatgtctatccatagaacaataatcaattgcattctaccagacacaattaataagcatttccatggataagaattgtttgcattgctattagctttctagatgttcactgtatctttacagagatataaaatagcttattcaaaagcaaagttacacatataagatcagataattcccagaggctccacctttccatggaaaggatagctaataatctctcttgcttgtttcagattctcaaatgtttccttaaagtagtattaggtggatacatttacaggcatatctcttccacagtatacatttcattctttcaatcacagtgtgtgtgtgtatgtgtgtgtgtgtgtgtgtgtgtgtgtgtgtgtctgtctgtctgtccagaatctattttaattagattcagattgctaacctggtgttttttattagtgatccattaaagtggatcatatggttgaaaacagtggaagttgttgcattgagaaaatattttgcacaatgtgatttatcaggatgactcttggatttagaaacgtatggcttttacttgtagaattagaattataataaatcattcagattctggaaaaaaagtaatataatttgatcctttaaaaccttttctaatgaaattttaaagaggcataaatacatacatatttttgtaaaaaatagtgcatgttcttttttttcaaattagggaaacatagcaatgtggaggagagccaaaatcagtataattacttatgatagccagctcatgtgatctgctgtgctgtagtttttaagtcatttttctattattaatagtaataatattattcatactatggataattttctctatacagcattatattatgctttcatctcctttccatgttattttgactatttttgcaaattattaatttcagaagtatttgtgaaagctaaataatattccatcttacagatattctctacaattgttactagtcctctatattagtcaatagaaaatataataattatctctttacataaatctgtctggattaatgaatatttaaggtggtatattatttacctatttttacataacaaattaccaaaaacttagcagcttgaaactatacaaatatattatcatgtagtttctgtgggtcaggaatctgggcacaggttagctgactcagttcagggtctcacaagtgtgaaatcaagatgtcatctgggtcttaggtcttatctgagacttgaagtcctcttccaagctcttatggttttttgcaaacttgagggttttttttttatttatttttatttttatttttatttttttttgtggttttagaactgagtccctcagctcctagaggttgatggccattccctgtcacatggctgtctccatgacatggcactttcttgttgaaagccaaaaggaaataatctctgctacttctttcctctaaccttttctatctctaacctctagaaccttttttaaaagaccacctgattaggctgggcccaaccaggataatttcccttttgattaacttaaaggcacctgattagtggccttaatcacacctacaaaatccttctatctttgttatataatataacctaatcatgggcatgatatctaccatatttataggccccacccaaacttaaaagaagacaattctacagggtgtggacacaagggagtggaagtcttggggcccatctcagaatttttaccacttacagatggatttttagaagcaggatgattgattcccagtggttaagtattttaaaggctatatattgagaaattgctttccagtaaaactgtactaatattcactcccatcatcagattatcagcatacttgttttactatatccatattgacataatagtcatttaaataactttgattactattttcctttctctataattatatatgtatgaatatacaaaattacaatcatggcatttttgtgtgagaaaattttatttttatttgacaaattattttagtatatgcttttatttactatcagttttatgattgtaatatttagtgactgtatgtcttctaggtattacctattcacttgatttgttcattttctatattcattccctttgctaattttcccaatagatttgtaagcattctttatattatatgggcactagcctattgatgtgtatgttggaaatatgtttgctaatttatatttgacttttaactttccctatacaatttatatttttatgttctaaaaaacacaataaatattccatttgaattttgactagaagtgcatattcccattttggaaaaatttgacattttatgccaaaattgataaagtagtcaatattttaatcctggagcatattatttgcatgaatttataatggaataaagttttctaacttcttgtcaccataccctactactaataaaaattttacatttctctctttctaatatttacagtcactgcctaggaattccagatcaaagctaaatgaaaatagtaacattaactatccttgccctcattctttatattagtttaaagcacttcgtcagtttaaaaagaaaaaggttttctatatttttatagccataaccatgattttctattccttggaccaaactctgtttcttgaaagtttggaagtactcatctgtattgttttcttcaattaacatttttggagtttatactttaatagcattttgagattttaaacggttttgggtttactcgtaattttcttctgtttaatgaattttagttatttttatccccaatcatccattctgtaaaatttacaaatttagtaaaattcagtgttctaaatattttatgtcattgtatattttataacttcttcagttctaattttgtttatatcattgctcttttttttcttaatagattagagggaagtttcatcaactctttgtaatacaaaaccggttttgacagtctgttctttaagcactattggtttttaacctcctgaagcatatagtcaggacatcttgagagtcaaaccaaccctttccttaccagattcctgtacaacttttcagcttcacctggtgccacccagtaggtgtgccaattatcccatagtaactgcgcttactgctccagtagtctataggtttgcaagacattccacagcattttgtgttagattgctccacagtgaactccacagtgtttaattctcgggacaatatttaaataaggcacagatgcattttggataagattatttgactgctgcgtatagtattcttcatcaccttgtagggtaatctgccaagaagcgtatgacttcagatttttattgataactttggttttttagtcatattgtgaattagcttttggagatcagtttagaagcttggttgtaagatttggaaggtcaacattcccttgtcagagaagcgctataggaataaatggtcttctgtttagaattgtgttaaaaagaaaacaagcaaattcccacagagttttgtcagggccaatttagaaaaaaattatcttggtgacctaaaacttgttttcgatgatctaaatgtatccccctccctactccccaactcatattgaatagattgtcaagtatttagctttattttcatcagtggttttccaaatggaccatgcactctttctgtcctactctacctgtaatctcttgcccaccatttatttaaccctttctaccttagtcattaatgaactccctcttctgcttccaaagtcagcccaatgccaccctcttctgtgaatgttttcatgacctatccaggctgcactgagcactttccatggattcttgagaagtcgtctctcataacatgtatccctttgctaaaattgttgatttccatgtctctcttccatgtaatccttgccacagtgaccatttcctaatcattttgtacctcagtatttagaacagcatctgcatcatgataggcactccataattaaaaaaacaaatgtatacataactttataatttgtgtttaatttcctcaaggtagtagccaaagcttatgatttagacacaagtttccctgtgactaattgtaaatattgtgccttttagtaacttatggttgcagagtatctaagagcttctgtttatcctctccccaggaaatctatctcataacatgcatcgctttgtgtaaattgaactcttggaaaaatactttatccgtgtcaggcacaaatggatacttcaatttttgattagagtgaaaaatggttgctttaatcttgaatatagtaatggcaaaactttaaatattaagtaaaatatagtgaatcatttttttagcataggtaattactacatacaagccaggagtggaaagaaggcataagaaaagagctagcattagaaaatgtctataattaaatgtcattgttaaacactaatagtcaccataaagacaagtattttatttaaggcttatgaaactttgaagtaggtatttgctacctcaacatgttgaggaaaagtaggtaaaaactgaaataaatatggcagatacttatgtccatgctttgtaggtgagaaaactggggcttataaagatgaagtaacttgcttaccttaacatacagtaaggccaataatccaggtttttctgattctaaagcgtattctccctgctttatagttaagaataaaacaaatgagtgcagcttccctccctttcacttccaaatttacctttatattcacccatttgtactttattttctacctataaaaggagtctcaacttccccatactaatatctcttccttctagattctcttctttcctctgaatctcttttgcctcagtttacatatgtcatccagaattccccagttaatcctcaacttctctaccctgaattgtggattccacatccacattcaaaacacattgttgcttgttttgaatgttgtttttgaaaaacattcaaaaacaagcagatgaaacctagtttccaccttggactcttttgattatgcccacttatactcctatttgtgtaatgaaaagactggtcattagcatcttaactctgataccagttgtcttttttatttcgagacaggatctcactctgttgcccaggctagagtgtagtgaaataatcactgctcactccagcctcaacctctggggcttaagtgatccacccgcctcagcctccccagtacctgggactacagcatgtgctaccacacctggctaatttttaaatttttttgtagagatggtggtcttactgtggtgcacagactggtcttgaactcctgggcccaaatgatcctcctgccttgacctcccaaaatgttaggattacaggcgtgagccaccaacgctggcccagatgtctttttttattctcacaatacacaaactctcctgattgtatccttaaatatccttgcttgcttattttacccagtattttctgattcacactccctctgtggcttgcttttctcactttttctccctcttgattcattttgcctgtcctataaatatttgtaagccccagggtggataatgtgagccttcttctcttctttatctgtacttccttcttgtttttcctaatacatgttcttaacttcagctacagttacagtgttgtgttatcttccatctctctactaagctcctggctaatattttaataaactacatgaaagttttaacagggccagtctaattaaataggtaagcatttgtttcctttattggtttgtgagcctttttgattagactccattgcattgtctttgtgtccccactacatcatagcaaaacatcttgtaactagtgtatgctcaataagggtttatcaaatgatgggtttaaatatcaaaattgaactgcatataatagcaaccatatccagtctttcattcatttatttttttccagctagtattcattgagcattggaaattaaaagttgcataaaactcacatttacccttcaaggccttccagtcaagtagaaaactgggatacacagaaaacttgatagggaaaggatgtgaatattagtagtatgaattaattggtagtacttacaataataataaaagtaataacaattaactgcaataacaacaataaaaacagaagctttgcctgtaatctcagcactttgggaggccaaggcaggcagatcagttgaggtcaggagttcgagaccagcctgcccaacatagtgaaaccccatctctactaaaaatacaaaaattagccgagtatggtggtgggcgcctgtaatcccagctacttgggaggctgaaagaggagagtcatttgaacccaggaggcagcggttgcagtgagccgagatcgcgccactgcactccagcctgaacgacagagagagactctgtctcaaaaacaaacaaacaaacaaaaatcccggaagctttgatttgttgttctttcaatgtgccagtgctgttctaagcactatgctatatatactattataatacttactttgcaaataaagaaactagtcacagagaggttatttgttccaaatcacagtttataggtggcaaagctgggatatatagactttctgctcttaaccattgtgatatgctcattctgcataaggtttagtagtggtttatgtgaagccaaatggtgaatggtattgacaggaaacaggcaactggtttcaggtccatttatccagaaattgaggcctcttgaaattagttcaccaatagtataagcaataagaaaatatgtgagaacctcactaaatgattatgtacagtttgtattgctatttctgggtgcaaattttgattatgcaacaaggatagcaaaacttggatgtctatggctagatacatttaatctgttttgcaatttaagacacaataaacttcctcaaagaagtttgtaaagattattatagattgaccaagatgttaagtctgtgaaattctatggatttctttttgtgttccctaatacataaagtttcaagagattcagttaaggatcttgatattaccaaattgatgctttccacacatattaattttaagaaatagaattgcaaactagcctatatgctttatagaaatgaaatgagtaaggaaatagtattttgaacaggagtaaagtaataagatagttgagctgaaaggtcttgcagtgtatagttgggtcctggagtttcttgggcagtgctgattaaacttacacagagaagaactgattctcacagctaacctgaaggctgaaggtgtcaacttgaagatttcctgcagctccagttagtgtggtggctgggaaatggtattcgggttttaggaatgcatgactcagatttgtactttaatgtggcagttcatcagatgtgtctgatgaatcagctctttggattaggtttcatttatgtctttatgtaaacttaaggtctttggatagaaaacttaaacagattgtcatcccttaaaggtgccgccattaaaatagattattttccatgctattacaaattcactgattttctgaataaaatggtgatggtgacaccttgccacaggtgaatggattttgcttttgttttgtgaattaaaatgtgttttaacagacttattaatatgagtaaattaatcaattaaaaccattcagaagtatctgaatgaggctctgggagaacccaaaatgtgatagttttggcattttcatctttaataaagttatagtgattgagagctggattgatcagtcctcaagtgtcttgcaaagaaaggtgtcctgtcataagtttacaatatatttgaactgtgttctgatttcccactttttgaaagtcggtctttcagctccactatctcagtcttatacaaaaagaaaagaagcagagagtagaatggtggtggccaagggctgggacaggatggggaaaaatggggagatgttggtcagagggtacaaacttgcagatatacaatgagtacattctggggatctaatgtacagcatgttgactataattaatgatactacattgtatacttaaaattttttgagagtagatcttaagtcttaccacacacaaaaatataacaactgtatcagttgaagtatgtgttagctaactttatagtggtaatcatttcacaatatatatgcatatcaaaacacactgtacattttaaacatatccaactttgtgaattatacctcaataaagctgagacacagaaggatgattttctgaggaagacaatgttcgtttatttaatttcaaatgaaatatttctcctttagaaatccaaacacactaggttagtgtcccttcttatattcctctgcaagccttataatagaaagaaatgatttttgggtagtttcgttgagtgttgtttcttcttcttctttcttctttcttcttcttcctttgttgcttaggctgtagtacagtgacacaatctcagctcactgcagccttgacctcccaggctcaagccatcctcctacatcagcctcccaagtagctgggcctacaggtgcactccaccacgcccagctatttttttttttttttgtagtgatgggggttttgccatgttgcccaggctggtctcaaactcctgggctcaagggatctacccgcttcagcctcccaaagtgctgagattacagtcatgagccactgtgcctggccagagtatacattcttttaataaaaacaaaagtcttaaaattatcttacaatatcttttagaggtttttgaaagaaaattataaaatcacgattaaatattttgaggcagacagcttatgatttaatctctgttggaaagaatgacactgaataaaaccacattctattgcagcatggaatgttaaaaatgtcagtttggatgatttttattaagataaattgttagtgaaataattcttttgacgggattgtttccatttatttaaatacaactagggcgtttaaataaaaaatccaaaacctcaagtgaacataagattttaaagcattttgggggtgagggctatggaggcataattttggtattaccagtttcgatttaacttaggaaccacaacatatgggaaaatataatagaaatcctggttatattctttccttttgtgtaattcattgcaccgatcatgtttgatcaaagttatgaaactctaataatattgctatctatttttaaaacatgtatgtttttcttctttttaatctttgctttagggaacggcctttaagagctggaagatgaaagctccgattccacacttgattctcttatacgctacttttactcagagtttgaaggttgtgaccaaaagaggctccggtaagcagtattcctctattttttatgtgtttttatagcttaaagtgatagtgctacatctacacatgtgccattagtggaaaagttgagaatgatcagttatcaatattgtggagatattgtagatattatgagtaaataggtggagcacactcatagggaattaggaaagtgagagtggattcaaaagaatgtggcttattttatcgattactatgaattggcatggattcaatagcaaagccttgtatttagatttcattttgtggtaggattttaagtattcttatataaacagtgttatttaattttttgcatggaaatattattgtatctttgatgttaacttttattgttaccattttgatgtcagctatacttagggaagattcttttcagggttgtactccagctgatttgatgaattgcttggaagtatataaagaaaatactagtgttattgaagaaaatgtcatgaggaagcactaatattttaataggaaatatagaggtaaagtaggatggtaatgaaaggaactactaaatagattaatgttggcatttatgaaaaactttacatgttatcaggcatcttggtttgtagtggactgttgatagttcaattgtatgggacaattgaataaataccattatcaatgtgaagttgtatcttgtctagtaagtcactaataatataaagccttgccatgctcacactatgtggagtcacataatttttgaagttatagcttttaggtatgaaggaagatgaagggtattgtgttttgttgctagaattagaatgtattgtctgttagttctagagagcctgtgggaaaaagaagatgagataatgtacaagaggttgcagtgttgtgatataagcaattgcatggacaaaagcatctttggagttcagaaaggaaagggaatgaaagggctgagatggggctgtgaagcaaacatcttaaccatgaggttaaaaggcttcaaactcactttgatgatataacgaaaaagcccacatgcaggggaaatagggagcagctctgctctcgtgagcccctcctggggataaagtctgaagggaaactggggagggcattgtgcatggacaaaggtttggtgcatggttgaaagttaaaaaaaaatactgagactgttggttctagcatatttggttattatacagctgttgtatctgccattgatgtggttataggcaacgtgaaaaaaatactgttgttatgtctacacattatttcatctcttcttctcagtggatcttctgaatgagataaaaccctagggcaggattatgatgttgtggtttatgtaattcaaatgggttaatgggaaataacatatatcttgatttctttaattgtactatgctcaagtacaattgagcataaccaagagagttagagtaggtagaaagaggggtaaatagtgatgaaagctgataatttttacaacactgatgttttctggaatagaaatttacattaaaatcacttaagataggtttttgagatagtagctatatataagagaaacactcatttgtgtaagtattataacaaaatgacaatagttcatccaaaatagaaatattgattaattctttaaaactttatttttctggttattaccactaattatataaaatctgtttttttttcagttctttctgtgtatgtcagatctatgatttatttattcaaatagaaatgttactcctttttaatcataaagtaatggtgataggtccattctatataacctctaatttgggggcaagaaattttatcaaactgggacttactttgtgtgtttgagaagcatgagagcagagctagaaacatggggcagttggaaaatgcaaatttaatataaatgcaaatattaaaatgtctcaaaaatctatattaagtgattttaatgtaaattcctattctagaaaacgtcattgttgtaaaaattttctgctctaaagacctgagaaaactcaagaatctgtctcaaattcagttttattttaattttgtaattatttgagaagaatggtaataagatgctgtgctaagctaagcagaagttctgagacctttctctcttcagtttatgaatgcagttgtcacgtaattatataataccttctaaaccaaatgtgttttctatattataatgtaaaaatgacaaggcaggtactgggattttgcagcatgcctgatttgtttacttttctatatgatgtgaattaacataccttccttcccctagtgtctatattaagatccagatggatggaggcttgtttgtttgtttgatttttggatattaagtgtgcactttgggaaggaataatattattctatccacatactttcatagcttggactgatttcagctgatgtctgttcctgtggcacctttgtttgaaggaagcagatatgtagcttactgaatagtgtcattactcatctccatacatcaagtagaagaggagtgtagttggcatcttttccttgaaagattaatagctcaatcttcatacccagcccaacctataaaaccagcagcaccatggccaggggataaaaatcaatttttgatgtttgattttacgtattaaccaagaggacttcttatctttcttcttttgtcttatcatttaattctcttttgattctttattttattcatctttttgaaaggtcagtaaacatgactcaaaacccaatgcttttcatgtgtcttttactagaatattatttttagttcactgtgaccactagaaaaccagaactagatattttaataattaggaacatatacaatattatattacacagagaaatattgatttttaatggcatgttaattttgtagagtgtttactttagattaacacatatggtcattccataaaagtagatattgttttctcattaacagaactaatttgaaagcaataggaggtcttattacacaagctggaaatgcattatttttatcacattggcttacagtcccatcgctgttaatttaaggaacagattaaatataataaggcaggccgggcgcgttggctcacgcctgtaatcccagcactttgggaggccgaggcgggcagatcacgaggtcaggagatcgagaccatcctggctaacacagtgaaaccccgtctctactaaaaatacaaaaaaattagccgggcgtggtggcgggtgcttgtagtcccagctacttgggaggctgaggcaggagaatggcgtgaacccgggaggtggagctcgcagtgagtcgagatcacgccactgcactccagcctgggcgacagagcaagactccatctcaaaaaaaaaaaaaaaaaaaaaaaaaaaaaatatatatatatatatatatatatatatatatataaaaaataaggcaattatatcattataacattcttgattgaaatattaaaatgcaactttataacattttgttttaaatatcacttcagatatgtacaatatgtatgacaactaaggactatatctggtctctcaggtaaagtcctaaagttgtgcctacatttagaatgaagacttttaatatctatggaagcacatattcagcattcgttacacaatagattttatcctgggacaatttcatacctattttttttagtttttataagtagcacttgatgaaagaggctaagatgaccaatattaccaatccccgtcaagcatgtgaaatattatagcaattcagtaagtaaacatctcggttgctgtcatttttagaattctgaaaaaaaatcccccacatgtaaagcaaacgcttgcttggagaatctttgtatctcaaccagttgaggaaatttagctttacattcttgtttgttggtccctttcttcattccttcctcccttctttccctttttgttctttccttccttccttcctttcttcctcccttccttcttctctgctagtatatttatctgcaaataaaaataatttattttcatattcccactgtgtcttggtaggacttttcaaactataaaaatattattattactttgtctgcatggttgaagtatttgaaatattctatctttacaaggccattcaaagaggttagcatagtctttgttaataatagctattcttaaatatatacattttaaaatggtgtataagaaaatctgcagtaagatttgggagcagggaaatagtataaatagttgaaggactgttatggacaaagtatgactatagcactttgcggggactaaagtgtgagttgtaatttgcctgaaaagtttgggatactgaagaaaaatgaagctagaggggtctggatgtagaaattaggtaagagaaggggttccatgatgtttttctctcaaaaacatcctcagaatataagatggtgagtgcaaggaccatgattaatgtatgcttataatctctacagtgccaaatatgctgtttcagagtcagggttcaaggaaatgtcttaatgacttaatgacttaatgactgcatgaatggttgagtgagtggttttaataatcagagttacatcagtgaggatgctacaggaccaaaacgatattagaaagataaaggtaaaattaaatagaggcatttaagaaaaatgatttttttttcttaaagagcaatcagtataatgtataatgtgagactactgaagcaaaagatataacccggaataagcaatatctaggacataataagggtttagatgaagacaatgaacctttacaaatggggagtgttttcatgggcttgaaatgcagttcaaaatctgttaaagggtaaggaaaatgattcttcgagtatttttctattggaattctactacgtttagtgccgctttaaagaagtactaatgtcattgtgcagaattttgaatttaatggtattgttccataatggccattatgaaaaggctgtagctcatgattactaatacaggataaataagcaagtgacttcagtataggaaaaaagtattcacagttattagaccatatggagaagagtaagtggctgcattaccaaaaagcacgttattttaggaggaatttcatctatataaaagctccctaaagcatccagctattagagagtaaaagggttaccaaaaggagttgatcttctcttcattctagaacctgacaggggacacctgtttgtgtaaatgatttagatgcaattcttctagacagcaagaggaaggcaagcctcaaaaggttttcctaaacttgtgactctaggcccaaataatttataaaaggtaagagtagtcaaataaccaaagacacagtttcagttctaatttttgtgttgttatgtatggatattcatttaagtaaaagaaattatactactgtgtaaagaaagcgagatttaactgaataggaatgagaaagtctagtgggggtacttccatctcatgtcaatgtgatttatgtgcagctgctctcttgagcattcctgtaagtcaatgagcttaatttcacatgattaagagacaacctagtcccccagcatctgccttttattatgttaccatgtgtttattctcagtttgtcaaatatgtcaaaaaagataaggtgtttctccttattttcctttggggtagcttataagaccaaacttctgggactttgtttctttaccttttgaagttaaaaaaaatgcactttaattttttctcaggaaaaaaaattctcctatttattgtaatttttacaaattttgaaattagatctagagtaattttaatattcctttgaaattatgtccttaaataaaataataagtctaataaaaatggaacttgcacctaacaaacaaaataaaattagccaatgtctttgtttagttatatctatgttctgttatacctatattctgttatacctatgaatttccccacaaacttacccattcagttttagttgtcagtataattttatatagagttggcacagatgaataccaattgtggaaaatgatgcctgcttcatggtgagttaaggataaaaggcagtatgaatgaatcttccaagttgactaagacttcaatgaggaggagaatattccaagttaataagtatagtattccaagttaatccaacttattaacttggaattcaaactaattaacttggaatattattattattagttgtattagtattccaacttattaacttgtattccaacttattacttattattgcttataataagtaataatattcaaagtatcataagtatataagtgtggtactgtattatgagggtacaaaataatatattgttctatgtatttgatgggagaggtgaggaatagagggaagcagtatagaagctggcaaatggtaggcaatataagtttgttagagaaatgatgttcgtattattccattttcatgctgctgataaagacatacctgagactgggcaatttataaaataaagaggtttaattgggctttccatatggctggggaagcctcacaatcatggcggaaggcaaggagaagcaagtcatgtcttacatggatggcagcaggcaaaaagagagcttgtgcagggaaattcccgttttcaaaaccatcagatcttgtaggactcattcactctcatgagaacagtgcaggaaaggtctgcccccataatttaatcacctcccactgggttcctcccatgacaggtgggaattgtgggagttacagtttaaggtgagagttgggtggggacacaaccaaaccatatcattccaccccggcccctcccagatttcatgtcctcacatttcaaaaccagtcatgccatcacaacagtcccccaaagtcttcactcatttcagcattaactcagaagtccacagtccaatgtctcatttgagacaagtcaagtcccttcggcctatgagcctgtaaaatcaaaaacaagttagttacttcctagatacaatgggggtacaagcattgggtaaatacaggcattccaaatgggagaaattggccaaaacaaagggactacaggccccatgcaagtccaaaatctagcagggcagtcaaatcttaaagcttcaaaatgatctcttttgactccatgtcttgctcatctgggtcatgctgatggaagaggtgggttcccatggtcttgacagctctacccccgtggctttgcagggtacagcctccctcccagctgctttcacgggctagtgttgagtgtctgtggcttttccaggcacacaatgcaagctgtcggtgggtctaccattctggagtcttgaggatggtggcccccttcttacagctccactaggcagtgccccagtagggactctgtgcgggggctctggccccacatttctcttctgcattgccctagcaatgattctccatgagagccccacccttacaccaaacttctgcctgggcatccaggcatttccatacattttctgaaatctaggtggaggtcaccaaacttcaattcttgacttccgtgcactgccaggctcaacaccatgtggaagccaccaaggcttggggcttgtaccctctgaagcaacagcctgagctctgtgttggtccctttcagccacagctggagcagctgggacatagggcaccaggtccctagactgcacacagcaggaggaccctgggcccagcccatgaaatcacattttcctcctaaacctctgggcctatgatggtgggggactgctatgaaaacctctgacataccctggagacattttccccactgtctcggggattaacattcggttcctcattacttatgcaaatttctgcagccagcttgaatttctcctcaaaaaatgggattttcttttctatcacattgtcaggctgcaaattttccaaacttttatgctctgcttccctcataaaactgaatgcctttaacagcacccaagtcacctcttgaacactttgctgcttagaaatttcttccgctagataccctaaatcatctctctcaagttcaaagttctacaaatctctagggcaggggcaaaatgctgccagtctctttgctaaaacataacaagagtcacctttgctccagttcccaacaagttcctcatctccatctcagaacgcctcagcccggaccttattgttcatatcactgtcagcatttttgtcaaagtcattcagcaagtctctaggaagttctaaactttcccaccttttcctgtcttcttctgaatcctccaaactgttccaacctctgcctgttacccagttccaaagtcgcttctgcattttccggtatcttttcagcaatgccctactcctggtaccaatttactgtgttagcctgttttcatgctgctgataaggacatacctgagaccaagaagaaaaaaaggtttaattggacttacagttccacatggctggggaagcctcacaatcgtggtggaaggcaaggagtatgtcacatcttacatggatggcagcaggcaaaaagagagcttgtgtagggaaattcccatttttaaaaccatcagatctcatgtgactcattcactgtcagaagaacagtgcaggaaagacccacccccataattccatcacgtcccaccagattcctcccatgacaggtgggaattgtgggagttacaattcaagatgagatttgggtggggacacagccaaaccatatcaatgtttattgtagagatagcatacaggcattcactgctaggaccagaggattaacccctgatccactggtggtcaactataggcttgcacgtgatccataaggtggcttggaaattagggacactggtgtatcagtatcttactgatgttttaacaaattgctacaaatatagtgacttaaagcaacacaaatttattatcttacagttcttgaggttctttatcatcacatctcctctgactctgacccttctacctctctctttcccttataagggtcttcattattatattgggcatcctcagataacccaggacaatcatttcatcttaaaatcatgaatttaatcaaattggaaacgtaccttttgccatgtaatatgacatagtcatatgcttcagggatgaggcagtagacatctttctagagaacattatttagcttactgcaactggcaattagccaattcaaacaaactgtctattgaatgcgttgaagactagagcaagaattgtcagccaggagccagatgggaatggaagagaaaagaacagggaagttgaaaacttttgctgaagggcctgtgcaatccatggtgcatgataaaaggtgcagagggtttgtagcaaaagaagaaaagggaaagaaaacagggcagagggaaaggaaggatgagagatgcggaaggagaaagaggaaactgatactagtgatgctttggatcttaagaacattttaagattaatctgcactccacacatatactttcaaaaatacccccttttctttgtggtaggctaaaggcgtctgtgttcctttcaacaaagtaatacctgacctgaaaatgatttccagacgtaaagtaatagcagtgagaatagtgaagacagaagagagagcaattttaaagttagactcaattgaaatagatgatcaattagatgtgagaggttataaagaaagaggtaaagaaaaacattctgtaatgagaggattgggataccatccatcatattaaaggtccccaaagcacagaaacttgaaatgactacttattgaaggaaaatagtaaggtctttgtgactaagatgaagccccaaatgtagattgaggatagaatatgagggattttgaatatcttgcaaggaattttagattttatcttgagaacaaaatattttggctgagatatttaataactttgcaaatccctttagtagaaaattcagtctgggtggttgggcctctgatttgatagatctgttcattgtggtgtcttctctacaccataaagatgaaacttcttgctttgtgtatgatggtgttacacacatttgtgagtccatcagtaaagctgcctttgcagagaagggaagacacacaatcaaactatgtaggatcatacatgaaaatggcatggtcaaacctggtgtttgacatgtaacactccctgtagaaaagactagggtgggattccagaatgaccagtaagggactcgataaaaatcgtatttacatatactgagggcctgaaaagcaatcaaaggcactgaaaataaatttctgaagaatatataggatctagtgagtgtttggagatgaattgtgaaataattcgaggagaggttatattgatggtgtcgccaattacagagagaagatgaatggcaatttttgcggggagagtggatggaatgaagtcaattcggaacatacaagctgtggtagtcactggaagtattgagctaatggatttattggtctggaattgtactagtttcctgtggcttctgtaacaaattgtcacaaactgggtgacctaaaacaataaaatttattgtctcacagttctggaggccagaagcccgaaatcaaagtataagcagggctacacttcttctgaaggctctgtgacagaaaacttccttgcctcttccaccttctggtggcttcagttttccttgggttgtagctgctaccatcttcacatggccttcccctctgtgtctttaatctccttctgcttttctcttataaggacacctgtcattggatttaggatccactgggaaaatccagcatgatctcattttgagatctgtaaccttaattacatccacaaagattctttatccaaataaattcatatgcacaggtcttggcggacatatcttttgggggaccactgttcacactgcaaatgtcaaagcaagaggtatggattttgaaattgtcctcatattgagagcaacatgatggaatgagattatccagggaaaacatgcagagagagaagaggaaaagaaaagggaaagggtgaggatcaaggattctgtggaacactagccctgaagaggctggcagagaaagagcagccagtcagggaaagagactaagggaaagctaagggaggaagaaagagaccttacttgttttggttcctgcaaaccaagagtggagaaagtttcaaaatgaaagaatgatcatgttacattctttggaaagttgtgtcagataactgaaaatacgtcattaaatgaagattcaggaaaatgtaggggtggagagacaacggagtctgaaagaagttgatgtcaggttttaaaaagtatatattgtacaaaatcagtatattaaagggcctttgcatattaaagggattttatttatttatttatttatttatttatttatttatttatttatttattttgagacagagtcttgccctgtcgcccaggctggagtgcaatggtgtgacctcggctcactgcaacctccacctccagagttcaaatgattctcctacctcagcctcctgagtagctgagattacaggcacccgccaccatgcccagctaatttttgtattcttagtagagacagggtttcaccatgttggccagggtggtctcgaactcctgacctcgtaatccgcccctgcttggcctcccaaagtgctgggattacaggcgtgagccaccacacctggccagggattttactttttaaagtttgtttaactgtttagaaattatgctttttctatttaggtaaaacgagtataaaacttgtggtcatccatgctaatgaaaagaattgtacattagtacagatataatagtatagataaaattttttccaatcaaaaacttctttttttttccaatcaaaaacttcttttagcaagaattaaaacatgttttgccatagataaacctcctgaaggaagggtgatactgatttaattttcgttttttcatttcataaatacagatatggaagatagcttacaagtgtattataattttccacggttaatcttcatgttaagtatcgtaagttccaggaaaggtctacagacagctaatatttacactccaactttcattcacagtgatgatcacaaaaattacatctttttagttagtatctcagaagtggcttacattaatctgatgagtattatattaggttggtgcaaaagtaattgcaatttttgccattactttcaatggcaaaaaccgcaattagttttgcacctaccttataatacccacagcagtggaaattaaaacacttgggtttcaatgcagctgctaacgagccttgttgattgggaacatgtccctaactgaagctgtcatatctttggtttcctttttcataaagttttgcactacaacattgtccatacaaataatagttcatctttttgttcctttcacaaatatttattgagcactttcaatgcatactaagtatatacctgacacttttttctgtaacttattttacatgtttgcaaattgatcacacgtttaaaaaggcagagtttgtgaccagagtacctgaggcccattgttagctacatttaactttgtgctatacagtttgagtcagcactacagagtggaggatgttattagcttaaaacaaaggttctgttaagagaaaaaaaaattagtttttatttctttttaaatagcacacagtatatcattagaaagccaaattaaaaataagatacttctccttgcatgtggtgatgtgattaagtaaaatttggtttgtcagtttcaaataccaaaccatgttttagtctatttttgcttatttaaggcaaatttctttttgtagagttatggtctcttaagacatctatgcaagacaccttgcatgggaaatgttgccttaaggcgatgacagtgaataactttgccaagttttaaaatctctgagggttatatataaatatttcttcaaaaaatgtcagtgagcctcttgtgagtattctcaacactattcaattgtcatttatgttttactaactgtactaaaatatttccaaattagttttgctaccttgagctcaataaagtactgccattggcatcttactttaagttcttaatgcatattccacttattttgtattccaaatattatgttgtaaatagtaaagaaaaattattcttatcaatgatgaagaaagattttcatactctggtgcattaatatttttctgaaatatattgtcatatcagaaaaaatgcaactatctgaaaagaggattcttccaattttttctataaatatgttctataaagcaattgtactctccaatgccatcttgtggctttttaggattgatgaaaatgcggtaataaacacagaacacagggagaaataaacatgggaagaaaacttctgatgaattattgctcagtgattattttacttgatcttaatactgttcaaacatttatttgccctgatttattgccttaggttttataaagagtatatatatatttctcctatattttgctacatttttataatagaaatgttcattgagatcttgtaaggagataaaaatatcgtatttttatgatcttagcatcatgtccatttgtagccctatattaccagaattcaaattattttgacaagtgcattgatattatagacttattaaaaatcctcttttaatacattgctgtcattaaggtcttgtcattttaataattcaggtgtcgaaaggagaaaaagtcattaaagattttagttgctcactattataaataagagctgctgagaagaatatggaagtgaagatcttgtgtggatagatgtgtgcttcacgacttaggttttcctgctggtctattggacaggccttggaataggagatgggagggcctaggtagaatcaagctaaatggaaagcactagtcatcaggcaaagttaccttgaaaaagcagttacttttatctgcatgtcccaaagaatgaagaccaagagaaattattggtcggcaatgttttgtttttttaaagtgaaaaattttcaaagggtcttaacagttataaatgcgttttcaaacgaaaggcatataatacaccccccacacacgaaaatattagcatgctaccaatgttttcaaactttgataagaatatttttcctgttatgagcactcatctaaaatatgtacaactgtacttgattacgtgtgtttcttttaggattttatgcatggaacctacttcttcttaaaggacaaagtaacaggttgtgtacaccaatgttaacaagcatttattgaattcctagtatataccaagtgcttgataacattgattcacatcagctatgcctgggcataaaaaaggttaaaatgtttagatatttgtttgtagaaacttgccttttgtattctttatttaaaaaacaaacttgtggaaaattttattaatagaaaccaaggcaatatgatttatctttattaatttgatcattcttagttttctatacctatgaatcatatcctgaaaattgtttatataatttcctcataactttgctgatttttttaagaaacatatggagtgcttatttttgtaactgcatgcctttttactttataaaatccatgtatctgtcatgtctttggaactggtggtgctataggcattgtcctttcatattcactagtcagttctaatttattctttgtatttagcaaatgttttcagacaaaacatactgtaaacaagcaactggactgaattctctgggggattaaaaaagatgaacaatctaccacctctgctattaaataccttgcaaaaaataagtgatatgagatatcatacatgtatagtatattactttcctattgtagctgtaacagatcaccacaaatttagtgtcttaaaacaacacaaatttattatcttatggtgatgaaggtcagaagttctaaaatccaggtatcagcagggatgcattcctttaggaggctccagggaagaatctgttttcttgctgttcccagcttctagaaaccacctgtattacttgtcttgttgctccttcctgaactcaaaatcatcagcatagcatcttccagtctctgtaacctttacttctactgtcacatctccttctctgactctgactttcctgcctccctcctgtaaatatccttgtgattacattgggcccaccactttaatccagaatgatctctccatctcatgatccttaacttaatcataccttctaggttccttttgccacttaacagtcacaggttctaggaattaagatatggacatctttggagagtcattattctgtcaatcacagtggtatattagagtagcttttacataaaatagtttgatatggatggaatacatctatatcagggcacagtacagaataagtgatgagggagtgtcaggagaaaaggtggaaaaagatagatgggagccatatcacaaggactttgtatgacatgacaagaaatgctaatattatgctctaggaagtcaggaaccattgaagaaattgcagcagagcttagtaggaataacctgaccagatagattggaaagagctctaagacaagagagtgggaaatgaggccagtagtccaggtaagaaagtcatgaactgagccagtaacagcaggaataaaagaaagagagatggatttgattgctagtaaaaactggaagtaataaaaactagcaggtgattgtacagtgaagagagggaggtggaaggtaattccagctgcttttattaagttaaaaattctgttgagaactagtagctaatgttatatttctagtctatatttttcctggtcaaatacatttttgggttttcaaaatgatgtatcttttgcagtgtggattccgactgacaaattgtacatctgaaataaaaatctgcgtttgggtccactgtagggttctttcaaatgtcttctacccttgtgcctataatgaagtattgtatcaatgggtcttgccttgataatctcagtgaagaacttcaagttaacacagggagaagctttttatttttttaagatgtcaagtttcttttagtatgtagtgctaaattgtggtatacctacatgcatacacacatatgcacatgtatccactcaaatatacacacagttaactattaattcacaaaacacacttgtattgcagctttcctatatgccagttgctgaggattcaaaaacaataagaatatatgatcgctgcattttaaaaatatctgttttatttacctaactaaatagtataagctcgttgagtataaaaacatctttatccgtttttatatgtatacatatatgtatgtatatatatatatatcttttgtaatcgctatgcttaaaagagtcattgcataatcagtactcagtacatctttgtatttcatttctggatttaagaacactgaaaaatctcatcacagcactctctattttcctgtggcaatgtacatgcatgtcataactcttctctgataccagaaactccttgaggaatgatctctatataggttaagttcattaatgaggctttacacatagcattatttgaccaattgttatataagcaaatgaataattttaacttacatgaaatgaatagtttcattagagtttacatttctctgaaaaggaggaattaaagctttatttttagttggcagggtgacctgaccattcatggttattgtgtataatcccctgctgaaattgtaatagctgaagctgaaagcactgagactatactggaaagtgaatcttgagatggcactccttctttagctccaaagggcaaattttcagttactttgttataataggaattgtgcagcttttgcctccttcttatctttgagagattttgccatgtctgtacatatgaaggtcattccatgaaggaagagcagatacacaaaaggactcctgcatggaagcgtggctggaaggagtaaggcattagccaaagcagctgctcaatgtctccatgtctctcagaacggatcataacaaaccctaggaatgctggtgaatagaagtggcctacaacattgagggtgtttaattttaattcagaacataaattagttcaatttggcaacttgcgcattcattctgccactctaactgacatgctgctccgtgatgaacagtgatgacttactgtttgtttcaaaggcatgttttcgctttctttgggagacgtgcttggtttgttttgttcaatttttaatgatacatgattttattttaaatttctttggaaactgctttgtatcctagggtttccggcttcctgtgaattgaggagaggttattaccttctaagttttcaattaggaaaacaaagcaagtttggaagctccgttgggaccttgtaaaccctctcaaagcatgttctgaaagagacaatttttgtgcaactagctctaattgtctgagatgagactatctacagaagctaattggagagtgtctcattctgcagcatgtatggagtcagcagaatagtaattttgctttcttgggttgtttttcctttttgttgttgttattttgttttgtccacacttcctttcagtacctagcattttaagataaatctttctcaatttaaaattacttatctctaatggtaaggctcaggatttccatatagacccttcccaaactctgtgtaataatgttcctaaatcctcaaccattctttagacctaatatggaattagtaagcctttgatggacttgtattcccttttgctttacctggatgtgatattaaattctgtttcaattttaatgtttgtgttctgaattacagctggtaggtacagaatagtatttatcacattttctttcttatgatcaccacctgagtgattacgttgttgacatattctgaattagacaagaacatatgctcaactaaattgatgccttacatagaaacttgcatataatgaatttcatttgtgcagttattttaatttttgattacactttttggttttagttttatgttttctcatgcttctctaaagctgttccatcatgacttaaaaactaagacttctctgaaacttggaaatttattatgcagatctcataattatcctaactagaaaccaggttcaatataattaaggaaaaatatttaaactttatagatgtacgccatttgttctcctattcatcctacatttgatttttagtttatagtctttaataagtggggaaaacagaattacattgacactttttggatttaattggaaggttttcagaaaagctcttttgcatcagactatctcttctacaaatgttctagtgatgactgatgactctagaagaaaactccatcaaatggaaggtagaagaggagtcccaagtaggaggcagctgagaatgcagagtaggagaagcttctgaggcagtgtatcaagtaatatgtaaggacagagtagagacttgtgtcttcctccttcttctttctgtgtccaaggctacactttgccattatatgattttgacatcaaataaaaccagttttcctcgcagtagattgaggcaggtattatgaagaaaaggatggacaatgccagtggattaatggcttaactcagacacgtttctgttgtgaagaaaccttgagacaaagtttaagactgggaaaaataacattaaaatcagatgttttgagttaagaaaaaacatatagatgctgtttgagatcattttaaatggaaacacttagtttatgccaccatgtggttataccacaccatctgtaaattagtgttcaatgacacattattaaaacttatacattcaaactcatggttaattttaatctagatgcctacatctctgcgaattgcaagcatgtaaaactgaactcaacttgcattaatacatgaagagttaatgagaaactgttttcctgtgtatatgaatataaatgcatgttttactatttcatatagataatttatacattctttacatgctttatgggattatgtagttacatatttatatgttataatacttgaattggaatgggtattaaacaagacgtaggcttttaatatgaaaatattaatatgctttaatataaataagttaaatattttttggaaaacaaattaggtattcattgccagcttataaatatgaagccttttaaatttatacctcactttagccaaaagaggttacgttactctttgcaattattatttttaggagaaggagggtatttttctactattgttgcttttttctcagcatttttgagtcaatgggtgaaatgcttttactcagtgctgtttttgcaccaagtacattgttattttacccattgtaaattattctctcaatggtttaacaggctaaacccttaaataagaggtgtctttttttaaagaaaatatttggaaacgtgcaaatgaaaagagtaaatctatttttggtcgggttgtccaaactcttcttaggatcttatagctagtatttgcttttttaatggctgtttgaggtgtgtttaatttaacaagaatatgccagggatttactaaattatataagacagttctttttttcaaaaagtagatctagtaattttatttttcatttaatactcattcaacatataatattttgagttgtctactatgtgatacctactattctaggaacttaggataaaatgatacatgcatttctcatgaagagtacagcctagtgggcttaaataaacaagataatttcataataattcatgctatgaataaaataaaacaagttagcatgatagtgattggcaaaggtagttacttcagatagggaggtctctttgcaaagatatcatttgagttgagacttgactctgaaaaaagagcccattaagtgagaacatgggaaaagctcattccaagcaggatagtgagtaccaaagatatgcagcagtagcaaacaagacacatttaagaaatagaaagatggtcattatggatgacaggtagtgacgaagaatcatgcagtgagtcaaattgtaaagttttcaaagggtgcagagcaatgattggaggagtaaaatggaaggaaatgttggagaattagccgtggccccttaggtcatggtttagagtatgcattttattctcagtgtaatgcaaagccattggaatctagcaaatggaagactgagtatatgatttacattttttccaaagaatctttttttttggctgtggagtaagaagctatttaaatcatcctagcaacagatgacagttaccagatcttgggtattaagtggaagatggagagataaagactggttcgggtacagtttggaagtaaaaccaaacaggacttgatggcatactggatataggggatgaggaatatgtaagggatatataccatataaagaagcacagatgacttctaagttttatgagtaactgtattgatggtgggactatttcctgagatggggaaaattagaggagggagaggttcctgttttcgaaatgtagaattaagttcgagattcctattcagtcttcgagtggctttgtcaaggagtctgcaggcagctcagtggacaggttaataatggatatttaagtggaaggagccattggcatgtaaattgtattgaaaaccatttgcctggatgagatcactcaagctaagtctaagtagatataaaaagtagaggttgcaggacagaaccctaggatacttcaacatttccgtagttagtaaagaagtgagataccagaaaagtgagagagaaaatatgagtgtgatttcatgggagctcagaatgattcaataatacgtaattaaatgtattgcatagagctgagaagtgaaataagatgaagatagaagattgctcattggatttggacacaggtataactatcaataatgtaaagcaatcaatgaatatcacagaaaagcatagaatggtgggtaggcagaagtcaagggagcaagcccagaagtcttatttgcaatatgggcatgacactgcagcaaatttaaaatcttctattgaatgtaaaatgcatatgaattttttttgtatgccactagatagctaaaggtgaacatgtaggccaaatggaaaagcaaaaagaacagaagcatagagatcaaactattttagggaacaaaaactagttaacatcaaattgattgaaatttgcttcacaaccccatatttctcatgcccactgtcctatgagatctattatgctgttatgtaatgaagagctgtgttaattattcctgccacctgcatctaatgaaattagatgtgaaatttctgataggtacagatggccacttgaaaaaaacaatccagtttttcttttttttctatcagctggtcaaatctcataagttagaaatgttcagactataaaattaaccccagcattcttcatttgtatagatactaagtataaatgacaacttcctcaagcccaaataacttgtttggatttagagtttaaatactatccaattaagtgtatcatgctgacacattgtcatttaatactccctttggtagagggttaagcttgttgaattatttcaacttaaataatctgataaccctctcccagtttagttcagttaattttatacaaataaaattaaatctcaaaatgcatataaagtaagagcataatacagtatgtaatggggcataataaagttgccaatattataatgaagcgcatagaaaaagtgtgacctattgtaattagtaatgtgcacctctgacaaattgtaaagcatgaattttcctggtaaggaaaaagagaatgtgtggtaatggtagctaaaatcctattcgttttgcatagattgctatcaatattctgaagctgagggttgttgaagttggaatttagatggttgaatgaagatgtgctctggaaattaggagtacagatagacccacatggtcagataaaggaaggctgacagaataaagaagcaagacatgggttggttacttgagttgtggagatgaatgtgaaataaattgaataagatacaatgattagaaattgatacattaagcctggagatgaatacaatgattacgaatatgttcagacccacatatgtaccaaatgcaatggatgtcagacatctcactgtgaaagcaggtgttgagatgtgcaagacttaaggtaaccacaagctgagagaggagcagaaacatattaagaattctctaaataacagtattaaacaaaataatgttgaagcccagaacgtcagagattttctttataactccctcatatgaggtgaaataacctacttaaggttgttcaactggttgtgtggcctactaggttagaccatcagagacagtgtggtcctccttggatgagttgtttaggagaattatacatgatataaagaaaggtcacagccatgtgttagaaaccgacctttgtgcattactccttctgcaggattccaggggaagaaaaatcaattgctgactaaatagcatatttgaattacagagatcagcaacagtataaatattgcaggaaaatttatatataaagaaacttctatgtgcctttattagttttgtccacacaaaatgaaacaatgtgtgtatatatatatttttttcaggcaagcacccaattgaatttcagaaatcagaaaacaaataatttaacctttctttttaattcaattatattgatttgccaaagaatcactctctgataaataattttaaagtgtcaactctctgaatattgtaaaatatgtaattttgggtaaatttaactacatattcttggatccttaccattttcttctcttgaatataaaagatttagaatatgtcttgatgattttttgcttgttgtaattaaaatgtcaaacttaaagttgttaaaatgtacatctctctgatactagtaattcttttctcttttaaaaaacatacttatccagtatttaatttcatatgtctagatttgcttaggcaaaaggtagaagtgcctgctcttcagtttgcacataagctaatatagtttaatatatataaatgaatgtgtataatagaagtatattcataagttagaacgtgacatattacctaacataaaacaaataaaacagataactcagtagtttgaaagggaagcttaagggtaatactatacatatagtgtcataacactatcatgaaaatctctgttaaacgctgtctcctcaggcacattctgttaactcttcctaccacacttgtcacattacccagtttcattttcttgacatcacccagggccctctgaaagaattttctgtattaacatacttgtttaatgttccactgtccatataagaatgtaaactcagtcatagaagatttttttttcttgttcacttctatatcccgagcatctcagaacaatacctggcatatgaaagatgtttgataaataccaatgaaattaatgtttgaatgaatgatagcatttctgtttcgttgtatttttcattaaaaaattcaagtttctctcaactgatttcagatattccttcttttctaacatatgcatgcagcactatgaatttccctctaggtgctgctttcactgatccccaaaactttgattattgtcatttgttcaaaagattttaacattttttggaaatgtcttttttgagtgtggattatttagaaatgtgttatttaattgcaaatacttggagattttccaggtatctttctgttgttgatttccaatttaattccattgtggtctgagataatacattgaatgatttctatccttttaaatttgttaggttatgctttattgcccagaatgtggtctatcttcatcagtgttccatgtgagcttgagacaaatatgtattctgccattgttagatggagtattctataatgtcaatgagttaaaaatgattgataatgtgactcaggtcatatatgtccttaatgattttctgccattttaatctactcattactgatgtaggagatgtttaagtcttcagctataatagtggatttgcctgttttcagttctatcagttttggcccgtggagcttgatgtgctgttcttaggtgtaggcatgtttaggattgtaatgtcttcttgggaaattggcccctttattaagtaatatacctctttattactgataactttgcacatttggaagtctgaaatgtcttaatacattaatgatcttaaataaactaaaactccagcttgcctttcgagcactgcacagtacagtagtttctgatctttctgttttgcctctcttagtgtggaatctctgccctgcaaatgagctgagtcccgagtgaatcaggacccacgtattctgtcctatgaaggctgagtgcaagaggagattacctcaacttcttggttgcactcacagtgattttgcttcttgaaattggaattagaaagaaagagaaatgctagcaaattgctcctcctaatgagttacggtaatctttgattgggaaataaagctagagagtgccccatcttcttagccatatccattagtaattgagcttttgcctagttgagctgtgtggaaggttgtaggaggaaaggagcagataatggttcaaatgccacagactcccactattctaactgaattttagtatgttttcttgaataaatgtttcgttcacttactatattcctttggggcaattttcaggtttgtgtgtgtgtgtgtgtgtgtgtgtgtgtgtgtgtgtgtatgtgtatgtgtgtgtgtgtagtttttaaaaaactgatttcacaagttttgcttgtttcactagggaatggtccatagagctcatcatgctgtcatctcaaaagtggatctttccaactttcctttgattagtgttagtatggtatatctttcttaatcattttgtgtgtaacatataggaatattcatgtttaaggtgggtttcttgtacacagcacatccttgtgtcttgattgtcttaatccattctgaccatctctattttttaattggtatatttagactaggcccatttattgtgattattgaaatagttgggttaatatgtacatgtttgcaactgttttctatgcatttgttctttgtatatttttatttcccctctttttctggcttttctggctttgattgagcatttatatgatccattttatcttctctcttagcatatcaattatacttctattttaaaaaatcttggtggttgccctagtatttgaaatatacattattagctaatctaagtttatcttcaaataacagtatactgctatatgcatgctgctggtactttataatacagtgatctcaaatttttcttgtattacctatgacactgatattattcacataatttaccctcatactatatttacctaatacattgttactattattaaaattagcagttatataatataagaataataaaaacaaaatactttaccttcatttatttcctcccttgatgctcttcctttatgtagagccagatttataacctatattattttacctctgcctgaaaaaacatttcacatttcttgcagggcagatctgctatgatgaaatccctcaagttttgtttgccagagaaatgctttatttcttcttcacttctgaagtataatttcagtgaataatgaattctagattgatgttttttctttttttattgttacatgatagatgtatacattttaggggcacatgtgatgatttgaatacattcatagaatcaaatcaggataattgggatatccatcaccttaaatatttatcctttctttacagtaggaacattagcattattcttctctagatattttgaaatgtataatagattaatgttaactgtagtcaccctactaatttatcaaacaccaggccttatttcttctatttatctgtgtatttgtacccattaatcaacctcgcttcatcccctcttaccccaccctgcttggcctctgacaaccattaatctaccctctatcttcatgagattcaattttagctcccacatatgagtgaaaacatgtgatatttgtcttcctatgcttgtcttattttacttcatttgatgacttccatttccatccatgttgttgcaagtgacaagatttcattcttttttatggcagaatattaatctattgtgtatgtatgtgtgtttatgtatatatatatatatatatatatatatatatatatatatatatataatttttttcttaaccattcatccattcatggaacttagattgaatccatattttggctattgtgaatagtgctacaataaacataggagtgcagatatgtctttgatatattgattttatttctttggggtgtatgcccagtagtggaatgctggattatatgatagttctatatttagttttttgaggaaactccatgctgttttccgtagtggctgtactaatttacattctcacaaacagtatatgaggttttcgcttccttcgtatcctcgccagcatctgttagtccctgtcttctggacaaaagctattctaactggtttgagatgatatctcattgtggtgtttttaaagtaattttaacctttattttagattcagggggcacgtttgaaggtttgttatatgggtatattgtatgatgctaaggtgtggggtacaaatgatcccatcacccagttactgagcatagtacccaacagttagtttttaacacttgccctccttcctccctccttcctcgagtagtccccagtgtcttttgttgccatctttatgttcatgagtatccagtgtttagctcccacttaaaaatgagagcatgcagtttttggttttctgttcctgtgttattttgcttaagataatggccgccagctgcctctacattgctgaaaaggacatgattttattcttttttaatggctgcatattatgccatggtatgtaacattttctttatccaatccaccattgatgggcacctaggttgtttccatgtcattgctataatgaatagtgctgcaatgaacatacaagtgcaaatgtccttttggtagaacaacttattttccttggggtatatacccagtaatggaattgctgggttgaatggcagttctgcttgaagttctttgagatatatccacaagctgctttccacagtggctgaactaatttacatttccaccaacagtatataagcattcccttttctctgcagtcttgccaccatccattgttttttgactttctaataatagccattctgactggtgtgagatggatgtatctcactgatgcctgttcagttctcaataaatctcagctattgtattgttaacagtaacaataatgtaattatgaatcccagtgtaaattatttgatatataaacctaagataaagacatttattcaattatacatatatgaaatttgacctgatagctcttcatgaaacttataacctcttatctggaattattgtgatggtaaagggatcaccattttaaaatatatactcagtgatattttctagaaatatattataagcaacaattgtataaggaagacacaggaaaaaaaatcaagtttttcttatgaccaatgtcttcccactctaccatttctaagacctcagatactggatttcatgtactgtaacctatgagtcagtaaccatcaactcccaatatcatttcatttgtagtaggtccaccatgtatcaggcagacctttcacagtgatagatagtatacagaagctaccatgctgagatagcaacagtttgccataatctcatgaaacaccactaataggagactgctggcagagtcaatataatgcataatgtgcttagagacatttctgaaccaattgtaccagtcatacatctagcacagaatagataagtaaatggaaatattgactttgacacaggagacatgttttaaacaagaatacccaagctggataagatttgaggtcaattttggtaacttttaaaaatatccctgtctaagtattgtgacttttgtcccaagtgcacattactagtcactttatcttaggatacaggcaggtagctaagtaattaattcttaccaggcaggttctgctaagcctcctctggaagatgacctttttaaaatgttgacctcacatatagctgaatgatggatgtgtcacttactggcaagctcttttctgttttgatggggagtgtttaagatcattggacttgtagtccacctggtaaatggtgacaggattgtgagtctggatatgattgagcagtttagtaatatatataattttcatgactgtctgaaatctctagacaccttttcacttttgatcatgatttcaactgctgccgcctgaattacaaatcaaatgttagaacaatacatcatgatgctagaggcatagcttaggcatgccagcaagccaaatattgagttttgtgaggggggttgtgaaagacaactttttacctatttggaactaacttgaaagcatagctttagatttacaaaaatttaaggacacggggattgctattttgttaaggcttgtttagggacattgaaccttaaaagtctcaattttgaagaagtagtgattaatatcatttgggacaaacaaagattttagagatgaaatggtaggtgaccttgaatttgtaatttgtttgcagtgtatcccaattaagagcgtggaaaatctctggttaatatcaaatgtaagtactctacattgtaaaactggcagtaaagatgggaacatctctgtaaaatagttttatcaaatgagtggcttagtgtaagaatttgatttaatttatatatatacattatattttatatggaaatacaacaacataaatacatcaaatgtgctttcatcttagactctgaaaattggttaatgcctgaaaatttctgaagtcctggttgaggtttgctgtttctcaggtgacttagggctaaggatttataacttgattctaataaattctgtatgtaaaataggttaactttatttaaaaggtctcatgaaatttttaagtgattataggacttacacttaagttcctgagctaaatttcttctgtcttataatctgactgatgtcttcagtatgacctctagcttctgaacgtccattattttttctcccgtacactctagtttctctagtactatcttgagaaattacagaacaggtatttgtgaaatattggaagcatgtacatagttcctgtgttattcatattggggatcagtaaaagtattttaaagctagatgtcatagttttattcctctgtctcctcgatatttactccaaaaatgcaggaactctacaagaaccatggaagcatgctactatgtttgtgtttatatgtgagttacaagtcagtccctccaaacacccactccccaggaaatatacctggacatgttcatcatcttaaaactactctgatattatactataaaaataatgaattattcccttaaagaagtatagatgtgtctgagaaaataaaaacccatgaatcttcggatcctttaagaattatttttttggaatcttgatatgtcaagtgattcaaaatgtttgttatatatgtgcatgtttgtgtgttgcagacaagataattatatggagcaagctaattaatttattttttcttattaacaatttcttcatttactgaagggtgttttaaggtaaatatctttattacaactaaaaatgtactgaagaatatgtcgtaatattagcaagatttgcctaagcctgtataaccaaattggctaaaacaaatatatacactcttaagataaactaaagtgaagtttaagccatacacatattgttatgaagtctaaatttttgtaataagaaataggaattcatcactggcaagagatttttagttgtaaatgcttataaacattttgcaggtatttaaaatcccatttagttatataaatcattctgtggaaaataataaaattgtgtaagatcagaattgttccagaaacctaggatgcaggttactttttaaggataactccagaggcaaaattaaatatactcattatcaggttttatatactcattaatatatgtatatgtaacattaagaattgcatagttttttccatttataccaagggaaacaaattggagcttttaaataaagtctttgatttattatattttctccccacagataaagaacttttgttctatttttacctttgtgattactgcataaacatagtgatatatatatatatatatatatatatatatatatatatatatatatacatgtactgtatctacaaatgaaagaacatttaatggaattaagatactttatcagagaacagtctatgtttactctataaaatactacctactcaaattatccttttatattctcaatataaaaatgatgaaaacaaaatctacaaaatgtatgaagataaccatttgggggttttgtttttagtttgttcaaatggatactttactccactgtggaaccagtgggttttgtccctgatgtaacagtgatatttatataattaaatgactatttttgaaaatgaccctcaagataatctatacctgcttcttccttataagtgaggaaactgatgtctgtgacgatgaagtgactgacttaacggtatgcatctaattggttgcagagcctggattaccacttttgatgtttctcacttacctgagcatcagtgacatatatcatttggtgcaatgctggtttacaccactcactgcttcatctacctgccttgttattcaaataggaacaacacattatatcatgggattaatacaaatagtaaatgtacatattagtcaggaaatcagaaatcatttcaggttttttaagtcggaagagtttcaacttaagaaattagagaactacataaccaatggaaaaactgaaaacagagaggtcagggaagctagcatttgagttcacgaaatcagaatgttggatgatcaggaagccattgctggctatatgtgcaccaaagtgggtggttcacaggaggagctcactcaggagctgccacggactcctcatctgtcatctgattttgctacagctgcccttggaaactaatggcccatttttctctcaacccccaaggaaagtacaaatgcttcgagttggctgaaacagttctggaatatacaaggaaaggagttacagaaaatgtagttacaggtttccccttgtgatagagagtacaaaggggccgtaatgatgctgagttgacaataggcaacatataaaccagcatgaaataataacaccggacgctgtcaagcacagagaggtgtttggtaaaaaatattaaaagaaatataactaaagccaatgcctgcatttttaaaagaacaaatttaggacaaattgaaacattttaacttgatttgaaattatctaaccaggaatggttaggcatttacttgaatttagatttaattaatacatgcacatgtatacatataaaagttggagaagtttcatgatagttcttcttgtttgtggggtgtttgtctgaacattatctatatttactttgttcctagatttttttaatggagaatatccattcagtataacattcaaaggttcttgggattaggatgtggacaaaattgagggtccattactcagcctacagcagaaattgtagttccagtaacagtatgtaaaattacaaaaatcttttaagtttcccaaagacatttctcagtgtactagaacactttctaagcagtattgtcagtgtacacagaaatgcagatatgtatggtaaagcagtacattgtgatgtgggttatttggacttgagtcattttgcctagacaaaaagaaacttttttcctttgcaagtaatattaccaaaatatttcctagcctcatttgatctctaagcttcaccacacccctggctttcttcagccctagtgtaaggtgagtaatgggttgtgcatgtaaagataatgcgtaccacggtgtaagggccagaaattgggtgaagtttactgatggaaggggttatttcttacacattgcttcagttagcatccttttggtcagaagaaacaaaatctaaatcaaattggcctaaattatgacagagatgaatatgtttattatttaaccaatatacacagacacagggtcggctttaagcgtggttcatagtttgagttagaggttttgatagcattaggtctccagcttgattcctctgtgattatgttggctctgttccctgctttcccctcccaccatccacttagtttgttttggggtgatatacgattgacttggaagatactaaactgtacacaggaagggttccctcaaagagctcctcatcatgtacattccagaactctcctaaaaaggattcatctgcagtctcatagtaccttgtctgcagtttttccttaacctcctttaaatcaaattttatattagttctctgtgtacacattgataatgacttgttaaaccagggtttagaaagcagttgcctgtggaacacatgtggcccacagcgtgtttttgtgcagcccacaagctaagaaaagtttttccagtttttaaaaggggtgtagaaacaaaaggaaaggaataagtgactcagacctcatgtggcctgaaaatcctaaaatatttgctatctgaccttttatagcaaaaggttgccaacccctgtgttagactatcagatacaaggaactgtcttattcctgacacattgctgttgtgcctaatgcagttgtttccacatagtgctgtcatccttaaattgttcttcccatctaccctccttggtcaagcttttctgtttcattcggggaggacatgttgccatgggatatcttattaattcaggaggggaagacttgtgggagatggctggtggacatagatgagataaaaattctcaccaatgataaagtatctgggaactaaaaggaccttgaacaatgccctgtccaactgcatcttgctacagaagaagaaataaggacaagggatggaaggggtgtacccaaggccataggtcataatcagctgctaaggcatcatcaggaccctgcatcttggtccagtaccacttccaccaacccctgttattttttgtgacacaacatcttttccttataaccaactcagatatataccaagctgctgtatccatgcgaggaccatccgagactgttcttttaacccaagagtttcccagaattccatagttactgctgaaaagagtgagagtgatcaagaactttcttaaaaggattttctctttcattgtgtttcattttcttcaacccatctcataatacctcttgagatttctatagtcctttaatgctatgtccttgttccttcccggtagttatatttcaatggccctagcttcaagatgtctttggctgctttctaggagatctcgttgatattatctcatttatttattgaataaaggtggtgacaaaaatgtaccagatcttgacggtaacttatgtgattgttcattcaaagattgctaatggcctgttaaagcccttagatttattaatttcctcatatctcattctccttgattgccctctcattccaactattaactggctttgtaactatagctattatggtacttcagtctccaacttgccttccgatttttctgatagctccttcccccttcttagttctaattttttcttccaccacctaagtatgataactcttagtatatttatttcctattactgctgtaagcattatggctaagtgacttaaaacaacagaaatttattgtcctagatttctagaggtcagaagtccaaaatggggtatatgggttaaaattaaggtgtcagcacaactgtgtacttttggaagctctagggaaaaattaatttccttgtcttttctagcttctaagagaggcctgctttttttgccttgtggctccttcctccctcactccaagctctgtttctgtaatcacatctcctttttctgactttgaccttcttgcctccctgatcacattgggaacactggaagaatccagaataatcttcccatctcaagttccttaacttaatcacatcagccatgtcctttttgccatgtaaggtaacatgttcacatattctaaggattaagatgtgtacactttgggggccactattctgcctagtctacttagattgccaccattggatctcagttgcattttatttttcaatcttactggtaccctctgcctgtttaaaaatgtaaattgttttacaaaagtatgccttgattcataaaggttatttatttgcatttcaaacttgttttctgtaaaattattccaatcgattcttactttaatttacctacacctcaatttaagctcctattaccacttgaattgattccattcaaataatatcatttgaccccctgatttcatcatctggaccatctgggtactccaaaagagtaacctaaattacttttcaaagtttttccctttactttatgtattctcaacatactttattctctcccattgctatgctttttctttggtgtctgaaattccttctttgaaaactctagtcagaatttcttatcattattcaaggtctgtatctcaatggtgacttcttcaaattaataattatttataccacaaatcctatgtgtctcaaccccttttaaattctgcccttccccctattgaattttgttattgtatctggcagtagtcatttttctttgctttgtgttttatgtaactgtgtagtgttctgtcctatcctcctaccacaccacccagggaagagaaaacacatcctgcccagattcatatctcctaagtcctgctccgatgttttgtacatcaaagtataaataatagcattactgtgatgttatttaaaattacactgtatgtggctgtgctgatttaagatatgtgttgaagaattcacctgccagccaactatacctaaatgactgtctcctgaatttatttcattaggagactttttctgattttaagaaacaccttctggcatagcttctgagttatttttgaaaaccctattatagttatgttggatagatcaagtaatccagggtatgttatgcaacataccctttctgtatttgtgtattcattagttgcattcatattgactgagaaacactgtgccaatgttatgaagggtatgcagatgtgtatgccaaggtggctgtcttctaaaagcttccaggaggatatgttccactgtgacttttccaactacacaacagcagaattctagcatttagcatgtttgtgaaactcctagaggcaattaacacattatgtgacagaacctagctccttaatggtattaaaaatgcttttttgaggccaatgagaacttgatatacagcaggataattctttagaagtatcttttatttgacatttattagaaatgaagttgtcatgaaaaggcatggatgtttatatgctgctataagatagtcatctcagcaggcattttgatcagtcattacctttgacagagaatggcacaatagcatgagagcctgcagagctttctttaaagatggttcatataataggggcatcgtgatacttggagtattaatccaatattgagggaaattccgtgcccctaatgcttgaatatctatgcagattttggaatatgtcattttcagtagctttgacagatatgtaaataaccatttccccaaacttcataattgcccatgtcattaatttttctttttactgttgcagaacattttcctctttacactcaagaggataaattattattgtggttccatttcattggaaagcatacacctgcatatttgagaatctttaacatttgaatgtataatatataatataattaagtaaatcttcaggtattgaaaatgtacttttgaataatcacgttggcctcctgataataagcagtgaatagtaattgattagattagtatgctatttttttgaatatagtagcagtgactcaataaggtttaattgcattcctgtaaacatatggatggttcaagaattacttctttgtaaataatataaattggtaagactctgaagtgaatgacacagatttgatatagtaagacatttgaatttcagcttctctgagcactgatactatttcatcattgaaatacaaaattatggaaatgctgaggaagaatgaatgcttatttataggcacaaatcaccaatattaagctgttatcaaaatctttacctaaatttgttggttgcaaagttctgtaataggcttaaaaatgtgcagtgttcagaaagtaaattcttatttgatttgccagatgcaaataatgtatttgttacgttcattcaattattaaagaaaatttatatcattcttcctatcttgtagggttgatatatattacttggaaatgtgagacaaacgaaatgagtgtaaaccctaagaatatccattggtggactaaaatgtaaattttaatttctgtattctcatgtagcttaactagcatttagcatgtttgtgaaactcctagaggcagtttccacattatgtgacagaacctacctccttaatggtattaaaaatgcttttatgaggccaatgatgtacaatgtacaataatgtacaatgtttatatacattgacttgctaatttattaagtatccacattttagcctcttagacctactctgaagttgacttaactttcaagatgaacagtcatttttgacaccctgccatccccttgcaacagagaaaggtatcctgatttttgtgattctctggcacctaatagatgcctcagtgatatagtgttcttatgggaaggttatattgtattttaaaacatgaaaataccagaacagagtcaggatcatgaagccaactctttaggggggtacattagctggttctaaaaccttttacctgtagaatccctattcttgctcccagatgctatattgttattgcagacatggatgttttagctccgttagcactggagacaagcttccctacaccatagtagtaatatagggagagagaaccagtacatcttgtgtgaaagtttctttgcatattcaagtagtttcagaggcagcccaattataagaattaggtctataatcttaaatatgctgtaaagatcattaattatctgtgtaaatattggagaggatcagcatggataattaaattgaatttatttgaacataggcagttttcacattggctgttgaagttgctatttgtgcaaaatatataatttactataattaggacactttctgagaagttttttttgatgtgccatattttcatgctcagcagaaatacatataaagcataaatattttcttcagctacatatttttatttaaataatctccattattttaaattcctaaacatttatattatttaaaaacctgaactaatctcattcttaactaggtttgtaggctgggagtgtcagagctatgtataggaaaatttgctgtctttttactcattagtctaatcaagactagaatagactacgttgagtgtttactcatattacagatgggactaaaaatagaagatttccaaattacacatttaatatgaaacaggaagtgattttgatgtagactatgtaaaagttttcttctgactttattaggttattttttaattcataaaaagaacccccaattgtcttgatcttttttctaaaatttgaacaattaaattttacctttacctacagtggctgtgaagaggatctatattacgtggtagttatttgtacatttaattaatttctcctgtcagtaggactgaaaagttttattcatttatttgtacttacagcaaagataaagttagagaagtaattaaaatgtgggttgttttgctttcccacaaatattgaatgtcattgacatttttgtatctcttctgttagcttaattaagagttgaattattttaagcaacagttgtatgttttagtcattctaaaagtttaatctacctgtgaaaatccacttttcacctgcggtattatgtcaaattgttttctctaataacacttttataagtacagtttatctctccttagcagtataattttgcaaatgtcttgaaagtttctgatttgtatgtgtctccactagtttactcttcttttttttgacctgggactagatcttagaatggtctgtacatttagtaatactcatcattttgctacttttagagctacatcctggtttcattgtcgtaaattgaaagataaatttagaattcatcttgccaatgagttcagacaagaagaacatcaaagtcaacatttaatgtgaggaaattgaatataaactagtacttttcatgaaatcgttatatgtgaacatcagtctatatgaagtcccatctcagtgaaatatctaacaaagtatggcctgttaatagtttcactatcatttcaagtaattttaaaatataacacgtttctagcattataaaataatttagaatataaaaggctcctttccatgtgcttattgccatttgtatattttctttggataaatttcttttcaaattctttccccatattttaatttggttgacttgagagttttttttagttgtccctagactatttgttgaaaagattattatttcccacattgaattgtcttgttagccatatcaaaaatcagttgactgggatttctattacctcaaacattaatcgtttacttgtgttgggaacattccaaatcttctcttctagctattttgaaatataaatatgtacaactattatttatcaataaaaaatcaattgactataaatgtgagggtttattttaggaccaccgatgtctgttcttttgttcataccacacactcttgattactgttgctttccagtaagttttgaaattgggaaatatgagtcctccagttttgttcgggttttcaagattgtttttgctattcttggtcgctggtaattccagatgaattttaggcacatcttgtcagttttggccaaagcgatgctgagatgttgaaaaggattgccttttgatagggattgctttgtcaatcaatatgaagggtatttccactgtaatagtgttaaatcctttgatccatgaaagtggatttatttaggtctttaatttctgttaacaatgttttgcagttttcagtatacaacttttgcacttcttttttaaaatttatccataagtgatttattatttttgatattattgtaaattaatttgttttcttaatttcattttcagattgctcattgtaagtgtatggaaatcaaattattctatattaattttgaatgctgtatccttgctgaacttggtttttagctctaataggtttttcatgtatatgtatagattccttagtattttctgtatataaaatgatgtcatctgttaatgcctatagtttttcttcttttccattatagttgcctcttatttctttttcttatctaatttccttggctaacgtctctggtacagtgttgaatggaaatggtgagtgtggaaactcttgtcttcttcctgatcttaggatccagccctttaccatttagtatgatgttagttatggttttatcatagatgccctttatcaagttgaggaagttcccttctgattccaatttattgaatgctttatcatgaaagggtgctggaatttttttttttttttttttgagatggagtcttgctctgttgcccaggctggagtgcagtggcacaatctcggctcacttcaacctctgcctcccaggttcaagcgattctcctacctcagcctccggagtagctgggattacaggcacccgccaccatgcccagctaatttttgtatttttagtagagacagggtttcaccatgttggccgggctggtctcgagctcctgacctcatgatcctcccacctcggcctcccaaagtgttgggattacaggcgtgagccaccgtgcccggcctggaattttttcagattttttttttcatcttttgagatggtcatgtggttttggtttcttattcttttaatatggtgtatgacattgattgaattttagatattaaataagccttgcactcttgggaaatattcctgttggtcataatatatgctttttatatactgctggattctatttcctattattttcttgaggaatttgcatttatatttattagggatattggtcagtagtttttacttcttgaattgtctctgtctggttttggtatcagagtagtactggcctcatggaatgaggtaggaagtttatcatcatctttgatgttttggaagaatctttgaaaggttgatgttaattcttttttaaatgcttggtagaatagaccagtgaggtgtgggaggtttaaattttatttgtgtcaagttttaagttactgatgcaatgcctttacttgttacaggtctatttacattttttgtttttgttcttcagactgaataagttgaattaatctattttcatgtttgcagattctttcttcttccagctcaaattggccatggtgtatctctggagaattttttgctttagttgttatactttacaactccagaatttaaatttgcttcctttatttaatttttatctctttattaatattctctggttgatgagatacaattattaagctgtcctttatttctttaactatggttttctttagttatgtgcatattcttgcaatcgctgatttcaagtctgtctagtaggttcagtacttgggctccctctgcaacagttattattgatggcctttttcttgtgtatgggctatacttttctattttgtgtgtatgtgtctcaaattttttttgttcaacatgggacactttagatcatataacatggctactttggaaatcaagtctgtcctcctccctgaagctccagggtttgtgtagttgtttatttgtttagcaactttccttaactaattttgcagagtctgtattcttttttaaggcacagccactgaaatatcttcttggctaattcattgctcaggtaatgattgagaatttttaaaaatgccttgaaccagtaattctcccaacctttgcccagggtttctctctctctctctctctctctctctctctctctgtgtgtgtgtgtgtgtgtgtgtgtgtgtgtgtgtgtgtgtgtgtgtgtgtctgtatgtgtaagcacattttcaatattctggcaatttacaactctgccttagccttttcttccaacttgtgtagaggtgggagattaaggtgatctcacgtcttttctgggcatgactatagctctgaacttactcacagcctactagatccccagaaatatttcagagctttgcaaggcctcctatgaccatctcattttatagatttttcttttacattttttgtctatcttcttgtttgtcccatgtggcttcaccacctaaggcagctgcaaggctaaataattgagactgatagtttttgccatattagggatagaactttcctcattgagcaaattctgagtcaggtgaaataaagagaaattcttgaatggggtttttcagccagctaccagagagataaaatagtagtagttctctggggatggagctttgtgacgagctccaaaccagtttgtcctctttattggctcctaggctattgtttttttcaaggctaatacagacttggggaaagagggatggaaatagggaaagttaaaatataacagtgtttgttatttttactaaaagtcagccatttttcttgaataaatgctgttcagattgttgctagattttgtttaattttcagagttctgaaaaagttgattttgataattttctggatttttttatttcatggaaacaagaatttcagagtttcatactccactattccagaagtacttctcattttaatatttttgttttctttatgatataatattttgacaatttttgattactttgtacttaactttttaaaaaagctattaatggtttcagttttttaaataattacaatagtgcttcatatgcttgaagtacttattcttttttattattattttatattgatataataattgtacgcatttattgggtatagtatgatattttgatacatgtgtacaaggtgtaatgatcgtcagcgtaattagcaaattcatcaccacaaacatttatttctttatgttaggagcattcaaaatctttcttctagccatttgaaaatatacagtaaattgttaattctagtcaccctgcagtgctatagaacactggaacttattcctcctatatcaccgtatttttgtatctattaacaaacctctccatatcctccctccctcctacccttcccaacctttggtaatcactattctcctctctacttctatgagatcaatgtctttatttactcgaagtactcttaaaagtttaggacttaagtatttgaagaaattcacttgctttttgtttttattctactcaatactttttaatataaagatttacagtcccccaaattctcttttcagaatcttaatataattattcatttcgtcctgaaaactgtttctttccaaaattaaacatttgttgtcatttaataaaaataaaccagaagtagaagagctggaaaatccctccaagttcatctgaactggagaaaaatcaagtctaaattactaaatattttgaaaagtacagagttttattacagtaaactttgacaagttgcctttatttggaaaagaaataacctatttttctatattctattttagagaattaaaatacatttaaagccttatattgggttggtcaaggttttttttttttaaaaccttagtagtttatttttgtattcaaagtatcttccagcatgtctgttaaatttcttatttttttcaattttttttttttttttttagattcagggggtacatttgcaggtttgttgcctggctatattgtgtgatgctgagatttgggatacaaatgatcatgtcatccaggtactgagcatagtacccaacagttagtttttcaaccctccctacccccttagtaggctctagtgtttattgttaccatctttatgttcatgagtacccaatgtttaacttccacttataagcgagaacatgtggtacttggttttctgttcctgcattaattgacttaggatgatggcctctagctgcatccatgttgctgcaaaggacatgatttcgttattgtataaaaaaccatacagctgcatagtattccatggtgtataggtgccacatattccttatccagtccaccattgatggggcacccaggctgattccatgtctttgctattgtgaatagtgctgtgaagaacatgagggtgcatgtgtctttttggtagaatgaattgttttcttttgggtatatactcagtaatgagattgctgggtcaagtggtagttctgttttaagatctttaagaaatctacaaacagctttccacagtggctgagctaatttacattcccaccaacagtgtgtaagtgttcatttttctttgcaaccttgccaacatgtgttctttcttgacattttaataatagccattctgactggtgtgagatggtatctcattgtggttttgacttgtgttcctctggtgattagtgatgatagcacatccctttagatcaataccaattcaatataattcaaatatctatatttactgaatgttatgatgtaattgagtttcttcacaatctccacaatcctttagaaaatttctaagctttaactaccttctatagatttcatgtacaacatgtaacataataagggatagcagatgaatggacataaaaagcaattgggccttttccccgatatttcatgtgcaactaatgaaggagaaatagactttgatttaaaatctactggtgacttttatgtaatgtagtgggcttgagaaactttcagtatttatgggttcaaatatcattttataattttaataatgcatttatgtaaacattaagttaatgttttctgaaaagtacagcatgtatttaatgcaataaccactttcaaattatttattgaggtgaagttttcttgtaatgaaatgtagatcttgagtgagtaattcgttaagttttaataaatgtatgcatatgtgtaactcacatcctgattaaaagattacatttctatcactccacatctttacttcatgctccttccagccatttcctaggtacacaccaaaggtaaactacattctgatttctattaccatcaattaattttaactgctctagaacttcatataaatggaattataccgtaggcaatttttgtgtgtatcttcatttattaaatttaatgtttaaaaaattcatccctcttgttaggtatgttggtttttcatttttatttctttattgagttttttcacataaatacacagtaattttttattcattcttttggaatggagatttttttggatatggcttcaaatttgggactattatgaagaacattcaggctatgatttttcaaaaggggcatgaagtttaaacaaaaagccttcttataattctgtagaaagtgggtaatgtgtgagtgtgtatattatgcattaatatgcttacaaaaatgatatatatacacacatgctaaatgtctaataataatagtaattataatgacaagtaacatttgtttatgttcgctttgagctgggctcttgcataagtactgtacatgtttcattccatttactcctcacaacaatttgtaaagtaggtaaattaccatattatctctgacaagtagactgtgcattttggaggataagtgatttgcctaagatcatgcgcctagggagcggccaactggggatttgaaatctagttcttacactgtcaggcattgtactatgcctgctacttcctaatagttaacattatttgagctccactgtgtgccaaatatctgcatgacacacacaaacacacacaccgataatacagtgtagaaagataatctatgtaaagattagcaagggtgcagtggaagaataccccacatagaggtcatttcctcttcagaggattaaggcaaaggccaccaaagtgacttattagaggcagaagccagtcagaagaggtataatgtttgacctacaaagggcttaaaacttatattctgtttgttgccaacatttaaaaattaggatatcacgttaatatctggatttctggcatcctcctacacatcatgatatctgaaaaccttgcccattgccatggtctgaagctgaccctcaactacttcccttgggcctgcagccagccttgatggcttatgctttctgaagagaggaatatgagtttatgaatattaaataattttttgaggagtggctttaagctttaccttaaagaatttcaatagagatttccaggctgtgtgagggaatagtacaatgcaaggaaagaatggcacttgctgggtgagctgaaggaataggaattaggtgggaactatctcgattgcccaaaatccagcacagtggggggaactaatcagaacataagatctgaccttaatatcttaggaaattctatgttttgaaagcttttatagaggaatgacaaaatcagagctttaattttctaacaggccaaatgcagcctaaacattgcttattccagaaactgtcatttaagtgtggttatttgaattgaacatataggctgaaatgcaataaaccgccatttttgtaggttaaaaggaataaagtatcaagtacatgcagtttggcattacaagtttgcctagtagcactttaaatgagtcactaatttaatatattatttcttttataaagttcatttatactttctgaaccaagacagtggagctggtacaaatatacactgtaatgcctccctatttgttgtttcctttaaatctttaaaatgtgtttttatatttgttttttgagatgctgaatttccataatatttattagaatattatatgtattgagatgatatttccctatgttagggagaaaccatttgtgttatataaacaaacaataaagttgtctaaaaatagaagatccttttggaaatgttgatgcctaaaagacaaaattatgtggatgaacatacgtaagcttcagtgagcttttcttgtactaggcatttagctgtcttgcaactgttaatcagcacaggccttaaaacagctgctatcagattaattagagggaatccaggaaataattcaactgaatgtagcattcatgtaagtgtgttgaaggcaattaagagtaactatagtcattactgagacttccaggaagtatgccaaagggcttgaaagttataaaatgccttttgcttcccaattttatatatatatatatatatatatatatgacagagagagagagagagagagacagacagacagagagagagagtccatatataaacacacactaatagcaattaaaaataaataaaattgaaaagcttgaattacagggtgttaactcacttctctctttgaaattaaggggccaagggaaaacaagaccatttgtctaaattcatttagaaagaaaaggatttatttaaagatgctgtggcagataaaattacgtttcatttttgtaatcctagttttcatagccaatgaaaggcttaaaataaaggaagttgatatttcaccaaggtcacacgatctacgagaaggaaacttaagaaagtttcctaatgcgggatttaaatccttaaaaacttgctgtggtcatcatcggcatcatcatcgtcatcatcatcaccaccaccaccaccaccactgctgccattaattattattattatcatgacacaaaggttgattacctggcatctcatctcatttctactgttcttaggtttcttgcctgtcttactgaatgacagtatgttactcaaaactcagcatggcaaaaaatctgggttttttaaaaccaattttgcctgtggttggcaccttgaaaaaaaacgagagaccaagaaagagggagccgaggatgggagtggaagataaagatttaaaagaataagtattgatattcttttctctttatttttaagtgacaaaacttatatatatttatggcattaaatatcatgttttgatatgcgtatacattgtggaatggttaaatcacactaatataggcattacctcacatacttaatatcattgttttgctatttaataggtctaaaagctgaagtcagagaactcatttatttatgagaattttggtgtgcaactgcattttgctatgtgttacagtcttttaacctacttccaaatctcttcttaaggatgagctagaaggagagactggctgacactcctcatttttgaagccttggcttttataaaaggggccttcagtgtagcaaaaggcctacttataattctgtaaaaagatgttcatgtttttcaggaacgtttgtctctatttagaaaaaataaaatgtagtttgggaatagcggaaatgattgattagagtgttacacatgagacaaaaagatagatgggcaataccgttcctgtgttttcatgccctgttcctcataagcaacagggcaagagatgataattcccaggagaagcaggagaggcttctggatcatgaggtgctattctcttacagaggtgctaccacagttactaggtactcattccacttcttttttttttttttttttttttttttgagacttattttgattaccaggcctctggtttaccaagtgtcaagcccaccacggtcccatcttttccttatctccctcttcaatattcctgtctaccaccacccttccctcacccacatagcaataccacataccatcatttttctccaagccccatctcttaccccttgcaaactctgccattgttttcatcccagttcaaatttcctccacacaataaaatgttctccccatactgtgacttccttgaccttacgttttcctaggtgttattatcttcaccaaatcactaagtgtagattatgtatctttgagtgttcatggattcatgtggttagctctactttagcacgagaaacaaatgccctggaatcactctaggaagaacgttagttgctatgtggaaataaggagaaagaaatattttagggatggaaactgtatcacagaacttcagtttttgaaaaactggaaggagtcttagaatccatcccgtctaaacccctcatttgagagttctagaatctgagagccagagggcttgcacatctggtaagtaatggagtatattcttttgacagtaagtactaaaaattaggtcttgtaattccctggccagtatactttccacaacactacacagaatctaagctttggcttatattatttgaacaacttgaacaaaaatgaggtaccagattttgacagctggaaataaccggaagtaaaaggggttagtattccccaaacaagaaatagacgaaacaaagatgcagaaaagagaaatgagtgtggtcctgttagggaagaacatatgggtcagtacaccatatagtaccaaggctgggtaaaaggagtcttggtgaaggcaataaaaggaaatgtttttctgctaaagaaattaaaagtaatattaaaacaaactcgggtttttgtcttccttttttttgttatcaccatgacctggcaattgcaaacaataccagtgataaactattcctccttgaaaaaaatactttataatctaaattctaaatagtatctgctgttataatcagtatttaataatatatgtataagcattaaattaacccatatttattatatgcttgaataaacattgaattctacttggaagtttactaggggaattcctaattgtaatggtgtctctgacacatgcacactgaaatacgcacattaattttgagagtaaatttataaaaatttcaaatgattggagcttgcttcagaaggacttcatgtctccagctcctatggcactacataatcctgcatttaaacagaagctttgaaataaaccatgtgaacacattgattataaaggtgaggaaaaagaacttgagttagaactcaaattagaacttcgttctattgtgttattctgtgcgaacacttggaatttttatatgtgcttaaagtttaaaacgatgaaacagtgcaaatgagttataatgtttttggtaaatgcaaatttcaggttataaattttccagaattttagtaatatctctaacattgaaatttgaccttcttgatgctagaacctataccaaactgtggtggacagaatttactgtatcctaagcaaaatatgcttagaagtaaaattaatattacctatgttttttcttatatttataattttataaatctgttgataattaaaattaatgaaatgtatttcatgatttagatggactttaaaatatgactataaagcatcatttgtttagtgaaacaaaatataagtaattggacactattttgaaatgatattttaaaataataattacttttaattatatgtgataccaaatttttaaataaaatgtctattgaacagctagtgttcaaggcattgagcaaatgcatgttgacagtgagagctacaagccacatctaaacatcaaggattaatccatcatgatgatgaaaaatagatagcaactattatcagtacatatttttaaaaaatttatgactatttaaatgggaaataatttgtttaagtttttacattgcatatttcaacaacttgtcttgataaaggaaactcaggatgtaagcctgacacccaaagagagttggagggaattcattcattaggaaaatataaggaagaaatcatgacatcagttacctctgttaataaaaaaaatcagaaaagaacaagtaagtaaagtggcattttagaatatatagtagagtttaaaactgttaaatatttgagcataagtattttgctttgagagagaagaaaaaaatactacaccaagtaagaagtgctagttgcgtctcttagagtgtaccaaaacgatattggacattggagcctcgttatttgtcacctgaagatgactcatgggaatagaattctaaagcaatggaaacaggcactttatataggagtaaatatcacaaaacacatttttaaactcattattttgaaatatatacttaaagaatttgcaaaaatactagagttcacccatcttcctctgatagtggcatttcgtataaccgtagtacatgaacaaaatcagaaaattgacattggcacaatactgttaccttaatatagaccttattcagatttcaccagcaagcacattttttaacactaaaactttaaaaggatttaaaatatatatcctgtttttaaatcttattttttgtgagtccatagtaggtgcatatatttatgggttatgtgaaatattttgatataggcatgcaatgcataataattacatcagggtaaatggggtatctatcacctcaagcatttatcctttgtattacaaacaatgtaattatactattttagttatttaaacatgtacaattaatttaattgatttaattttacatttaaatattttttgtggataaaagtatttaaactaaatttaacttaataataagtatatatttctatactcattttctgaatatgagttataagatggttggactttatctctttattctatgtcttaaaagacttaagcttccgtgtctaagttgtacttcccaatggagtcagaatcactgagactagaacccctggaagctagaatgagacagatacagtagtaactggagctgtggggaaaccttaggttatatcctccaaatcatcttaacagcaacaagtatggaacctaatttccaatggaaatatgttttatatgtggtcttgtaaaatagtcctgtttatgaacaattctatttcagtacgacaatagacatactgaatattaaaccttaaattccagcagagaatttcagaggaaaatatttttttcaatataatatgaaaaatagtgtcaatgtttgtcaaaatgtgactctttgaatattctaatatactaagcttgaaggaaaactataaatctttttgaaatgtcttttccattttttattttagcaaagtatgcaatacttaatattccagtagtctaccagtagacaaatttacacttattatgttcaccacaaagtcttttatgactaggagattcagaacttcttataaatcttataccataatgcataacttagaataatttacataagaaaaattcaactcaaagactaaacagataccaagaataacatattacatatctaaaattagaaagcacacagacacattttagagataatagcaaaagctttttagtgcacaaataaagttagtagaagaaaaacaaggtaaaatgatacatatttttaacattacagaacattactaagaatacattgcctaaaattgatttataaacagagaaaagtcttatgctcacaacccctctattttaatataaatttaaaaagagagaaattgcaatgaaattgataatcatcatataagccatgatttgcacctttggtacacatcataattgcttggggagtgattttggaatacaccagaataaaacctggtaagtggtagtttgagataaatcaaataaaacacatttttttttctataacaaacaaaaggccaagtctggaatcattggtttctgtatggtgtattttatccaggactggcttatagattatttaagagttaaaattatgattacatggtcacatatatttgactttagacacttttaaatttagctatatattttaagtagagattcttatgaatatggaaataaaataatgtacaatggtatgataatctgatttatctaaattctgagttctagacatgccagtgagctacactggtagtaggactcaaaagtgcattatgtagggaaaaacatgatgaattgatttcttaaatctttctcagctagtggtcccttagtggcttaccctggtttgtcacctctcccatgatatttatcaatacttatgaacattttagaacctttctagccataatttggaacctaaaatgtttacctatgcatgtacttcaaggataaatatgttatgattatgttatttgaaggacctggctagagtggagcctacagctgaagtaaccagagttgggagggtatgttacgatataaatttcaaaaaaaaaatagttttaaaatatggctatgtaaaaataacttctattacttgtattttatgaacgattcaacctgtataaaaaatatagttctgtggaaaaagtttgatattagagagttctgttctttaatctctgccacattttcgctaaacatcttttctttgacctcggccaaattccttaactgttgaatctcctggggtgcctgtgagaattcaaaatgcacctcaaaacagcctaatacatggcagacattcagcaaatgttccattctcctatcccctaattatcacacaagacaattacttttaatctgtacatattgaggagctttgcatgttgtggacactttgtcaatattcgttgaaggaatgaaattgtggattaaatttgctgtattataaaactgatatcttttacttaataaaagcttggcagtatgaattgatagaaaatgagtaagtctatttatttggtggtaatgaagattactgggataagtttccaaagcaagttataaaatattgttccattaaacttttaaaatgggatttgttttcctgctttttgcctcatacagaataagtatggctctgtttcaagattctggtgtgttcatgatgacctctcaagatcaattctgaatcacagggagaaaacgttgaaatgataaagacatggatactagaaatgcaagcaagttatagaccattttatttacccatttttttttttagctcaagcaatttcgtgtcttatatttatggataaagttgaaataaaatttccctttttttctgttaaatattaagagtctggggattagttatgcagcatctatttatttatttctgtcttataaaaattatcttaaagggcttggcttaatttctataccataaagaaaaaatgtgtaagataatccctcgctatcgggatcattttcttatataattaatgagctgaacgtaaaagataggtgaatctacaaatttatttattttctgtcttataaaaattgtcttaaagggcttggcttaatttctataccataaagaaaaaatgtgtaagataatccctagctagtcgggatcattttctcatataattaatgagctgaacgtaaaagataggtgaatctacaaagaaaatgccccaggtaccatccattaaagcatgttgctgctatatgtgcaagatgtccagggtatggcttccataattataaacaatttactatgtctcaattattatttcaattgttaattcccttgtctctggattgatgctttagtgcatcatttattgtggatattttggataaaatgaatctttggattttgtaaaaacaatatttcaaatttgtatgcatctttgaagtctaaatagcatgttatacaaattgaaaattgactgtaagagttgctacagattcaaattttatgtagtttattttttatatcttgatttgtgaagaaacaaaaaccttaactttgcttggtggcaagaacaaggggattagaacatgaacacacaggatattcagagcagtgcgtttgtaaggcatgccttatttgagtttcaggtgcttgctcattaagatgaaatttttgtcaggcagtgtgtattgggagtttgctacttgaaaatcaatagtctgcattctctgccttattgtttcaatagcctcttaactgatctccctgctttcgctattgagctccctgctgcctagctctttgagctcatctcctaacacttcccctctctccagccttagtaaatgcccccacccacatccatttgtgatatcttttcattttctcccaccaagaggtggagtttaagctccccctttttgaatggcatatgaccttggaaattcatatggtcggaaattcaaatttcccaccaaattcccaccaaagttcccaaaaaaggtgggaacggaacgtaaacccccaccaaatttgaatttgaaattcaaatttggtgggggtttacgttcccaccttttgaatgccatgtgaccttggtaatttgccttgacaaatacaatgtggtaagattgacatcatgccatttctaggtttagaccttaggagaccttgaatgcttccatttattctcttggaaccctgctatcaacagatgatgaaagacttaacgttttactcaccccattcgacaggtggccaatcatcagacatgagcgaggccattgtagaacaagaaatcccctaatcttggctaggtttcctcataggtctgggttagctgttgtgggtactcatgtcttactttaaaatatggttatttaatacctctgtattgttattcctctaagaagatgtaataagtcctctggaagatatgacattaatggacttcgctgaagttttctgtgactctttatgtctcttgacataaaagacaagaatctctttaatagaaacaaagtatttgtctctatatttttatggttgaaaatgtgacttaaactagctacaatgaggaaagaacatgttacttgattgagatatggtgtttcctttagaaaagagaaatgcagttcttattgatattgtcttactggcattgtgtacagtttgatagcattcagtattgagtcttttgtgtcacagttcttgaaaaagctttgattcttgttttaagattacctatatcttgagtgattttgaaagcaagtgccaagaaaagatgttctattgatgtatacatgacaggtgaaatatcacaccttttcagaaggcttctctggtgaatttaattccaaagacaaccagagtggaggtggaagtaaaagatacgatttgtcatgttattataagtgcattacaaaagtaaagaatcatagcccatgcaggaggaatgatgtagggtcttgtttattagacatttttccccagggtttacatagcttagggattatgcaaacaaaaacaaaatatatatagtccaagataaacaagccatattgaaattgatatgtatgtatggtattaaatattgttagatttttctgaaattctcattttttatatattcaacacacattactttaattgtacgtattaaaaaaatttatcaaaataatcaatgatataaaatctctccttatatgatttaaaataatctagctatgtcagattaaaggaaactattctgtacctctatatctggtcaactcaggatttaaccaatagggcccagggtatttttagtctaaataatatacatttatgtttaaatcattgatttgaatctaatggcagcttgttgaaacatcaactgagtgcttgactttcacagacaagtaacacatttttgactgtagcatttcatctgaacaatacaaggtcaatcctcatataaagtataaataaatcaggggattctattgtatacttataacacatattcatatattagaattttatgaagttaaaaagattttattttcttaaagattatttttagagcagtttcaggttcccaacaaagttgagaagaaggtacagggatttattttacaccctctacccctacatatgcatagcctctctcattatcaacatcccccaccaaagtggtgcctttgttacaatggatgagcttattgtgttgacacatcattatcacctaaagtccatagttttcactagaattcactcttggtgttatacattctatgctttgggacaaatgcatccaccattatagtatcatatgtattttccctgacctaaaaatcctctttagttctcctattcatctttccatctgcctagcccctagcaaatactgatattttcctgtctccacagttgtgccttttccagaatgtcatatagttggaatcactcagtatgtaaccttttcacattggcttctgtaacttagtgatatgcatttaagtttcctccatgactttttatgacttgatagctgatttatttttagcactcaataatattctattgtcgggatgtacccaggtttatttatgtgttcacctactgaaagacatattggttgcatctgagtttttgcaattatgaataaaggtgctataaatattcacgggcgggtttttatgtcaaaatacagttccaactcctttgggtaaattccgaggagtgtgactactgagtcatatggtaagagcatgttcagttttgtaagaaactgccaaactgtcttttagtgtggctgtactattttgcattccaaactacagtgaataaaagttcctgttgctccgtattcttgccagcattttgttgtcagtgttctgaattttggctattctaataggtgtgtagtgatatctcattgttgttgaagatttcatttttagtcacaaaaatcatatagcattggaaggaatgttagatagcatctggttaaaatcaccacttaatgtataaacttactctgcaatatttcgttttaagcaatcatctcatccagaatccttttaagaccatctatggaatgcttcttgtcatgagatgcagaaaagctgtatgctaccaaacattagaaggccccagggctcagtccttggacatctttgctttgtgcacttactgccttggagatctcttccagtatcatggctttaaataccatttttatgctggcaattcccaaattttcatcaccaacctggacctctcccctgaactccagacacatgtatcaatctgcttagttgacatctttattttttgtctaaatgggtatgtcacacttagcgaccccaaacaaattccttactttttctcccacacctgacccttcacattcttcctcagtagtaactttatcctttcagatgatcatgccataaccttcattccttttagctcttctttttcatgcactccagtctatcagcaaattctttcaactcttccttgaaaagaagagttgaatggactcaaaatttgactaattctcaccacacctgctgcatcttagcccagtgccccttgtctctcacctgttttatttcaatagtcttgttactgttttctctgctttctcccttgctccctttaactgttttattctgaatatggcagccagcgtgattccttcacttaccaattgtatgatattcttctctattcagcctctacttataatggtcttttatctctctcagaataaaatcccaagtccccacagttgctcacaaggttctcatgcataaacatctggctccccaatgcctcttagtatatccattagtgttttccccttgtttgctcgactccagggcacaaggctcctctgttacatcagacacaccccctcccacgtcagtgccttgcacttgctgttccttttgcctgggatgctttccacacagctatctcatgagtcattcccgctcccctgcctgtcacagtcagctccttcaggtcttttctcaaacacctctgcttagtgagtccttctctagccacctgattaaacttgcaacctacttcttaactcttttcaccaatgactttttatatatatttaaataatttcttattgtctgtctcccttcacttcagatgtcagctccatgaggagagagttttgtctgttttgttcactattatatcctgcatgcctacaaaaggccctgctttatatacaccatagaatactatgcagccataaaaagaacgagttcacgtcctttgcagggacttggatgaagctggaaaccatcattctcagcaaactaacacataaacagaaaaccaaacactgcatgttctcactcataaatgggagttgaacaatgagaacacatggacacagggaggggaacatcacacactgggacctgtcggggatggggggaaaggggagggagagcattaggacaaatacctaatgcatgcagggcttaaaacctagatgacaggttggtagatgcagcaagccaccatggcacatgtatacctatgtaacaaacctgcacgttctgcacatgtatcccagaacttaaagtaaaataaataaataaataaaatgaaataaaaattaagtcccctgcttagtaagtattgattgacagaatgaattattttttatacattctaaatattagggaattctgtacttgtagggttttttttttctcaactgtgtattttaaaggagagaaagcaatcaacaactcctttgtttttaatttgggttttctatatttaacagatttatcattttattttttccctcagtgaacttgtttattaaaaagaaatctgtcactagccaaaagctgtctaccttttagctactcggcaatattggtgcataatcatgggttcttgggatgcttccaactttggtttgacctttacagattagctctgaattagggaccactgctgggtgagaagtaaggtgtaggaagaagacagatattccaacacaatctggaataattagaaggacgaagacaacaaggaaaggagactattttcagtgcttcaggcctcatttttataactgctgacacaagcctgctattaaaatagtcacatttcctcaaatattggactttcagatgcaaacggcgcagtcaaatagttctgttaacatgacctaattttcagagctaggtgttatatgtgctttcattctgagtctgtaaacctttagacctctgattctttcagccctaagctgatagtattattgtctaaaacctagcaattttctctgtaaactttatcattttgcattttataaaatcctttatacttacctatgtagagcttggagtttactatcctagggagaaggagtacaaggcaattaaaaaaaaaaaaagccccgtattcaaagcagaatgtttcaaaaagactctacttctgaaaaggggaaaaaatcaccattgttctgttggctgaatgtgttggaagtatctcaaagaagtacaattgaattaattatattttcatctctgtgtacccattcaagtctgagaacatgcacttcactgtagttttacctccttctggattacacgagaagctgcaagattatcaagatgtcagacattcctattgggataacatgacatctttactaaggacttctgtgggtctgatgttcttcttcctagaaaatcatatgaaagatactttaaaagtgccatgtacccacttgagcttattttttaattctgatttttaaaaatattttactacttaaagtgacatttaaaaagcatattaaacaacgatataagactctgacttcacaaattagtttttctaagaacatctaattagacaacttggattgtgtcttaccagggtgcatagatgtaaccaacctaagccagcccttttgacaatctgcagtatcaaagcaaaatggaactctcgtcttatacttacattagtacataggtggtctttcttgctcatctttatcccctttttaaaaaccatagcatagtgagtaacacatcttatatactgcgtattagacacatttctgtttatctttgtccctgtcttatgaatcttcattttgattatctgagcagtgttgctgatttgctctactggctttattcaactaatgccagtactcccttattggactaaggtcttaaaactaccgtgtgcttatgtgtactaaaggtagttactgtctgcaagtgaggaatacatttgatggaactgattaattagggtgattttctgtttttgtggtcaattgaaatcttttgttaattttagctttgctaattttagctgaattttctacagtaatttttatttatccataagtatttgatttctgcaaattggaagtaaaatcactcatgtttgtttacctagttggagctcagatttttattaaaatattgttaaaattttattaaaatatgcctataaaagcatagtgactggctgaatgcattgtgatgctcacgaaaatgccctctcacatctcctaccgcaagaaacacaactgagtactgggctcgagatgctgctttctggatccatcacagctttggtgctgaggccccactcttcttaggagctgcttctagtcagtgacagagtgcagcagcaggggtactaaaacgggcccattgctgagggatgtgggaactccactgatggcaatgtgagctcaagaatccccatgaactttacactgcactacagtgtaaagcttgttttccttcctccctctcttccccctattcttcaaagaggttagacccacatcgaggtgagatcggtctcttggcctcctctggcttcctcctgttttctttcataggtgttcctctctgaccctgcctctgataactcttgggtttgtctaatcttatctttgtgtctgcttttccaggaggagaacctggattaccacatgcaaaaaagatgcttttgtccaaataatttcatgtttgggccccttattcgtatttggccacaagttttaaaaacctgatctgtagtcctaaacttatatacccctatggttttttttttttttttggaagctgttaaataagtctgaatattctcttcatttatgttgttgaacctagcattcacttcttttcaatttgaactccgccaaccagtatggaaaagtatagtctcttctgtgtctgccagtcaaaggtagtttgtttaccccatttagcaaatcatgacaacttgatgactctttactaggtccactacaatgttgatatgtcggaaaacactttcacaggctactagatcctattatgcaattttgtaacagaggctcaggctggagttaaggactcacacttgccttggaagacgtgacaccctgctatttagaatgagtggtgctttgttttgttgtgcctgttatccaggatcaagacaatgagacatttaccatccccctgcatatcattttggcatgtatccttgtgaagggttgtaggaggcagcagttattaactccttaactgcacacatattttgcaaaaatagaaattttgcttgtggatagcctcccagagttgttatggtgactcatcaacaatcatttctaacacctggatatcaatacaaattatttgggaactttggcggttaagtattacctaaatcttggtgaaaattccttccttattaaagtattatcggcatactaacagcttgctccatacatccacaattaatatttcaattttattaaaaacatctgagaatgctgattttataatgtcaactttaaatctggagaatctctgagcatgaaatggtacagtagttaccatcgaaggagcagctgaaggtcagcctctgaggtgcattaattcttccaacattaactcttgtaaaaatgtcactttattgttattaagtagaggttcttaaaaggcccattaactctggtggctacaaagtggcacatcaattataaatttgttttatgtaaacggaacccccaaatgacaccatcaacatattgctttgtacttaggatcaaaataatcaaagccactatttgaaaatgtatttgcttgatttctcagacagaatctggggatagctgagcaatcatatctcatgcattgaagacaaattgcctcagtgaaatttctattatagtttaagaaaattatcttcctgaatttgacacactgaggtggctgggaatgtagttatccagcaacacctgcttaaaatgccaataggaggtatgtggtaactttgttccactcagttgctacacatgacctttggaattgccacagctaccttacagcagagaacagggacgcacacagggattttcagagaagcactaaggaaaatttgaaatgaagctaaattcaagaagtaaatgatacttagaccttttgcaaagaaaacccagagattttaaaatagacaatagcatgacaatttataaaaatgaagctatttaaacagtatgatgtatagtattcacaatagcttaaaatattttattcccaggagcaacctaatccataactttttttttttttgctaaatgttagatgttgatatttgcaatgcattgccttaaattggaagattataacaaatttgtgtattttatggtgtactgtctatgtattgtctcacagcagctttgattcacttccatattaaccttgataatttgcttctttcaacattcaggatgaaaactacttaatataattaagttggcaaagcctgcattttggcattttatcccactctacattttcttggtactgctttttctaccctcttaatttttacacatggaaataactcatgtgcctcattgtaagtcagtgtgttatttgccaagagatattctgcatgaggtctctaataagatattgaaagaatgaaaggcattttcttattggacttgcagtcatcagaatccacagaaggggtaaattacggccaaagctttacagggtaatggttaagcatgcagaattggtgcctgaatgctcgccttcagatatttgctgtatgatttggggcaagttccttaatctctttgtgctttcctttttttttttacttctaaaaagtgatgtataaatagcatttagcacaatccatctagtacactgagaactctttattattatgggcttctcaatatcctgatatagatagacataaatgcaaaccaatcacagaacagtgcttggcacataggaagtgctcaataaataacagctaccattaaaaatagaggcatgggattgatctggattttctaaatccttgaagttctaatagttttgtacagcatggggtggaaatgagcagagcagtttacaaaagagaaaacaaaattatgaatgcagactgtctacagcaacttcaatgcaattgcataaaataaattataaatataaatgcctgcagtttccacggggaaagctcaggttagtgaagggggcctaaaatgtaggtatcattggtgtcgaaataaatatacctttgaaaacgaccttttccaaccccattgaagttatctacctctcttatgaattaagtgtagaaacattgtgaggagcagggccaaggttaataagcaaagatttcggaccaagtttttatacctttttatcctgtttccccattgcaatcccctcagtgcatgtgtgtgcgcgcgcacacacacacacacacactctcactcatgcttctaacaaaaatatgttgttacagtacagattctcagtaaacatttcttaaataaaggcagccataatgtatgtttgttagcctatattagtgtgaggaaataaagtagggctactttataaccaaaatgaggaaaataaacagtaaaagaaaaataacgccaaaacaaatatgatttatttatttatccaggaatcacttatcaactacctacagatatatagatcattaagatagggtagctgcctttgggaagtttatagcttaaaaagaattataagatgtataaaagtttcaaagtgtggttaaggactgtcatagaaactctgtaagatgagagtgtttaattttactgactgtggttatgaggaaagttttaaagagaaggtacaatttgataatatcatcatagtgaggttttcattgagtaggcaatggaagggcacaaacagaagatatagaagtgtgaaacatggaggaacactcagagaactccaaatattttgaaataagtaaatcattgggctttcccagaggtatcacaagagatatggtcagaccagagtcagattatataccttaccaaggaatactgattttctagattgagtagtgtgaaaccagagacataaaggcaattcaattggatgtatactttagtaagatcacactaggaatatagtgaagaggaccagaggaggaaagacaaattaagaaaacaccagcatgtcaggtgagagaaaatgagtagtagcaatagggatggggaatgaggaatgcataaaaagaggaagaataaacaggatttgatcatcaattggacttcaggatgaaggagagaaaggaatctaagatacccctaggttttttggtttagagaatatagatgtgaaatttaggaagatgtgaaatttaggaagatgtgaagtttaggaagatgtgaaatataggtttgattatgctgtatttaaggaacctgtgggatgtctaggcatagatatcagagttggagggtgggatcagggaatgtggctagaaagatatatttcagcaaataattagtaggtaaaatcactggaatgcatgtgatgacacaccagtaatgtgtggagtgggaagagaccaaacgcaaaatcctaggaatccaatttaaagagcaggaacaattggggcaggggaaggggagagaaagagaattgttaggaaagtaagacaaaactcaggataagagagctgtgttgtggaaatcaaagatagagttgtgctatggagagattaaataaaatgaggtcatcagtgaccttggcaagaccagttcctgggaacagaatgcacacaaatctgatgattgttcttgaaaagggacagacatgagtaactggagtcagcaagagtaaatggttgtattaagcaaatgaatgaagttgtctcagatcctcttatcttgtagtgttgtgcctagcatatttgacatgcacagcatcttttttgtttgtttatttgtttgtttttgagacagggtctcactctgtcacccaggttggagtgcagtggcgcgatctcagctcactgcaacttccgcctcccaagttcaagtaattctcgtgctttatcctcccaagtagctgggattacaggtgtgcaccaccatgcctggctgatttttgtatttttactagagatggggttttgccatgttggctaggctggtctcgaactcctgacctcaggtgatctactgccttagcctcccaaagtgccaagattacaggcatgagccactgtgcccagcccagtgtatcatttttaattacttccgtcctgtctgcaacattagttttggaaataagtactaataatggctagaaaagaaaaaaaagatcatataatcattccaagaaaataaattaatgaataaattaaatattacagtacaccaaagaagggggaagtaatggaataataccttttatttttcctttaaatttatttttaatttttgtgggtacatagattaatatatttatggggtacatgagatgttgaaataataccttttagtttcattaatatgttttctgaataaagacaaaaaacttatatgcacttattgatctgttgcagtcatttctagttgtttctagtttcagtttctttacagttcattataatgcatttacttctagtgcaccatagttttctagtttagagccttaacgcctacaaagttgccaatgactttgtctggagagccctttttattaagtttcattttgaaaagtttctttcacatcagcaagcagatatacaaataggaaaaatcttaattataaggtaagattggaagagatttttaaaaatcctactctacagtaaattctggaaattgcaatatagtccatatctttgtttctttgggataaattctaggggctttcaaatgtctctatgtcaaagaatatttaatacaaaatctccaagtggtcatataaattgttagcagtgaagaaactcaagttctgtttcttggtcttcataatcatggtgagattattgtttattttaaatctacctttaaaagtgaaattatgtaatacctgtgctttggagatagcagctgcatccaaagagaccttcaatgactttgagacattaggaactcctgttgaaatgaacctatgtaggcaaatctgtgtttgtctgggttagaatatgtgactgagagttctcccgataaacttccaggtagaattcaatgtttactcaaggataagtcataaaaatgagttaatttgaagcttatgcaaatgttgttaaaactcaacaggaaccacagcaaattgcttaaaacttggaacaaaggagttttttttccaagagtactattttgacacagatacaccgtgttttattgtgctctactttattgtactttgcagatattgtatttttaacaaattgaaggtttgtgtcaatcctgttgtacagtacgtctatcaatgccattttttcaacgcatttgctcactttgtgtctccgtgtcacattggtaactctcacaatatttcatactttttcattgtgattatgtctgtcatggtgatctgtgatcagtaatctttgatgttattatgaaattgttttggggcaccacaaaccatgcccacataggaacttaataaatgtgtgtgttctgaccactctatcgactagccactcccctatctttctccctcttcttgggcctccctactccccaagacacaaaaatactgaaattaagtcaattaataatcccacaatgtcttccatgtgttcaagtgaaagaaatagtaacaggtctctcactttaaatcaaaagctagaaatgattaagtttagtgaagaaagcatggtgaaagctgagataaggtgaaatctaggcctcttttgccaaacagccaagttatgaatgcaaaagaaaagtgcttagaagaaattaaaaatgctactcagtgaacacacaaatgttaagaaagcaaaacagccttattgatgaaatggagaaagcttgtgtaatctggatagaaaatcaaaccggctacaacattcccttacgccaaagcctaatccagagcaagatcctaagtctgcaattctaagaagtgaggaagctgcagaagaaaagtataaaggtagcagatgttggttcatgaggtttaaggaaaaaaagctgtctttataacataaaagtgtgaggtgaagcagcaagagctgttgtagaagctgcagcaagttgtctggatctaggtaaaattattgatgttggtgactacactaaacaatagatttttggtgtatacaaagcagccctctattggaagaatatgccgtctagaacttttcatagctagagaggagaaattagtgcctggcttcaaagcttcaaaggacaggctgcctttcttgtcaggtgctaatacagctgatgattttaagttgaagcaaatggtcatttaccattctgaaaatcctagggcctttaataattatgctaaatctattctgcttgtgctctatacatgcaagaacagagcctggatgacagcacatgtgtttatagcatgggttgctgagtattctgcatccattgttgagacctattgctcagaaaaatatatttctttcaaaatattactgcttattgacaatgtacctggtcactcaagagctgccatggagatgtacaaggagaataatgttttcatgcttactaacacaatatccattctgcagcccatggataaaggtgtgatttttcaagtattatcatttaagaaatacatttcataaggctatagctgctatagatctgctatagctgtgatagatctaagcaaagtaatttgaaaatcttctagaaagaatttaccattctagatgccattaagaacatctgtgattcatgggaggaggtcaaaatatccacattatcaggagtttggaagaagttgattccaactcttgcagatgattttgaattcttaagacttcagtggattaagtaactgtagatgtgttgaaaatagccaaagatctacagtgaggattggagcctgaagatatgactgaattgttataatatcatgataacattttaacaaataaggagtcacctcttatggatgagcaatgaaagtggtttcttaagatgaaatctactcctggtgaggacgccatgaacattgttgaaatgacaacaaaagattcagactattacatagacttagttgattaagcagtgacagagttgtagaggattgactccaaattttaaagaagttctatgggtaaaatcttatcaaacagcattgcatgctacaaataatcctttataaaaggaagagtcagtgcagcagacttcattgttgtcttattttaagaaattgccagtcacctcaaccttcagtaaccaccaccatagttagtcagcagccaccaacattgaggcaagaccctccaccagcaaaaagattaagatttgtggaaggctcagatgatcattaacatttttagcaaaaatgtacttttaaaattaagttatgtacattgttttcagacacaatgctattgcaagctttatagactacaatatagaatacacataacttttatatgcaccgaggaaccaaaaaaatttgcgcaactcgcgttattgaggcatttgttttattgcagtggtctggaactgaatctgcaatatctccaaggtatgcttgtattatttagaactgccagcacatggtgataacggaaagcaattgactttaagtgaattttattattactttaaaaaattatctgcagaagatacatttgtttgttgtctgctccctatgcctggtctttggaaaaagcctctttttaagcaattaacatcctttttcaaagttaaactttttctttgataaaatttaaatgataaatatgttaaggatcacctatttcttaaaatattgaatgatttcaaacatatatgtcatctttactaagattacttacccatgttttccaattctgctagaaaaccagtggatcattctttgaagggtagacagtgtaccttataggttagatattatttcttatgcaacttatagtacacagaaatctatttttaaacgtacagtaaaagttaaacatacatgcagttataatatgcaatgatggtctcctacaaaaaagatcttagctattgattgattgattgattgagacggagtctcactttgtctccaggctggagtgcagtggcgcaatcttggctcactgcagcctccgcctcctgggttcaagcgattcttctgcctcaagcttcccgaggagttgggactacaggtgcgtgccactacgcacagctaatttttatatttttagtagagactgggtttcaccatgttggcgaggatagtctggatctcttgacctcgtgatctgcctgcctcggcctcctaaagtgctgggattacaggagtgagccaccgcgcctgggcaagatcttagctatttaaaatacgtatttcaaaatctctccttacctagtatctatctttgtttacttaagacgttgtaatataaatttgaactaggttatggtatttatgtttttaaatcatttaatttttccattgagtaccactctatggaaaaattattattattgatatacaataatatataattgtgtaataattatataatattgatatacaataataatatttattactattattgtatatcaattatttattgatatgcaatggtggtctcttacaaaaaagatcttagccatttaaaagatatatttcaaaatctctacttagtattcatctttgtttacttaagattattgttataatataaatttgaaataagttatggcatttatgtttttaaatcatttagtttttccattgaaggtaccactcacttcatattagtaagatttctgtgtgtttcttttgaagaattattcagaagcagacttcattgttgtcttattttaagaaattgctgatactagctagatatttacataaattgctttgactaaactataattaccttgtcactgttttctagtcaattgtaatgcagaaaaaaataattcaaactattaatatcatggtgaaaagcatgggctctcataggacattatcaagctaaaattccatatgtgctactaatcatgttaattaatttctatgcctaattctcttcatctgttaaatggggctaataatactacatagctcattactttgttttgagggttaagagtaaaaacacacagaaagttcttataataatatctagcatattgtaagcactcaacatgtataagttattttaggagataatatataataattatgtatttatttcattttcttttctttttttttttttgatggagtttttgctcttgtttccaggctggagtacagtggtgcaatctgggctcactgcaacctccacctcctgggttcaagcaattctcctgcctcagactcccgagtagctgggattacaggcacacaccaccacacccggctaattttttgtatttgtagtagagacggggtttcaccatgttggccaggctggtctcgaactcctgacctcaggtgatccgcccccccgcttagcctcccaaagtgctgggattacatgcatgagccaccgcactgcgcctggcctatttccttttctttgcttatgttgcaaagtgagaaatgcctcatatttaaccaagttgtccctaggactttaccaatctaagaatttttttttctgagaaaggcattctgaaagtcaaatctagatatactttaaatcaatatcactttaaacatttacgttagccatgttttttacagtgtaaaagactatcatataaattctgttaactatgttttattgttccctgttgtaaatttttatttatttaataaatctgtttataagaatttttttctcaataatactactgaaaaaatagatttcatccaagcacagtgttaactagataagaaaccaacccaccctattttaatagcagcattaatacttttccttaagaaaacaagacagccacttatagtataagtaagctaagaatgtcaaaagggcgctcaatatgtctttcttcaacataaaaagtgatgacaatcgatcagtctgactttcacaagaggctccctaggagagaacagcatactgataatagtaagggcaggaagcctatttagttgttttatattctgtagctctctgactgtcccagtagttacaaggcagcatgtttgacacatagctaaaattcaagatgaacgcaacacacaaaaagagggcaaaacatgatgggaccaataaggagagatcatttcttattataaaggcattaacttttttcaagatgagtgacttggagttttgagctgaagggttggctagaagaacacttcggtttacaaagagaaatgcaccctgtaatgaactgcagtggactctaaaatgaaattgctggaggctacataagaaatagaaaaaacctagaagcacaatgaaaaacatcccgatttacagcatccctaaaggcagctgagggttgaccccattactttcattgagcaatttgttccatctctcctcacacataccctcactaggacttctaaaatagaaagatgcacaacatcccttagccctttccactgtctcaaaaaggtccccaaactttgtttactaaagttttagaactttatgttttactgtgtttagtatttatttaattttctattttttttttccccttgacctagatcatagaataatatacttagaggacatttttctaaatgcaagttgctagaaatgacttggcaaagattagtacaattcacagtgtcctgcagcaatagaattaacgaggagtttttttaaagagagactgatttaattttttgatgattttgaaatataaatgctaagaagaaaatttgaaggaataattttagataatttatatctaaagtgttacaagcattttatgaaacactagctatcagattagtcaacagctttggttttaccgtcaacagatattctttaaaacattcatacaatttattgtgtgcttatgtatatctttatgcaatctttatgtgaacactcataggggactattgtataatgctatcattgttagcaacatttgtgctttgtttctgaagtcttttactgtactagtaatttttttctttgcagaaactaaagttttctattagaaaaactttagttggatcctgatttataagcagatataacaaacatcatgagagtcctagagaatatcatgtaatcttcagttgttcaatctgatgattaaattgggcagagaaaagagttccagttatgtgaaaagtatttaccgtgttaatgaatctgtgccaaaacgttcatagaggctcaacttcaggccactccctgtgttaattgctggggtaagatgtgtaacgtagacacttgcctctggatgggtcaggctccagtgggaccaggtgcattgcaggaggaatgcattactttgcccaagcgcttattaggactttgaaaagaaatgctttcattatattatttgatgttttgtacatttcagtgtcctggctagctttgaagatttcagagtaaaaagccacaatttggagattgatatttaatatttagaaacaactatgcttctgtttctctctctgatactactaaaagcaataaaccaaatatttattaaataattagttcatgggaaattatgccatttttttttttttagttggagtctcactctgttgcccagtctggagtgcagtgggaatgatcttggctcacggcaacatccgcctccccggttcaagtgattctctcacacagcttcccaagtaactgggattacaggcacatgctaccacacccagctaatttttgtatttttagtagagatggggtttcaccatgttggccaggctgtctcgaactcacgacctcaggtgatccacccttcttggcctcccaaagtgctgggattgcaggtgtgagccactgcgcctggtctcaaaccttgtattattagattaaattggggacctgcaaactttttatacaaagagccagatagaaaatatgtttggctttgcaggccgcatagtatctcttgcaactactcagatctacctttgtagcatgaaagcagtaatagacaatatgtttaaaaaaaaaaaatgagtgtggttgtgttccaataaaccttgatttacagaaacagatgcttggaatgatttggcctacgggccttttttttttttttttcttgtcaatccttgaattaagtaaagaaagtgacaggtttcctgctagaaaagggtttgttatgaggattatgtgatttaatatatgtgagatacgtagagccatgtctgcatgtagtgaatgctgtaaatgtgttatttattataataactgttagagaaatgtagaaacacatctaaaccatttataaggattacatcttgaatatatatttctttaaaacctggatcagtgactactactatacctagatttcaatttatcaaccaaccaaatacactgtgaaggattttgtggatgaaaaccttcagatgattgagtgtttcgattgcatattgcatatataagggttttctctaatagtagatatgaatagattcaataatatatgcttttttcatttgccattcatatattctttaaacttctaaccatttccccaaacttggctcattaaactgatatacattggtttactgtttatactcctgccttattttttgcatattataaatataatacaggtgtttctcagcaagaaagacaattgaataccaatgttctgaaatattcttgtttctgtcaaagacatgttcatcacaactctaccacatacactatacacatatatactattttttattttaccagatttttagaaatatccaaaacctaaaatattccagttgggggacaattatgttctactgggataagagaaagacagaaaaatgtggctttagaagcctagaaaagcagtgatttagttaagcatattcaaattttagtaatgcacagtcctgactgacacttaggactttttaatgtatctttttatttgtaggtaagattaaatagaaaataccatatttaaatctgtgaattcaaaacgatattttttgagtgcctataccatgtccaggttaagtttttctactctaatggagctaacattttataaaataacatttataaagtaagataacaaatgagtttttaaaacttggatataatttttactagagaaatactctcataaaaaccagagagactaagggaaagagttatgaaaaatagagtgaataactattttagatagggtggtattgaaagactgtttagagaaggaggcatttgaacagagagagttctaaatgaagtgagagagcaagtcatgtgaagatctagtagtagagtgtttggacagtgggaactacagtgtgaaaggccctgagatgagaaaaaagctgggatatttttagaaaagaaggaggctagtgttgggcatgaaggaaagtgatctgaaataaagtcagtgatcatttagggcctcgtgggctgtttttagatcagtgtagctctctgaggcagacatgagatggctgtgggtagggcagtgctgtgaacatcattaaagttttcccaagacccttctggtccatccagtggtagtagatataccagtagggaagctattatagcatttccctgggaaatgatggttgttagactaaagtggcagcagtgacaagggtgggaagaggtgattcaggatacatgccaaggtagagctaataggaattgctgttgagttgaatgtagagtgttggaaaaagagctgagtcaaggatgttttctatttgcgtcaggtagattctggtgtcatttactaagatgggaaggtttatgttgacagggagttgttaagaatcacaagttcaggccagatgcagtggctcatgcctgtaatcccagcactttgggaggtcaaggcgggcagatcacctgaggtcagaagttcgagaccagcctgaccaatatgatgaaacctcgtctctactaaaaatacaaaaattagccgggctgtggtggcatgtgcctataatcccagctactcaggaggctgaggtgggagaatcacttgaacctgggaggcagaggtcacagtgagccgagatcatgccacggtactccagcctgggtgacagaaggagaccctgtctcaaaaaaaaaaaaaaaattaagagttcagttttaactgtgttaggtttgtgaggctttctctatattcaaatggagctgttgagtaggcaattaaacattggaatctagagttcatggaagagatctgaattgcagatatacatttgagaggactcggtatgtaaatggtatttaaaaccatgagtctgtataaatatcatcaagatagtgagtgtagacagagaagtccaaatactaaatcttgaggtatttaaattttagttgtttggcagaagagatgaaccttcacagaagaccaagacgtgcaaagcaagttacaaggaaagctaggaaagtgtcacagccctcaagccaagtgaaatatgcctcaagatgaaatgtgtgatcaattggcaaaagctgtatagaaattgagtaagatgagaactgtcaaaattgctcattggatttggcaagatgcaagagaatgttggccttgaaaagaagagtttcaacagagaaattaaaaactgcagttaatgaaaaaaataggtgaggaagtggaaacaaagagtataaacaaatatttgactgagtttgctataaaaggagcagagaaatgctcttgtagctgactaaagacacgggacttaggaaggttattttttaaatggatgacattataatacgtttgtttgctaataggaatgttccaaagaaagagggagaaatttatgatgctgcagagaaaaggaaatattcaaatagtaaattctgccataaaaaggaatgaattaatggcatttgcagcaacctggatggaactggagactattattctaagcaaagtaattcagaatggaaaaccacacattgtatgttctcactcataagtgggagctaagctgtgaggatgcaaaggcataagaatgatacagtggaccttggggactctggaggaaatggtgggaaggaggtaaaggacaaaaggctacaaattgggttcagtgtatactgctcgggtaatgagtgcatcagaatctcacaaatcaccactaaagaagttactctgtaaccaaatgccacttgttccccccaaaaactatggaaataataaataaataaataaatagcaaattatttgagtaggcatgaagaaatggaatccattgcactagtggagggcttggactcagataatgacaataatggccatcattttttatgagtcatttacatatattaactcatttaattctaaaaataaccctgtaagctgtattttattaccacctctattttacatggacagaaaaataaacacagcaggttaagctagtaattggtagaggtggtttccaaactcaagttatctcattccagagtaccactctagagagttatatgttatacagtagatgtacatattataactgggaaaaaaggcagactacacagataaagttagggaattttttacatgtcttcataacaagatgatatagtatagtttttattctatttttcactaaagttaagtgcaagattatcatctgagaataagaaggagggatgggccactgagggatggacaatatgagagttgaagaagggatgggcaatgtagggaaagagcaaaaggtatgaaatatttgtcaagtacaggagtaaaatggccatggaaaatgacctgcaaaatctgccagtgccaaggtctcttgaagatttttgtcattattttaaagtgagatgcatcatcatgtgaggcagagagctaatttctatccatctttgcttcaaggtgtcaccagtgaaatatcgatggtgggactgacaggtaatctagaggaatagagcatgcctttcgttttcatatctgtcatccttttatctggcatggaggtgtgatggctagaactttgctagtcataattgaccatggagataagtaccacactctaggggtggtaggatattgagccaggcggcagaagtttgttctctgatgacttcattgaagtgccacagcagtcctggacttttcgcctgcagacatctctaatgggagtcagaaataaatgtgtatcttgtctaagcctgtttaggagtctcttcttcttatagtcagacttaatcctaacttattccagaatttgttttcagaagcgggttgctaaagggacaaaacctaaaaatatgactttggttaaatggaggcaaacaggtggttagcagcaagactcagatgttgcagtttctctcaacataggccactgttctgatggacacatggcatatagggagaattattttaaatatactttgggttttttttcaggtgagtaaaatggagagagaaaaggagattccacaatttcctttagtaacaaatttcactgtctagcaaactttactttcagggattgctttcaggtatgtcacttaatatttgtaccacttcatctaatttccattttcttatatactaaactcaagagacacatttagttaaaatttttaataaaatcttacacttgtcagatatttcaaatattttactttactcctgtctattataggaaatccaaaactgacttatatttaccttcttaaaccttgatatgttctcacaatctttttatttttcaaagatttatatcagtttatgacagtataactacaaaaaaaagtatagtcaccaaagtaaacaatgacatactccttgtcaaatcttagggcctatttccacgctcttggcccttatttcttatcttgcctttttcccctaaactgagagccaacatcatcatgggcgtatcaagtagagacagatcaatttgtgttggaatccagttagtcatttactagttagttatgtacctttagctagtcagaatttctttctaatcctcagttttcatccacaaaatgaactgtgttaaagactgaataaactaattttgtttactcacatttagtttatactttttttttaaaaccttcctttctttggttcaatttacaccatgcaccacctacattagtacctattgatatttgcgagggttttatgtctttgccccttctccatttctataaccatttctcaagccttcaacatggtactccttgccagcaatcattctttgctacctgtgttcctacccattctctagtttcttccagaggttccttgtccctcagcaggtctgccttcttactgcctcctgcataccgcccacttgcaccattttctatatattttctcttgcatcaattttccattgcatataataatctctagttcacaaacctgtatttgtaactctattttaaagacaatatttagtcttacttcatcccagaaatcattgactaacttcaccacaattgagacatcacttacatgaagttcctctttgtatgtgtataatttatcctcttataccattaaatttcttgtattgatcgttgattttattttaggcttgtcttaattatccatttaggatgtaaaatcttccttgtcttcatgatccgctgatggtataaaacttcctttgtttaaagaaagataaaactatctctgctgttccctgtcccatgctttgcagtgctatcactatgaggagaatttattaatttatgcatgctgcatttaatatgtaaaagcctttaaatacatgaagattggtactacaatgtcctcgatctttgctttcttaaactcaaatagtcttagttactttaaaacattttgcctagtgttatttttgtgtgtgtgtttcctctaaattcaagtgtttatattcttctttagttgagatccagaatcggcctcactgccatcatataatcaaattcatgcagagtggattggggagtttaattcctagcatctcctcttacctttgcttccatttaaaaatttaattatttctaaaattcaactaaaggccctcatttattataatttatatcattgttgaattattaattggttatttatttgctatacattatagtcaagcctgtagctgaataaagtataccttgatacattggaatacttatataaactgcataggcactaaggggctaaaagaaagtaaagtgggatatgataataaatgaaaacttattggagtagaaaatgaaaaaaatttaggttatattttatttcttttaattaagatggaattcatataacataaaattgaccactttaaagtgaacgccaatggcatttagtgtagattttattttactttatttttaacagctttattgaggtataatttacataccatacaattcaccctcttaaagtttaaaatttaatagcttttcatatatttacaacattgtgcagccatcgtcacagccaattttagaatattttatttaacccccaaaaaaccccatacctattagcagtcattccttattttcctgtatccactatacctaggcaaccattaacctactttttgtctctatagatttgcctattctggacatttcatatgaatgaaatcatatatggccttttgtatctggtttcttccatttagcataatgttttcaagattcatccgtggtatagcatgtatcactactttgttcctttttattgctgaataatattccatattgtgggtataccatgttttattatccatattatgccatattatggatatacattcatcagttgatgttcatttctgttgcttccatcttttggttattatgagtagtgctgctataaacatttgtatgcaagttttacttttaatacctgttgtcagttcttctgggtatatacctagaagtgtagttgttggattatgtttaatatgtaaacatattctatgtttaacattttgaggatctgccaaacagatcctttcctgatttctaaaatggaatatttatttttttaactgtaggctttacattccttatatatctgaccactagtttattgtaccataacaggtatttcctgatttcttttgtgctttgctttcatcaccaaataacaacttccttgaacttttaaaattacatcatttatagaatagaaatatgaaaagagttttgtgattcttagacatgaacacttccataattaaagatattcttacccctatggtaacacatggaatgaaaaggaaaatttgattcctaacattctattaattttattttctttatatatctcttccatgatgctgccaaaataattgggctcaatttaaatgcccttgtctgcttgccagtgggatgcatctgagaattcaactgtgctacattttgtttgaccacctatgtgttctactaacccctctattaactaaatgcctttttgatatagtcagtgttacttaattccaagggaaatctggggaaaatattgtaatttactgtgtacagtggagataaccacagtatgtaatatccattattgtatgggaattgtactcaagttagtccaatatggagtgatggttttaaaccttttagttaggaattaagtaaacaaatatttgtgaagcacccacccactaaatcatacaagtcactgaattaaggagagaaagtgaaaatattaatttgtggcttaattattaatagcatattaaaaatgtaaaggtttattatggttttagtcggagtttatccttcattacatatacaagtatgaaaggaaagaattatagcactaagccggtaagagaaaagcagcttgattctcttcagagtgaatagaaggaacataaccgtaaaaggaatataaacaataattccgagtgggagagaaataaattatttttaaaataattcaaggacatggcttaatgcaatgagataacatagacctgctaacctcattccagttaacaaagcacatttggttatattgtatcttttacagtttcatagtttgctgttttatagtaggaacaggataagctttaactgccttgttttcctttattcttccttttttgaccctgttaaatttaggaaagcacacacttggctcataagtgcttgttcagataaaacagtgtgcttccaaatgtagcagcaacccaccttcatcagaatctcctaagagggatgtgattgcaaaaatatcatttttcttagccctacatcatggctcttagatcagaacctctaagagttctgagctgagttatgatatagggctaagggagggcccaggaatgtacattttatcagtaaccccaggtgattagggtagggtccaggaatgtacgttttatcagcatttccaggtgattctcacatatgctaaagtttgagaaccactatactgtactgtattccctgctgtagtgactatgattgagcagaatggttaaaagcatggactttggtgtcaggcttatttgaatttaagttctgattctgttacttcattgtgatcaaaacttggataagcctcttaaattctttcagcctccactgtattcagctataaagtttaagataaaaggtgattataatctctatttacctaaagaataaagacttattaacataattctgccttatcattcttactattattagagatagggtcttgctctgtcacccaggctggagtgtagtggcatgaccatggctcactgcagcctcgacctcttggactcaagcaatcctcctgcctcagcctcctgattagctgggactacaggggggaaaccaccaccatgcctggctatttaaaaacaattttttttttttgtaatgacagaatgtccctatgttgcccagaatggtctcaaacccctggggtcaagcatcctcccaccttggcttcccaaagtgctgggattacaggcatgatccactgcacccagctgctgcccaattattaatagaatcttcctttattcttaaaactatcccactttagaggataaattatgtgatctagcatagctatgtaatcatttactgtgatgattatatgacatcacttatttgatttgatacagttggcacataatacatattttttaaatgttcttataattaatgctatttttaaaaatcaggccaactctgggcccactgcctaggagttagcccttctccataaggagcagtaaaagcaaacaaacaaacaaatttgattttttttttattttaacagagtactcaggattatctactgctttaattgcttttaaaaattgatttccatggaaaagaggtcactgattattgattgttggctagttttgtcctccatgggtacaggtctttaagtcattttgtcctcattgtttttactagcttggccatgccagttggcattgtcttgtgctaaaaggcattttgtagtagagactttggggaaaagacattcaagagaaggataataaaagtctgtacagtggaactatagtattacacaaatattattgtctataagccctattacctacaaaagataaatatgacattttccttctcttattagcttcatgatgaaacaccttgctattctgccttcagtttgcttttcacttccaagtaagtatattctagccatgggagagaggtatttaggtgtttttcttgtagttagatgggaatcctagactctctactcagactgctctgagcctaagttttttttttcactttttttttttttttttttttgagatggagtctcgctcttgtcgtccaggcaggagcacagtggcacgatctcggctcactgcaacgtccgcctcccgggttcaagcgattctcgttactcagcctcccaagtagctggaattacaggcactcgcgaccatgcctagctgatatttgtatttttattagagatggggtttcaccacgttggccagactggtcttgaactccttacctcaggtgatccgacctccttggcgtcccaaagtgctgggattacaggcgcgagccaccgagcccggcctctgagcctaagtttatcagtaatctcctaagtggtgccataaggatatgagttaatgtacatagagttcgtagcagcacatctttgttctcaattattgttttctttctttcttttttttttttttttttttttttttgagacggagtctcgctctgtcgcccaggctggagtgcagtggctcaatctcggctcactgcaagttccgcctccggggttcacgccattctcctgcctcagcctcccaagtagctgggactacaggagcccgccaccacagccggctaattttttgtatttttagtagagacggggtttcactgtgttagccaggatggtctggatctcctgacctcgtgatccgcccgccttggcctcccaaagtgctgggattacaagcatgagccaccgcacctggcctattgttttctaataccattattaagaagaatattggtggtcttaaaattgagcgagcagcagattttagggtaatatgggacttatttggctcattggcttctttcagccaccttgttcagattttttgcttctccagtaaaaaaaaaaaaaaaaaaattgttcttctttgtgagatggatgggggaaaaagaagtcatatagtttaaggagaataaggaaatcccaatatctgaacatttgagggagaagaactcaataatcaagggccaagtgacatagcagatatattgtgttttgcagtgtctgactgtcaacacgtaacaataagtggttgagattttcatactcaaggccttattcattgctttttagaaagtgtttttgttccacttccaatgaaggcataattctcaatgaaatatggaaagtgttgtagtcaacatgaaaatacatatattcaaaatagcatagcattaagcctgaagtatccaccatcatttttattcacatactactggtatttaaaatatagaaaataaatagaaatatagaaatataaacttctacagctattgccttcataaattacaaccttcatggctatcatatgtcccaaatatatgtttcagatatgtgcaaatgatgataaagaaacattcaatcatcagttatctaggagacaatgatacacactaggttatcttgagttaattatttcatgccaaacttaagtgactatgtgagaaccatatgtttggtgtgtaattcacactttcaataatgtttgtatcaactgaaatatttttcaatgaaccagcatccttataatgaacatggtgttattataaggaagctggcagtacaagtggtactttgtgttttctcatttcatgctttcatttagatttaagatgttcttggtttcatttccaagttggcatgagttagcagtaaataggaatctgctggcttgtgttacatttgcttttctgatacctctaaagaaagaatgggaagaattcagaacagtaatcagttttaattgaggttatccagatagaagtctttgttctatctaaatatcaagccaaatttcttggtatataatcagaaggaaccatgttgatttctctacttattgatgggtgtatgctttgattaaggagtcacagggaaagaagatggtaatattctcatagattaatgattgtggattttcagcagttaagaattgtattcaacctagaaaacaacttctaagaatcattaatagtgcaattcatagaagtagggttgattaaaattatgaataatttataaaatgtaatatatggatagaaagagcacattggctttatttaactcatgattaggcatacatgattattccattttcttcctttagcattgacttttagattatggaaggagaatgcctctagagagttaaagaataggcacagcacaaaagtaaaaatgaatgctccaaaagtagatatatgttgtgcttctgatgactttgcattttgtaatggatttccatcaaactgccttgctgtatcagtcagaatagtctaggttacattgtagtaatgaacagccccgaatatgaatgggctaaaactgaaaaaacaaaagatgtgtttgcatttagctcttgctatatgtctatttcaggatggagttgctggctgatatggtttggatatttgtctgctccacatctcatgttcaaatgtgatctccaatattggagatggggcttggtgggatgggaggtctttggattatgggggtggatttcttatgaatagcttggtggcttggtggcatcctcatggtaatgagtaaattctcattctattattttcttgagaaactcatatttaaaacaagagaaatgtaggtatctctaaagactgtagtaacccaattttattgatgatcagaggccaaaaaagccttgtaaccttacatgttgcttaatcctgatcatgtaacagaatcgtttggcaagagtttgaaatgcgtgaattcttggctcctattttcaatgttcctaatttaggaggtttagggtgagacccaagcatctatatttattcccttaagaactggttgttaaaaagagcctggcacctctctctttcttcttctcttgccatgtaatgtctgctcccctttgccatctaccatgaatggaagctccctgaagccctggtcagaagaagatgctggcttcatgcttcttgtacagcctacagagccaggagccaaataaatctgtgttctttgtaaattaacccagcctctggtattcctttatagggccacaaaatggactaagacgggacatgggctgtgttgcatgctatcccagactcaggcctgaggaagactccaagtggaatgctcctggtcactgtggcaggaggaaggggagtgctagaaaatcttgcaatttaattaaatgctgtcgtccagaagtgatgtacagcatttctgtccacaactctttggccagaattattctcatgaccctgccaagggcaaggtggcaaagaagtaccattctttcatgtggctgggagggaaaaaagaaccagatttagaagagcattagatatctctgtcacatctgaggaacaaattagccatcagagcaaaggtccaggcatcccatctcggcaaacaaagcatgattaaccctagagctgctgattctgagctcaccctaacttgattccctccactggccccaagctggcagctgtagctttgcaaacatgataatgcttctcttgttagaactgaatttagaattggcagcaacagaaacctgcaagctgcagttcatttgtgtatccatgcttaatttaattcttattgaatgaaatgcaccctcattttattcttgctggaaaaaaaaaaaactaacaacataaaagccagtccaactattaaatcaagattttctacaagatttgtgttaattattctctctgtcctttcacaagaataaaactgattttatttatcagttttgattcatttttgatacttgaaggaatgaggagtacagaccagctatggactatgtttattttcctgagaaactcatatttaaggcaagagaaatgtaggtagctctaaagactgtagtaatccaattttattatcagaggccaaaaaggctttgtagccttacatgttgcttaatcctgaccatgtaacaaaatcacttggcaaaagtttgaaatacgtaaattcttggcctctactttcaatgtttctaatttaggaggtttagggtgaggcccaagcatctatatttatatttaaatctcaccaggtgattccgatgggcagccagaagtgagaactgtcctggaatgttatgtaaaagaaagttattatttttgaacttgttttctaaatcaaataactatccaaacctaattttccaactttaagaataaggccatctatttagcagtacagaatccatgcttacaatgtttctggttcacttcttatgtgaaaacactgaagttgttaaataattcatagattattttgcaatcctgccagtctttatgtgtttcatgttcttgtttataagtcagtgagtagggaatacatccattttgagaatgccactctgttgtagttaatagatacagatcccattatcatagttattctaatatatgattcaccaaaataatggacaaaatgatgtaactaacaattgatttgcctgctctaatacctttctttaaaacactgtaataaaacaggaaatggttttttttaaatcatatattttgagtcaggagactagagttaaaatgaatcctagagatggaggatagtaaacgccaattgtgaagccagtaattacaggaatccatgtagtaataaacttattgtttctgtcttcaaagtacctttacttcatcctgtttaaagcttctgttgcaagcatgtcattttgaaagtaaattagactaaacatcattctgatgtccatagttcaataaagtagataaaatgcatattctatgaaagactgtcaaataaatattatgcttattcatctctctgtttgctttaaaatatactttaatttatgtaaatgagcatttaatagaaataaatagtaatgaagccacataatgcagatattgtcaagcttaaacaatccagacataggtaaggagaggcactattcaaaaggattattttaagagctgggagagggactattgcagtagaaagaatgctctagctatgagatctgtattttcaaagtcagataaaaatcttttctttgcctggccctcacctgagcactgcatatgcttactttatctcaaccctaggtggtatgaattactatccatttttagctgtcaaaattgagacacagagaagccaaatatgtcactgatattttggtttatgggggtagtgagcaaagttaggaagaactaggtgtagggaaatggtattgaaagggtggcatgacggcatgatcatacagttgattagggaatgctttttcctaacgtaagtcaatggtccagaaggcctcttaaggagaggttgtatgccgactcaggcggtgtgcatgtgtcacagttcagagacctgaaggaaagagagaagctttagttaaatttggtgaagccaaactggtaggtattttatccagattagtcagaggtataaacagttcatctaatcatttatggggtaaagactgggaatttggagggtctgtgtctggccttgtctaagtaaacaagaggggcatctgtgagtcttatctaagtcatacaggaaagacagtaagcctccagaagtaaaagggtgggaagacatctttaaccatcattgtttttcaggatcagagggctctgggaaagttcatggttcatataaagcaatagggtctagctaagtctcatccaataataggtatcatttagtgattgcctggccctcagttgagcactgcacatgatcactttatctcaaccctatgtggtatgaattattatccagttttaggtgttgaaattgagacttggaaaggccaaatatgtcactgaaatttagtggttaatctagaattcaaacttgaatgtccatagtaaaaaaatcaaactcatagtcatttatactatgacatcaaactgaagtagaaggtgcaatagtttgtttttataatttataacaaagtcattaacatttttaattattaaaagctaatgaatttttatggttcttttatttttctcttgcattttcatagatgagttccattcagacagtttgacaattaaccatgaaatctaaaaatcagaaatgattagtgccttgagttatacaatgagaccccatattgcttaacagttagaatctattgaattaaaaattaagagaaatataaaatattcttcaaagctactgagttatgcttaggatactggtctttgtaaaggaagaggaatgcaaaatgagtcatgttttattcaaggatttaaagtccagtgggaaagctatgacaatacctaatatataaataattataataataaaccacattgtcaaaagagaggtataaataagaaaggaaggtaaataaagattaatttacatttggtcaggagtatttttaagaaattgaaaaatcatacataaaaactaaaaatattggtagttttattaatgtggaatagatgattgctaagttagcttaactagatttagtaattctgtgaatgcatgatatatgtcaaatatagtacagtctttcagagaaaaaagtcatctttcaaaatgtgaaaatgctttcctattattcccaagtttcagtcattttagtgagaagtattagtaggttgtggaatacatatttcaagaaaaatgcactcaacttttaatattactcttggatttaacattgaggcagagaaaaatgctctatacagtttcaaacagatatgtattttgtgttctgaaatatagagattgaatgagagacaggaatgaacaggaccctaaggctgaaatctttacaaaagcataactgtggaggaattcacctcccaagtgaacttctctgattctcttgcttttaaacattatggcaggctctgttctttttctttggaccttgctgcgagatcctgctgagaagttctctctgcagtctgctaacagacatgtacagtgaaaattaaaattattcaattcatatatgaatgagcatattatatccagaacctacagattgtatttttgtcaatgtatggttttaaactgtttgaatttaaaaagcaatggaaattaaaatgtgactaggactttaagctaaattgttttaaaggagagtaatctgtgaaattaggacatctagagttgaaccatagagtttagaattgcaagaggacttaaaggtcatggaatccaacctcccacacagtgcaggaattcccttgtaagaaattcttagtaactagtcagctaagctctgtttgaatatccttagtgttgggaatctcactacaggggcagacatgccacttttgaatagctctaattgttaagaattttctgaactcagaaataactacctagcaaaagaggagtacttaatttgcatcagtgctttgaaaatttaaaaccaaagaaatggaaaatatcaaataatttctaaattgaataccagctccaaggggcagaattagtctcaatcattgtttggtaacttttaatactgtttccctcatgactcataatttcataaatttttgctattttgtttactaatataggggaaaatatgtgtttcagtggaagagcatgcattgtcacatatagcacaggcttgtggattattagattctagtctatcattgcctttcagctattttataactataaattttgtcttatttcacaaaatttccaatgacttctctcccaatcatgggtaagctagctttgcctccatttgcaattcagttcccttactcccagaaatgtgtgctttttaattttcctttgaactggttataacatctatctggttttcttattgaatgaataaaaataatatttttaatacatgctcattttcatttttatatctgtattagtcattattttaccttttctgaaaattatcttttaatatttgtggaggtattcccaccaagatgcccaatgatttgcttactagagccagatatactttctcatcagagaagggcacctattgagcagtttaaacctaggcttctacctaggatttctgactaaataattttgttgactgtctttcttatttttattttccactctactaattttgtgttttgcttttggtttgttttcagccagtaagttatttctgattgctggcaggaaatgttgggaatttggttttatggtctgaccatttggtgaagttattgcacatcactggcaagagtagttggaaatttggcctcaacgtcttatcatttgatgagttctgtaaatgcagtaatggtttaaagagttattttctctgtcgggtgtaagacgacagagaatcttgtttggtagggttttctatttgtcttatttgtctagtttgagctcaagtcagtgaagaatttcatgcccaccagaaagtagatatctagactaatgagtttttatttctgtgttcgtgttgaaattttagaattaaagataaccattttaaagatgctcgatgagctaagagagaaaacagataattaagcaaaatcaggaaaatgaacaaaatgaaaatatcactgaagacatacaaactataaaaaaagaacaaaaattttggacttgaagaatataatagctgaattgaaaaaaatcaccggaagggtttaccagcagacttgattgactaagtggaagaaagaatcaatgaacttcaagacatgttatttaaaattatcaggtcagaggggcaaaaagtaaaaagaatgaacatatatgaagagagactacgggacttatgggacatcaggtgggccaatatgtgtattatggatgtgccaaaaggagaagagagagatggacggacagagagctcaattaagaaaaaatggctaaaacatcccaaaatggaggaaagaaatacaaatataaattcaagaaattcaatgaactctatgtaggagaaaccccaaaagatccacacagagacacactataattacattttagaaagtcaggtacaaagagagaatcttaaaaattaaaaaaatatatatatatatcttgaaataagtcatactatatctttaaaaaatcaagagaaaaatgacttatcctgtacaaggtagctttgacaagttatcagtgaatttcttagcagaaaccttgcagaccggaagggagtgggatgatatattcaacatactgaacaaaaaagaacagccaaactagaatactatatctggcaaaattgtccttccaaaatgaaagagaggccgggcatggtggctcacgcctgtaatcccagctttgggaggctgaggtgggcggatcacttgaggtcaggagtttgagaccagcctggccaacatggtgaaaccctatctctactaaaaatacaaaaattagctgggtgtggtggtgcacacctgtaatcccagctactcaggaggctgaggcaggagaattgcttgaacctgaaaggtggaggttgcggtgagccaaaatcatgccattgcactccagcgtgggtcacaagagtgaaactccagctgagcccccgccactgcaaaaaaaaggagaaattaagattttcccaggtaaataaaagctgcaggaattcatcaccagtagacctgccctacatgaaatgctaaagagtatcctgtaagttgaaatgaaaggatgctagacaacaacatgaaaccatataaaaatattaaaatttttgataaaagtgaatatatagacgaatatagaatcctgcagtattgtaatgttaatatgtaaatcacttttaattctggtatataatttaaaatacaaaaccattttaaaaacctataaatccataataatagaaacataatataaaaagatgtcatttgcaacatcagtagcatacagtgtgtgtatgggagagatgtaaaggggtagagatcttttatgtgattgaagttatcagtttaaaatagactcctataactttatttaatccccataataaccacaaataaaatacctatagaaaataatcctatgaactggttacaacatgtgccagtttcctcactgaataagaagaaataaaatcttcggcatgtattcatatcttttaataaaagcctatgcaaacctctctttttttgtataaatgaagtagtattggataaatagatatttataataaaaatactggcttttgtcaatcttgttaaagttgaatattgataatatagtgtgatctaatatagctctgtccaatagaaatttttgtgatgttgaaactttatctattgtccaatagggtaatgactagctatgtggagctataaagcatttgaaatatggccattgctactgaaaaatataattcatttaatttaacttaaatttaaatagtcacttgtgatcacatattgtacagatctatggagtgagacttgtaagtattgccagtggcaaggaagtaacaagcctaaccatgaagagtttttgctatgtttctgtagtagaaactttcaaaccaacttacattctttttgcctgcttatatatgagttaagtaaataaaaatgaaggtttttagaaaagatcctttaaaaataatgactttgtgtattttagcatataaaaatttattttaaaatcttataccaacacttttaatcatataaaataaaatgtaacagacatctttcattatttgtaactaatatgtgtatttaattcagtttaaactgatagcattccttggaaaccaaatgcttttcaaatgataattcttagaatttttacatatcttagaagtgtttcttttgttctttgtttttttgtttgtttgtttataaaataaagacatgttacacttttgtgctagtgatctaaatgatgcaagacatgtaatcttgggagaaactagatttggaattttggtgttaaactaataatatgaacatatagcattgggagatatacctaatgctagatgacgagttagtgggtgcagcgcacaagcatggcacatgtatacatatgtaactaacctgcacaatgtgcacatgtaccctaaaacttaaagtataatttaaaaaataaataaataatatgaacatataggtaattaaatgacagtcagaaattgtcatctagaagtagatgtattggtcatctcagaaaataaccatacacaaaatacagaaatacataaaaatgcctgggatcaactaaaatttttataaagttatttttgattatcctacaaatagggatttgatgaatactaaggtatagaactttggaaactttatacttgggaaggtgttgaattatggcttctgggaaattataccaaaatagcctgctgttgaagtgaagctaagtttattgcttattgtgataatgaggattattagccttgacagaatctcattctagagaaggaaggacatagactgtctgtcatcttcctctctttcacaaacagtgccaggaataatatcacagaatcccagagtatctatattcgaaaatatatttgaaattattttggcaaatctccttttataaacaagcttttgaattctgagattgattactaaactaacatgcattgtttcatctaggtttgtatgactgatcagataacataccttattattttatcattcagacttgaacttaaaggcagagaaaggacaaaaaataaaatatttatagattatttggcaaagtataagtatctcacatctgtaaaattttaataaaattctgcaaagtttttgtgtcatgcttgcctaatgtgatttatctgtcaattggtatatagattccattaaaattcatttttaaaaaggtggaattatgactgtcataaatgtaaaataaaatggttaaaaattttatttagctcaacagttaatgaggaaaccaataagatgttacaactggtaaaaagagaattttaaaaaatacaaaacacacagatacagccaattaggaactgtgaaatgaatgtacaaatagatgcaaaaaaaatgcttcgtatccacaagacagtaatcagttgcatctacaggaggcacaattcatttacatatctatggacaataatcattataattattataatcagttttctacaatttacagagatgtaaaataactcaaagacgatgaaaggcggatatgactcagaagggtgctctagagagcacatccaattaactttttgcctatttcaaggactttcgcagtgtttttcttataaccccaatgaaaatgagaaatggtttccactttaccctactctccatcacgtcatattagtgttgcctatttgactcattagtgttatttgcctgactcctgcagccattttaatataaaaatttgaaattcctactctcaagttgaacatagaagatagtcaatattctaaatttaaaaggttaaaaacttaacgtatttgtttttaattttaacatatgtttaataaaataagaaacttgaacaccgtagtatttatggtctgcataatctgttggatttacctaattcatggattttaatacacatgttgtctttaggttacccctgagggcaattgtttttggcatacctagcataaagcaggtattccctgtaagattttttcccatttcatgtaaaaaggttaaatgctggtttggtggatcctgcttcaacattatgaagatagcatttgaactacatgtctttcgggaaattatatatggatatatctacagatgtagatataatagatacaaaccagtaagaaaggaaatctaactttttagtgatttcctttttacttttaaaaaattgctattgaattttttcagttaaatagtaacaaaaataactaacaacataggctccatacaaaatttaatttgccactttataactttttcaattcctttatactgtataaaccacagattttttgtttctagcctatagtttctgcctaaaatacaggaaatgatacttacaataccaaaatgaaaccattaaaagttttggatgctggattaagtgatataccacttaaataatgatccaactttgtctaaattcttcaagaactagaatatatataattttattatattatctcctttttacattgtttttttttcctttggatctgatttttcaaaactttagtctaataatgtatcactctgtaaagtaacattccttgtaagatttttaaagtagaaaatcttttcacatgaagatatatatgtactatatacatatatgtatatatttctaaaccctgtgttctttgtgtaattgatggaggattggtctgtagagaacaaccaaagttgcaaatcatggagaaaatctctctgaagtgcaagtaagataaagaataaaataattggagcattgttgttttaaaaaaaaaagcttctcttggaaaatgtccttaagtatacgtggttagaaaaataatgaatcctagctttaaatttgtgtgatttaacttagtttacgaatgtttatgtttttcattaatggaaaaacgtttaccaatgaagaataacatgaattgatttataataattagcatgtttaatttcaaggatactgcctcaaaacactgaattaagttttaaattattatgcatttgaccacagagagtctataccaagctattatgatgtagttatgtttgttttaatacttcagtctccacataaatggcataagataacctcatattcataatactctaagtacgtgcatgaaaaaatcaaaactgttatttgaataacaaagctcatgggacaaggaaatgatgccaaactatcttttaggaaattacagagtaaaataagttatttactttaggtacagtatttaacttgtacctagtacattgatttaacattcacatctctgataaagagttacctactagtgtcagaaatcccatatatctccaaggttttactatggctcgaatgcctcctccacacattcaggtgttaccaatgtggttgtattgagaggtggagcctttaaacaatgattaggccatgaaggctcctcctgtgtgaatgagattaaggcccttattaaagaggttacactcagtgttcagcgatcttgctcttcctccttccgccatgtgagaactcagccttccttccctccagaagacagagtaagaaggccctcacctgacatcaaaatgccagcgccttgatgttggacttcctagcctccagaactgtaagaaataagtttttgttctttataagttaaaaatatataaatacataagttatttatcatgcaatatttaaggaatacctaagcacatgcgtgctcaccatctagcttaagtaataaaacattgccaaagcagcgaaatcccctcctctttgtctgttcccttccttccctgatcatctctcctgtcttccagatatacttaccattctgaatatagtgacaatcatcctatgcatttgttatttctttttttaaatatagctgtctatccccaagcaatatatagtattgttttacagtttttaactctgcataaatagtgtgataaaatatgtgttctgaaacacacttttgttttgctcattgtacttgtgaaattcatttgatatgtgtagctctggttcattctttatcagtgacataatatttcactgtttggtctacattatcaaatggtggcctactcagaaaagaatgtggttaaaaaaaacccctaagttggacaatattctgattattatgattaatttcagatttattaaactaaagtttattttgaatcaactagcaatgaaaaaataaatattcatatttaatatgaccataaatcagcttttctattgcctttgcatcaataattaaaaaataagtaaataatgcactgattcaatagtcaggtgctatttatcccaattctacctaatttagaggtaatatattaggtaggaaacctaagagtatcagtactgattagtgatttgaggcagaaaacttgcaaattaggctgggaattgctagtaaggttctggattcaatcatgatgaagtgacttggttttatgtgcctaaggaccctgtctaatgagttgtatcgtcttaataggccacgtactggtaaaaaaaaaaaaacaaaaacataaaagcaagcaaatgttaatgatatctcaaaagagctcattaattaggcagtcggcacctcaacacagaaaaaatttctggccatgtggccctcaccccactttagccttagcaggtagaaaaactaaatgcttgaggagtatttgttactaattacctctgattggtatgccatgtctggtctcgttttgatatagagggcaaaaaacatgaaagccaatgaacattaaattgccaaagtgagtgtaacacagcaagaacatttaccatttccaccatgtttcatcataaatgggagaaataatactggagttgtggaggcaggggttttggagatatcacagatttgagtcatggacagctatgtagtgctatccattatcttaaaaaaaaaagtccttttaaaacagtattagtcatgtctacaggatattttctcagttttgcataaaatgcttcctgacattttcatgctaatataacattaaatatttctgttgtataacaatctcactagaacttggttttccttttttttaagacgtgaattttaagtggtggtcattatgatatcattgaaaggaaaccagaactaacaataattaccaaatacagcccttttattacctgtttcccaaagaatctccattttatgtaccatttgacaaatgcaacctattgtgtaagtagcaaaaactctgcaggcagagtgcatttttaatactttattacattaagactcaggtttaaaaaagtaagttatttctgttagctttagtatttttcacttcatagaaaaagcttttgtctgaattgtcctattttggggttcctggatttagtaagatgatataaaatactatactattttaagatattattaatactccactactaagaatataatattaggatttaattattttttcttgcctatacatattagactatatatttgactttgcatttgcataaagagcatattattacaatccctaacatttcttagatcgtaaggcaaacctatattcaaatgagaatatatattgaagattccatatctataagcctgagataaatgtatgatttggtgagagggagaagagaatttataataatgataaaagctattaacactaaaatattttaggatttttagcacagtgtcattatctacatgaagaaattgttatacttgcaagtgaaatagttccacgtgaattcgaatggctgggctagaaattaggaagttggtactatttggaatgaagcacttatcatttttctttttctgaagacatattttttcactcatctcttctctccaacatctttcaacttattaagcaggtcgcctaaaggagaaaccatctccagaaaaattgcaataacttctttagggctttcgtatttggcttcagtttctcctaccttccgtaatagattcaccctctttgttcacctttctaaaggaggcattgtaaggaagctttcttacagcgaatttacaatatctggtgacgtctgactcctttttttttcttaggctagacactttctcactgaaagaagccttttgtcggcatctattatgctactttcccaccgttataaatcctctatattttcttaaataggacagatgatattaggtatccagttccaatgccatagcacttgaatttaaatgtagacagtgttttattctcctaatctctgtaaactctgatagttgctttaacagaacgtgccttttttgtttgctttgttcagtggttgagctttaatagtaagtgaggagggaacatagataaaagaatgtctttaaaggccatgaaatcttccctcagtttggaacaaacaccttagcttcaatgtctctgccacttagcatatttaatttctttggacaacattgtccacagtgttgaaatgaatctgacttgaaaagctcaggcatttttaggatatatattggcattaataaatagtgtgttttgacttcagagctgtgaattacccctagttccctgataaaatatttgtaattggattttttttggtcagtattaaagtgtgtttgagtttcaagagagacatgaggagtttttaatatagaacaatttattttacttaatatcttacatttatttttggaaagtgattcattgtatttaaatttctcaaatattcaaagcaccaaggaaaattatagacaatagtttctattattatttgcttatttttctattggaaaaacttttgtttttttctcactatacaaataagttttttcaattagcttaataactttgaacaacacatttatttgacactacatttaactgttgtcaaaaatgttattggatcatggttgaataattaataaaccattgggtactttctacagaaccattttagttattttataataaagtccctcataggagatattagttgaggtgaaaattgttcctatcagtataagcccaagaactcttgtctgacaattaagcaacaaataattattgtgccctcatagaaaccactggtagctctttcatgaatgaatgacaatatttcactttgtagttaataatgtatgaagacagatgaaggtgtttgtgacagataatactccttcgtgaaatacagaatcactgctctgcaaatagtattcattaagggtgtggtatttgtctggattaagtagtttttggtggcatgtatgtataaccaattcaaaaatgcttaatgaaaatttatcactatgatagttataaggttgttttatagaatacaaagtttgcaaatgcagacaggattcataaaggagagaaagtagaataggcatgctatcaggaactcaggcagaactctcaatgtagtctctgagtttacttggtctcttgatttaattaattaattcagtcagtcaattggtcatgtgtctatttactcaacaggtgtttattaaggaccgtgtgtctaatccagtcactggaactatgtataatacagacttgacttaaaaataatatataattcacaaaccatgctactgacccatttaaattgtataatttgatgatttctaataataaccatagagttgcataagcatcactacaaacacttttagaacattttctttactccattaacagtcaatccctatccccctttcccctgctactagcaaccactagtcttctttctgttgctatggatctgcctgttttggatatttcatatgaaatgaatcatgtaatatgtggtatttcatgactggcctacttcacttagcacactataatccaaagtacttcttcctttttttgcagaataatataccgttgtatggatgcagcacattttatttatcctttcatcagctggtagacatttaggttgtttccacctcttggttattatgaataatactgctatgaacgttcacttgcaagtttttgtgtggagatattggtggtttgtgtttaaagtattgaggaaccagatttaccaaaacagctgcatcatttttcactccagctaatagtatctgagggtgccagttcctccacatccttaccaatacttgttattggtctttttcattatggccatcctagtaagtatgaaataaaatatcattatagttttaatttattatctctctaatgactaatgatacagaacatattttcatatacctattggatattcatatatcttctgtggagatataaatctttatagcgtttggtaatttttaaattgggttttctgtgctattattgaattataagagttctttatatattctagatgcaagttttcactcgcgtccgagtgaagagaccaccaaacaggctttgtgtgagcaataaagctttttaatcacctgggtgcaggcaggccgagtcctaaaagagagtcagcgaagggagttggggtggggctgttttataagatttgggtaggtaaaggaaaattacagtcaaaggggggttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcctcaggtaaggcaggaacaggccatttaaattttacttcttttgtgattcttcagttacttcaggccatccggatgtatatgtgtaggtcacaggggatatgatggcttagcttgggctcagaggcctgacattcctgtcttcttatattaataagaaaaataaaacaaaacagtgttgaagtgttggggcggcgaaaattttcgtggtggtgtggagagataatgggtgatgtttctcagggctgcttcgaggtggattaggggcggcgtgggaacctagagtgggagggattaagctgaaggaagattttgtggtaaggggtgatattgtggggttgttagaagaaacatttgttgtgtagaattattggtgacggcctggatacggttttgtatgaattgaaaaactaaatggaataagagaaggagaaaaacaggtattaaaggcctaagaattgggaggacctaggacgtttaattagagaatgcctaaggaggttcagcatagccttgccagcaaagattatttactttaagagttaagagtggcggtttggggatagcaccaggaagtatcagctgtgatgtcttggagaagcagtgtaaacaagagcagggcatttatgagtagttgagactggtgaataggagtatgactagacagaagatagcagggatgacaagttttttggggtgcagtctaagttggtctggtgtctggaatgagactggggccgaataaaaaggagcgtctatacaggagcttaaatgggctgtaccttgtagcattctgaggacaggcctgaattctgagaagggcaagtggtaaaagtattgtccagtcctttttaagttggtggctgagcttggtgagttgtgtttttaaaagaccattagttcactgaatactaagagcctgagaaactgcttgggtgatttgactaataaaggccggtccattataggactgtatagaggtgggaaggccaaacccacgaattatgtctgccagaaaggaagaaatgaccgtggtggccttcttagaccctgtgggaaaggcctctaactatccagtgaaagtgtctacctagaccaagaggtattttagtttcctgactcggggcatgttgagtaaagccaatttgccagtcctgggcgggggcaaatccctgagcttgatgtgtagggaagggaggaggcctgaataatccctgagaagtagtagaatagcagatggaacactgagaagttacttccttgaggatagatttccatgatggaaaggaaatgagaggttctaagagacgggctagcggcttgtaacctacacagaagaggttatgaaatgatgacagaacagaatgggcctatgaggctggaaggagatattttccttggtctaagaaccatttgccttgtgtgggaagagattgataggtggaagtttcagcgggggagtaggtgggagtgaccgatgtgaaggagaaaaactggccatgagggacagaagttggaaggctagctgcttgtctagccaccttatcagcataagcgttgcctagagcaatgggatctgacgccttttgttgccccttgcagtgaatgactccggcttcctttggaagtaaagcggctttgagaagcgtttttttattaaagaggtattaatgatagaggacccttgtgtagtgaggaaacctcttgcatggtggtgcaggatatggaaggcatatttagagtcagtataaatattgatgtgtagtacctttgcaagagtgcgggcttgacttaaggcaatgagttcagcttgttgagaggtagtggaggagggcagagctgtagcctcaatgatagatgtggaaggtactgtggcacagcctgcctttgctggtgagtggcgattaggcctggtggaactgccatcaataaaccaagtgtgttcagggtgaggaacaggaaagaaggaaatatggggaaatggggtgaatgtcaggtgtatcagagagatacagtcatgggggtcaggtgtggtatcccgaataatgtgggaggccagattgaagtctgggccaggaacaatggtaattgtgggagactcaacaaagagtgaatatagctgaaggagccggggagcagaaagtatatgcgtcaggtgggaggaagaagatagattttaggagttatgagaactgtagagagtgagttgagcatagtttgtgatttttagggcctctaaaagtattaaagcagtggcagccgctgcacgcagacatgagggctaggctaaaacagtaaggtcaagttgtttggacagaaaggctacagggtgcggtcctggctcttgtgtaagaattctgaccgcactaaccatgcctaggaaagaaaggagttgttttgtagaagggattggggtttgggagattagccggacacgatcagcagggagagcacatgtgtttttatgagaattatgccgagataggtaacagatgaggatgaaatttgggcttgactgaagtaatgggggctgtctgtgaagctttgcggcagtacagcccaggtgatttgctgagcctgatgggtgtcagggtcagtccaagtgcaagtgaagagaggctgggatgaagggtgcaaaggaatagtaaagaaagcacgtttgagatctagaacagaataatgggttgtggagggaggtattgaggataggagagtatatgggttcggcaccacggggtgggtaggcaaaacaatttggttgataaggcgcagatcttgaactaacctgtaaggcttgtctggttttaggacaggtaaaatgggggaattgtaaggggagttataggctttaaaaggccatgctgtagcaggtgagtgataacaggctttaatcttttcaaagcgtgctgtgggatgggatattggcattgaggggggtaagggtgattaggttttaatgagatggtaaggggtgcatgatcggtctccaaggagggagtagaggcatcttatacttgtgggttaaggtggggggatacgagagggggatgcaaaggaggctttgaactggggaaaagggcagcaatgaggcgtggctgtagtccaggaacagtcagggaagcagataataagggaactgggcaggtggggataactaaaaaagagtgtttaaaagaatgttttctaagttggcaccagagttggggagttttaagaggtttagaagcctggctgtcaatacctaccacagttatggagttaagggaaacaggcccttgaaaagaaggtaatgtggagtgggtagcctctgtattgattaagaaggggacggacttaccctccactgtgggagttacccagagcgtctgtgatggtcctgtaggcttccgaggcaatcaggcaatgtcagtcttcagctgctaagccgagaagatctgggaaggagtcagtcagagagcctcgggccagagttccacgggctctgggagtggctcccaggtgagttgaacagtctgattttcagtggggtcccacacagatggcacgcggcttaggaggaatcccgggctgtgggcattacttggcctggtggccagatttccggcacttgtagcaagctcctgggggaggaggttctggaggaacccctggcagctgcggttcgggcatttggagttcttctgtgctggagatgtggctggggtttgtctcacagtggaggcaaggaattgcaactcagaaatacattgctacttggctgcctctactctattattgtacaccttgaaggtgaggttaattaagtcctgttgtggggtttgagggctggaatttaatttttggagttttatttaatgtcaggagcggattgggtaataaaatgtatattgagaataagacggccttttgaccctttagggtctagggctctaaagtgtctcagggttgctgccgaatgagccatgaactaggctgggtttttcatatttgatgaaagaacctaaacgctaactgatttgggagaggtcggataaagaaaaaggagcattagccttgactatgcctttagcttcagccacctttttaagaggaaattgctgggcaggtggtggagggctagtctcggaacaaaactgtaagctggaccgggtgtcaggaggggaggtgataaaaggattatagggttggggagtagaggctgaggaagaattgggacctggctcggcctggcgaggagcagcctggggaggaggggagaggtcagatgggtctgtagaaaaggaagattagaaagactcagcaatgcttggggttgagactgagagaacaagcgggagggaaagaaggaagatttgggacgagttgcattgggaacaaagagtagggagggaacaatgtgtgaaagaatgcctggacgtcaggcacctcagaccgtttgcccattttacgacaagaattatctagatcttgtaggatggaaaaatcaaaagtgccattttctggctatttggaaccactgtcgagtttgtattggggtcaagcggcattgtagaagaaaataaggcgtttaggttttaagtcaggtgtgagttgaagaggttttaagttcttgagaacacaggctaagggagaagagggaggaatggagggtggaaggttgcccatagtgaaggaggcaagcccagaaaaaagagagtagagacacggagagaaggggttgggggggttcttgccctccagaaaagcagagaaggggtagagacacggagagaaggggtcgggggggttcttgccccctagaaaagctgtacttgccgctaagggtgaaggaccaaggcaggcgtccctgcgtggccagagacctctgaaacgtgggtgaataatcaggcaggcgtccctgcgtgattaaacaccaagggaagactgtcttcccgagcccgtgaccagcacgggagttttgggtccacggataaaacgcgtctcctgtctctaccagaaaaggaaaggaactgaaattaagagaagggagagattgaagtgtggcgccaagattgaaaggagaaagaggttgagggatagtgagagaggttggagaagagaataaaaagaggccacttaccggacttaaaattggtgagatgttccttgggctggtgggtctgaggaccagaggtcgtaggtggatctttctcatggagcaaaaagtaggaggacaggggattgatctcccaagggagttcccccctccccgatctgagtcacggcaccaaatttcactcgcgtctgtgtgaagagaccaccaaacaggttttgtgtgagcaataaagctttttaatcacctgggtgcaggtgggccgagtctgaaaagaaagtcagggaagggagttggggtggggctgttttataagatttgggtaggtaaaggaaaattacagtcaaaggggagttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcattagttaaggcaggaacaggccatttacatttcacttcttttgtgattcttcagttacttcaggccatctggatgtatatgtgtaggtcacaggggatatgatggcttagcttgggctcagaggcctgacacaaatcccttatacatatgatttgaaagtattttttctcattccttgggttccctttttactatctggacagtgtcctttgaaacacaagatttttaaattttgataacctctaatatatctattttttgtcttttttgttttaagtgaataactagtaagtctgcctaacttaagatcacaaaaatttctcctgtattttcttcaaagagttttatagatttagctcttacattgaggtctgtgatttattttgaggtaatgtttgtgtgtggtgtgaggatggagtccaatttcattcttcaaacttctttttttcccccttttttttagagcaaggttttgctatgttgcccaggctgatctcaaactcctgggctcaagcagtcctaccgcctctgcctccctatgtgcctggcgaatttcattattttacatgtggatattcagtttttctagcttgatacctatttttataatctaatagaaaggactggtgctcctcaaacttaaatgttagtaagaatcacctgaggttcttgttaaaatgcagattttgttatggtagtgggacctgagagtctactttcttacaaacttcctaggtgatgctgctgattctggtactgggactttttttttgtttatttttgagactgtcgcccaggctagagtgcagtgttgtgatcatggctcactacagacttgacctcctgggctcaagagatcctaccacttcagcctccagagtagctgggactataggcatgctccaccatgcctggtgtattagtccattttcacactgctataaagaactggctgagactgggtaatttataaaggaaagaggtttaatgactcacagttcagcctgtctggggaggcctcaggaaagttacaattatggtggaaggcaaaggggaagcaggtaccttcttcccaaggtggcaggaaggagagtgaacacaggaggaactaccaaacacttacaagaccattagatctcatgagaactcactacaagagaacagcatgggggaagcagcccccatgatccaattacctctacccggtctctcctttcacatgtggggattataattcaagatgatatttggctggggacataaaacctaaccatatcaccaggctaatttttgtattttttgtagagacagggtttcaccatgttgcctgggctggttttgaactcccgggctcaaatgagctgccttccttggcctcccaaagtgctgggattgcaagcatgaaccgtgcctggccattcctgggacattttgaatagcaaggaaatagacaagtactaaacaaagaattataagtgcattctaactgtgcatctgttttattttcacctgtctgacaactggctttctttgctgcttcccgtatgtgggagactataacctctatactgcttccaagatcacatcccattaggtcaagccataaacttaggagttgcaaaatggcattgctaagcctgagtttttaattcccagcagagatgagccaattggctaccttagacctatcagctcttaggtgttcagttcttagttctatcagctgtggctaggggtctggcttgtagagggctcagtgggtcagtggcagctcagagagaagagagttgtgggctggccagaaactgaatgcttttctacagatgtacaattgaccttctgtgtcatttcacagaagtgtgggcatctttgactttaaattgaaaattgttaaaggcatggtaattagcaggagtcaggaattctccaaatgactgttactgaccaattctgggcagaggagggggaaaaagaattttccttgattaccagctaaactgtgtttcatatttagcaacatgaatgatttgtgtgacttcactaaggactccgattggaacacaggcagtcctagtgcagactattgagtgggcagtcatgggtaaggtactgagcctttgtggaagctttctcatttatagactgaggaataatagctgttctgcaaagacatttttaatcattttgtttctggaacaatgtgtaggtgctgaatctgttagttttcctctctttccccgccttcctacttccagaaaagattttctgtgatttacatataaatgatcaagtataatagggccattaaattacggataaaacaagagccctctaatggaaagagaacatagtttttctacaaaaatcaaggctaagatggttactctaactgaataaaaatttaactatgagctttctggcacacatcataaaaacagaatagatgaaactgtttttaatatataaaaatcttaaaataccagttaggagagagaaaatgtttttttctaacattaaaatcatgtttacatagaataactaataagaaaaatggaatgacataattgacaatgttttaaaagtatcaaatgataaaacctttttctagtatgctccttgaattctagcctctgcacactgtctagtttctcatttttaggtatttgttacattagcatcccacttccaggtatttttatttggaagtatttttatttggaagactgggatttttattttagaagcatttaaacaaccagctttaccttatctattgaatgtctctgttctagctccccctttctttgtcccttataaagggaaaccagtagtctgttagtgaagagtgggaaaatcactaacttactgtaaggatattaactcttatatatcacataaaacatatactaggtccattacatagtacaaagaataagttgctacagtgccaataagcatgcaaataaatttgataattaacagctggtaggatttatgcatttattcactcatcatctattgagcatctattgaatattggaattatagcgagtaacaaaacaatggaccatagattatatcagaaatcttcatggttgcatgcaaatgaaagaaaaaaatagaatgaggatttatgtgcttagggcaaacactaacatagagccatttcttaggcacacatcaactaattttatactatataattacagtgcttaggtgaaaacaaataatacaatgatggttttaataaaattaaatttaactccctcttgtttcactgttactgtttttcaattaggaagcatcatgccatttgaaatttgggtaatacatatattattttcaatatttagatagcatgtatgttaaaaatattttaacttttccattttgcttttcacttcatgttatcaccctatttggacatttaatttttcttgcttgtattgttgcctgtgctgtacaatctctttattgctgcttttcttcaatccttcctgcatattgccattagactcttttcctaaagaatagtctttgttgtgagagtctcttgcccaccatctgaaatgctgatggctgaaattcaaggctttctaagagatggcagaaactaacttttttgcctcttattttgtatcactacattcatgaaagtttgaggtataataattcacacaaattcatcacataaaactttaatttgttttcatttgcggtattctccatgagtaggatagcgatttccatcctcactcgctcaaatattactcagcctttcttgtatagctcaaaggtcacttttgtgaagctttccaagttgacttcagctttcaggaatttccttcatctaactctttaagtaatttgggttagtttatatataacccagaaataatggctatgtgactcccactctatagagtaacattttttaaatctgcatctaatgatcttaaataataaggtgtactttttgctagattataccatgacatgcacacatttctccagaaatcgtcagtaagaccttcccaaagttctatattcatgtcagccacaaaattatctctctggcttcctcccattcatgtttgttcattgcctagattaagccacttcaccttccttatcctttttttttttctttaattactacagtttggttctgttgcccaggctggagtacagtggcatgacctcagctcactgcaacctccacctccctggctcaagccatcttcctacctcagcctcccaagtagctgggaccacaggtgcatgccaccatgccttcctcctccattttatcacatcatgacactctgtcttcttgctggaagttgtcattggaacttctgctgtttcctacttcctagggaacccagaattttcataccttactctcaacccatcagttcccctgagagttcaagaaacttccaggtaatagcagttcttctctcactctaaccgatttttgttgtgagacatccttgtggagactttctggtaaataaaactttctactactgtcttttctatatcattttcaacaagtactttctacacctggtaatagtgcatgttttatctactcttcaaaactaagggaaaaaatgaggacaggaagtacttttttattactcatggcttaactcagaggtccccaaacgtcgggccacagaccagtaccagtatatggcctgttaggaactgggacacacagcagagttgtgcagtgggtgagtgagcattactgcctgagctctgcctcctatcagatcagcagtggcattagattctcataggagcaggaaccctattgtgaattgtgcatgccagggagtgagggatttaggttgtgtgcttcttatgagaatctaatgcctgatgatctgaggtgaaacagtttcatcctgaaaccctccccaccgtctgcgggaaaattggcttccatgaaactgatcccttgtgccaaaaagattgagggccactggcttaacctttagcaagttctcttctttgggtgaaatacaagtaggaaatgaagcttcagtcacatattttctttccttttttttgtttgtttgtttttttgagatggagtcttgttctgtcacccaggctggagtgtagtggcgctatctcggctcactgcaacctctgactcctgggttcaagtgattctcctgcctcatcctcccaagtagctgaggttacaggcacgtgccaccatgccctgcgaatttttgtatttttagtagagatggggttttgccatgttggccaggctggtctcgaactactactgacctcaagtaatcctcctgccttggcctcccaaagtagtaggataagcttcagtcatgtattttctttctttcttttttttttttttttgttttgatcacaggcatgagccaccatgcccggcccagtcatgtattttcgatacaagccgggtgtcattgacatctaccacatgtccacacggcatttcgttcttctgcatgtagtgttaaagaaggtgtagataaaattcctgtcattccttccttttctaagcttgcatttcttttcctcctcctaaaaagaaatgataatagcttaaccaaataaagcaatttctgattatgcatgatataatagattatgttatcaggactaggtaagacaatcaacaactaaccaaatatcttaatgttggaatttattatgcgctacctatatgcatatattctatgggcaaaatattatattcatataatgcatacatatgtgtattttaagatactttgtggtttttctaaataattgtattatatttaaattatgagaaaagttaaaatattaactaatgaataaaattacatgtgtatatatgtatctgatatatataaccatatatattatatatttatatatgtgtgtaatatataacctatagtcttccctctttctccattacaagatagacctacagttatagtttttttaacacaaacttctactgaagatgcagagtattagaatttcctttcttgctatcaaactcaaacattatcatcctcatggaaacattaataatagctgtttactgtaccattagtaggtaccaagtactactctaggagatttataaaaattaaattgtttaatcataaataaataattgtgaagtgaattttgagaacatggaagctcaaggacacactgtaagtgcaggagatggaaaaaagggtatataaaattggtctgaatatccagattaaaatttctagcattcttagttggaatggtatatataacgaaatactgtgtggaactcaaaacaactactattcatcgtaagcatatttctcacagtagcatcagccacagcgtcactgagcaaagtagagaaagtggttgtgaatctgacaggccgtagcttaacatctggcacaataaatcattattatcacattcttaaggttagaaaggagtgataatttaaatgtttacataaaagaagtcacgttttaaatttctgttttcttggtaagttatacttcttagccacagtttccttgttcataaaatgggggcatttgttagatctgtaaggatccttcaagccttacaatttctacaaatttgtgattcctttcaattaacattttatcaccaaactaaattatcttaaaggttgaaagaatatgagatttaaacccaatgagttattctattgcattagattcagaagaccaatggagaaaaaagtataaaacaaatatatgcaatagagaaatatcaaaagttttccataatatttctacatgtatgtatacattgaaataacaattttaatacttaccatttaagtaaaatcatatatcgtaacttagagaataaaagcttttctaaggaattcaataattagagactttcatggtatgttgccttatgattctcttttgatttgctttgaggtatctgttacttctttgaagtttatgtttttcttacatttagttttggatattttctcccattacatttttcttccataatctctaagataaacacatttattattaaaatgcagtagatttcactagatctttaaaactcagtaacaaagtatcattttctatgcattattattatcactactaatctgtaattttatagtattgtatatacttatattattttcaggtttttggatcacatttcctagacaataatgagaaataagggcttctatttaaatggatattcaaaaagtatcatatatttgctgtggaccttcatctcagtgaatttgtgaatgtattatttataatgaaaataaaataagtgaatgctaaaaaagtttttccttttgccaggggatttaccagaaagagaacaaaatggatcatggtatgatacttttctgtgtaaatatatagagaagaaaatctaccaaagatttaacaatgattttcctacaattggggtgggaatggaatggtgagattcagaacaggttcaactctctatgtggtatctttctgaattagaacattttgaatgaatttgtatttctttaataactactaaaatatgttgttatattaagatagtcatatttagagtatttatactaattcttgaaatcacaacaatttatttcatatgtaaagaacaattgcaaaaacctctgccttgatggagtttacggttcagtgggggagagggtgataataagaaagtaaaagatggtatgtagaaaaataaaaacacagaagggcagtaggaagtgtgtatgtgtgagatataattcttagtaagagaaagaaggcctgtaactgaaaaattaacatttgagtgaaaactgaaagaaggcaagtatattattagtccagacgttctcacactgctataaagaaatacccaagactgggtagtttataaaagtaagaggtttaattgacttacagttccacatggctgcggaggcctcaggaaactcacaatcatgatggaaggcaagagggaatccatgaccttcttcacgtggcggcaggagagagaagagtgaggagtgaaggggaaagagccatttataaaaccattatatctcatgagaactcactcattatcacaagaacaggatggaggaaaccacccccgtgatctgatcacctcccatgaggggtctccctagacatgttgggattatggggagtacagttcaagatgagatttgggtggggacatagccaaaccatatcagcaagggaagaaaccacgcagttgtctgtaataggaatttcaggatgaaggaactgctaggacaaaggctctgagtcagaagcacatttggatagtcacagtaagtgggagtgtggtaggagatcaagtcagagacgtaatgaggtaataggaaacttgggccatggtgagaaattttatattggctagatgagttaagagtgaaataagcattaagaaggaagtaagtggttgggtaattgagtaaaatatggtttgagtgcctcaaaacaaagagcaaatatgaatagagaaaatactatttccccagctagcaaagtatttttggaaaaattaatatcttctcactagacatatgtatatatccaagctatttaggtaaataatttgatttaaactgataaataaattaagatattttacaatctttcattcttttcatttttttcatttatttcttgagtatctattatgtatcagaagacaaaatcacatcatactctcaagtttacagtctaagtctacaacgtaagtctaatatatccagccaaagttagatttgcatttattttgcatgataatgttagaatggtttcaagtaacacttggaaagataacctaaaatgaaaaagtttagagagtgaaatgcatattattttttatgtgggaaacatgaatcttagttgtgaaaaatagccttgatgatactctgaggaaaagtaaccaggttttttttttaaccattaagtgtgatgttagctgtaaattttttgtgaatattctttgtcttgttggggaagtccacttttattccaaattttctgacagtttttattatgaatgagtgctggattctgccaagtctttctttacatgaattcatatgattatatgatttttctttagtctcttgttgtagcggattgcattaattgatgttttattatttttatttttattagtattttttgagacagagtctcactctgtcacccaggctggagtgcaatggcacgatcttggctcactgcaacctctgcctcccgggtttgagcgattcttgtgcttcagcctccctagcagctgagattacagacatgcaccaccacatctggctaatttttgtatttttagtagagacggggttttgccatgttgaccagggctgtctcaaactcctgacctcaagtgatgcgtacacctcaacctcccaaagtgctgggattacaggcgcaagccactgtgcccaacctaattgatgttttaaatatcgaaccagcattgcatacctggtataaatcccacttgttcatggtgtatgtaattttttatgctttgttggattagattatttaatagttcattgaagatttatgcatatatatttatgagagatagcttttatttgttgtaatgtctattagggtttggtactaagttaatactggcctcttggaaaaagataggaacaattttctttacttctgttttatgaaatatattggaagattaatatttcttccttaaatgtttggtagaatttcctggtgaaataatcaggtccttgttcttttgttcttagaaggttattagtaattaattcattgtatttaatagacatagacctattgagattatctgtttctccttgtatgagtttgtgtctttcaaggaactggtttatttaatataatttatccaactattgaccatagagttatttctactgttgctttattaccatctaatatctgtgggatcaatattttacttttgatattggtaatttttgtctctctcattttttcttggctagcatggctagtggtttgtcaaatttattgatctttccagagaaccagcttttgatgtctttttttctattttccttctttcagtttcactgttttctgctctaaattttgatgtttatattcttttttagatataaagtgttgttttttctctggtttcctagggtgaaagcttagagtttcagatcttttcttcttttgcagtacatgtacctaatactatacatttcccttaagtagtatgttcactgcatcccataagttttggtcagttgtattttcattttcatttagtaatattctagaatttctcttgagaattctccttgactcgtgatttatttggaagtatgtttaactttcaaatatttggagattttcaaactgtctttctgttattgatttttagtttaattccattgtggtctggaagcatacttcatgttatttctattcctttatatttgttaaagtgtgctttatgggccagaatgtggtctatattggtgaatgtcccatgtgagcttgagaagaatgtgtattctgctgttgttggataaggtactctataaatgtcgaatatatcaagttaattgatgatgctgttcagttcaactgtatcctaacaaattttctgcctacttgatctatcagttactgaaagaggagggttgaaatctccaactttaatagtggatttatctatttttcttttcatgtttatcagcttttgcctcgtgtattttgatactctcattaggtgcttacatatttaagatgttatgtctacttgaagaatttacccttttttgttatgtagcgtccttccttatccttgatacttttcttgatctgaggtctactttatctgacattgatatggctattccagctgtttttttaaaataatgttagcatgcgatatcattctttattcttttattttcaacctatctgtctttgatacttaaagtggtttcttgtaaacaacatcaagttcagtcttgtcttctcatttactcttacagtctgttttttaattggtgtattttgaccattcacatttcaagtaaatattgatacagatggattaatgactgtcatatttgtaactgttttctatttattgcatctgttctttggggaaaggaagttaaagtcactaggtttattattccttgcaacataaattaatggctctggggggatatatgcaggtctctctgaaagtgtctattgtgaacttctagttttctttttttcgaaagccttgaccatgcagaaacatgaaactgttcatatagcattgtttcctgacagtttatagccaatctatgtcagttccataatttttaaacttagaacatttcattaacctccttatttcctttttataaacatcttcatttttcaggcattgcatttaacttgattctgaaccttactcagatgattaactcaatcctttaagaagatattgaatttctgaagaactttctcaataatgttgatttaaaatgattaatgatagtccctttacttcccattcatgcttaaattttataaaatacaatcctttttatttagaatttaaagaattttccttaaatattgtgaggtgtagcagtaacagctttttgttttgagcaaaacttttctctggttatagtaaaaactggtttattccccttcgcaaatttgcaaactcaccaaaagccctcaatctgttcttccacaaagatgtaataaagcaatttgctgttgaattctcaaaatacaagtatggctttaaaaacaacttcttctggatatattttgtgcaacagcattttaaaattcttgtttattcttttgaccacctgtgaaatttggagtattgtattttagccaggctaatataatcaattctgccaactctatgtcaactacaaggaaatattcttacttaaaacaaataaataccactaattagctcttcatttcgtgaagtctgagaatgtgaggctcagatagtaaccattgaaaaaagacaactcagaatgttgttatttgagcataattctattggttctctgacatgaaaggaagcctttctcccccaaacttcaagggattttctttatttgatctgagaatcactgataacttttgccattctcaacccaacctgattccttgtttgttatgattttaacagtgacaacaaggaaaaacatttgatgttagtaatatgtgaaatcttaggattctgtgtcattccctttattttataggtcaatacatatttaatacatttctactgcatatatagaaaaggaaagtgagatttatatactaaagcatgaagtacagtgtcacaaaagcagaagaggaaagaatttcaagaaggctgaaactgtcatcagtgttaggttcagcactatgttttcattaaaaaaagaagaaataattttcatttgaaaagttaaaaaaaaaaaacgttttgtaaagcttttggaatgagtcttactatactacacttgtttttgtaagactgcctgaccctaggaattctaagatagatgactaatatagataatggttgctgcttaagtgtgcttatgtgtaaccctaattcatcactgtccaatggttaatagatttagagtagctgcattaaaaaaaaaaacacgtgaggtctttttttaaaacataatctgtcttgtctttgtcattttggcaatagaaaatgtagttttattttgataaaggttgaagaatttattgggagaagatatctgatggcattaaaaatgtctccctcaaagcaatttaagatatcaaagttacttattgaggctcaatctgttgacacagtcatacaccaataatttcctaaaagcagtacagaatactaatgggtgattattttttagcaaagaaaatgcaaatatattctgaattgaatgaatgttatattaaaattagatgacgaatatttgaaatgaaggagaaaaagttcattagcagaaaaatctcatgaatcattaatatttccactatagagcaagttgattttttattttagtacagtaatgcatagtatcacatcaagtcatcttttgtttatacggttaaaaggaatttttcaggaaagtatttacttcataaataaagcttttttttctggaagtaattgaggttgcatagcagtgtcttcagtacggttaatgttcaaagtgaaaagaaaatatacacaaactttgggtggagaataatacagatttcaaacacatcaataattcatttgacatgaagcaaggaggggcggtgtgtcctacatgctctgccattttctctgctagaattccacttcccccattgtatcctctcaactcccacaactcctctttaaattttagttcaaatatcacttcctcaggaaggcattctcagattctcagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggaaaatattcatgatacattccaagggaagaatttatagcactttgcctttgattccatgtggaggaggagtatcctagataattttaaggttttgagccaatggataagatgaatggtaatggcattactgaagaaaaggcaattcaagaaaaagagcatgtttggggagggataacagtagcaacaaaggcaacaaattgcctcttaatgagaacatgctgtcttatatcatagtagatactacacacattctttctaatttgtgcagtaattcagtgttactcttccatttgaaccgttatggaaggtaaggctcttagaggttaagaaacttgcttaaagtcaaacagttaggatgtggcagaatttggattttattccggattttatgctggctccattatgccatttttgagaggataagatgttaaattaagatagagaaatgatagaaaaaatatgtgtatatatacacatatacaaacatccatgtatataatgtctgtatatataactatagatgtatgagtgtgtgtgtctccgtgtgtatatttgttgtgtatgagaaattgaaacacatttatgtatggatatttagcaagtggtgaggaactttgagatgaggattctgcagtgatattgatgttggaaatgggcaatttattcccatatcaggttctaacatttaaaatgcacctgaatttgtattaagaaacttgtcttgctaaattttaattctatcagattaataatagccacagagcttgtaaagggaatcattattctaaccttttgaaaaaatttttttgtagctcagtttaaaaaaatggaatcatcagcaaaagtttatggttgttttgtcatccagagtgtttccattaaaaaggttttgtgattattttattcagttatattaataataaaattcgttttaatttatatttattgtgttccatcagattcttctatttgtggtgacaggtaacttaacacccttgaaaacagctgtttacaagatgccattctgtaatgtgggtttctttctcttctaatgggaggtcctaatgagcaatgtaatgatccaggaagatgagcaaaaggacttaataattgaagattgagtgcaagaagtgttctgtagaagtttattaaaaataatcattgggtattttggagataattatttcacattagaatggagaatatgattgtaccagaaaggaacatgggcaatcattctgtctatccttgtaaattcttgatctgcacctctagaattttggttctggccagtttatgctgactacatccatttttgaattacatacataattttagattgtacttcatagtcttatgcttaacagtgtgttgcctttgaaaggtatttcagtttcaatgtaagcatttcttagctcctcaaattgatggcaagctcctcctttaaggtcagcatatgttttctggagatttttatatcctttaaactgcctaatggtgagctgaatacaaaataaaaaataatacgtaggccaactatttggaaggctgaggcagaaaaatcacttgagcccaggagttcaaggctgcaatgagctatgattgcatcattgcactccagcctgggtgacagagcaagacgctgtttctaaaaataaaataaaataaaataaacttagggaattagatacagcatctcttatggcatagaaacatgaagatatttgtttctgtcaactcagggtgaaaataatctgatgaaatggaacaatctagttgaagttcagctctggctatatgacttccgctttctcacctataaaatagtgataatcaaagcatttaccagttgtatgttatcagaaattgaattttaggtactcctgtgagcatttggaatcttgttaatgttatcatttttcctaataccatcatgtgatatataatactgagaacttggaaatactaccttgtgtttttatacccagaaaactcaagtagatacaaataattagggtaatttgaatgagataaatttcagaaattaaactagtcaaaaatttcaatatttctacattttttatgtgctaagtgaagacctaggaaactcagtgggatgacagcaaatacctagacattgtgctggatcggtacagaaagataaatgaggtatttacctcatttatggactctatacttaggactctatacttaggaaatatggactctatacttaggaaacttagggaattaacataagcacaggaaatataacacacatatcaaatgtagagtcatcaattatttgaaaaatgtaaaatgttcatcatatagccatctaccattgaataattttagatgatctcaagtctcattattgtaagtcacttcccctcctcccacaaatgaccttaaattattccaccaactctgtatcttattacttcttttgtcaaagcgaatatttggtaagtaaaattttaagtaaattgcttcagaatgtcaccatcttatttcagactttcatgtacacttcaacatttgaacctttttttttgtacttaatgggactaaaaatatctgcactacctgtacgacacattgttatttgaatactttgaaactgtaaaacactttgcaaatactgagtatcattatttaactccagctaaacaaacaaggttgatatagatgttttcaatgttgctgcctgacagcaaaacatgtgttagctcagcaagagatattctgtatatactctatgaaaatactcgcagatgaactttccattaataaaaactaatcgcttggtaaagaggatattatttgtttcttcttctatcccatttgttacaaatttaggcatatgaactacaggcatatgaaaatccaggttttacagtgaaaactgtagatcagtggcccccaacctttttggcaccagggaccagttttgtggaagacaatttttccatggacagatgatggggggcaggggcaatggtttggggttgaaagtgttccacctcagatcttcaggcattagttagattctcataaggagcatgcagcctagatcccttgcatgcacagtttacaatagggtttgtgctcctgtgagaatctaatgccactgctgatctgacgaggcagagctcaggcggtaatgcttgcttgcccaccactcacctcctgctctgcagcccagttcctaataggccatagaccagtaccagtccacagcctgggggtcggggaaccctgctctggattcttgcttcattctctgatattttaccatgttttaagaagagttagggaagattataggtctaggcaatataatgtaatggcaagtcctcaggctccaaagtcatagatttccctttgtatcttggccccaatgctaatgatgtttctttagaaaagttgcttaaaaataacgtttattgaatgcgtataacatctcaggtactgttgcacatactttacatgtatgggttatttactattcccagaaacactagaagtacattattattattgtttctatttgatagattaggtagctcaggtattaaagagttgacgcgagatttgatcccaacagtgttttccagagcctgttatttttttacaccatgcttctcaggctctgtttattatctataaatgagattaaaaggtgatctactttatcagtttttgagaattaaatgagacaataggtgatgaataaattacaattcaacagcacctgtaaatgctcttgatatattccaaacatctgttggccaacatattcattttttttaacttgggtagcagtgttaacactagcatagcttctaaatagtgaaaaagaaaaaacaaatatatctatctatctatatatgtatgtgtatatatatatatatatatgcttgttaatttgaaatagctaataaagaactaagtgaaatcagctacttacaagtagaatgaaaacattaaaactaagtacaatttaagaggatgtagtgcattttgatgggctgattgttagtgtggaagagactttatttcttccctactaacattcactgttaaattggattaagttcctaattttagtcagtcaagcatataaaacctagaataaccacagagagtaggagcaaatgtagcctacaccttggcccccagcatccctaatgagggcacataactcccagaaacactgtttccccattcttaggtcaattcttgctgggacactggctttttattctcccagcttacgtcatcattcaggaagttgtaaataacaatctatgaacatgcattcaaagggaatggttacaagctcagaatcaaccagggtcacatcttcatttgggtttaacatattcaagaactagtgtaccccaagcctaaaggtagagactacctccagcgctctagcccagaatagctgtgtattgtcaagccctaacagtttatgaatagatgctctgcatgtgttctttagagctgtgctagaattgtgtgtttgaaactttaatttgtgtaggaagcacctgcagagattgttaaggggatggtgatctggttggcctgacttggggagtgagttttctgcatatccaccagattatcagaggatgcccatgcagctggtcattggagcaaacttggaataccaagcctgtaaagcacagatgatgcattacctaggtgagcttcacacatttgtaaggaagttttaagatcgatcttgtcagatacccagagccagatgactgcattttaaatctgtgtgctgctctgttttttaaaactaacatttctattctaggaatcttttattataatttagatctggaatgacttttttctaaatggctcccaatgtaatgactgtgtcttcagattcagcaaccatgttttcattatcctctgaatcacagagtataattgtgcattacagtttggggtttgtttttcctactaagaaactccttttccttgcgtcctttctgataaatatcattaatttttccactatggaataattctacttcacttttgaaacataacctcatttgaatgtattttaactgggacttcattgcctgagggaagatggattattagtgacatgtgtcttgcttcttgatacagaaaagataatataaaagtagtgtttctactatatcttaaaaaaagcttcatataagccaattttctttaatgatattgtagcaagggaaaatattgtacaactcatttaccttcatttttacatatttttcaacctcaatgataattctggagatattcatgtgccttatcttgaaatcaaattaaatcattcttttgtgatatgacacgcaatttgtgacattttgagccaacagtatattaagatttaattttcagttcattatagacctagtgcctaaatgaaatttattgagactaagtaactctgcagtgattgtgggctgatggttcaagtacagtgattcagtgattcttagtaggggagaagataggccatgtaattgaacttatctctggatttttgaaaggttgaggcaatacctgttcttccaacccctcactggctccacatttcaaacacactatacctgagttggaaatatcagcaaatgtgtttctagatggatatgtgaaaataaataattattggcttactgtgttttttaaaattgtggtataccatacgtaacatttactgctttaaacattttaagtgtacagttctgtggcattaggtacattcacattgttatgcagccatcatcaccatccatgtatagaactgagctactattttttaagatgtattttttcccttagattcttctcttctgagtttgttaatgatgtccaattaaatgtatgcttattttatatgtatgaggttactttttaaatgggaaagttgagctccatctgcctgagggcactgtaaaaatttaactttcaaaatataattcctgttttgctgttgttgttcctcatgatttccttttttatatgaatattttctttaaacatattgacagtcaatttgacaagctgtcacttctggcaaatgccactttttccattagtaacttccttctttcaagaaacactattagtcactatatcttattatattaaacatctccttttaacactggtaacataaaaatgttttactaacagttctcacacaaaaatatcatattgaaacaaaaattagaggaccagaggcatttactcagaaagaacaaactttttcttagtaatgacagtgacccaaccaatcaaataaattgaagaagtaataaaatgaatgcatttttatctgaaacggatgccaccagtaacattttgggaattccaatttaaaaggcccaatgccccccatgcaagattagtttttcaagatacttttacagggctaggacattaaaatatttgcttctctattggagcagctctttcaacaagttggaggactgatcacatccctttgccaattgcagttcagataggctctgggaaggcaaagtacaggatgtcatgcaagtgaaaacagaagtgattaatcttatggatagatcaaggaaatttatctgaactttagaagtgagacttgatgctaaataggtgtttggtgtatgaaaactaaggatgaagcattcctggtaaatagaaaggcctgattgaaagctctgagctgggaacacagcagagggaagcctactttggaaggagggattggtctggcaaagtgctggataacacaggttgtaggtcatataaaaccttgtagggggtttgagcttcttgaagcctatgagtgcaatgagaagccactgaaaggtttttagcaggaaattaacattgtttctaatttttatttttaggaaaataacttgctactaagtggtgaatgggagacaagagtgtctgtgaggctaaaggctgttcttgctgaagccccaaaatacttatttactctttcttggtgtaaatgagatgaaagatactacaggaacatcacatgtgttcaataactgcgcgagtgatatacttccctacggggacatgaacagtacttgaacagctgttaatgtctgttgcccttaggaaatttatttcatcaagcatacagtgtttcaacccttattaacttatttcataaggcataatatatctgactgtgatctgttcacttaatgctactctgctctttgcacgagcatgggacaaccagttgctctctgtagtcgtagtttattaacgtgcaattaaagacatttatcatatctctgaaaatgtctcttctcccataaaattaacatcatctcctcaaaaagatgcttacgatatatgctggattatagttactgttaaaatgtattcagaaacaaaaatagaattgaaaactatagaggaatttttttaaagcatgggctttggaatcaaacttgtgtttgaattctagttctgccacttaccagtcatttgcacttgagtaaggtacttatcccttctgaacttcagtttttcatctggaaataggcataatgacatctactttatgaagttgttggttatgtaaagccatctatgaaaaatggttagaccagtgactgacacatacgcattccataagtgatagatacataaataatataaataaaaaatgaatgctatagctgacaaatgtgattaaaaagtctacaatgcaaattatttttataaagtataaaatccatgtgaccatataatatactaggacaagaatgcctgttagatttcagattcaagacaacatactaagtttaagtgtagttatctttgctaggttagctttatgtatttgcatgaataattgtttaaatttgtctgattgtactacggactggcaggcaataaatttcattatctagtcttaaaatgtgaagagaagacagctcaaagttcatttctcatgcctgatctttctgggggatacaatgtacaacatcagataattcttttgccttcttttcttttgtgcatccagtaacagttatatcatttttttctgaatcagccttttcacaaaaccattatgtgataagctcttgtcttggaaaacctcaacagcttcctcaacacctatattttaaatcctgcttaaatgagattaaaatacggcactctgttaagctgtaaaactggctttttgcttctcagttgagtgttggtttgaatgtgtcatttgacctatattgctgctctgaatcttcctcggttgccccaatgatgacagtttcaatgatgtgggtgtttgcagcagagttgttcctaataaggaagtaacgctattgtctttcagacatcattcagcctgaaaagtactatttttcccacctagagctataaatgtctgtaaaatcttttcttcttttggtagcatttgcagcagcagcaggaaaaaaaaatagtcctagtagatttgcagcttttgtagttttggggtgttgtggttccaggctaagattcactcacccttcttcaaaagttgtatacaaagggttgatagctaaatggtgactgaagtacttgatttattagtatctggcagtcatccaatatgtactagaatacaagactctctgtcaacaatagctgcataaagagcaaactgctctgcctgaacctaaaataaggccttctgctgtctgcccgttaattgaagacaagtgggccaggagtggctgaggaaaaacgaacaaagaataggcaattgtcatgcacatggaggcactacctgtgcctctttgagaaacagaaatcccctgacctggttcttacattgagagaagctaacccagcccagtaatacattttagctccttgcatgtataattatgaccattgaaaaataggatactacctttttattgggtcaggtaagatgcaggaggagggagagcaaagtgccctacttgagggtgggattgagattagaatgtgaagagaagagcagaaagcttccttcttacacaaataaaggttctgtggattcatctagaaaaatgagttaaaaaaaaaacgagtggaactatagtttctaaagtctgtggagttgggacaaatggtaattataaagactaaatgtgaatactcatagttctttaatttgattgtattaccacttaattcatagttttgaaggaaatagccattatattagatggcacattaattttaagatgcaacccaattttcaaaatgttaaaatggaaaagaaagttaaagggtgattgttaggacaagcatctccaaatactctgtgtggaggcattttaattccatgctcttgcaaaattaaactcaaaaatgtttcaaattactgggtgttatatgcccttctggtggaagccacattttctctttcctttctttccctgtctaccctccctcttccccttcctccccaaatctatcagtaaagaccaccttgctgtgggcagctagctgaaagagaccatctgccttaggaatagcctacactagattcaaactacaaagaagcaggttgggggaaagaggaagtgaggatttcaagtcaagaaagcatcctgcctactctggcaaagtattctgccagcagcatatttggattcacactgtgggtttaattctttccgtttaatactttttgttgaccttataaagccaaaaaataaaggaacacccatggcactgctggaaagaggtaactgatttctgatgaaccggtaggcattttagccactaaccaacgtatcaaagtgggcacaactaacacatgttaacagttttcccaaagtaagaagcttggtttggagtgaacaggccttgtacttttgagattttattttatgattttgtgaattgatgttctgtggggaaaaaacttgccttagttttaatataatggtcaatgactaagaaaaatcaaggagttgggctgggtgcggtggctctcgcctgttgagaaatttacatgtccatcagtttcttgtattgtagtttgaaatcaagaaactacctcagtttcttgtacaagtagtttgaaatcaggcggtcaagtttcattctaccctgctagaatatacaagaatccaaagcaataatgtaatttatacatttcaaaaggctaatgccaaattttatcagcaaattggtcataagtctccaactggaacaaagtgagtgattgttgggcaatgtagtcctgcaatgtgaaattcttgtatgcattccttcttaaaaggaagcaaaataagcctttcctatagaatttccacttcaagattccatcatcggcacatatcaaatactgttggcaatgctgaaagtaaaagcaaggactcacataaagtcttttgttgctgaaattaaaaatagttgtcactattttcaatatcaaaatcctatggtttttgacaggtttaaattctctgttgattcatttcagaacagggtcatctttttatacttctttgacattttaaaaaataagtagtttggctagaaattgagtgtttcaagccatcttggccctttgcaccctaaaatttcagtagcactgtcaagcgaatcagttcttaagagctggaaacacaaagaagacaaatatcaaagaattaattaaaatcttttcttgaatgacaaaattgacattatctactacttatataaggagactacattgtggattaaccctgaaatcagtacttggaaagtttattccagtgtgtttcactgaaatttaaattcatgacatttgaaaaatgtaagttataattaaacactgagagtaattcttgtggttattgtatatttgttaagtattccatggtaaatgtgacctgtaaatctgttaaattaaatacttgggagtaaatttacttttactttctgtggaaacatttggattaccccaacagtaaaagtaacagattaaaaatataatattctttattttcaacttttatttcaatatatatgccagtcaaatgccagtgaataataatcacatttgattgtcaaagctcatggaatggtacacctaagatttgtacgtttctttttctttcttttctttttttttgagaaggagtttcgctcttattgcccaggctggagtgcgatggtgcgttctcggctcactgcaacctctgcctcccgggttcaagcgattctccagcctcagcctcccaagtagctgggattacaggcaagcaccaccacacccagctactttgtagttttagtggagacggggtttctccatgttggtcaggctggtctcgaactcccaacctcaggtaatccacccacctcagcctcccaaagtgctggaattacaggtgtgagctatcgtgcccagcctgtacgtttctttatatatgaagtttgcattaagagatcatgaatattgaactctagtgaatgatatgcctgctgaagtgttttaagggtgaagagtactgatgtctgcaacttacactgaaataaaatggagtgatatttggattaaacgatgaatagatgggtgggtatgtaataaagcacatataatacaatttattattgaacctagatggcgggtatatgggtgttcactgtaaaattcttccaacttttctgtgtgtttgaaaatttttcataataagatgcgaggaaaaagcttaaaacatgcttgaattataattctataatatattaatattaaaatactggaagtactcttgcttcatcaaagttactttcaaaaatattggtttttgtcatcttcaaagcatgtaataagaattttttaaattaagtattaaaataaaacttttaatgtttgaaacttaaatctcacatggcactgttcctattatggattttgggggttagacctgtagctacccatggtatcttctttcagtggctcatatatacaagatttcaatttgtagttccctcactaaaaacaaacagcctctgatgaaatttatcttgatagggacatctgaaagtgttgatgaatgccaaggactctaatggaaaacaaacaaacaaacgataatttaaaaaatactgtttgctttaaaattctactaaaatggagttagtctacatgataacattaatcccatttgctgtgccaacatttaagaaggaatctgtggtttatcatctggtttgccaattttttgttaaatatgaggaatattttagtaataattttttaaagattacatgcaataatagcttaaactttaatacccattaatgagtatccataaagaaaacaattcagtaccacttaaaaataatttgaatatcagtcatcataatacgatgaacacatttgatagagaatatgtgaatagaagtacattgaatcagttttattctatctacagatgctgaatggcatagggaattgtgggtctcatgaaattttctcagaagtacccggaggatcttcactaccagactgataaacacaattttttggttctttgcccacacaggaaacttttctagaaaagtttcaaagaatacatgccgaaacatgaatcctggaaaagaaaagtgatcttctaaatttgaaaatgaaagatttatgtggctctcacgtgaaacatcctctggcaagggagtaggtacatgatggaaatacatggattttcactgaagaaatgaaaatataagtggcaaagtaaacttcatttatactattgaaatattcaactgaggaaagtacattacttttaaattggaagaagcaagggcacatgatttttttacaggccatgtcattctctcatttctttcatattgaaattagttggacttttctttatcataacgagtgttgccacagtttacacctgccattctgacttttcgtataccacctgttgagaggaatttttttttcattctgttatctacatcattgaaaaacttaacacaatccatgtaaagaagaaacaaaaatatacttgtaatgttcacataaatatagaaatataacttaggagtccacctaatgctagaatttttatcgcattttaagtgttatggagttttaaaatttccatgtgacttaatagctggaaggaagcattaatatttaaatattaatttcaataaagataaaacaaattaatacttttaaatgaatattttaaattccctaacgagaagacaattgcataaaattaagtatgtattttagtttgaagaactaaatcattcgtgatacatgaccgtactacctgccggattcatctttttgccaaatatttcaatagtaattcttgaagtcaattctcagcacatatcaacttttactgttgtggtgggtgagagagtggagaatcaggctttaaggtgaatttataatttactatgtgaatattgccaggagttagaatgacctttaaacattttgtgaattgcctatttcaatacttaaggattttgtatacgcaaccctgtacagtaattatcaagcatactaaagttttagaactaccaagttaaacttaagaaccaaaggggccaggtgcggtggctcacgcctgtaaagcactttgggaggctgaggcgggcggatcacaaggtcaggagtttgagaccatcctggccgacagggtgaaaccctgtctctactaaaaatacaaaatttagctgggtgtggtggtgcgtgtctgtagtcccagctactcgggaggctgaggcaggagaattgcttgaaccagggagtcggaggttgcagtgagccaagatcgtgctattgcactccagcctggcgacagagtgagactctgtctcacacacacacacgaaaagaaccaaaggacgtctgttttgcagatatttagacattctattatttgctttacaaataactaagaaatacctagtgatgaataagagttggatgggtgattctgtagctaagctgttcagtaccgtagccattagccacctgtggctacttaaatttaagttcattataattaaacaaaatagaaaatttggttcttcagtcacagccgccagatttcaagtactaacagccaaatgtgcctagcagcttcgtattgagcagcacagaaagacatttctatcattgcagaaagttctactgaagagtattgttctcaactgttcatctccctgggattttatctattttgttaaaagatcagacttctaaaaacataacaacttgttttgagaattatagaagctatttgagattcaagttatctcatagaaaaagttgattgtacattttaggtgttgtattttctgaaaatatctagtattgttaaaacaagagtacttagtaagaattattgatatggcactgtacattccttgtcattaaaaaagtggtcagcacaaggaaaaaaaaaacatatatagtttaactaaaaatcacttttcctctcctaaaattattctttaagttgtggtttacaggcttgattatagcaaaccatctcaatgcctgcatgcaaatagctaaatattattgactaatctcattttgaattcatagccacaacaattctcaaaggagattcagcctctccaagcaccaaacatcctattccatttccacttcttattctctaaactgattttcacaccttcttctctctcttcaaacctccctctcacaacagttatgtcttctttttacttcattgaggaaaagaaatatgacaccccatttccctcattttttcatctgcaaatctaccagctcatctggatccaaatctacattctcctcttcccaccttttttttagagatggaatctccctctgttgcccaggctggagttcagtgtgtgatcatagcttaattactacagccttgaaatcctaggttcaataaatcctcccacctcagcttcctaagtatctaggactacaagtgcatgccaccacgcctgggtaatttttaaatttttttgcagagacagggtctcactgtgttgcccaggctggtctcagctcttggcctcaagtgattctcctgcttcagcctcccaaagaactgggattacaggtgtgagccactgtgtccagcctaaatctacactcttggcctgcctttcagttttactggaattgacaagtttacctgttctcatatcatgtccagcctttccacttggactctggatttcatttacttttaacttattcatgcatgttcttttgaaattatctctctcctccttcaatatcaatttttttgtgtgtgcctataaatatgttctgctgttttctaactttaaacccatataaaaatacgctcttttgattctcttttctctttcggatattaccttgtttttctactctccttgctacatgcaaacacacatcaaaatctagaaggaattattcatactttttattgcaattatttacctcgtattctcttttcaaattagttcatcagggcttccctgacataggctggttttctttcctcctttccttccttttttttttttctttcttgtttttgtatcctatggtcacatgactattgcattgtcaaattgaatggccatgtctctgttcttcccatacttgatccctccacagaatttggcacagttgactacttgctccttctggaaaactgtcttcttttgtactgagccacataaaatcatcctggtttcctcccctctcagtttccttttctcatcatttctgtatccccaaatgttagtgccagttctagcttcatacttttttttggattaagtcatccaatctaatgtctttaaaatgctaactatatgcaaatcacccttaatatgtttttatatttaattctaacttatctcgtgaacatgaggcttttttcccctcaaacagcttacttgacatacccatgggagtacgtatctaatatgaatgtcaaacttaacataaacagaccttttgatttttttccatcagacctcccagcataaacaacaaacaaacctgctgagccctcactgattaactggttccattatgacccgatgactaaagtcaaatttataaatgcttttataaacttcatatctaatcatcagtgaatcttgtctcctgtacctcgcatcccccaaatctggccacttttctgtttcttcattatcactaccttatctcaacccttattacttctcacctagactgttacaattatttcctgtcatgttttttttcttttgtcaccatacaattaaatctcccttcttcctctacagatacaataatctttgaaaaggtagaccaggtaattttactccactgacttcctataaccctaaggcaaagatctgaatattttaacctggtctacaaaatccttcatgtcctaacctctgcctagctttttaccccacgtcattccctttcccacttgcatctcaggccaactcctacattagcatctttatgtagttagtagatgtttctctgcatgaaatgttcttacttcagatcatctctatgtgggcttctcccttaattgatactttctcagaaatcttaattaagtgatactttctcagaaatgcctttcctgacctaacgaaagtaggaacagtcactctcaatcacttcaacctattacagttgtcagtgtggaacttatgctctctaaaatctttcttattttacttatttactgattaattatgtatctttatctgcacaaaataatctccattttatccccactgtctggagctttgcctgttctagaatctgaactctttgtatgaattaaataaggatgaagtcaaaacaaactgtactgttttttgtttcaagtatcaggcgatatttaactatttgaagttatgggactaccaaagttactccttctggttgacactttactgagacaaacaccagtgatatgaaatttccatatagtcatgcatcacttaacaacaggcatatgttctaaatgcattcttagacaattttttgttgtggaaacatcagagtgtacttacagaaacctagatagtatagcctactacaaacctaagctatatggtagagcctgttactcctacaaacatgttactgtactgaatacttaggcaatttgaacacaaaggtaagtaattgtgtatctaaacatttcttaacatagaaaaggtacaattcaaatacaatattataaccttatgctaccactatcatattatgtggcctgttattgacagatacattgttattctgttcatgactgtattagtaccaggttgtggctgtttctaatatatcctctcccactcctctcattccttactgaagtcaccagggtagtagcaaatcactggaaccagacctataatatatctgacttggtatctgtaactgttctgagaaacatgtgttgaaaggcagccaggctgcctgatgattatttagtagctgtctttctttactgaacaacagtgaataatatctttgatctctgccactgagaaataaacagaacccatcaggaatttaatccctgggaatgattttcacatttcctggtatagacgtttgattttgaagctcatatggtttgcacaataaatatttacctatttatgtcaaaatgcatgttaaatcatttttatggttggtgtgaggaatttgtgaaacaatcccatccttttgttattactgtgtttttgtaagaggacttctcacaccttaacctcatcaatagtttttcctgtgtgttaatgcaacaaaatggaagcaaaaagatatattttgttttcatttattttattcacctgaatctatccagagggaaagcactggaagtgttttctttttaagagtgttaacttgtattcttggtaagatctcatcaaaagcttaaataacgaaggtaagagtcagtattctgtggacagcttagctctacacaagaccttctgtccatcttgctagttattttccagttaatggaaatcttatagacagaaaagctcatgttagcttctcccgcatagtattatgtcaacaatccttactctaatccttgatgcagctctttacctaaatgttatagagatggagaatcacagctgccagcaattcaaaatataacatgcagtagctattttttaaaaaaaattttatttgctctcataaaaataccatcttaaagggtttttgaaaatttacttgtgattttgtctttttttaaagtattgagaaaactattgagtctgaagtaaagtctctaaaatacatcttgtcttattgtaaagtaatatgactgatattttgtgtgaattttagaattagttttttcactttatagattcattacatagtggcacttgatttaaacattgcatcagtactgtagcccttgggcatcgtgtatagagtgtctattagctttaactcatttctaaaaaattaacttctaagaataagaaaaatattgaaaactcttgaaagtaagttagaaacgaccatgattttatttttatttttaatttttatttatttatttttttgagacggagtctcactctgttacccaggctggagttcagtggcacaatcttggctcgctgcaagctctgcctccgaggttcaagccattctcctgcctcagtctcccgagtagctgggactacaggcacctgccaccacgcccggctaattttttgtatttttggtagagacggggtttcaccgtgttagccaggatggtctcgatctactgacctcgtgatctgctcgccttggcctcccaaattgctgggattacaagcgtgagccaccgcgcccagccgattttttttttttcctgcaaaaccatctaagggaggtgtttgggttttcaaggaaataccggctataagcatcattggatgttttggtggggtgggttttttgaaaatgtgtatgcagataacagtgagtgatattgcataagtattttaactacttagattgtttaaatttggttaacataaaatcaaggaaatggcttgcattattctatcttttcttttctaaacagtgtttccttaacaattaattctaacaagtcttggaaccatgggcactttctttcctcctgtcaccatgattgatccctattttgttggaaagtgaaaattgagcagttttaactctaaaggctaacattatggaaaaaaatttcaactgaatttgctagtaaatgctttgtatgaaaatatttagaatttaagtacttctctttacagacaaaatcatttattttcagtgtattatgaacatagttcctagtagggtatgtaaatgattcacttttaaattatgaatattttcttccaaattccattgttaaaattagtaagtgtaaagtatgacttttaagcaatatttcattagctatcattaacaagtatttaaccaccttgtttcaaattagttagctaatgaggtataaattattaaatctgaaaattttatttggacaagtattgtatcattaatttaaaatgattacaatgtagttgaattgttattcagtatttaatattttattgcctataaaaataaataatagccatgcaaacttatttttcaaatggtgttatctgtgctatatttaaaataggccaggtgcggtggctcacgcctgtaatcccagcactttgggaggccgaggcgggtggatcacgaggtcaggagatcgagaccatccttgctaacgtggtgaaaccccgtctctactaaaaatacaaaaaaaaaaattagctgggcgtggtggtgggcacctgtagtcccagctactggggaggctgaggcaggagaatgtcatgaacccgggaggcagagcttgcagtgagccaagatcacaccactgcactccagtctgggtgacagagcgagactccatctcaaaaaaaaaataaaaaataaataaataaataaataaataaagttaggtttgcatatatgagcatatgcatttataactagatggaaacttccttaaatatttaacatttctccttaaattttatattttatagtacttttttatggttagattctaagttctacttacattcagtgtgtatacaaattgagataggggttgtaatggaatatataacttgaatatttctatttgcattgccatagcatcattttattttgctcttagcaaaatctttctatagaggctttttctcctttcagttgtaaagaatctcttatctttaaaaaatatgtctcattattttcttacaatgtaatagtaaaaacaaaaataccatcaggtttttctcgatccttcctattttcctggatgtgtgcttttgtgtttttattgatatggataaatacatcttcaaattcaagtactagcgtttcagagaagtaatatgcttcttttgttctggttcctcttaaatgttagtaataaagaaacaattaacctagatatagaacaactcagtgaagggaaaatgtcttcatgggtcccttgagaaagacctatttagctttttatgtttctaatttttaacattgagtatagagtatatagctgtctttacacttttttttttttacattttagcttatttgtaatgctaacaggtaaagtagaaaaaaaaaatcactaaaaaaatggggatttagtagaaaaagaaaactcagtccctaaataatatcctacacatttacattatttccttatgatattttaagtgttccctatgaatatttttattttcaaaatgccaaagttatcagtaattttaaagctaatactgccaatcttactcttccaattctactcctaatcttttcctcctaaatgcttgatccaagtacctccctttgggacaagtaccaaatgtctttctccatatgattttttgaatgaattctgagtgagttaattaattaattctaggaattaatatttctttgatttctagcaagccagagcattttcttcaaatgtgcattaaccatgtgttaattatatctttatgtatacactgtagacattgtgtatgtgtctgtagatttccagcttggatttatacattttaattttcattggtttgcttttactgtcttaggcccctcaatccgtgggtagaccttggaggagcaagctttcagatcttttccactggagttctctcccccattgcagctcagtggccatcatgatatctaccagaacattcagttttctgaaactgtgtaaacactcttgtaaaaacacagtgtagagtcactgtgggagagtgtcttcaaccaccattcctatcctgtaactgaacatagctgataatatgtcagtagttttatttttgtccatcattcaaatagagttccacagtaattgtttcctcttggaagataacttgcttagcagtggggaaaaaaatggattagacagggtaaaatgttatcggaaatgggccctgatccagaaccctagagagggttcttagacctcacacaagaaagtattcggggagagtccgtacagtaaagtgaacaccagtttattaggaaagtaaaggattgaagaatggctaccccataggcagagcagcggcatgggctgcttgactgagtatacctatagttatttcttgattatatgctaaataaagggtggattattcatgagttttctgggaaaagggcaggcaattcctggaactgagggatcctcccccttttaaaccatgtagggtaacttttggatgttgccatggcatttgtaaactgtcatggtgctgatgggagtgtattttagcatgctaatgcataataattagcatataataaacagtgaggacgaccagaagtcattttcattgccatcttcggtttggtgggtgttggccagcttctttactccatccttttctgtcagcaaggtctttgtgacctgtatcttgtacaaacctcctatctcatcctgtgactaagaatgcctgacctcatggagatgcagcccagtaggtctcagcctcattttacccagctcctagtcaaaatggagtcactctggttcgaacacctctgacaaaaatattctaagtataaatacatcaaaccacattgaaaaattcatcaccaagttactttcagtacagttcattaccccatatctaaaagcgatcttgaaatctgcttggttgttagtggagacgtttcacttccttgttattaaaaaccttttcgctaactgccttattaagatattattcatataccatacagttcatgcctttaaagtgtacaattaaattttttttagtatatttacatagttgtgcaattatcaccataatcaattttacaatattttcatcacccccaaatgaaacaatgtacccattaacagttaccactcatattgctcctaacccttccccctcagccataggcaactactaatttatttcctgtctgtatgagcttgcctattctgcacaatttatataaacagaataatacaatttgttgtttcgtgactgatttcttccactcagcacaatgtttttaagattcatccatattaaaacatttatcagtacttcattctttcttattgttgaattacattccattgaatggatataccacattttatttatctgttcataatttaattgtcatttaggttgtttctagtttttgcctgttataatgctactatgaacatcatttacaagttattgatgtgtttttctgtctttatgaatagaaatgctgtgtcatatagtaactctatatttaacttcctggggaacggtcatactttccaaagaggatgcaccattttatattctcattatctaatgtatgatggttccaattcttccatctttctcaacaatacttgttgttatctgtcttttttattatagccataactgttttcagcagttctgtggatttatttcactttcttgatagtgtcctttgaagcacaatagtttttaattttttataaagtctactttatttttttttagtttttatttttggtgttatttctaagagatcattgtctaatccaaggtcacaaatttgatcctatgttttcttgcaggttttgctatagttatagcccttacatttagttaatcgatcgatttacaattaaatttttacaaagcgtaaggcagagttccagcctccttccttggttatatatatatatggatatccagttgtctcagcaccatttgttgaaaaaactatttttttctccctttaaataacctggcacctttgttaaaaaataatggatcataaaagtaagttttatttctggactctcagttctactcgttgacttatgtgtccatctttacaccagtaccacactattttgattatcagcactgagagaactttaaatggtttatggggagagagtagctttgggcttccctgagggttatgtcttgcaaaactggaagctcagccatgctactgttacaggaattattggctcttgtatgatgtgagacttgtaatccagggtgactcccacgtctatcaaatgtggacactggtttatcttctggagggtcaaggagaataatttatgaattaacatattgactgttgaacgtattctcattgaagaggaatacctaatgctgccccgctaagatgctgttcttctgccttctgttctcagaatggatctgatgccaagtatagactatagtgatcttgtgagtctcagtgttcagcagagccaaagatgaagactaggtttgtgcctagacatagaaacggggtgtaaaagggtttaagctacttggcatttgtctgtgaggaagtgtatttcacacatattggcagagtatgtttgtaattaggcaaatataggtcactggaattgatctgctgtgaactaattgatctaccttgaacaaaccctgtaaccactgagccacagcctcttcaactgtaaaatttaaagactagtaattgatagtctctatccctcatgctgaatcgagcatcctatgacttgtctaagattgttcacactgtagtttgatactttcttacattcctgaaaatgtgagttttgaggttttttcagatgattttctctatgggaaaaaatagcatacagaacattctcatgacctcagactagataataaatgactgagcaatggaactgtaactgtgaatattgaaaattataaaaaaaaattagccagacatggtggcacgtgcctgtagttgtaactacttgggaggccgaggtgagaggattgcttgagctcaagcttttgaggctgcagtgagctacgattatgctagtgtactccagcctgggcaacaaagtgacaccctatctcaaaaagtgagcccctgagtgtactgtaatgatataataaccatttctatatacttatgtgtgtatatatatatgtatgtatgtatgcataatatgatataaatcatattatggtgatgcttttgattgaaagacaaggagatcttagagtgagtggttttaactctgattatgctgctccctgatataccacaatgggtgataacacttccatgagcttcaggttcctcctcttcacaataaaagttttgtgtcacttgagttcagattttcctttcaactctaaaattatatgattaatgacatgatattcttcatatacatccatgcttctttgactatttaggccatagtgtctctctctaatacaaattttcagataatttgccaaactgaattttcaagacattccttctcagaaacatggcctccaataaacaggttttacatattttttccttttcctgttggccctaacgctgtcaatcttagcctcatcgtctagcatagtcatttatgcaggatcctgtgtaaagttgatgaaaaattctgtcaatatgaaatatattgaagattgccagtttacctttttattcatttattgtcatgtcacttgaaagatattaacgtttatatctgtctaaaaatttactctctgaaaacaataaataacatttggccttttgtgttaccgtttctattgaataattattctgaggtcccctttcacccatgaaagcacagtaacttgtactctaaagtcctacaaagtattagatatataatatctaggcataaggtaaaatctattattatgcttgggtccttaggctgtgagagtgaccagtttttactttcctacctacttgattaaggtaactccagtgaggtagaaaataagggaactgagtcaagaacacaaagtgtggtatgtaattgccattttagatatcattagtagtcacactcccgaaacattaaaaattaatgacagagtcaggaagaggagagaaggtgtcttttgcattgccataatttttacaatgtctacatgctgtcctatagcctggaatatgagatttttaaaatcatggttactatcatcactcaagtgtcttaggctgaaaaggacattttccatatttcataaattcaagtcccagccagagtaatcaggcaagagaaacaaataaaggacatccaaataggaagagaggaagtcaaattatcctgttggagacaacatgattctatatctagaaaaccctatagttttgtccccaaagctccttcacctgataacttcagcaaagtttcaggatacaaaatcaatgtacaaaaatcattagcattcctatacaccaacagcccagctgagagccaaatcaggaatgtaatccgtgtcacagttgccacaaaaataatgaaatacctaggaatacagctaactagtgacatgaaagatctctacaatgagagctacaaaacactgctcaaagaaatcagagatgacacagacaaatgggaaaacattccatgctaagggatgggaagaatcaatattattaaaatggcaatactatccaaagcaatttacagattcaatgctattcctatcaaactaacaatgatgtttttcacagaagtacaaaaaataattttaaaattcatatggaaccaaaaaagagtccaaatagccaagacaatcctaagcaaaagtacaaagctggaggcatcatgttaactgacttcaagctatacaacagagctacagtaatcaaaacagcatggtactggtacaaaaacaggcacataaaccaatgaaacagaatagagagctcagaaataaggctatatacctaaaaccatctgatcttcaaacaaagctgacaaaaacaagcaatggtgaaaagactccccagttattcaataaacggtgctgagataactggctagccacatccagaagattgaaactggaccccctccttataccatatacaaaaatcagctcaagatgcattaatgacttaaatgtaaaacttgaagctataaaaaccttggaaaataacccaggcaataccattctggacgtaggaataggcaaatatatatttcatgacaaagatgccaaaagcaattgcgacaaaagcaaaaaattgaaaaacggtatctaattaaacttaagagcttctgcacagcaaaagaaactatcaacagagtaaacagacagcctacagaatgggagaaaacatttgcaaactatatatctgacaaagatataatatccagcatctatgaggaacttaaaaaaatttgaagcaaaaaacagtcccattaaaaagtgggcaagggcatgaacagatacttttcaaaagaagacatacatgtggccaacaagtatatgaaaaaaaggtcactatcattgatcattagagaaatgcaaatcaaaaccacaatgagataccatctcgtaccagtcagaatggctattattattaataaacagtaaaaaaaaaaaaataacagatgctggctggttgtagagaaaagagaacacttacacactgttagtaggaatataaattagtttagccattgtggaaagcagtgtgacgattcctcaaagacctaaaaacagaactaccattcactcagcaattccattactgggtatatgcccaaaggaatataaattattctaccataaagacacatgcatgcatatgttcattgcagcagtattcacaatagcaaagacatagaataaatctaactgtccatcaatgacagactggataaagaaaatctggtgcatatacaccatggaatactatgcagccataaaaagagtgatatcatgtcttttgcagaaactaggatggagatgaaggccattatccttagcaagctaacacaggaatagaaaaccaaataccgcatgttttcacttataagtgagagttaaatgatgagaactcacggacacaaagaaggtaacaacagacacaggggcctacttcagggtggagggtgggaagagaggattacaaaaaaataacgattgtttactacgtttagtacctgggccatgaaataatctgtataaaaacctcctgtgacatgagtgcacctatataataaactccacatgtacccctgtacctaaaataaaagtttttaaaaataagtcaaagatgtaatcttttctctcatgtttttatatctctgaaatcaagacatattttacaattgattgggagcaattttcttgcttgaacataaaataacattgaatctcgtcatcagagtatcttggattagacaaatttagtatgttcagaggcaactttaggtagggaatgacagacctcaaattccagtgtgtcacagacttattaaataggaatatggtatgcaaaaatttgctgattaatcagcccatcataactgaggcttgactctatgcctatgtgcatttttactttgtctttcacttcaaagcaggtgcagctgcacagtatgaattcaatacccatggtaaagagtccctttaaaaggctatatttttatatttaatatgtggatacagaaataacagaaaaagataaataagctatccaaatgcaaagaaaattacattcatagacatacctcttattaccttttcctctcaactctgcagaaaatatgaagcaggttggaatgttcattttatgtggctctcaaggtactattctcataaaggtaaaatgagaaacagtaaattattgtgaagtttagtaataagagcaaaaaagacatatatttatgagagcaaaaatattgagtagcatttggccaaaggatcttgaaactgatttgaattgatttaaccagtgtaaataaaaatgatttatcaataaaagcttatttctagaagtgtttttttcctgtttttactgttcttttcagaagcgttcctttgcttatgaacagtttagaatatgatctttttgtcaaataaaatttccagcaccttgcaatatcagagacgattttctttctagaagttttagaagacgtcattatgtgtcattctagacaaataagatgtgtttggctgaaatgttttagaagtctctaaggaaagaaataacctgttgattatattttgacttacttggggaaatggaaagtcacagccaagataatgctaagtctccaccaatcacattttattatgtggtgtgcttgcctttggccctctctctaccccttggaggaacaggtaaatattggcacaagtcagatgaaccctacccatcactttttggatatatctacatgtcataagaattatgacatgatcaatcaatgtaccagctaattttcataaatgctgtacctcatgaatggagaattgagttgagcatgagtgaaaattggattttccccactcagaaaaaaataagccactatatatattttttgtttagttctttttattttggttattcttcttttcctttatattattacttaaatttatttatgatactgcttcaagcaatatttaacgtatcaacattttgaacagttttaagtataaaaaaatttgaaattctgttctagtgtgaaaatacaccagtgagtgacatatttgaatgaacatttgtagaagtatgttgaccttaaaaagcaaaaggatttatttttccttttattcaacagatattcatatttgtaccagtcattgtgtaaagctctggggaatgtttcacattttcaaaagggtagagattagcgtttcattttgtttttgacttatctctcttgttacaagctctctgcaagatatttacttaagagttggatgaaatgggtaaataaaaagaaatttatgaggcagaagaaaatgtggaaccttcagacatccctttttggtaccacttttatgacactttcatctaatctagctccatctcaattgacctccatctaattagtcataaaagagaatcaagttctatactgagcaagcatgcctgtgcttcatcagtaacatttaagaaggggcagaaatgagtcaaacacttaaagatgctgctttaaaaattttaatgtgttcttcaaagatgcaagcttattaaaattttagttctgaagaagtaagcacagtatctagtttggctccactgatccttttagacatatgtcacacactttcttctcatgctcaagagggtgattacatcatttgcatagatgtccgttttatctctaatagattatgaattccttcagggaaatacttgttttaaggggaataccatgtttttaaaatctttattttgcagagagtaactatgccatcaccttgcatgtaataggtttttaataaatctaattaagtaaaagtaccattgacttctgttcttggtggtctcaaagataatacttgagtctgctaaatttggaggactaccatgtagaaaagaaaagaaaagaaatgcttctaaagattccgagtaaagctagaaacatagttccgtagttcctagtctctccgtagagagaatacgataactgaagagggctttatatgctgagatgaaatttagtttgttcaaatccgtaatgaattgccatcgggaagtactggactgcttgccactataagtgttcaatcagtctggacaagattttgagaggaattttctagagagatcttagtcatctaatttgcggctggcctacttgacctttttcttctttactcctgaatcttgtttataaaaaatgcaatgtaataaaatataatttatattgtatgtaatataaattatttatacctctgtgaatatatatgataaacaaatgaatatatacaatgtaatgttatattacatcatgggtcattttcttcctaaactataatcatttttacagttttaaaccaaaaaggtagtgaaaataagcgagcccatattaaatttctaggaagtatccctaaattgtttcctcagtcttttgacttatttcacatggaatcctaacatacgtggttgtctgtttttcatgtctcaataaaaaaagttgaccataatataaaggataattggaacttggccacatataggaatataagacatctaatagtaaaaaaaaaaaaaaaaaaagtttataattaaagagaatcgtaagttttataatgacttagaggcatcagatgaaagagaaaacttgttctgtgcaatcccaggggaaagaattaggaaaaatgaggtcaaagctgaaagaagtacaggtttctgtttaatataaggaagatatttttaacatttttctgaaaacggacaattttgcctcaagtagtttcatcttaacagataatatattttcaagcacaaaatgaaaaaccatgtaataaagatattgcagaatacatccaagaatccgatgagacattatcttagttttctactttaaatatgcaagctccttaaaacttctatagatcaacacattatgtgatggtttcaatatgcctaaggtttgatcgtgtagtatagcgttgacttagaagttgtaaatggaagaattaccttttatttctcagccagcggaacctatttatctctttattccagatacgttatgtgatatataatgggcaatgaaaaggttggtcattagagcagctttaaaaaaaaaaaaaaaaaactcatcacagcaagtggaatctgtgttgaatgtttaactgattgtaactgaaaccttggcagggggatagagagacagaaatgagattaaggtagggacagttaaagaaatagcaagagtgtcattttgaagaatttgaatttgatagcaagcattattgtgagctgttgatgaggacaatatggttatgaacataagaataatctatcagtaatgtatatgaacccttaaaatgagagaagtagatgtcatggaggaagaattgtaattttatgatttactatgctgtgatgaggagtaggatggggaattgaggggtggatacgtaacatttttttttttactcattaaaatttccccagcccctaaataggttgtcatattttaaaactctttattattttatccttgattgtctggagttgccaagtatattagtaagtacaaaaagtaatggtattaagttttaatgacaaaaaaatgaatccactgggtataattagtataccaaactagaaagggcctattcaaagatctaatgaaatgcactcagtactttaatttaaattccacaaagtgctgaaatgctggtttatcttcccaattccctttagtgtcattggtataccacctttactattgtttccttaatgtattttttctgagtttgattcgacattcacctcaacatagatttgtaaatctacttttgtgaaagttatgcaactgctgcatttggacaagtcagctcatctatgaaataaaattctccttagtcactgtgaaggtaaaataaactaactcatgtggacgtattttgtaaatataagtcaatttagttatttttatttttagttatggaagccaaagatcgaatattattatttttaataatcacaaattagttgtttttatatttattatgggggcagaagctcataatattatttaaaaaattatcgtggagaaaattttaaaaatcacatattcctcaggataaattaagatttggtaagttctccctaacaatttatggtagtttcttaaccttgcatttgatatcaacagtattcaaatattagggtaatgatttgtaagttatcttttaaggagttgtctttgtattctattttaaattttctaagaaaatcgcacgttacttgctctccccacaccatttttatgaaccgatctcatatccactgggtatgcagttgaagtttaaatgatttcacaatacacgtttcctggcttttagacagtgtattatgtgtttagattacaaatagttagaaatctatttgcataaaattttaaattatttttataatgtcagtgatttaaaattattgataatttcttggattttgttctgttcacaattttttaaaataatgattgtaactgaaagagtaaaaatatccgacatgaaaaaagctacattaaataattagcatgttttaagttacagttgaagaaaaaagtgaaaatagactaaatgagatttttatcacatttccaagtgcaaaaagaatcatccagtgttggggataggaagtttttttttttaagataagaaaaaagatcattttaaaatttgactatggttttccatcttgctcaattaaaaaaagtcatagcatgtcactttcactgttaattacctaatcatattcaaagtcagtgattgacattttcacgaatccttatgtggcataaacacgcacacacacactgtgtgtgtgtatatatatgtttgtagaggtcccttgcttacctgtagcttttgacttagtgtattaataattcattttatgcaaatcaaaaccacaatgagataccatctcacgccagtcagaatgacgattattaaaaagtcaaggaacaataaattctggcgaggctatggagaaataggaatgcttttacactgttggttggaatgtaaattagttcaatcattgtggaagacagtgtggcgattcctccaggatctagaaccagaaataccatttgacccagcaatcccattactgggtgtatacccaaaaagtatgaatcattctgctataaagacacattcacacgtatgtttattacagcactgtttacaatagcaaagacatggaaccaatccaaatgcccatcaatgatagactggataaagaaaatgcggtacatatacaccatggaatactatgcagccataaaaaggaaggagatcatgtcctttgcagggacatggatgaagctggaagccataatcctcagcaaactatcacaggaacagaaagccaaataacacatgttctcactcataaatgggagttgaacaatgagaacacatgacacagggaggggagcaacacacaccagggccagttggagggttggggatgaggagagaaagagcattaggacaaattgctaatgtatccagggcttaaaacctagttgatggcttgataggtgcagcaaagcaccatggcacacgtatacctatgtaacaaacctacacattctgcacttgtatcccggaacgtaaagtaaaatttaaaataataataataataactcattttagttagttgtttaatgagggtatgtttttacccaagttctgcttttatgggagtactggatactaattatggtttactgttatatatgtatgtatatatatatatatatgtgtgtgtgtgtgtgtgtgtgtatacactcaattaactattttcaaatatttaaaaggatatatttaatccagtacatagaaaagcaaataacaatgtctagcataattttaaatgaagggcatttatgaataacacatacagtgtgatacaaatatatagtgagcctaccaattaagatctgataaaaaaagaggtacatggttaatattatcaacaaatggttactacagaatactagatgagggttaaaataaaatcattaatttgtatctgacgcaaaaataaagcagtcaaatttctaaagactgatttatgcatgtgtaacacagtcattcggttatctttctgtctacaataacttcaatcatttattttacttcatttaatattaagcaaaactctttgtgtgtggtagtttgtaggggaaagcaataggggtagtattttaaagtaaggcctctgaaaatgatgctgcttaatttgtcatctaggcactgccattattaggtatataattatagaaaacttactttctcaacccctcactttctcattcatattatgaagattaaaatatgcaaaaatattgtgagataacttatacaaaccactccagagactgcctggtaccttttaagcattcaaatgagccataattattaaaaagaataaacttatcctccagtgtatggtaattctgaaacactagatgtctaatagattttctcatttcaatccaaacaatatttattgggcccttggtatgtttaaggcattgtgcttgattagggacataaaaatgagtaagacagggtttccactctcaatttctcccaatttagtatgctccttgaaggcagtgtccatatgttttgatcatctgcagcatttgatgtagtaaagcgtatagccatgacatcacttaataaaaagcacagtgctatttgtttatatttattacaatgtcttcttcctcctgaagagttcaatgagtattttatcagtgtcaattctattatctacttaacaaatttgaacactgaggaaacagtaagggaaaaactgaatgctaataagcactcacagtctttgacaaatttgtgtctgcaactgcaggccaaggaagcatgagtcagagccacagtaatcaagttgttccatttttcttttgaccatgcaatgttggataccgttgctttcttgacttttccttttggtctgttttaggtgtctcagactcgaagtttgtgtgatgagaggagcacagtcccatagcaatgctaaaagatgtgtgtgtatgtatgtacatgtgtatgtttgtgtatccgtgtgtccaagcacacacacatatatgtgtttggaaaattgggttttgattttcatcattctgaagtttaattccccattagagttgattcactacataccaaaggatatactggtttattcacgtattcaaattgtactgagtggctggtatggtaagtgccatgagaggtacaaagatgaggatactgtggtccatttcttggaaagcccttaaaaacttactgtttagccactgcatgttctcactcataggtgggaattgaacaatgagaacagttggacacaggaaggggaacatcacacaccggggcctgtcgtggggtgggaggatgggggagggatagcattaggagaaatacctaatgtaaatgatgagtattaacccattagggtgcagcacaccaacacggcacatgtgtacgtatgtaacaaacctgcacgttgtgcacatgtaccttagaacttaaaaagtataataaaaaataacttactgtttagcatgtaatacatcaggaaaacaagtagttatatgtactacttatatgaaataataaaaatatatagagaaatattctcagtaagaatgtggaaattttatatttgtttttggtgctcactgaaagcttcgagaaatgtagcacttatgctaaaaattcaaggatgtgataggctttagaaatggaaaaatcgtgtagaaggacgttttggcaagagggaagaacatggctgaaacattaaagaggctattaatgtttcttccaacactctgcttattgtgagacctagcaggcactaaataattaatagcttgagttaatcagcttgtagttaactgaaaaagactgttctacagaagaaatatgacttctgactgactagaagtctactattaaggcctgaagacagctgtagaattcataatgccttcttcagttcaaaaaatgaaaaatttggttatgattcagcatcccatatattgaagttattatgtaaaattatttaatgaatttactttcttcatttaattcttctaatattaataaagtgcctacttctggatacatcagctgtgaaacactggtttcattctgccttttacctccttagatatgagggtgggtgaatttgctctttttgaccctcttctttagacccattcactgtccctgatctgatctgaacctagaagtctctccccagtcctcaggagacagacaggattgaaccccatgcagagagaaggtagtatgatggaattgaattcccggacagatgtggcattgaactctggcactttatctgagtgccactggtcataatgctgtaggttaatttcctcccttaaaaaaggatggaatagcagtctccttgaagtgttataagaattttagatggtacatgtaaagcacctgtaacattcagcacctttaacattaatgcagtaagcattcaacacatgtctaaatggaaggtgatggaaaagtagtccctccttatctgcatgatacatgttctaagaccttcagtggatgcttgaaaccacagatagtactgtgccctatatatactgtttttccctatgcctatgcctatgtacctatgataaagtttaatttataaagtaagcacagtaagacattaacaataatagctaataatgaaatagaacaattatagcaatatactgtaatgaaagttattttccttctgaaaatatcttgttgtacattcccacgggcaactgaaaccacggaaaatgaagctgtggatggaggatcactactatattattgttattattattattatttgaatctaattattagtctctaacaatagtgtttggtaaacatatctttattaactagtagagtgctttaggttaggaatgaacacaattaacacttcagacagtctccaaaatgttcttttaaaaaaatccactttatttcagctatattttgtgtactcatcttgctgtatgaaaattcttcaaagataactgcagaaaaatgttaaattgagaaaaggtgttttttgttttttttttttgtttctcaacataaatgagccttgtgtgctttcatttgcacatacctttaccaaggtaaaagtgtttatatattgtcaacaatgtattgatagactctgccaaggactggcttgtggatccctttggctcaatgcctgtttttgtaaagttttattggaacgcagatattggttaatatactgtctgtggctattttcacactacaacagagttgacaagaggccttatggcctgtaaagctgaaaatgcttactatctggtcctttgtagaaaaaatttgtccctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtacattctggatattagccctttgtcagatgagtaggttgcgaaaattttctcccattttgtaggttgcccgttcactctgatggtagtttcttttgctgtgcagaagctctttagtttaattagatcccatttgtcaattttgtcttttgttgccattgcttttggtgttatagacatgaaatccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatagggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccacatgtccaacagtgatagaatggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaatctgcacaatgtgcacatgtaccctaaaacttaaagtataaaaaaaaatgttcaaggatgcaaatttgaagggaattctcaccaaaatttatagacttgtagaagcataaagactggaaggaattttttatccttcaattattctaacttcatataaatgtattggaatccatgataaatggtaaaaaaaaaaaaaaaaaattgtcaactacacttttacatttagtgtgccatagaaaattgttttacaatttagggttttatttttatagaatatcagccttttatgactagtatttataattgtgaatattaaaaatatagtacacatttattcaaatttgatggatttgaataattagggaacagaattgatatctgcttagcctcattagagtgaatattatggtaggtttcagaaatacagtttctacttttattttatcatttacagccccaattaaattctcttgcctttctttctaggacaattgagaaaaataaaaaagtgcgattgacaaagacaatgtagttcactatagtggagcatctgagcttcctgacaggctagatggaaaaggaaacacagataaatacttttttaatcatgagaaaataggaagtgtatcaattactacagtaaaataaactttatcttgatgctggcttttaatgaccttaattatatgagctattgtgaggcagtatatggtagatgttaagaaggataaaattggcatcagggagatataagactgcagtcctcatatactctctggccgtgggcaagttacttattcttttagaaattcagttatgtccagttatactataactacaataaataggtaccgtagagaatttccccatacacactttcatttgtcttaatttatggtgagactatctataaaaacagaaagcattaattttaaatattaatatatttaaggattacttaaagttaaaaacacatttccaaaaatttatatttttagtttaaagtatgcacttattaagttgttaaatatcctgggcttgatgtatatttaaaaacaaagaatttaaggaaaccaggtatttggaataattaatgggcatttaaaaaagttatgtttataaattgtagggttatatgtacacacaaaaagaaatttaaatgtaacatacataaggacaacgtaaaagtttatttcttaaccttcttaatctacttaaaacttttagaaaagctcttctttcagacataaagatcagccttctgccattagcaaaaaattggaaaaatagaatacacattttctcatctaagcaagtatttttagagtcattatttttatgttttttttccaattgaagaaaatatagggtgcatatcaggaaatacaatctgctagtatcactaagaataaggaaactaatgttgacatatttgactcgaagaaaacaaaaccattattgatgacatccatgtttgaaaagaaaggaaaagtgtttttatggaaatatgtagtgtttaacatccttagaataaagtacatttggtgatatttttaaaaggttaaacaaaggcagatcttcaatataatgatatttatctccattttatttctggcttttactttgatattaacagaaatatatgcacagacatattagcaggataaaacaagggtcatgataaaactgaatttatttttgtttgaattataagtagttttacacattaatgaaagtccattgttatggttaatcccctggcaacttgatctgtgtaatgggttttcattttctttataaataattactcgctgtttaatatttcaaaaaactatagtgtaggcatattgacttgttcaataaagctcatttgtattcattgtggactcttgaatatggactatagcagccagtgaaattggtggtgttttcttgttacgaataatacaaggaaaaacccaaatctattcaattaaatttttgtgtgcaaaatttcagctatagtctaaaaacgctacataatttatattacaatcattttggctaatcagatacccaatcatattttaatagatttccctgggagaagaaatgggatttaagcttattaatctgtatggcatgcaattaagctaacattaagatgaccaaaccagtatgttttattccatttggaataggatcacttctccagagtagtagatatttcggaatttacaaagaccaagaaaatgtgtattcctttatgatttttactgcatgcttaactatttattattccatcttgttcttgaaagatttttaagttctttataaaaatacatacattacaaagtaataatacgtagaggagggaattgggacagtgttgggaagaaaagctgtgccagaagtgaggctgtccagaggtggatcataaatttgtgtctaaactttttagtactcattgcaaaaaaacatgatatcaacataattccacctttatgaattgtaactttttttacattaattactggagctcagatcttccattctagatacaaacaaaagtttagttttaatgccagatcatttaaaggcagttactttaaaatggcatcctacaagactactttctgtcagctgcctatttccacacatctataggttaaataaaccaatattgaataccattggcattacattttttcaagatttgaaagtgactcatgaatcattaaggagaggttgaattacgtcaagtgtagtttcactactacatttaactgatacttttaaaaatgtactcactttcatatggtgcataaagctctgttaactcaaatattttcattgtccttgatatttaatacctcagttattgatagcagtcaattgctcataaccaaagaaatgcaattgacatagtgtaaaagttcaatttcagtgttctttctttaaaaacccttcaaaatgagttttaaaataaagtaataaaatttctaagtcaacacttagaaatctagataagccaatagtttcatatagcgtcttcaatgttacaagatttgtgagtactggcatgtgggtcagaaaacaaggggtttgaattccagctctgctccatttttattgcaatttcagttatcattttagcacttcagaataaaaaagagatttatttaatttctaattttttttctacctctcagctttttttcaacctgtgtgtgactggattgcccccactttagttaggttatcataatatacctgtattatttaaacatacacaatctcattgtcacttccccacaaaattaaaggaaaagctctctaaaaaatggaaaatttttagcacttcagaataagagatttgtttaatttctaaatttttttctatctttcagcttttgtctatctgtgtgtgactgaattgcctccactttaggttatcataacatgcatgtattatttaaatatatacaatctcattgtcaccttccccacaatattaaaagaaatctcttcaaacaaaatggaaaagattctgaacaacgtgaacctaagaggcctaaaaatgactaggcaaaacaagtgaagttagaagtgataaaggatattgggagaaatacagtaaagacataaaaatatctattctcctttcctcatttacccccacattcatgtcatttgcctggtttatttacctgaagatatatgcccattgcagtgaaactgtatcatgtcattttatgctacacgtaaacagtaatggatatattaccatttaaagcatattaacctattcatgatgtgaaagatataattgatctttaaatgttttatgcagaaatccttgatggattattagttgttagactattttgattggggctctgggtgcactggaaataaattattgtttttatcatttaaaataatgaaatatagactcctactagccaaaacattttatcaaacacgtgacaggaatggattacattgatataatgacggatatatgtaactgagataatctcttcatgtatggccatagttagagataagatttgtgctatttttttgtttttcttgataagttgttttttcttccttcttttgtgataatttagagagttcacttttggctctttaaaagcacttcacacatactagagtctttacctaataaactagatcttcaaatacattaggtcgaatcattaaaaattactaatcttgtataaggtataaggaagggatccagtttcagctttctacatagggctagccagttttcccagcaccatttattaaatagggaatcctttccccattgcttgtttttctcaggtttgtcaaagatcagatagttgtagatatgcggcgttatttctgagggctctgttctgttccattgatctagatctctgttttggtaccagtaacatgctgttttggttactgtagccttgcagtatagtttgaagtcaggtagtgtgatgcctccagctttgttcttttggcttaggattgacttggtgatgcgggctcttttttggtttcatatgaactttaaagtagttttttccaattctgtgaagaaaggcattggtagcttgatggggatggcattgaatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagctcactcatgatttggctgtttgtggttggtgtataagaatgcttgtgatttttgtacattgattttgtatcctgagactttgctgaagttgcttatcagcttaaggagattttgggctgagacagtggggttttctagatatacaatcatgtcatctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctgttattattttgagatatgtcccatcaatacctaatttattgagagtttttagcatgaagggttgctgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaagttctcttttttggttgtgtctctgcctggctttggtatcagaatgatgctggcctcataaaatgagttagggaggattccctctttttctattgattggaatagtttcagaaggaatggtaccagttcctccttgtacctctggtagaattcgactgtgaatccatctggtcctggactctttttggttggtaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatcccctttatcattttttattgtatctatttgattcttctctcttttttagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaattactaatctttaactcatttgacacataagaatgacaatttcatatattttatttcccacctttcattttatttttagtctccatttaatgataactaaattttaaatattttaagaattttaatcaagcgcttctcaagatatgattaacttctataattttattatgtatgtatatgtgttaaatatgtaattattatttgcacatattttacctattccaatgtctcttactgccttcaacattcatttctgtttcttttacacaacaccagcctcaatttgttagtgtttttttgttcgtatatcactgattttgagtttatctctgatcacttgtagaacgggatttagtttttttttaatgttttaaaatattggccaggctcggtggctcacgcctgtaatcccagcactttgggaggccgaggggggtggatcacgaggtcaggagctcaagaccatcctgaccaacatggtgaaaccctgtctctactaaaatataaaaattagctgggtgtggtggtgggcgcctgtaatcccagctactcaggaggctgaggcaggagaatcgcttgaacccgggaagtggaggttgcagtgagctgagatagcaccactgctctgcagcctgggtgacagagcaagacttcctctcaaaaaataaaataaaaataaaatattatttatttatttgtaattgataaatattgtatatatttattgtggacaacacgatgttttgaaatatgcatacatttttgaatggccaatggagccagttatcatatgcgtcacctcacatacataccatctttttgtgatgagaacacttgaaatctattttttttagtaattttaaagaatatattgatattaactgtagtcatgatgttgcacaatagatctcttgagcttgttcctcctatctatctgaaaatttgtatcctttaagcaacatatcttcaaccctgcccagtcaccctctggtaaccaccattctactatctacttctatgagttcaactttagtagaacatgaatttgaatggcttcactcctaacgctgtacacatctgattatgagggtcttttcatttcctatgggtgtgattgaaagcctgaatgtatgtaaatttgggggtcataacgttttcttgcaatgtactatagacatgcatgcaaatccatactggggcaagtaagctatggagtgtctgtgtgataggctttagacattaagaagaggaagtgataagtagtagaagaggccagcatgattccttcaaggattatgaaggaagatagtaaaagtcattttttaaacagtttgtctactttagatggtaaggcagctaaagaattttgcaaaactcctctaacttcaaaccttctagaaagggttagaggatctcatgtcatcaaacagacccccaccaacaggagcagatggggctgaatgtagtttctccacttccgtagagttttaagtaaatacagctctaattacaatttgtattggacattgattctaataatccataataatgaattaaggaaagctttagtaaaataaagagaaatgtctctgacaaaaaaaagtttttctaagtaattagatgggaataaaatgtttactgtcatttttcttttgttacagagaaaaaagatctgaagataaatatcttcagctctttttaaaataacctatattttcctctttgatgtttatcaagatacgtgacgatcagcatattttaactataaagaaatgtaacatcatttttgaaatgaaaaagtaaggacaaataattaaagaaaattacttataatcttactaccccgatatttgtttagattgacactttattgtgtatctaatttttaatacatatttcttatttaaaataaaatgcagatcgttcagtacaaactattcataacttgctctttttacatgcaaggaaacattccttaatatccttacatattttaacactctcatttataatggtgcatgtggccttttatcctagtgctgtatttttaaaatcaattataaatggaaattcattggaatgtagttaataattttatttcttctcaaatatcttttcataaaaattgtgccaatttatactctccagtataagagagtgtttgtttcatccacttatcaccaatattatttaagcctttgccaatttggtaggtgaaaaatagtaatgtaattataattccaaattatttagcaattcatttgaattttatcatattttcatacttaatacaaatatgtttctcttatgtagaattcaggattatgttatttgcatatttttattaatgttttcttactgatttgtaagatgtttatgtagcaaggacattcatattttgcattctgtaaatatttggaaattttcttttagagatgttaaacattattcacttttactgtattttggatattttttcctaaatttctgaatcactgatttgattttctgcagtactaaatctgagttgtattgcttgtagcacatattttatttcaaccattgcagtctcatttctttttactttaatttcactctacatttatttaataaatgaaatgtgctcttttctgtccctgaacatgatgtaatgtaactacatatgtttataccatggctcaaatggagagaagaggacccaggtaacaaaggagaaagataaaagatagataaagatacagttgcatattggataaagtcactaatttgcaaaggtcagaagatatttctgtgcagaaaaggaattggccattaggtaggatgaggcacgtgtatacctatgtgttaaattatgtgttaaatatttgtcattttacagatgatcgtagattcctgctaaaatctcacatgacctcagttcctattactcattaatttttctcctgaatataacttcattatcatgacgtcatgataagttcaaaaagcattaggaaaagggggtttagcatttttatttacttcaacattttaaagtatttcccagtatgtgtctttaaaataatctcttatggaatatcaaaagacagagggactgataatagttacggcttgagtcaaccaaactgttcaataggaaatagcatcagtatattttctgaaaatcctgccttttgcttgaatattatggccattttgttcaaaataaaaatactcagcaaaacccttaagagaaaccttcaaaaggacaagtacatgccaagtaatctatattgtaagtgcaagggcaaagatacttctccatccttatattgaagcggttgaaaatttgctacacattgctagagttctccaaaattgtttagagtttattattattgttgttgctgttattgcagttgtttctgttaagaaaatgtgggtaaagggccgggcgccgtggctcacgcctgtaatcccagcactttgggaggccaagatgggcggattccgaggtcaggagatcgagaccatcctggataacacagtgaaaccccgtctctactaaaaaaatacaaaaaattagccaggcgtggtggcgggcgcctgtagtcccagctactcgggagtctgaggcaggagaatggtgtgaacccaggagacggagcttgcagtgagctgagatcgcaccgctgcactccagcctgggcgacagagcgagactccgtctcaaaaaaaaaaaaaaaaaaaaaaaaaaagtgtgggtaataagaggaaatatttatgaaatcgggataaatattgcgagtaatgtaacaaacagatagcttatgcccataaaatgctacattttactagctacggaagggtttgagtccactaagaatatacagaaagtacttcttgtacatcctcatttgatactgttgttgctctgatagggaccacatagcaatgtaagcacaccacagttaaagaatggttgaaaatagaacttaaggacaactgtaaatgacgtttggggagctattttctctctgtattttattttatttcatctcattttattttactttaagttctgggatacatgtgctgatcatgcaggtttgttacataggtatacacgtgccatggtggtttgctgcatctatcaacccatcatctaggttttaagccccgcatgcattaggtatttgtcctaatgctctcccaccccttggtccccaccacctgacaggccccggtgtgtgatgttcccttccctgtgtccatgtgttctcactgttcaactcccacttatgagtgagaacatacggtgtttggttttctgttcctgtattagtttgctgaggatgatggtttccagcttcatccatgtccctgcaaaggacatgaactcattctttttatggctgcatagtattggggagctattttctatggctgactttgttacccatgtgactgttcattccccctctcccaaattaattataattgctttggcttcatatttaaatgttccatatattgccagttgtctcctgggaagcaaaattgccactctttgagaaatattggtctagataaatagataccatttaatttttttgagacaatagtatgaacttttctatctgtatagacatttgattcagccaaagaataaactagattgttaaatcttatgtttcttatataaggtgttactctcacgttaagagcacccaaactatctaaattcacatatttacatcattttagcccttaagacatagcctgggaggaaaaagtatagcttaagaatggcataagaagatatatatttgttcttttctgaaatttaggaacatcaaatattttgctatgagacctgtcttctttggaagaaaaattatcagatttgattttgataatctggttctctattggaaaacataaacattcaaatgactaagcttcatatagggctctctagcaatgttttgttttctagtccgcttacacattatgagtataatctttaataatgttgaagatcctttggcttaaaattcaaactacctcttcttatgtttagcttatttttctggcagtaccactgtggtttcagataattttcttttccttttactctctcatttccaagtttcagttattaaattttggcatttgagacccagaatcctggtagtaagacttttgtttaatttttttctcccaaaaattacatttgattttaattatgtcacatgcacagagagcgctccttatccatgtgttctacatccatgtattaaccgactgtagattgaaaatattcagaaaaaaataataagtagttatataccaataaaaatattataaataaaacaatataacacagcatgtgttatactgcacagtatttacattctattaggtgttataagtaatttagagatgatttaaaagtatatgggaatatgtgcatagattatatacaaatactacaacattttatttaagaaatttgagaatcctcagaatttggtatccgtggggggggtcctggaaccaatcccctgtggatactgagagatgattgtgtgtctgtgtgtatgtgtgtgtgtgtgtgtgtgtgtgtgtgtgtgtatgacatgttgcttgttggctttattagctactatcaagtttttatactgcagcattttttaattcatgattttgataactccctcacttacttagagtgctttttgaaagattttgttcaagaaaaatacatgggtaatatgttttctaggattctctaaattggaagatatattccacttctgtaatttcttggctgaaaattcaattattgaatcacaaccattctttgaaaaaaatctgtgggcactgcctcaacgttatttgacttttaatgttgcaaaggaaaatgacaatttggatttttattcttttgagtgcaacttgtttttgctgcctagaagtatattatacttttttctttgcctttgtcgtttaaatctgtggccagaatatgttcatttttggttgtatttcataaatattgccttaataaagatgatctctattttacattatatattcctctgcatacccccaatatatctatatcaatttatgaatcaattgcatgttttactcttacaatatatctgtaattgatatcaataattaatacatagaaattaataaatatatatacaagtagatgaagttaaaattaatgaaaattgaacttctgatatattcttttatgctgcaagggattaatcaatgcgatgtctaggaaggtgcccatcctcctttgaagactatggtcctggaacaccgaggatccttaaatatgcatgtttgggtgttattacttccctggaaagttttcagaagttgtgtgtttaattctggcgttgattttaactgctcttgttccatcattccagaacctctataattcttaggtgggcttgtttttctgtgcaaacttccatcatcttctctctcttatttcttcttttcctaaaattttaattgtggtaaaatacacaatataccctatttcaccttacttccctcaccctaccccaccttcttgcagaaacttattcctttcacaattcattatatttttatatgtatcattctactcaattttctctgtgtattgtgcttatatatgtttgcataaattatactctatattgttttctgtgcttcgtaattgtgacttaatcatatatctaggaaattgtttatgagtgtatatttaaatatgacatcatttaaagtaatccttgaaaatattttaatacttcttttagttttataaatagatgtgagtggttaaaaattcatcagtgtagaatggtataacataagaagaagccatcaaatgcttccacttccatctggcaccaccatttttatttccaggaataaacacatttgagacttgcctatccacttttaacataaagtatctacgcatatacagacatatgtctattaagtaactggcttcttttttttacataaatcatatcaatgtgtctctgcacatatagatttctttatttccctttatttgctgcatagtattccatacgatggatatattttccacttaatcacgaaattaaccattcattttgttatgggtggttggctcatatacaaattttgttattaagatgcatgatatggtgcttattcatttacacctatttttgcatattggtaggaatttagcagtggaataaatttctagtagccaagttccttgggcaaaaggtatgtgcagtttgtttctagatatttccaaattattcccccaatttttacactatttgatgcagcataaatttgcttctttgctctttaagtgcaagttttaatttttccattttatttttctttctggattttttctcatttcttggcatctcaaaatgttctccttttgtgagacctaggtcttctcttacatcctatttgggtaagcaagtagtcttgaaataatttccataattcttttttttctctaaggtttgggatcagagtcacagtttatggttttgaagtagttttttaattgcgtacatgcatgtgtgaatttttcttttgactatttctggaatatacaccttagtttagttctcactaaagataacttgtttgtcttgttcttggctttgtatactctccacttgtgtagaattgtaaaagaatgttatacacacacacacatagacacaaagctcaatctcatattacattagctcagaagtcaaagtcctttaagaaatgggtgaaatggtggtaaacaatttatttttcatccatacttaggaaatgctcattccccatactacaggttgaaaaagaacttcaaatttctcttttaaacatcccatataatagaattgaaccttaatagtaagataattattaatgtgcatatgagtaagtttattatttaatatccttaaattagcacctgcatttcaaggtacagaatttgggttaggttccagtttgatcatttatttaagaacatgttgagcttatagaaggaaagtgagccttttttctctctcagaagacaggcaacaacattaaaggtctgaaaaaaatgctttttgcataaaatagtttacttaattgaacagttttttgctccccttaattcagttcttttacctagtagagaaaataaaccttaggaattaagttatagtctctaaggacagcttcaaaacttcacaactcattgaactggcataatatcagagagacttgcacttgattttattttaaatcctctagttctttgcctataagattggcattgatttcagcgtagctttcaaatgggcccaggttgcaatatctgtctatcagggatacaagtactaatgtgataaaaataataaagcaatctgtgcgctcttagtgattgtgtccttatgagatttcattttcctttataccatgaaattatttagtaaagccatctatcataaagagtgctgttagaaatacaattttctcgtgacgaatgatgtaaaagtaacctttttcaggacaatttattgattaatttgataaacatgtattttgtgccttttattcttggggcaccatattaggcatgtactaaaaaatactcacgaagcccttttaattctttgaaatgggttagatggtggggctgcataatggcaccaatattaaatagacattaagttaattaaggtgcgttaccttagttttcaaacatatatacacataggtccccaatttagagcaaaacagaaattttacaattagacttctaatgaaacttgcaatttttgttagaataagccaatctttagcatttataattgccaaattatgtttctctgcttttctgaggaaatacatggttatgctttgttttctgaagcataaatggatgtttttacttattagtcacttgtgagcagaaggtattactctcgttccttttatttcctcttcttccaattagctgacagatcaagaattcgaaagatgagaatgccttgaggtattcagatgtcatctacaacagggaagaagggtgactgtgagagtgccaaactttgctgctggaaggcagtgttatttcttgaccaactcatgtgcattctaatagtcagtgattttgcttccttatgtggctttgcaaaatgatcgtcctctgccaactctcccccctcctcttgttgttgcttttggtttcagtctgtatgacacaggagcgattttaaagcctttcatggccagtattgtatataaagaacttagtggttgcaatgtatcaattaagcaaacccaaaagttatctttatacagctgtagatattgaatgctaaaacactgttttatcaaatatttggttctaatatcatcatctaaattttaatgtaaacgtctacattaaacttttactggaacagttacagctgatttgaggtctactcctctagattagtgacattttctattaagcatgatttattttttctttacctgtaatcatttaggcaccacaaaggaaaccattgttattatagtctagagactagagcttgttggaagctttctgaatgtttttccacaagaggtggccaactcaattaggactggttcaatttttgtcaggtttagtttggttgcaaattccaccttttggtttgtaaattgattgctgctgtgatataacacaatgaccaatgggcaaaagctaggccaaaacagtgaccaaacagttgagcttgtggaactggtctcctttgcccagttacatgaacactgcaatagtttctaacttctgccactcaaaatatgtgaagcttctctaccaaagacaaggctccctttgcaaagatcacttggtagctccatcctgctggagttggtgtaaccgttcatgatttaagtcatataaaataggcactgaagctttatatactattggccacaatcagtttcataagtcttatattactctttcagcctcataaatgttcaatctcaaatctagtatttagatttatatataacttcctttccttctttacccttatatctacatactgttctaaatcagaactctttaatttagtccccttggccaatgagaaagttaagccattaaaaaaaaattctactttcaatacataacaaattttcttcttattctttaaattaaagatctccccctaaccctttacctttaaatcttttgtctttctaggctcactactttggtgatttacctattcccatgaccttactcatcattacaagcacttgacatttaaatacctagatcaaaccattcctgagttgcacatcccaacttctaacttccttatgaacatcactagttgcctgactatatattgacatgcacaattgagagtgttacagtgcaggcatgcacagcctaacaagcaagatacactcactgaatgaatgttaaagtggaaaaagtcttccaccttaaagattattttaaataatccctaaggggtgtaaaaatcatctttacttacattttaatttgtaaagaggagaaaaatattgatgaagcagttagaaatcttgtgcctgagagagagcgtccctcacttttggtccctgtagtgtgtctcttttcagttacagtaagtggcttcccacattcttttctcataagggcagtgcggccagatggcatgctacttacttattgagaaacaaaagagaatttcttccttacaaatgttatctaaaatgtagttttgaaagtctcttaggtaaagatctcctttataaaatgtaatatataattataagctggtggacttctttttgatctctaagattattttgggtatacttagattactgacaacccttagtcaagagccattagttccgtagccattagttaattattactgtatataattattagttagctaatgaagtgtaggttattattaatttggggggctgagatacaaagtaacatcaggtataaggagtttatggaagttcaaaaatgcaaattgtgagttatttcatactcatgacttatcatatggaagttctggtcccgccacttccagactctatgatctcaggcaggcaaataatttatgtccctcagcctctttaacccaagcgcaaagtggaataataagattggcctcacaaaactactttgaggaaaacattagaaaatacatttgtaagatgattctataataaccaagggaaattgttaataaatcacagtattcccataaaataacatgagttaagcattgtgtagaaggaaaataaatttcaaatatataataaatatggaagcaatgctcaaaattcaattttatgtgaaaaatgcaggaatcaaaattctacagaggttatgcaaatttatgtgtatactcacatatgtgcacatttgtgtgcatgtgtgtgcacatacacatatagagatgggatgagtgcagaggcaataacaaaccaggaacagtggtgggaatacatgttattttctttatatgtttctttagaagtgattagtagtcagacttattaggtgttgtatacactttttagactaatttattgaataaaaacaaaagccatttttaacaatggaacaattggaatttgttgttttctatagtaaaagctgtctatcttatcattcattcagccctcattctttgacatctgtatcaaacccgtatgctgtatggttaagccaactaatggacagtacatccttcaataaggaggaagtctaaaacacatagcttccaacttgctttaaaccagatcttgttggtgtgaagccactgtatagttatttttatttatttattcatttaaaaggatttccaagctggggttttggttacttattaaaacctacagagacaaacatgtgtttgaaattaattgtgttattccagatttttcttataccattacatcatgctctttcccaatctggcttcctgaattttcttcttaaagttacatgatttttagtctcattctcaagagacttggaaatgtaaattgagttattcaggcaaaacactgaatttcaagacattgttagaagccagcttcccattatatagaaagctttttttttttttcagtgtaggcatttttgctcagtttttagaagatttagaatgtaatacttgaatagccaaatactgatttcttaatcctatctattcatgtacattaattcctatgatgatgtttgttaggtttacaatcttggctggtcttggtaaggtagattaaaatattataggttttagactctcacagcagtaatgtccaccgtttttctccctagtgttaattttttttaatactaagaaattgtattcttagatattcgggaatgcaaattttatactgtagcactatatatttcggtctttggatagacaatattttggcttatttttttcaattcatctttagaaacatatatatgtttctaaacatatatgtttctaaacacatatatatatgtttctaaacacatatatatgtttctaaacacacatatatatgtttctaaacacatatatatgtttctaaacacatatatatgtttctaaacacatatatatgtttctaaacacatatatatgtttagaaacatatatatataaagataaagttttgctcttgttgcccaggctggagtgcaatggtgcaacctcggctcactgcaacctccacctcccgggttcaagtgattctcctgcctcagcctcccgagcagctgggattgcaggcaactgccatcacacccagctaattttttgtatttgtagtacagatggggtttcaccatgttggccaggctagtctcaaactcctgacctcaggtgatccacctatcttggcttccctaagtgctgggattacaggcgtgagccactgcgcccagccaaaacttttacatctttatgttgacataaaattctaaactatgtaagcaagcttcactttttttataaggatttagaaatgaacaaaatgggtacacaaagaacagattctttatttaacaaacattaattcattgaacaaatattgaagtgtatactttgtatcagttatcatgtcaatcatactagaagaaataagttccaattgtgtcaattggatgttctaactgttcttaacttctatgattcataagtttataactccctaataaatctttacatataattacgttggagtatcacaataatgaataataccattttgcttatataagctttgtgaatgtgaaacaaaaagcaacaacagcattgaagttagaaactcttgaaataattttctacaaaaatttatcctttttaaaaaaactaactttttaagctaagcagagttcggcctggttagtacttggatgtgagaccacctgggaatactgcgtgctataggctttaataaaacagaaagaaaaccctaacttaaaatatatatgtaagttcttaaaaagcatatcttgccataatttatgaaaacccttatatatataatttttattgtttttcagccacataataccagtctaaaaaagcacatgtagaatatttatatgtagtatatatatacattcaactaccttgcatatccagtctcatgaaaaacaaatcaaaagggaaagagaagtatagaattttcagtgtagttaagccacactgctttccctgattttgaaaaatcacttaagacataggttttacttgtttccttggccagggtatgatggattacctgtttcacaaccatctcagtaactaacaactgccaactacagaaccgtattgttctaccaaaggaaaaccatcatgagaagataagatgtttttcccctaccccattgaaacttctaaattacctataaaattgtcataatgtattagtaattggaaaattctgaatgatttttgtttatagtcttaaaatatatggatgaaaaaagaagaaacagttttggcaaaacaagctcagaattcttgatgaagctgttccttggagtcaaagggagtgtgatgccattgccactcaaggttctccttcgtaatctctagcagataatctataaatcccaatgacctataagagcaagacaaggactgcaggtgctcaggcaccatgatatcattagcaataatcaatgcatggctgtgttttctcactaatacatgggtagagtaccaaattattgagcaatactagatctctcttttatcgagctcattagtcttggaagaattcattaatcttttaagcttagaagaaaaatgtaacctaggatttggcagaacgatcaatgagacatacgtgagagagtgtgtgtgttcaagaggaaggtaaggagaattgaaagttttagcattggatttagcataggatttaagtggacccatctgtatttggggatgagggggaggtcatacacggggctgccaacatgggtggagacagaaaacaaataactctgaaaattgtgtgtgtgtgtgtgtgtgtgtgtgtgtgtgtgtgtgtgtatttctgtaacagtttagggttttaatttttttccagaaaccctaatcaacataattaactttctagcctcagatctaattggtcactacatcctgtcatggccaccaccaaattatatcttatttacttccttcttttatgcctactgccggaaacttatttcaaagatacctgtattttcatctgaactgttgtaataacctactgactggcttctctattattttcccgtgttcatcacttatattgacttccttatttaaaagcagtccagatctattcattgcctacccatgaaatccaaactttttggcatgaatttgaaacaataataattattattatcatttattaagaaacttacattgctagacataaaacatgagtatctccaactcccaaactgagctttgaagatagggtattgttatgtcttgctttgcagcagaagaccttgatatacagaaagattaaagatctttccaagttcaaggagctggtgtaagagacggaactaaaattcaaaacatgtgctgtgggtcgggcgcggtggctcacgcctgtaatcccagcactttgggaggctgaggcgggcggatcacaaggtcaggagatcgagaccatcctggctaatacagtgaaaccccgtctccactaaaaatacaaaaaaattagccgggcgtggtggcgggtgcctgtagtcccagctacttgggaggctgaggcgggagaatggcgtgaacctaggaggcggagcttggagtgagccgagatcgtgccactgccctccagcctgagcaacagagcaagactctgtctcaaaaaacaaaacaacaacatcaacaacaaaaaaacaaaaacatgtgctgtgactgcagagttcgggcattttccattacacctggttctgtttaaacctgacccatttcacctttatagattcagcaactaccagtctcaccttctcgtacatcttatacatatttagctttacccacccgccatgatttaaatctctcatactttttcccatcctcatcctgttggtcatgcccttcctgctgttgtttccttgatctttagtaattttcatttagataacatctactaatctctccaggttctgtgcaaatgtctcttcttctctgaagtctcttttaacctattgagttttccccttacccatgcaatatttccagagcatgtgatacatacttctattgctgcaccaatctcatttttgtagttatttatttgtgtatccataagtcaccatgactgcttgaaaacagagcacttttcttcttactttgttgtttatgacacagtgattgtcccatcaaacatgctcatacatattgaatgagtgaattctctacccatctcaaaccaatgcgttatggcaatggcacacaccattagtttttgtaagtaacttttgaaagttaagccaaaagtatcttcatgttaattaatagtgcaattttgcacgtgttggaatagttgagaattggttattcttaagatttatttcctgcccaaacaccacagctccatatttcacgattttccaatataacttatcatcttggctgtaaagaataccttaattttggccttaggtaggatagatatgtttgattggactttctctgactgattaggttaatttgtcagctggactcacggttcttctttagttttcttctattctacacttatgataactctgtgtttggatatttctttgtttattacagatattaaacttgtaaatttaatgattctctgtaatttttcagagcccatcagcccaggtgtctttccacatactgatgtagtaactgtgagtgcctttaaagctcttgtatctaaaccatagctctgttatggttagcctctgcttcattcatttaaaacctattttgtgtagtcactatttgcaaagtgtttagctaagataaaccacgtactttccctgttcttgagaaattcatagtgtatcctttggtttatgatctagcctaggactcaattagaacattaattttgaaaagttaaaggagacctctttggagattatgcgtttgttttagttgtgctattagtgagtttaatcatataattttgctcaaacaaatttcttaagggtctactacgggcctgcagagggggaccaagggctcagaataaattgatgtagtggttacagatgctggcactggattaaacctggatgtgactcctggcttcccccatacttgctgtgtgatgccctgcaagttacagtaactatctgagttttctctttgacatatgaaaaatgtaaataatagtatttcccatataggtatttggtgacaattaaatgagataattaaaataagcataggacattatatgacctttgctaaacgtccaatttttgttgtttaattattgagttttcaataaatatttgccaaataaaaaacttaaggaaaataaacactgaagttattgtcatgactttcatgtatatctccattcttgaagttttgacagagttataaaaattgaactccgagttttggctcaagaaacctctgttaatctgatatgcataaatcttgaattaaggtttcctttactactgttactattcctactgataatatctttttatagcatttatattttaatgtatatttcccattacctcctaaaatccttagagcaatccctgtgagggctggtattattttcctttatagatgaatagactaacatgtgcagggattaagagtcttgatctacgccatttggctcataaatggccagctcagtcctggaactcccaggtgtcctactcctgtacttcttgcctctcttccctaaattttggttagttgaaaagtggacaattatcatcttctggaatcttctgtatgtaatgtaatatagttacagtgtgtttatatagagtggaatataaggagatggagattactggcctaaggatatgtatagatataaatggaatgtgcacacacattttaaatgcatgctaagtggaacatggaagtttttcatattgactcaaagtgtggtttatttgaagacattcaattataaatgtcaagtcaacttgcattcaagtaaattattatgtccctactcctaaaatttttaatacaaagtcatctggccaatgcttatctcttcagactcataccccgtcatttgttctttttttcagaatcaccatatgattcagctgtatagaagtattgtggtgaatacttgtttcatacttctgtcttattatattccctctatcagtgtactccctgccccttctgcaactcttgtttatcctgggaaatgctggatgatctttgaagatagcaaatgcttgccccctctgtgataccatctttcaactctgtagattgaacattttctggcacttatagcactttaactgtcctatcacattaaacaatgttgatctaagtcaatctgggattccttagctctagtacaaaacctggtacaaatgtggaaacaattaatatttgaattgggctaaaaaactaggatacatgtttctttgggaatttgctgaaggaaaattagaagtaaaaaaattgagcaactttctaactgttttctttcaactccaagtgttcattcaatctgcacatgttcctgaacacctatgaagtctcttctcctaaccagggatccagcagtaaatagaacatataacaatcctaccctcatggaaaatgttttctaatgtaaagagatatacagtaagtaagataaatatatgaaatatcttacatggtgataaatgttttagagaaagataaagcaggaaggtagaatatacaatactgagaggaacttgcagttttaaataggatgggcaaggaagactctgctgaataggtgatatttgagaaagaggggaaggagataaaggattgaggtattaggatgtctcagggaagagcatcccaaatgtaacagcaaatgcaaacaacaagagaaatgaacacgtatgtcatgttcaaagaagagctcagaggccagagtggctggagcacagtaaagaatggaggagaaaaagaagacaagttcataaaaatccataaaaatcatgtaatgtcttgtaagttaaaagattgatagttaatatgagtaaaatgggatgtgaatggaaggttttgaaaaaggcttaatgtcatctaacttagtattttgaaaggataactctggcttttatattgagaatgaaatgaaagagggttggcacagaagattgaggataggaacaagggaaagaacagggagaccagttatgaatccattgaaatagttcaggccagaaatgatgatgacttggtttatgatggtagcagtagagataatgacaggtggtgggttgtgaatatattttgaagataaagataagagaatttcctaagagagcatatatatgtgaaagagtcaagtatgaatccaagatttttgttttaagcttttgagaggatagagttgccatttactgagatgggaaaaactgcagaaggaacagataagggggaaggtcaggaattcagtttttgacaaattaattttgagatatgtttagtcatcaaagtgaagtttccaaataggcagtttgtcattaaatctggggttcaaggaatcattccaggaaagatgaaatttaatgctatgggcctggattaggttacccaggaagtgagtataaacagaggagagaagagatccaaagactgaatcttggggcatttccacattaagaggcttgggagatgaaaaggaactggttaaagagcctaaaaagagagtgaacagtgaggtgaaaggaagacaaggatagaagtcaagaagaagttagggatcactggcaaacttcttctgtaaagtgccagatagtaaatattttaggcttcataggccaaaaggtctctgttggaagaatacaactctgctcttttagcaggaaaacagctatagatatcaggtaagcaaatgaacatggttatgttctgttacaactttacttaaaaatgaggcagcagacttgatttgatccataggctataatttgctgattcctgttcaagaaaccaaacaaataaactgtttccaggaggaaagaattattgattgtatcaacttctgcttatttgtcaaaggtgaaactgaggaattgaccattagatttaacagcttggtagctgtattagtccattctcacactgttataaagaaatacctgagactgggtaatttacaaagaaaaaaggtttaattggttcacagttctgcaggctgtacaggaagcatagcagcttctgcttctggggaggcctcaggaagcttataatcatggcagaaggcaagggcaaacaaggttgtcttacatggccagagcaggagcaagagagagagtggggaggagccacacacttttaaacaaccagatctcataagaactcactcactatacagtaccaagaggggatggtgctaacccattcatgagaactctgccccatgatccagtcaacttccaccaggcccgacctccaacaccgggggttacaattgaacatgagatttatgtgaggacacagatccaaaccatatcagcagcctttagtgaccttgatgagtagtttcaaaaggtgttgagaggaaaggcaaaattgaaagagggatttgggttaagagagaattaaggagagaaataagaggtaagaacaagtcagcactttgggaggccaaggcaggtggatcacaaggtcaggagttcaaggccagcctggccaacatggtgaaaccctgtctctactaaaaatacaaaaattagctgtgcatggtgatgcgtgcctgtaatcccagctactctggaggctgaggcaggagaattgctcgaaccaggacccggggggtggaggttgcagtgagccgaggtcacgccattgcactccagcctggggctacagagtgagactctgtctcaaaaaagaggtaagagaacaagtgttaaaaagtgaacgcgtttcagtttcacatttgaggggaacaaagaaatggagctgaaactgtaagtgggaaatacggtcaagagaggatgtttttaagatgggaaaataatagcgtagaatacacacaggaatgacccagaagagaggaagaaattggtgatgcaggagagagtggagctaattgctggagccatgtccttgagtaggtgagagggaatgagatctagagcacacagggtggggtccgtcatcggaacaaagactggtgatccacagtgttggtcaccaacgcaggcccatgggaagatatgttgacatgaggctagggagcaactgtttactgattacttcaattttctcagataaatgagaaacaaggtcattgactgagagtggggaaggaggtgttggaggtgtgaggaaaggggagagaataaaatagccattcagactggaggttctcaaacgttgctacatactaaaatgacctcagagagcatttaaaaattccaaaggccagattgtaaccaagacaactttactcagaattttggggtgatgccttgctttagtactttttaaagattccccaatattcaggtaaatttgagattgagtaagattactgagtcatactaggagccaacttgaatctagtgttcatgaattcaaaatgtgactagtcagattatgtgttttcctccagaagtttccatagcatgagagtgaacagtgaatgagtggagagttggtggtaaccggggtttaagatttatcaagtgggcaccagatttgagagggagcagagcaatttaaagatgtattcaaaaaagtgtttacaatacactgtagagtttatgcttgataaaaagagaagtgatgccacgaagggcataaggaatagtgaaaagccagtagaatgaatgcattggagggcctggtaatatcaaagtgttgttggaatggggtactagatggaatcatctggagacttagaaggtggaggtcagaaagtgtgatgtttataactgagtttctaacaacatctatcgtatgaccacagaaccaagtggccaaggcagggtggaggacaaggtctctggagtcaaaaagttcagtgaattactagggcaagatggtgagagaattgttttcaacagacatttaaagtaccagaagttatgacaagcatcatatgttggagagggtaacagttaggcaggagctaaaatcttcaggtagtgagggaatgataccacccatacttagatagctcctcattttcctactttcacagatactgattccatctttagacattttgaacaatgcaacaatgttaattttcttatactttgttcaatatactttcatgtgtagtcaggtactagcgttttcctttttgccccgttttattctggttattagtaattcactagtttctaaagctaattgtatcatcattgctttttacacttgaaatatccagtcactatttgtgcagagccaattcaatttttcttcttgaaagaatataactcttagctacaagaatggtccagcaatggtaatagaattattctccatggagaatacctttttgcttctctagctctcccttttaacattagccttaatctgatagcaaaatcagcagtcctaaaacaaaaggaaaaataatgatgtttctgaaaagagagagtcagaagaattaccagcacactgaatatgtatttcagtctcttgtgtaacaagtttgttgttgtgatggttgttttttgttttccctttggcaatggcaatgtattctggggaaaaaatgcagtatgttgattttttaaaaagcctattaaaaatttccaaagataaaaatgcctgaagcccttaatctaccacatgaaattgtaaatgatccccagtggtggagttctctgtgatgcaagttcatcatagttgactgatggatattttcagatcattcctgaagttgtagtgcatttgaacaatgagtattgtaggtatagtgtagaaatgttcatctttctatgactgagatggcagagccttttagctaagactcagtgtgatttattacctctatctacatcaatcaccaaacatgcaaatcatcttgactctcaggagagccatgactcattcactgatatagaatgtttctccgtcacttggctggagctctcttctctcacctccagtgttttacacagtctgtttcacaaatgtgaacaaactgatttctctgccatcccagttttctcatctcttcaaattgatggttttttccagcacatctttactgattaagctagatcatattcccactccattaaatcttactgaccattcttacctgctcatatttatatatcaagtcaaacgtctgttaacgtgtgaagtttattataatcagtctgtgttctctgtttaaattatcctacctcatttttatattaatttcttacataattcttttgtcaaacatgtataacttggagttgaaatagccttgtgtaaatcttgaatcttactccccgcaccttctgccacattgtccatttatgatgcttgtaattagtttgtagatttgactttttaagtgaaatattccagagcaagagttttctgtcaagagggagtttgcagttaggttgaggacaaatgcatatatgggtcacctggctaatttttttttattttgtacagcatatacattccttatttctagcctacttccacaaacaagtctgttaaggctcaagggtcaagtatctcaaatctgataaaatattatgcttaggtcagacacggttgctcacacctgtaatcccagcactttgggaggtcaaagcaggaggatctcttgagcgcaagagtttgagtccagtctgggcaacatagcaagatcatgtctctactaaaaattaaaaaaaattagttgggcatggtggtgcatgcctgtagtcccagctactcaggagactgaggcaggaggatcacttgagcctgggagattgagagtgccgtgaactatggttgtgccactgcactccagcctgagggacagagtgagaccctgtctcaaaaaaaaaaaaaaaaaaaaaaaaaaaaaaaaaaaaaaggaaagaaagaaagaaaagaaaaaaattctgcttagtcccatgctgtaggtagaatgactctggcttttaatggcctgccttgataagaggtcaggtgcactttctcacacatcatgccatgtccctcaaaggaggactccttattaacattgatactaaataactgataagctaatcatggagtttaacttaatacacctgaaaacgatcctaaaatgatctaaaaatctcctgggtttttttcttttcacagagaaggaaattgaaacagtcctctttcaggacccctgaaccaatattttttctattatgccatactacctctaaaataattgtttgctaatagccagctatatgcaaagaaatatattaaggcattaaaaatgtttgaagatatgatttattcctcaaggcccttaacatccctttggcaagataatgcaaactacctgtgcctctcttacacttcttagcaagatatctgtattttgtgatggtctatattgtgttttcttctcttctcctcccagccttgtcttcctgtttaccatctgaatgtggtaaaaatgcagatctacctttcttcccaatgctgaaatagggcctggctcatagttggcattcacggcagttaggagaaggactgaagagaagcctgcactttctcgtttttgtacatgctctgcacaaatcctgaagtatcctaactcaacccctaattatccccagctctttaagccctacttatctccctttaacctttgcctgcctcactgttcataccccctctcccatcgctgcttttgggtttgcatctacctcctgtccctgttttatcctattgtatttatgcatatgagtattaaaatcttaaaatataccagtaccttaaataagaactgagggataaagcagatatccctccaatttgagggtactttttttctattttattctccagaactgatcagtgccacaaaatatgatgagagagcaaggtgtctgttttctctttcagtttcattgttctaaagacaacactttcagtgtaggtgctgtgtatccattgcctgtttgaatttacagttgttttccagtggtgctgcctaactctttgctaatatctatatttgacattaggtcatctgggcagcttgctgtaatcatctgtgagaaagctcctctggaacccaccaatgggcactagaatcaaaactttggttcagtcttataatttcctcatttataatgtggggataattatagtaccttccttgtggagttcttgtgaggattaactgagtcattgaatgtaaagcacttagaatacgggaagcactcagtaaatattgttcatatggcgctcttcagtagccaaaatataacaccacactatttgcatttagtacctttctgttgtggaagcttctattcaaacaagggtatgtatttcatttatttttaacgttttgcttttgagaaagcttgagatatatttcatagttgcctacaggcaaagggagacaccaataaattgaattctgcatcctggatcataaggtaagtgccgaatctgaccacaggatcagtgcttctgccactaaacccgagtatcatcaaccttactggttctttgcttagatactcttgtccaaagttcttaaacgtatcagcaataccatcatgcatctttcttttattattatttttatttaaataaaaagcctacagcacccggtattcccaggcactctcccattcaagtactaaccaggcccaaccctgcttagcttctgagatcagatgagaccagccatgttcagagtggtatggccatagactcatgaatcattcttaactagagagcaatacattttagctaggaaaactcctgcattcaactataatttcatataatgtaaatatgttttaactatattaaataacttctccaaatatgaaacacacatatatatcatttggtctagatggatccttgactgtaatttactttgctgaagtgtccatctctctatccacatttggattatttaaattacttggagagccaaggtggctcccagactaaaatttccccaattgtccttccactgctacttgttcatgtaggaaatttctccatcctgtacacagacatcagagtactctactccaaagaggccctaggatttttatctcttcccctttcccagtccttctgacaactctccctccactgtttaaagcagtattaaaattatccaaatgttcatcattgcctctttctactttcaatattcctctagcagtgccactaatctaaagcatatgctgatttctcttccctcatgaattatgatttataatggattagcatgagcctaggaacaatgtacttcctcttgtcccagacatgtttagagctttccaatttacgctaacattggagtttgtcatgggggcatttttgcccatctatttttattatattttagtcaatactgtgttatatttccatatcatattattctgatataaacaaaaatcacaaggtaaaatacaagtattcattattttcttagtatttatcttatccactgagtagctttgactatacttaaaaaaattctcagcttatttaatagattaaaaattataatctgtaatgaattaattggaaataaccaattaatatagtgagggaatgaaagtatgtcacaaaaatctttctgaaaatgtttcaacgacataagtacaaacaactctgagaagtacaaacaactacagagaaggcataacaaatatgtcatgattgtcaatattttaaattcaccacttcaggtaggacaaaggatgttaaaatatttttctttgaatatttaatatcactaataggaccaaaaacattggaatagcatgtgtgtgacataagctcaaagttctagagcagtgctattcaatagaattttctgcagtaatggaaattttcaatatctgcactttccaatatggaagcaactagctacatgtggccattgagcaccagaaatgtggttagtgtaactgacctgatgctgaattttaaattgtctataaattttattttaattaaattataaatttaatgataaatagctacatggggctatttgtctgcaatattggatgaacagtaaaactttagagacttccaggcttctgttaagactgtaattcacacaaggctgggtcatcttgtggtcactattaggccagtgtcacactacaaagcaacacaaatcctacattaaaacaaccacataaaacgacctataagaaactaccacatcacactgaaaaataattttgatatttactgttttgcaagcgtgtcaaaatatttaaggatccttttcacacatctttctccttgaaaacctctcactatgcttcttcagtgctttcttcttgtttctcctccaaatattttccccaaacttacctatatatctcaggcatccttcctttctctcatcctcatctcttctctacaccttttaagatctgtctctttatccattatccccacacatcaacaggtccctgaccatgcacactaaacacaaaatcctcatccccagagaagagacttgctatccgtcacaagaataaatatttgtaaaggctaaattgggggctatatattagaatcatttctagatgtcacccttttttcatcctctaggcaagattatttctaatacgaatttcatgaggcctctagagtttaagaaaaaagctaatgcttattgaatgctttgagtagtaggagcacctcaaggcaataagaacatctcaaggtctcttccacctctttgatctgatgaaaaattgaataataaatataaactgggtatgatacaaaccaatgagcaaatcactttttatgtaaaagtaattaacaggggaaaagatttaaaaaggatgcccttcatcttccctagattgggagcttatcctttagactttaggttttgttcatttgggatacagtcaacaaatatttgttgagccttgactgagtgttaggcagttttaaaattattttatttgtattggtaataaaaacatggtggtccttgcccatatagagcttacaaatgttaaaggaggcagagagaaaacaagaaaatctataacctaaatataaaattatcaattgtgatcactgtaattaagaaattgatggggttgaataatagaatagcaggatgggaatgccatactaacgcatggccattagaaactaagtgatcctacataacacatgtgcacagagatgttctttatggtttcatagatttgatgttagtgtaacccatccttttacatgttatatgttgccatccttaaatggtctttggtaaaccacatctgaatttttgattagcaaatgtgaaataaagacttcagcttattccgtgtaggtgctgaataccaattaacaattcagtatgaataacatttccatctttacctaacgagcacattttttttttttttttttttgagacggagtctcgctctgtcgcccaggctggagtgcattggcgcgatctcggctcactacaagctccgcctcccgggttcacgccattctcctgcctcagcctcccgagtagctgggactacaggcgcccgccacctcgcccggctaattttttgtatttttagtagagacggggtttcactgtgttagccaggatggtctcgatctcctgaccttgtgatccgcctgcctcggcctcccagagtgctgggattacaggcgtgagccaccgcgcccggcccctaacgagcacattttttaaaaggttgtccattttatgaaaatgagtagaaatcgaaaaatgcagtgctgataatgctaagaaggatagactcatggagattattatgcatattgtattagcatcaggtggctgtaaatgcattagatataagctggtagatggtgggctacatgaggaagaaaaataaaatcaaagaagacataaaacttgctgacactacaacaacctcaaagttgtgcctaaaagatgagatttaatcgagtatttttaaaaactagatgctagatcttatggaatagaaacttgtttcctatcatgtaagtctattaaaatttttcccattaagaatttatttaaaaattcgtaactgcattatgtagaaattacatggaatatgtcttatactttgtcttttccccaaaagtgttatttcttcccattttatacctaatagagtagaggttaagtaaatggaggaacataatagaactagaaagttgcatagataggattaaaatgtagaatgttttggcttcaaagtctctgttctttctagttcatgacttctttataaaaatatatttatcagtgtttttggttggatcatcacaaaagtgggttcttccttcacttgtgtagacagaaataaagagtgaaattataacatacaagggagtaatttgaaacatgctcatttttcttgctgttgtcgaaaatgagtattttatattgttttctttttaaaacacaatttgctcccctgcacagaaaaatatacccgtttttctttagaaatttactaaatttttaatttgctaatcccaagggaaggattattttcttaggattaagtatagtcaattggtattatgatgttgggaagtaaagtgcagaattctattaaggacttagtgatttggatttgtcaaagaagagccactccgtgatgtaatttgcatggtcatatatatatgcaaagttctgtttcagcttggagactttatctttgaattttcactgagaagatattggcttattcctattttagaatctgtttagccatgactctggacacacatgtatagaaagagtaactcctttgtacatgtgcttttgaaatattgcctatgatcggtgcctccttagggaaagtgagttttttgttaagagtctgaaagtctatttaggaaagttgttttcaaagagtgtcctgaaggttacttggtctgacttaacagcaaagtcaatttaacagtagtctgccttgcagaatcctggatctatcagagattgagttctccatgctgtgtgggaaaattatactggctgattttgggagaagttactgtgggaacacattttggcacatttctgctgaagccagaaacctgaatgctttgttctttgtgaggtatcaaaaataaaaattcctgaaattctgacatcctgcctgctcccttatctgggttaaatgctgtggtaaacttctcttttggttgaaatatttaaaaaggaaagcaatacatatgaacagacacatatttatacacacacacacacatacacacacacacttgcatttctttacttgaactatcttgttgaatcctaattactaaactcacatactgcttcttcccagggaatatagaatattactgttatcaagatacgccacacctatcctcattggcgacctaccccctcaattctccttgctggtttattggattaaaatagagaagcagaaatcttatgtaggaggaatatgttgacaaatggtgggttttgtcttgataatttcaccaaatatgtgaattgactttgtcagtcattaaagtaagtgtgctgaatgccctctgtgtgtgtatcaggataagtggtctaatcaagttcaaatgttctgtgtctatttggctcagcttaattaaaattcagccctgcttttgagcaagccacagtgggttggcagaccttcaaagggctatattgcagcaaacaataaaagtgataaaggcacacaatagcaatcaatacaatgcaaatgcccctgttactcaaaaatccagtggaaagtgattgcttgaaacatgcttatccacttctcatcataaaattaaagtttttgcatcactttatttgtaagtttgcctacactctccttgtcaatgggcttgctttttttttaactacgaatggagtgaaagaaaatgatagtaagataaatcagctcaatacaaatcaaatactgtttaaatttttacagcttttgttttatttgttacacatatgggtgaaaacttactcaaaggatttttacctgtatgaggaagacagccgtaattcatcctccattcatttgtagtggaggtggtatattcttggtgatcatcctttttttttcttccagtccactgtttttggctggctgccatggtcccagattttctcacaaactgccatctggcattcttgctgtccctcacatatagctttgtcaggacctcctccaagcaggctggagaatttcacagcttgggggcatgggagtatacacgaagttgcagccacttcagggttgatttctcacctacaacccacatatctgtcactgctagatgtttagtggaaagagctgctagggcactggagattaggggacctggaaagaagtacccactcacctctgatgagctgtatttttagtcactctgtatttgaagaatagagatttttaaaacctgatctctgtattttacataatcatcgtggaacatcactgtgggtaaattattatgaaagatacttctagaaattcaagatggagatattgatattacaatatctcttatagcacacatgattgttgtatcatctcaaagttttcaatgaatgcttttatctgtaagcattcattgtaagactgaatctgtatatataattccacaatgtaactaaaatataagagaaggaaagtttcacatctcatccaagttaggtacatgaggccaccaattgcagaactctagaagtatttttgttacagtttttcaacccagtgaaacactatctcttctgtgtgtatgctttaagtttcattttggcttctaggctttaatcaagcactgagataattattataaaggtatgcttcaccattgtattaactacatcactgacttcaatagctgaaagagaggcactgggatagcgccatcacaactgttcacaaaattctggccagtggaacagctagtcacaaggccaaggttttgtgaactgtgtctatggctgtatctcagtacatctcttatcttctgcagtggaagccaatgcttctcacttcttttatatttcatccattacctacttattgcccttaaatcatcctaaactttgattgttttgttattctgttaaaaccataaatggcagaaaataaatttgaaaactaattattaacatcagtaacatgctctcttaacatgctgaagaatatcatactttcaagtgagagcagccagatcaagtgttaatttttgttttagatgccatgttaagataatagcttttagaaaagacgtacacctctattgatacactgacgcatatacaaggttcaatgaaattcctactgtagagtattgactgtgacatttatattttgtgtcaaacaattatatagattctgaatgtctacgaagcaaaattgtaaacacaactaacatcacttctttcttagataatttaatcaagatttccctgtgaacataaaatatagaatagttagtggttaatatttttgggaaatttccatcatagtataataaatatttggggaagacaaacctatacttgtaaagaataaaattttcttaaaaagtgtcatgaatatattgctcaaatttattctaatatagtttatgatagaaaaattatttctaggtagttatgttaaatagttacgaaaaatgccaatgaatgtcaggttaaacaagtttgcagtactttcaagacatggagtaatttggtaaattattgtattttaacaacagatgtattttctgatttttttttatgttctgaattttaatgtgcagaacttacactatagtaaccaagcaaaaatctcaaagggtattctttttccaaagccaaaaacaaattaaaaattagatggaccagtggcccccaggtcggcacccctactctccaattgaacagttacttcattcctaagtgcatgtgaccataatctgctttgagcattatattcaaactttatcagtctttgtttcagtctgtccaacttctgagcccaatcctccagccttcctttgagaacatatctagaataagcttaccttgtattacatctcagaagtttcttaaaactaaatcggggatagtatcattggtaagtaagctttcgttgatctggataggagatatctgcctgaaatgtgaattaatctgaaatccttagacatactaaatagttctctatttcagtgaaacagacaagtattcaccgattcttttcagtttgttatctgaagcttaagtttcctacttagttttttcctgttgctcacttttgacctataactaagaatgaggccgaagatatataccatcaggttgccaaaggagaaacaaagtaggtaggttctggggccagccactctgccagtgaccgtctgttgagatctttctatatatagagtcaaccaactgcaaatatatatgagaccaggatgtctccagtatagaatcaaaatgccagatttgagcatcctgtgtggctcacccaacaatgatggtatccatatgttagatggttttattttgtactgctttcatataaactcttcggaggcctttgaatagggatttttttcttctataattttaaatacctcaatgccaatgagatatgaaactcatagctataacttctcctacaattagggacaacaatttaaatttggaaaagtagatgactaaacaaatgtatatgaacatatacatcttcaaatataaatgctttcttaatggaggcttgctcatagaaatcagaaatgtatagtttgtttgctgttgtatcaacctgcatttgactatgattctgttctaaatgtaagtcttgtctcaatttttgaatttgttatggagtcttttaaagagacaggaacatatcaatagaagaaacagattctactgtgtgtatacttgtgtttgtgtatgagagcattcacaaaatattcatacttttaaactaactcccacagaaaaatttaaaactaaaatcacttaaaacatatgattggcaagagcttcaacaacctgagaactctatgcttatcagatgaaagaagaagcagcattatgaaaatgtatctggataccataagataatttcagagtacatcaggtgaaaacagtgagaggggctctttgttcatctgaccttatattttataaaaactcaaccttcgattccatgataaatagaatatcaaaatcccataatgtcagatatgtatctcatctttgatcttctgaaatgttatgtatgtcaagttaaaaaatcttgaactttgatggtaataataacatgcaaatattttgatcaaaactggttactttgcaaagaccgaaatgatattgaagtacttgttttttcaagagtcatatagagacataaatatatttggatagcataaaacttaggaacaaattattgttaatgagagttctgagatagaattttatatttagatttaatacttttaaaataacatttttcaaaatgcaaattgaaatattatatggatgcataccatattatgcacaggtagcgtttatttaacttttgtttcacaattatttattgaatgtctttttttgtgggagatgctatagtaggcactagtaattatgtgaataataaaatagatgcaatccctgacattgtggacttactttcgagtttggtgctataaaacttggttctctttcagtcaaatctaggttgaattattggcttcagtttttactgactgaatccatttgaatttcaataccttatgagaaagctatggcttagatagaatataaaacttggtagtcaataatggaactaggaaataaagccaagcttgcctgactctcaattcaataatttccccgttattctagattagataataaatgtataagtgtgaatttaaaactgcaaagtatgggctgggtgcggtggctcacacctgtaatcctagcactttgggaggccaaggtggtggattacctgaagtcaggagtttgagaccagcctggccaacatggtgaaaccccatctctactaaaactacaaaaattagctgggcatggtggcacatgcctgtaatcccagctacttgggatgctgaggcaggagaattgcttgagcctgggagacggaggttgcagtgagctgagatcatgccactgtactccagcctggctgacagaacgagactctgtctcaaaaaaaaaaaagaaaaaaaaaaaaaaagaagaaaaaaaaaagaaaactgccaagtatggtagaaataacaattggctttataatagctatttaattttatttaatattccttggcaattttatttatataattaaccaatattcattgagtgcctactatttggcaaacatagtttgagatcttggggatattttcaggaacaagaaaataagtcccacttctcagagtactgaagttttagcatgaaaatatagacaataaacaaatacttgagaaaatgtttagtgctaaatgctatggtaaaaagtaaatcagggaaactagatgctcaggaaatctttcccaagtggacctgaatgactaaaagagccaaccatgctaacatgtggggaagaatgtttgagaaagaaggaaaatctagtgcaaagccctgagaatggaatgaggttggtatgatcaaaggtccaagagaaatcaagtgtggctagagcactagcttttaaaatgtgattaccagatcagcaacctcatcatccaagtatttatcagtattctaggcatgttaatttccttgatttgaaaattatgctgtgattcggtaagaccttaacattcagcgaaattgcgagtaaagggtatatggcaggatttcattgtcctattttttgcaattttttgacaaatttgaaaatatttgcaaatgaaaatttaaaaaagaaatgagcaattatacagcaaaaatgaaaggttttaagcagtgcaaccagtggaatactgtgatctagtttgggttttaagaaaaatattattgctatatgatataaaaaatgggttagaagagggaatttaatgcaagcgcaatgaccggtgaaggagctgttgccattgtccagaggagacatgatggtggctggcactggggtggcggcagtagagatgagctgtgaacaagtcgatccaagataatataatttgaagatacaattggcaaggcttactgatggattgattgtgagaaagagttaacagaaatagaaaagtcaaggatgcttaggttttagaccagagccactggcttgatgctagtgatatttatttattgagaaggcaaagattgaagtaggaggttgtcaaataatggcacttgattaatttttacaagtaaattattaaaggaaatctaaacggacaatttgcattatctttgagtatttgtgattattagctggtagtgacgaatttaacttgatgaatgccatattgtctgtaaataaattaactcacttgagtgttctcatatttttcccgattttttagttgaatgcagctttagaacattaaattgtgccatatattaaataaaataattaaacaataccaacaagcactcttaatttgctcttctaaattttatatccttatgtagtttattattttattcaacaaatacttgtggagtggctactttgtaccaggtactcttttcatcactggaaatataacactgaacaaataggctgaaatctctgccctgatagagctttcattctggtacattctagaatgaggcattttaagaaaaaaaaaagtatgatatgtgggtgaaatagacagtttaaacaagaagtaaaatgactattaagccagttaataccaaggatatggaccaaattgaagccaataaggagcattgataatatgagaaaggaagggtttgggtctggagggggttttaacttaaaataaggtcatttggaaagacctctttgattaagagttaagggatggagttacaaagtgctaagaagagaggtcataaaagtgggggaataggcagatataggaagctttgtatgcttatttcaaagacgaccctgtgattgccggaatgactggaaggatggcattgccatttatcgaaatggagaagacagccgaaagagtgggtctggattgtgggcatgtttgggaggtcattttggacctgataaatttgatatgccctttagacttccaagtagagattccagtggctggtaggatctaagagatcatagatcacatgagaggcccatacctctgaatagcaaatgttgtatcaaattaagaagttatatttcagggttttttgtgtttgttgttgttgccaaggaattgatatacaggaataagttcctgataggtttaaatgcagtgaagagtgattttctcaattctcgtgagaatttggatcagaataattttatttcaatgaaaaatctgaaatatcaaatgcagcttaattgcattgacattattaaaagaatgaggacttaagcatatggcaaatttaattaaaatattactcttatagaagagtgatcatagtagaggacttttttctttcttaaagcaaattatatgccttcagcagtacttatttttacaaaatgcagaagactgtatttaagatgatttctagttcatgttattatgtggtgaaataaggaaatgcatgaagctgtgttatgttagtttgggttatcttcgaagcctttgattgggaattgactactaaacactgtaaataatatataagtactaagttctgaatgtgaatgtgatcttacatagtcatcaagccattatgtgtcctttgttttcctatcaaatgtagggggcaataatgtcagctattatatatttattttaaaaaatattttgaaaatgagaacaaggctatagatatacctataaatgtgaatatattttcaattcttcaataaaatatgttttaaaataagaaaacctgttctttttctcatcttcactaatctctttttagcaggaaagattattttttgtttgcaaataacaaggcttaggcattaagtaagcgctagggagaggaacaatagatctaccctagaacagattgaggaatcatacttaaaagacccatatattaacttggaaataagaggtagaagaaaaggaggaaaattaggagaaattactttgctagagattgttttgcattgatcatcaaatgataaaaatgtcttctttgaggttttcatttaggatctctgaactaatattcatattattgctgtagaggtattataaattcccagtcattagcataaggatttagtgacagatctgaggttctccaaaaacacctcaatgccaagcaaatgattctgctattagtcttcttaatgcacctggcaatttcctgtctttctactttgatcttctttctcttctcaggtttgcaacattaagaaaggggtagtggcaaaaagaaagaatgtcaacttagaaggctaactttgggggaaatcagtatagccgaggcatcccccaaaagcttcctttgcgttaatgcaaacttccacacaatatttaccaacttctatgaaccagaaaaggctcattcttaaaaaaaaaaaagacagctttattgagatataatttacatactatataatttacccatgcaaaatttaagatgcagtggattacaggatattcacggtgttgtgcaacctttaccaaaattaattttagaacattttcatcattccaaaaagaaaccccatgcccattagcagacagtcttcattttcctccaaatacaacccctcccttcctcagtcctgggcaactaccagtcgactttctgtctttatggatatgcttagtctggacagttaatataaatgaaatccagtcatatgtgtcctttgtgactggcttctttcatgtaatgtaatgtttttaaggttcacccatgttatggcatctatcggtacttcatttcttttgatttccacacatcgtccattatatggatttagaacattttatttatccactaatcatttgatgatcatttgggtagtttctattttgggctattacgaataatgttgccataaaattttttgtacaagtctttgtatgggcacttcttttgggtatgttcctaggaatggaattcctgggtcatatgataattctatgtttaatcttttgaggtactgccagaatgttttctaaagtggctgcactgttaacattccaaacagcagtgtattagggttctgatttctctgttgatctccaccaacaattgttattttgtgtgtgtgtgtgtgtgtgatacaatacactgaacataaaatgtaccattttacgtgtacaattaagtggccttaagtacattcacaacgttgtgcaaccatcaccattatctagttccagagctttttcacaatctgattgtagccgtcataggatgtgtgatatggtaactcattgtgattatgatttgcatttccctgattgctgataattctgagcatctttttgtgtgattattggccatttgtgtatttttaaagaaatatatattcaaatctgttgccaatttttaaactggcttttaaaattattgaattataatagtgaaaagactcattcttaagttaacaatgaatgtattacatgaaaaactcaaccaccccatggtttcagtttaaatgtattttccagggatcatggacttacccagtgcgcagataggacatctttatgacatcagaacattgatgtcaagtgcctattggttcagggtagtgtggaagaagttgtacaaaagcaggcacttttatacccttctctctgagaacattcatctctaaaaaacatacatgaaaaaactgccaaaaacctgatgcatttgtggtgtaatattaatttattggatatgaacttgttttgttgtaaactaccagagtgctttgaagaggaattttattaaatcatattcttaagaaaagtattaaatcagaaggtgcacatatggatatgcttattagtaagataactctatgttggtgatattcagtgtatagttttccagagctgaagtgagttttctgtttccacagtttaaatgaaatgtgtttcaaaatgacacttaggatatctgatggagatgttgtcccctgtcatgtttatcatttaatcttatatggcctcaaaaagagaaaatcatctttttggcatactggcatacttaatttatgcagcatactatataaatcctaaagggaggactgagccaagccagagaatggaataacctactttatttgcaaatggataaccatagacatgtccagttattattaagataaacaggaaatgatgacaaaaccaagatcttggctatgttaacaaatttcagtttctcagtctatttctgaaaatgttgagttccttccaagatcccatgttccccccacccccacaaccagatttattccaggcaatagtaaatacacctggtattcaagggaaaatattcacatattcacttttaaagccagttttgaaggagtctccaagacattgaagggaaccagatggtgtgcagaccattctacaaaggtttatgattagtttggctaaagcagctggtctctgcaatgaaagagttgtcatggcagaaaaatccccttttccctcagtgcagctgggcttgtccagggacgacttttcccaggcaagtgttctctctccattgggtgtttgcaaagtctgttgtacttagagaagttaaaccatttctgttgaaccaagttgacaaaaaacacaaataagccaatgttatttatttattttttttagctcaggatggtttaattgccttaaaaaaaaaagttttcacctctgagtgggccttttctgtccagtattagaaataacaactgagactattcaggaaaaaaaaaatggcactcttccaaaagagaaagtgaacttcaacacaattctcagattcaaaaggactgcaaaggaggattatttctgccagctttggtcatttgacagctacaattctccttcttcaatatgtcatcacaaatctctctcaacatattaatgggaatcctgcatttaattctttcatgtttatggagagggaggtggggtggagagggagactgagagagaactttcaccttctatatgtgataatatgtttaaatgtaattaactgttctgcttttgccgttaaaatgttattttgcattcccatcgtattgattttaaattgaaactcaatgcttttgcaaagacagtcttggggttataaaatgataggttttattgcaaagagaggaatatttatctgaacagatacatgagtgtttccataaagaatgggcctattttactttatcagcaactaaggggaaggttaatggctatgatgtatcttttctgttgtgtgtgaaacatgcagtgttcttgctgttgagatttatggtgtggaggacaaagcaggtgctattccaagccttctttcaacagcggagtataaactagggcctgaacttatctgtcaaaaagtaagttaaaataacgttagagaaagcctagaatttcacacttttccataccttcctgtctctagctcaggaatttaggcagggtgattaatgaccactgttatttgtgagctttccaagtccctacagacataatgaacttgacttttcagccacgtagaaggaaacaggctgttagagctctacaacatgacatgttcataattatgagctctctgcaattgggaagaaagaggaagaaaagagaataatcttctcatgtcccatagtctcaacttcaaacatcctctactccctctctttcttctttccccatcttcttcccgcctacacacacactcacacacacagaatgtatctatacttttattaatccagaaacaaagtctgactctacttaatcttgcctcttatttttccttcatatcaagcaagcaaatcatgcttactgatttctttgtcagaatatcgtatggatttgtccttccctctgttctattcaccctgtcgtcttgtgtttatgctagcccaatccctgagttaatttaggctccaggcactgtatgctttttgaggtaatacaacctcttcattttcctgtgtcttttattttaaccccagcagtttattttcttgcttttcaaaatcttttttattctgaccccacctccaaagattgtatatgctccctctttttgttatcgctaatgtaaatatctcttatccttttgaagttcaacattcatttccatcaagatgtactttaaatgcatcttcttgtataatccttttcagaccagcttcacctggtaaggtccattctgataaactgcttacaatgtttttaccccgtaatactaatcatatcttagactacttacttaaataaaatacaacttcttgcgcataggtatttgttctaaggatagttgctttgttatctatatagtcagtattcaatgccttttcaaatataattcaacaaggcctgttttcaacctcaaagaagtgaatgaagagtcactaactttaaagttccagcaatcccacagcattccccggctcctccagagtacctgtggaaattagattccttgtaagccactggtaattttaagagtctgctgctcttaaggaaagagtctgctgcttgctacaagatagcagaaattagtgtgttggttagttctgatcctgaaaaccttgcctttatcaaagacagaacatttcctgaatctcccgatgatatagtaaagtagtggggagaaattaatctccatcctccgccaatgtttttaccggatactgcatggcatccttcctattatggagtgttattttgactagaaaaaggattaggtggcaccatgggagaaaggcatagtctggttgaagcttatacgaattttcatttacatcctttctttttgtcttgcaaattactattctttttctctctcatttccaccctagaagtcccttagatgctctctttattctccattgctctctgatgctcttttattgaattctatgctccttgaatacaggtcttatgtcttgtttacctttgtattattacagttatctctgtgccttccacacaacaggtaatcaataacaatttgcttaatggaattgagtaattttagaagactagtctatattatagactctgataatttccttttattctacaaaaaagattttctatcccaatttttcttaccagtatcataccactcacaatacagcatgctgctattccatcagcccagagaatgtgtatgaacacagctactcaggtattccttatttttttcttttgaactaatcttaaagacactgattatatctctcttatgaagagcaattatacaattttgtggtagttctctttttacaagtttatcttcttagagaagtataactcttttttttttttttccaaaaaggagactatttctcagtatcctggggacatagcatgatgtgtgataaatagttattgctcttttttttttttcagagtgtgatcttcaggtgatcttttcatgctttttccatcctttcttcatattgtctttgacttgtcatagtttctgcctggcacagtgcctcctaaattcatctattactctcacctttctttccacttttctcatgtgagaaatacacatttatcttcatttaccctggaaggttttctccttaacaacagtgtcacacatgacatactatacattgcatgctctacaaaataaaacataacctatgagagaacaaattcataagttttattgtaatcaaaatatttttttgaaaaatcttacatacagtattaatttttcagttttctctgatacaaaagacaccctcacttaatgagaaaaaaagtcttagaatacgagagctggaaagtgtctttgggagattacttggcacataaatatgatgcatagaaggtaggaaattactgcataattacacaagtaatcagtgacacagtgtctagatagcccaagtcttctagtataattataaggccacatatccgtcatggtgactcatgtctttattcacactgaccctgtttttaattgtgtggattttcacagaggaaaaaaaatggtggtctttgtagagctggaatgagtgaatactttctggtagatacattcatttttcacatttaaatataatcttagtggattttagtttttactaaactacttaggaaaataaggttaaataagtatattttttaaagatttgaccttctaaaagttcatttaaaagaaagaaaaaatattttaattgatggaaaatgagcaaatttattcaaagtgacattagttgcaaattcattctgagatcatcagatattaaagcaatgcatttagaaacgttattcttcatattaccaaactgaagcaatttaaatgtctatcaatagtagaatggataagaaattgtggtaaattcacacaatgaagaactttttttttttttttttttaacggagtctggcttcgttgcccaggctggagtgcagtggtgtgatctcagctcactgcaacctcccccgccgagttcaagcaattctcctgcctcagcctcccgagtagctgggattacaggtgcatgccactatgtccggctaatttttttttgtatctttttagtagaaacggggtttcaccatgttggccatgctgctctcgaactcctgaccttgtgatctgcccaccttagcctcccaaagtgttggtattacaggcatgagccaccatgccaggccccaagaactattttatcatgaaaatgatagaacaaaactacatgctataacatggatgaagcttataatcataatcaaaagaagttagacccaaaggaatacttattatataaatctatttttataaagttataaagttcaaatctgtgagattagaaatcaaggtggtaattactgctggaaggagggaaggccagtgttttggatgaggcaggaaaggtgcttctaagtactggtaatatttcttgacctattgatggttacacaggcctgttcatgttgtgataattcagtaagcttgggatttatatacttttctatatgtatgtttttttaaagccaaaattaaaaaaaaaaagactaaaggggaaatttattgaataccattagcttttaaaatgtatttttgtttttacttaagagttttaaaaagtagtcatattttaaatttacatattgttgggaaaattctgccaatggtaggataaaacaatagatttcaattgaaatattgaaagcaacttgtgttggtaaaagatgagaagtgaaggtggaagactgattaaaactaccaaaaatatcatagtgataacacttttatttttctttttttgtgggggtggggatagtaccattataaaaatacaaacataagctgcttttgtacatcaccaaataattcattgaaatttaaggaaatcaaccagttatgtgtgtacacacacacacacacacacacacacgatctcatagagtgaagggttaattggaatactgactgagtgcaatgtacaagaaaatgtacacactgaatacaaacaagggaaaaaaatcaactttgcctaggagaataataaatataattataggaaggaggggggacagggtaggtgttaaaaaggagtttcctgggaaaataaggaagtgaagaaaggcattccaggcataaaatatgcttgctatgtgcaaaacaacagtgggaaatagcatagactcttccatgtacatactgcaagtgggtatgtgatggtggagctacagttggaaaggtaggtaggggtcgtatcatctagcccgatttactagagtttaactttatttactcatgaataggtagatcttgacagattttaatgaggggagggacatcaggtgccaagtacctacaaacatttaaacaagggaagggttttatggttgcagtgattaggacacgtttgaggaatatttagacaattaagttagtggaacttatatttttataggatgtaaatgaaggggcacagggaagccaccgaaggtgatttctgagattctgttttgcataacttggtacatgatatgccacagacataaaggggaaatgctttcaaagagatctgtgtttttctcaaattttacccaatatatttgcataaagctcaatgtagattggaactatggcaatttgattcagttccacagcttaagtaagtgttattttgttcagttaattgaaaatgaaactatacctgacaggaagctgattacttatatgctaatgtgacagtattatagatcataggacttataacacctattaatttggtaaatgggaaaaacaaaactgtatactgtgaaataagaatttacgttatgtatataagaaatagttgatttaggctgggtgtggtggctcacacctgtaatcccagcactttgggcagccaaggcagctggatcacctgaagtcaggagtttgagaccaacccggccaacatggcagaaccccgtctctactaaaactacaaaaattagccagatgtggtggtgtgtacctgtcgtcccagctacttgggaaactgaggcaggagaatcacttgaacccaggaggcagaggttgcagtaagcccaaatcgcaccactacattccagcactatactccagcctaggccacagagtgagactgtctagaaaaaaaaaagatgaagatacagttgatttaataaatggttatgatgaatgcatattatcatacttgcaagtaaaaatgcatatgcttataaaatatttttgaacagatattttaaaatcatagcaggttttagaaatcaaatttatggaaaacgtactagtttcatgtgtatactctaacaaagtagaaagagacaaaaatgtagtttgagatcctctgcaaatgccaaaatttagccagagtaggtaaaggacttgacagatgaaatgcactctgtctcttacactgagtttatacggagaaaagtaattttcgtaggcagtgaacacataaggaaactggtccaagtcttatgaatgtgaacattagtagaaaataagttatctttgagtatttagtagaaacaccaggaatactgcatagagggaagaaataatccaggaggtactactaataaacacatttttaattttagttcacatatttgggagaattcttacaaatttcatcggctatataccaaacctgaagaaaatattcctaatcaaattctgtggtaagccaggcacagtgtctcacacctgtaatcccagtgctttgggaggctgaggtggaaggaccacttgagccccggagtttgaggctgttttgaggcttgattgtgccactgccctccagctgggtgacagagtgagaccctgtctcaaaaattaaaaagtaaaacaaatcctgtggtggccactcctcatgatagtgacaggtacagacagtcttgttaatctgtggaaacactgaagtgagccaaatcatgttgtttaatggttcccatttggcattttgagcttgtttaagggtatagcaaatagagctataaatagtgcattgaactatgaattaatatggtctgtctgaaatcaatggaattttcaagccctttctgttaatatagagaaaaccaacttaaaaattatgactagcatgcagttaagaaacttggcaggccaaacatcttagaactaattaaacaaaagtgatacatttactcacatgatctactaattcattattattggtacgttagatgtttttcaaaaaaatactgttgtaaaaatttccctcaggtttgacaatgataaggagtgttgtgaaactactgtgattaaagcaccaaaggtacaatgggtcattttatatatacagcattccgttaagtgaagttgaatgcataatgactatattagcatagaatatatgagattagaattaggttttttttcctctgatttgaaattattggaaatcaaatagtgacaagaatgagtatattttccttcaaggcccttgaaaaacaagtcttctgtgtcacgttttatcggttcttttaaaaagagtaaacttttagcagcaagaaagatgtttgaacattattcgagtagctgccacttttaaaacctattgactagggaaaaatgaccccaatttttccccattatggtttgtctgtgtttgcgagtaaagacgtgtcttaattaaaatgttttaaatatgtacctaaaattaatatgagaaagtcataataaaaggccagatactctttagcatggttcttaaccatcaaactttcacttctggttctaaaattatacacctagaataaaatgaacatgtaaaaatattcatgtgtcttgacattggccttctgataaatctaatttgctaatataaaatcttgtaaaaagactataatctaccaaatgaatttactacaatatactcttctaaatagatcttacttataaacatatatgtgcaaaaagagagagaaaaggtttaatttatagtcttaaaaccaatatgctggctatcttagtgtatctccccagatctacatccaccttccagaacatgctctatgccatgggagggggatctgtaaagaatgcatcaatgggcttcctgtcctcctgccagctgggtgtggccagtgaggaacaccagaaaattaatgaaagggggagaattgggtggaggggtctttgttcttcttgttacatttttgtaagtgattcttgaggtgaactggagaacagatttaccacaccttcatcccagcactttgggaggctgaggcgggcgatcacctgaggtcaggagttcgagaccagcctggccaacatggtaaaaccctgtctctgctaaacatacaaaaattagccgggcatggtggcaggtgcctgtaatcccagctacttgggaggctgaggcaggagaatcacctgaacctgtaagagagaggttgcagtgagctgagatggcgccattgcactccaacatgggcaacaagagcaaaacgccgtctggaaaaaaaaaaaaaaaatcccacacctcctgtcagaaagccctctttatccatcttgccctcaatctctgggttctggtatccgttccatcctttagctttgtcttgcccacatttgtgtgtgtttatatatatgtgtgtgtgtgtgtgtgtgtgtgtgtgtgtgtgtgtgtgtgtgtgttattaaatattcctcaaatttcccaactcaagtatgctgtttgtttcctggaaacaggaagatatctagaatctacttctaactggctttgaaaatctggcagtgacagctgggggctcaattttgtatactttaaactttaaatttatatcatttatatatttataaaatgcatatattcattcattgttaatagtaataaaatatatagcaagcatttgggaggcagttttaaaagaaggccattaattttgctgctttagaaaatgttttatgtaaggtgtttcaaaatttggaatttgactctgcatgtagcaattggtatgtgttttactaaagaattatactctacctgtaaaagttcttttaggtaaagacctggaaattatattcaacatttgtgaattgtacactctttaatgcagtcaggattacaggcaaattttctagtagagtaaaaatatacatgaattgtaaaagtaataagaaaggaaatttgaattttgctatagttgttagagagaaggagttagatgatttttattcctgttgccagtaatactaagataaaatgattagagtcacatacacgttatatatgaaaacttataggaggtatgaagaccagaattgtttaggagtttataatctgaggacttatatgatgttctttaacattttttatgctgagaaagaatattattaaacaatgagttaagtcagaacataatgtgacagttaaatgtctgttaaaaaatacatttttgaaggcagaacttctggttatggtagaatatagagatcagcaaaccctttccccaaaaaagtaaaaataaagctggataacattgataaaaccatgagttcagttttttggaaattggccagaatcataaagtaatctggagagatttcatggctttgtagtataaattacaattattctaaaatatttaatctgaaggctatcatgagattttaaaatggaggggacatgctaagtaaaaaatgacaacaggtgattaagcaaaagtgaaaaatattaattttagtatatgattccagcaagtatgtttggactgttgaactattatgaatatttacctatcattatcatcttttaaaatgtctactcactagaacatctcactaattatgtatttctttatttctccccaatagttgtgctttgatagtttttgcaaatttatttaatcatactttatttgaatgtattacattcatattttattttttaacgcagacatttgatatattcagaatggtagaaaattaaatgtacttttttagtattattattatttgagacagcttctcactctgttgcccaggcggaagtgctgtggcacaatctcagctcactacaatctctcccttctgggttcaagcgagtctcctgcctcagcctcctgagtagctgagattacaggtgtgcagcaccaggcccggataattttttttttttttttattgagacggagtctcactctatcgcccaggctggagtgcagtggcgtgatctcggctcactgcaagctccgcctcccgggttcacaccattctcctgcctcagcctcccgagtagggtagctgggactacaggcgcccgccaccacgcttggctatttttttgtatttttagtagagatggagtttcaccgtgtgttagccaagatggtctcgatctcctgacctcgtgatctgcccgcctcggcctcccaaagtgttgggattacaggcgtgagccaccgcgcgtggcccgggccagataatttttgtacctttattttttgaatttgttaattagcttgatttaatcattttataacataaacatatatcataatattacattgtacccaacaaatacataaaattatttttcaattaaaagtacagttttttaaaatgtcaatttttctttttcaatgattcttttatttattcactttatttttttcagctcttgttttagattcatgtgtacatgtgcaggttttttacctgggtatattgtatgatgctgcagcttggagtaagaatgatctcatcactcaggtactgagcattgtacccaatagttagtttcaacccttacttcccttcctccctccccccacaatagtccccagtttctattctttccatctttatgctcatgagtacctaatgtttagctcccacttaaaagtgagaacatgctgtttttggctttctgttcctgcattagtttgcttaggataatggcttccagctgcatccatgttgctgcaatggtcatgatttcatactacatagccacaaaaaagaatgaaatcatgtcctctgcagcaacgtagatgtggctggaagccattagccaaagcaaactaatgcaggaacaaaaaagcaaataccgcatgttctcacttgtaagtggttgctaaacattgggtacacatagacaaaaagatgggaacaataaacacgagctccttcttgagggggtagggtggtaggaggatgagagtaaaaaacctgtctattgggtactatgctcactacctaggtgataaaatcatttgtacaccaaatcccagtggcacacaatttactcatgtaacaaacctgcacatgtaccccatgaaccaaaagtaaaagttggaaaaaaaagaaattacctatacataaagtttgaggtcttacatttaaatctctaatccatcttgagttaattttcatatatggtgaaagctaagggtccagtttctttcttttgcatatggttggccagctgtcccaacaccattggttgaatgggggtcctttctcttttatttatgccgactttgttgatgatcagattgctgtaggcatgtgactttatttctgagttttctattctgttccattggtctgtgtgtctctttttgtaccagtaccgtgctgttttgattactgtagccttgtagtatggtttcaaatcaggtaaagtgatgtgtctggctttgttctttttccttagttttgctttggctattcaggctctttttggttccatataaattctggaatagttttttctcattcagtgaaaagtgacattgttcatttgataggaatagcattgaatctatacattgctttgggcagtatggccattttaacaatattgattcttccaatccatgagtatgggatgtttttccatttgtttgtatcatctatgatattttacagcagtgttttgtagttctccttgtaaagatattttacctccttggttagatgtattcttaggtatttttatttatgtgtagctatagtaaatgggattgcattcttgatttggctctcagtttgaatgatattggtgtatagaaatgctacaaatttttgtacattgcttttgtatactgaagctttactgaagtcatttatcagtttcaggggccttttggcagagtcttctaggtagaggaccatatcatcagtgaaagagacagtttgacttcttcttttcctatttgaatgcctttattttgatctcttgccttgttgctctggctagcacttccagtactatgctgaacaggtgtggtaggagtgggcatccttgtcttgttctagttctcaaggcaaatggttccagcttttgacagtttagtatgatgttgactgtaggtttgtcatagatgtctcattattttgaagtatgttcctttgatgcctggtttccggagggtttttatcatgaagggatgttgaatttcatcgaaagctttttccatgtctcttgagatgatcatatggctttggtttttaattctgcttatacattcatatttttaaagtcacaaacatatagagttgcagttattaacatgatctctaatttttgtaaataaaattcaaatatcgattttagtgattgatgtaatctctaaataagatctaatgtgtattcaaaaaataaataaataatttgcaagtatttagtaatgtgtagatggtggaggggagtgtcatattgtaattaagagctgatcccttgggcttaaactgccagatcatgccaaagactggctttgtcacttattagttttgtgactatgggaaacttacttgtctcctcagcttcttcaccttttagattgattcagttttagaacctacttacatagggttgttgtaggtacttctatgatataatacatattaccaacttagaatacaagcagacacatggtaagcactcaaaaattgttagttgttcttatttttatattttccttcattataagctgttacttgtgagagggaagaaaaaaatctacttttatcattgtttagaatagtcaacttatgttccagttcttataaaatgacctcaccatatatcgtatatattgcacagtgaaaagatgcttctgtcttaataaatatacagatagcccatagggaccaactctttgtgcggatataaaatagtacagccacaatagaaaacagtctcttaaggcagttcctggaaaagttaaaaatgaacttaccatataacttagccattcaagacctatgtattgacccaagagaaacgaaagcatatgtctatccagagttgtacatgaatgaacatagcagctttgttcttaatagataaaaactagaagcaacccaaatatttatggaggtgaattgatgttttaaatggtggtttaactatagaatggaatataactcagtaataaaaaggaattaactattgttagcctgcgacagcatgtatgaatctcatgctgagtgaaagaagccaaaccaaaagagaatgcacattgtgtgattccatgtgtatgaaattctagaaactgcaaactaatctgtagtgacaaacaacagatcggtggttgcctaaagacagtgaaggtaaagtttgaagagacagattactaaggagcatgaggaaacttttaggtgtgatggatatattccttattttgattgtagcgatgatttcctgggtgtatacataagctaaaacttataaaattctacctattaaatatgtgtggcatttacatttgtatgtcaattataagtctacaaagctatttttaaaaatacatttctctcataaactaaataaatgcagaaatttaacattttggatgttgtattattgcatgttttaaataatgaattcaattggagttttctcattaaaatctaaagttgagtttaggttcacagtcaaatgatgtcctataatctataaaagttattattgcacagtgataaattggaaaccagagagaccgacattatataatatttcagttgagtgtgatgtgtctgttatgtacagattttggcaccacagtgcatggaaatatatacaaagagtcttcaaaaagttcatggaaaatgcatattatggaaaagcagttcagagaaatcaaattttgttgaaccaaaataaactcatactaacatttaaaaacacgtctagatagcatctagtttgaggtactaagatggataagtcatcagtttaaaaagaggccctggcggggtgaggtggctcacgcctgtaatcccagcactttgggaggctgaggcgggtagatcgcctgaggtcaggagttcaagaccagcctggccaacatagtgaaaccctgactctactaaaaatacaaaaaattagctgggcatggtggcggccatctgtaatcccagttactagagaggctgaggcaggagaatcacttgaacccaggaggcagaggttgcagtgagccgagatcatgccattgaactccagcctgggcaacaagagcgaagctgtgtctcaaaaaaaaatcagatttatggtgatgcttgagaggaagaatggtgaaattattgatgttttgcacaacatttatggggacaataccccaaagaaatcaacagtttacaaatggaaaactcattttgagaagggatgagacaatggagaagatgatgctcgctgcagcagactgtccacacagagcagaaaattaatcttttttatgccctgattcaagaggactgaccattcacagcagaaacaatagtgaacaccatagacatctcaattgcttcagcttacacaattctgactgaaaaattaaggttgagcaaactttccacttgataggtgccaaaaccattgaacccagattagtggagacaagagaagagctttcaatggaaaatttaaacaagtgggaccaagatcttaaagcatttcattaaagaattgtaacaggaaatgacatacaactttaacagtatgatcctgcagacttagcacaatcaaagcaaaggctaccaagagctgaaactggtcctgtcaaagcaaaagcatatgaaacaaacatgtgagaaaagttcaacatcactgatcattagagaaatgcaaatcaaaaccacaatgagataccatctcacaccagtcaggatggctattattaaaaagttaaaaaaaaaaaaaacaatagatgctagcaaggttatggaaaaaaaggaatgcttttacactgttggtgaaagtgtaaattagttcaaccactatggaagacagtgttgagaatcctcaaagacctagaggaagaaatgccatttaaccaagcaattgcattactgggtatatatccaaaagaatataaatcatcctgttataaagacacatgcctgtgtatattcattgcagcgctattcaccatagcaaagacatggaatcaatataaatgcccatcagtgatagactggataaagaaaatatggtacatatacaccatggaatactatgcagccatgaaaaggaatgagatcatgtcctttgctgggacatagagttggaaaccattatcctcagcaaactaatgcaggagcagaaaaccaaacaccacacgttcttacttgtaagtgggagctgaatgatgagaacacatggacacatggtggggaacgacacacactagggcctgttggaggtggatggtgggggagggagagcatcaagaagaatagctaatggatactgggcttaatacctaggtgatgggatgatctgtgcagcaaaccaccatggcacacagtttacctatgtaacaaacctgcacatcctgcacatgtacccctgaacttaaaagttgaaggaaaaaaaaaagcaaaagcagattagtcgagagaaaaggtcatagcaacaatttttgggtatgctcaaggcattttgcttgttaactttctggagggccaaagaacaataacagctgcttattatgagagtgtttaaagaaatttagctaaagctttaacagaaaaacatccagaaaacctgcaccagagaggccttttccaccacaacaatgctcctgctcattcctcacatcaaacaagggtaattttgtagatgtagaagttttgatggaaaatcattaggtatgcgccttacagtcctgcttcggcctcttcttactttttttgttttctaatcttaaaaagtctttaaagagtattcattggcctggttaaattccgagcatcttcagttttttaggagtaaactaaatggtatcattgtttacaaaaatgtcttaaacctattttgaaaaataaaatttatatttttaaatttttatcttttatttctatttttctaactttttgaagtcccctagggtgtgtgtgtgcacacatgtatatttgtgtatatatactcttaacccccacatgtacatccatgctgcatcctattgggggaggcagtttgtgaaagcattatccaagaatggtttagttgcccttgattttatatatagtgatccagtcataaaactgtagtttatgtgtataattacaggaagacaattcatttgaagagaggcatatgcacacagttatttcaagaagccattttttatttatgaattttcaggtcaaattttttaataacctaagcaacctttggtaggatgttttaacagaattctaaatattctatattgtagtcccccaaacagtgaaattttcaggaatgtaatactttgtcattatgttagctcatctatgtaaaataggctacatttattccaaaacgagaatactttgaaacttctaatgcttagatatttaaatgtggtgattatgctctcatgaatatttaaatctttggagtcagacatagttgctgctagtgccaatcaaatctaggatgaccaaagaaacactgctttcatgaataagtaatctttctccccatgagttttctgaatagtctaagaactcatgtgggaatagggagagcactgttagaatgacattttatctaaaaaagggagcaaccacgggagcagatgtagtatattataatctgcttgacctgttcacaatgatttgtgagttctgaactctaaaggaaatgctttgtttgattctaaactatagctaacaatgttggatcagtgtatgaataactgaagtatttattattctcaggaagtacatattggtcatccaatatgaattctaaaataatttaatgattgctattattttaactctataatggtaataataataatcttcctacatttcaaaggtcagctttacattaaaactttcgctctgaaatttcatattggccatattactctgtttaaaaacattttctaaatatcacagtgaattatatagaattctgtttaaaatttgaattatacagatactatattgatggtagatgccatgagtaagttgaaatatatattattagaagaatatgtcacaacagaataattaaaagtgagtactaagaaataccttatattagacttaagcctccctggataccaaaaaccttagtgtctatttggggaattcctgagatttcaacatagagcattagccagtgtatttgcaaggccactcaaattcactctcatagaaaggacaagaaatattttattcagaaagaagttcatctcggtaactcaagccaagtgaatcaaaagtctaatgttctttgggggcaaaatttctctattgtactcagaaaaaaaaagtcaaggtagtaattgttactgtctaaagaaagtcattgaaataacaggacattctgaagtttgtacttttacaattccttaactttatacatgcttaattaaaagttaataaatatttaccaaacaccttgtttgtgtgctggggaaagaggtatacatatatgtgtacaacagttcttcatttctcaagcattttttagtgggtagagaaagtggtcattagacatatacagaactgataataatacacagtagattgtgataagtgctaatatcatttaatattcattagtttaataaatacagctcagttctgttgctaggaagatcaaaatggctaatgcatggtctctggtctcaaactcacagagtagtgtgggaggtaagcagatacaatacagaatgataaagcctgcactagaaggttcacatgaaacatagaggcagacgcatctcattctctttgtgaaaaggtggcaagtcctgaagaacttctagtggctttggctaatatatagcttatagttacaaagtaagcagtatgacacagggaataatttaatatgtgaggcattattacatagttcctctttcaaggaaacatagctgtttagtccaatgggatcatatgggcaaaaatatcataaattaatatatataatcttcttaaaattccatatgttactctagaacagcctttgtaagccctttacagtaattaagaattttaaaccttattgtaaatatagtagatttgaactctaggcagcataagaagttttatatgtatattcatacagaaaaggaacaaaatgtacattgtgaatgattggttctttcggcataccaatgtgtcacttactgtggatattttcatgccagatattcagaaaagtttgtgtgtgtgtaggtttctatagtatcagtatagtaattctgtaatatagttcaaattataagtatatttttatataatttactgtgatatttaaacttttttaatatttaggatatacaagttcagatttcttacatgcatatattgtgcagtggtgaagtccacgcagagtaaaacatatatacacatggacataaacagatatatatgtatttacaataggtccacaagttatattttcctagagtaatatgttcattttacaggaaccaataataaataggaaaacaagcaaaagtactacattatacttttctttaaaaattgagattgtagattacatttaatagtaaaccaataactcactttttcctttattctgaacattggtatcagaaaagtatgacttctgtaacactgactagattatatgattcgacgtgaatctgttagaagcaaagagaatgatgaaaaagctataatatttagttacacatggtcattttaagaagagaaaaagcatggaaggaacattctgattgactggtgaaccactaccacgtattacgtgttgcctcaatgaattaaccgagagtggatttgtgtgctcacaatctgcttctgtagaataagaatgaacgtggagtctttacctgcttatagtaagcgtttatctctcaaaaacctttaatcatctgaatatcactaatgcaaaaacaggacccaggtaaatcggagaaaatagttcattctttgagcctttaggaaccagaaatttctgtagcaacaagagactttcttttataaggttttaatacctctgatttatttttcattgcaacagaggtttacaaagccacgcttggaggctttgtcaggattttgtagagtgtcagcatagtcatggtggatgttgcagttgcactgaaggtaccttaactttatgcaggaaaagaaacttaagtgtaactaaaaagctaaattttaaagtgaatcttaatctatgtggtaaggacaaccaccactacattcatagaatggacagaattgatgtttgaagaaatttagtactcacagaaatttggagtttttctgacataatatttgtaagatctgtacctatcatcatggcaaggatagcgagtatgtagctcattttaaaaatagttgatatacatttaaaatattttagattcccctttcttctaaatatattgctgttgattgttcaggttagtaatttgccttgactgtcactgtttttcagtttctctattaaaaattgtctgaatctatgtggatatatcatttattattgattgttccataataaaagaatctcgatttgtaggatcatggaaataactgaatttgaagcatttataatttacctggttctccatatccaattcatgattatcacctttgtattgatattttctgatgaaaacaaattcactgtgtgccaatttctacatttccactctcattgttttactcttttgctctagcaattgatctatgtcttttgtttcattgcctcacagactaaaccagtctctagtattaactccagtaatatttaaggtccttcaattaatcattccttaatgggtttacatattaattaatctgttgatgtattcatgcatgcatttgcaaatataatttgaagccctaccattttctaggaattctgcgagaacctagggaatagataggactacattgattttgtcatcatgggattctggaaacattcaggaggagcatctcatctctagcctagggtgtcagaaagaacttgagtaatcaaggattgggtcttaaaggacaagtgaacatgtgcaggtgagaacattctaaaatgaagggacttgaacaaaagcaaagccatgttaaacagcttgtacttcatctgtaggtagatcagtaaccactcaggggttttaatcagggaaatgatcttctcagatttggcttcatatgaatctctctatttgccttatgtcacagcatatattaggagatcatcagagtagtccagacaagcaggaatgaagataagcatttggaatctagaaatgattacattaaaacaggcctagacacaaaccaccacattttttgccagaaaggcatagaaacaaattgtattagtgcttgccaggttctgggaggagttggagatggagaatgactgctaatgggtataagatttctgtatagtctgttctcatgctgctatatggacatacccgagattgggtaatttctaaaggaaagcagtataactgacctcaggaaacttacaatcatggcagaagggacagcaaacacgtctttcctcacaagacagtaagagagagaagattgagtgcccagtgaaggggcaagctcctcataaaaccatcagatctcgtgacacctaactcactatcacaagaacaggatgagggaaaccacatccatgattcaattatctccaacggatccctcccatgacccgtggggattatggggactacaattcaagatgagatttgggtggggacatagccaatccacatcaatttctttttggaatgatgaaaatgttctggaattagatagtggtgagggttgcacaacattttgaatatattccaaattaataaatggttcacattttgaatatattcaaaattaataaatggttcactttcaaagggcaaattttatggtgtgtgagttatatctcaagaaaactgttattaaaaaaagaacactgcatttagtgatgaacgaacaatagagcgagatggaggtacctaagaaaactcccaaggttcttgctttggtgactgggtagatgactgtgttatcaacaagatggagatcaccaaaaaaggagacattgtggggtgacaatggggataaaattgaggtagttggtgttgatttatttttaattgtgtttaaggtctgtataacatccaattgtacttgaactggtgtttggtctacgccatagatacaaatctggtaaatcttatcccagaaagtgaatggctccccaaatttttctgcctttacatattccagaagtacaacataatcttattaatagcatctccctttgcatgccagtgattctcattcaaggagtggagcatgtcagaatctgccatgtacaagactgtagttcaaaaaggccagcttatcagagatgctgacatattccatagggaatttttgtcaaatctttctatatcctccattggaaattattgatatacatgatggctaaatccatgagttcaggtgtcatcacctacagctttatgtcaagtgaggagaacgttgaagggctcaaagaagtaaaagcagtatttgaaagctcacataaagaacgaacgaatgaataacaactgcaggaaagattcttggcagataatagtttcaaaattagtatttattgagcaaatgcattaataagtgaatgagtgtgttttccagaaaccgaagaatttcaagaataataaactattttaaaatcaagatatgaatctaataagacaaaaacaggtatgtccattgtacagttatgctctgcatgatgttttggtaaatgacagaccaaatttaccctggtggtcccataagattctaatactgtatttttaccatattttttctatgtttagctatgtttacatatacaaatacttaccattgtgttacagttgcctacagtattcagtacagtgatatgctgtacaagtttgtggcttaagagcaataggctatctcacagagcctaggtatgtagtaggctatgccctgtcgcattgtgtaagtattctctgtgatattcacatgacgatgaaatcacctaacgatgcttttctcagagcatatcctcatcgttcagtgatgcattactgtatttggtgaccatagtaggttgactatagtagtacagggatgactaggaaagtaggaggaggagatgagaaggcgatgggtatgaactatgctcttaagaaatgtggataaaggagagggactgagaacataggagggctctagaggaaagaagatagatttaatgctacttttcgcatataaagtcattcttctcctaaataaaagtttctatgattttgttcaggaatcatatttaaccagttttcaattttcctatgaaaccagaattaaactgcacctaatttctgatcattttctttcttaatttgtgtaatttagaaataggtatgacgggccaggtgcggtggctcacgcctgtaatcccagcactttgggaggccgaggcaggcggatcacgaggtcaggagatcgagaccatcctggccaacatggtgaaaccctatctctactgaaaatgcaaaaattagctgggcgtggtggcacacacctgtagtcccaggctgaggcaggagaatcacttgaacccgggaggtggagtttgcaataagccgagatggcgccactgcactccagcctggcaacagagcaagactccgtctcaaggaaaaaaaaaaaaaaaaaaaaaaaaagaacaaagaaataggtatgacatcatcccttcaaaatgtcatctttctccacattccatcttacccatttataggaggttaaattcatgtgtcattttttagtagaatttactgataaaagctggccctttagtggtatcaggtctgtgactgatatgtcacaagttgatgatgactttcccattgttaataattctacagctgtctatcttattcatcctggtccttattcttggtacagctcttctttaaatcacagaagtaaaagttccatatgtatttattataaaagatatgcatatggatactttaaaacgttttattgttccctgtttaagcacagtaatttctactagaatttttgtcatagaaagataaatcttctccctttgctactttctgctttcatcttctttgattcttccttggatcctgcccttttctccgttattttaaatttttaatctgctatttattcactgtcttcgtctatgcctaaaagcagggacttttaggactgttgcaaaacagcagtaaatcttatttaagtgtttcatgtatgttttcagcttcccttttcttcctttcaggatgaagaattccagaattatgtctgcaactgttattttcttgacatacactcactctttaactcattgccttcaacgctcactacactgtgcttttgaaatgcagtcatctccttattattatctattaatattttatacatcttcattctctttaaactcccagcaaaagtagagaaaaggttaattacccctttctgcactttttggattccctttttggacttttcagctcccgattttttctccgtattccatttgcaccttcaccagctccttcagcaagtcctcttcattctccctctcttccaatgtctatgtgtctgaagctacagctttttccttctgcacctttcttccagttgaatttcgccccaaccctcatgagagtcctctattctcaaggcacctgtcaccacctcggtgtgaccaatttttccatgtatatccttttcttctctggtaggccttacctactctctcccacttttgcctggatacatttacttatcattcctatggtaaatttaactttgatatgccaaaaactatatttgatagaaaagtatatttcttgcttgaaagagagattgcttccattcaagtcataatgtgtaccataaaaatatcaaatatggaaatcaggtgatcagaatatagaaacaatgaaaagtagatattgagaaaataacttttaagttccaaatattacctaaatagtcttgaaatgcaaatgtgtcataatgataagttttactttatttgtttttggttatcagagtcttaaataatgggtgattagcttagaagtcccattctgaaattcattaaaaaataaaatatttctctgaaaaggacttatgcctaaagctgccgtcattctttctcatctggcaccccaagcttcatttgattccctgtttccttattgagcataatttaatgcaacaatcttgcttaaataagtattacaagatccaatagattaactttaactctttatcaccaatctataggcttcatagaaatattaaacaactattgattttaatgtataacattgtcataattcttgttatttagaaacaagatccaatctccagtaaaccactcactgcagcccacacttgttagcataatcaatttatcacacttgttttataaagttgtaagagaaccccacagaagggtgttactaaaaattacagctgatgtaagcttttcacttcatgccaaaaggagggcagttgacgctaccatgaaataaactctactgcagcctctttaatcatttgtcaagatgtattatgtccttgtcaatatcaagggaggtaaacactgtcattaatctgcaagtgaggaaataagtaaccacgtcaatgttcaagtgcctggctgttaatgcaaattcatctttattccatctttctccctctttcattttatgatgttgttcctttttcataaaatgtgcagttacattgtaatgtttagaaaatatacataatgcattattaggatgttggccattgtgaaatttgctgggtgtgcttagcaagacaggcactgacaatgcagtagttaagctgagccagcatagattagtctaaagagaacataccagctataaatttaacaaactgttcattttctaaagtgattgctttatgcatctgcaaatagggaataacagaacattcaactctattttttccctaggcaaataaaaaacttagatcttgaaaagctttctttagaaactttaaatagttattttaattttagatgctgtcactgatgtgttatgcaaaagagggatgttacttacagtggatatgaaatggaattgcagttttagcatctattatttgacttgaattgccacttatgtcttgataccttcctatggggaatctatggcttatctgtatcgattagataaatatttaaagtaaagctgaatatagcagtgttttatatccaccagattacgctacaaaatctagtggcattagattttttctttataggatttttaattgaaaccaacacattggcaatataccttgtttatctagcatagttaccctcaatgaattagcaaatcagaagcttaactgagaaaatagtgaaactctaggagatataaaggctgaataaccaaataacaaatcactacttattgagtttatgcctgtgtaagatagtgtactgtcatttcatgtaatttatcaaagagcactatgaagtatttattatcatgcagacaaattaaatgactttctcaaaccacacagataagaagtcatagatcttagatttgaacccgtgtgactagatgaaaaatctcagctattgtgcaatgggtcacactacttctcagagcaattttacctaggaaaatcttcttatattttactttgaaagatgtccggtgtgtttacttaagttatttaagtaccctaattagggataagatatccaccttcctaaagtcccatatttatttttttagaggaccaacaggtaattcttttataaggaatgtgatagattgaatcacgtagtgattaacaacacagattttagccaccaattgcattttttcaaattatgactctgacatttccagtgtgtgatgttaggcaagttacttaaccactctgtgcctcagtttaattacctataaaataggcaaaattacattgggttattgtgaaaattaaatgtaatgataaatttaaagtaattgaaaaaaggtctgcaataaggtaactgcttacttagcagctatatcttatcatttaaagaagcaatgtctttggctcacatatttgttaacatgaatgggaataaatatccgatttagttccttaatgtctttaatgtcagtatctattatccagtcttgtccatccaaagctttctggctcactcttgctcagtctgtcatttttctacagcattatcatgatataattcatatagctacaattcacttatttaaaatgtataattcaaaggttctaatatatttacagggttgtgcaaccatcaccacaatctaaatttagaacctttttgttccatttaaaagaaacaccatacttgttagtagtcactcctcatttctctcctccctctctgcccagccctaggcaaccactaatccagtttctgtttctataggtttgcctatactggatatttcatataaatgaaattatgcaacatgtggtttttgtggctggcttctttcacttaaagtaacagtttcaaattttatgcctgtgatagcatgtttcagcacgtgtttattatccttgccaaaaaatattgcattgcatgtatataatattttatttagtcttcagttaacattcatttaggtggtttccattttgtggccattgtgaataatgctgaatgaacgttaatgtccaagtgtggacgtatgttatcatttttcttgggcgtgtaactaggagtgaaattgttgagtcaatagccttgattatgttttacttggaggaccacatagcctcctagttgggcttccagtttctggcctagcttagcctgtgaatgtttgtacactgctgccagggagatctttgtagatcttaaatatgattgtgttcatctcatgttcatggcctttagtggttcttctgttgttttgggaataaattatagataccttaacttgacatgcattatttaatcattaaatacttattgggttcctactatattctaggcactcttctagatacttgagtatccttgaaatccttgaaatcatgtcacattggaataaattattactaaaatcagaatcaaatttttgtagaatctttgatttaaaaatacactccttctttagcctatttttcactacaccacggtgcctaggattaaagataaatatggtaagataattacgttgctttccatgttgcattattggcaggttattctaaattatggaataatagcgatgtgttgtgtttgcctgtctctttacagagatgcttattttatgtgaatttccaacatccctgagagaggatcatggcaaattactcacttccatcttacacctagaaatgttgagactaaatacgtaaataaagtacagtgtttgctctactaaaggtgataaatatctgttgaagttaagtccaaccatactaggaagtccctggaaaatttatgaactaatttttagtttttgcctttactaagggaaagaaaagcaagaagtgggcaaatgaaagctgagatgactgcaatctcatcaggacctagtatcctggatgcttttacatcctctctcgtgtttttatttgaaaccaactctataatgttgttgataactgtattactttaaataaattaaatgctaggtagtgtgactactgatttgatttgatttgattatcagaaaccatgataacttctgttctgtaacaaattctaaaagccattaatccaaagcaagatttgttttcaaagctcatccaaatttgcagtagtgcaattttaatataaatgtagttattcacacaccagggccagttgggtggtggggggtgaggggaggaagagcattaggacaaatagctgatgcatgcacggcttaaaacctagatgatgggttgataggtgcagcaaaccaccatggcacacaacctgtgtaacaaatctacacattctgcacttgtattctggaacttaaagtaaaagaaaagaaaattaaaatagaaagtgtagttattatagcataaatatttcatcaaatatcctgtattttcagagaaatttgatcatatatgaatattttatttatcacctattcttatttttaggtgagataatggcacaatggttatgttttcaaaatgcatccttaatttttagaaataataactgaaatagtttatggaagatacacataaggatttgtatcaaaataatgtagggagggataaataggagtagagatgaaacaagattggccatagttttagtttttgtaatagactttatcttttagagcagttttaggttcttagcttaattgaatggaaggaacagagatttcctatatattctccaccccatctatacacagcctccccctacaatttacatcctctaccagagtggtacagttgttgaaattgatgaacctacatcaatacatcattatcattcagagtccatagtttacattagagtcactcttagtgttgtacattctgtgggtttggacaaatgtgtaatgagctgtatctaccattatggtatcatacagaatagtttcactctcccaaaaatcctctgtgctctacctatccatccttccttcccactaattcctggcaaccacaaacctttttactatgtccataaatgttccctttctagaatgtcacatatttagaatcatacagtatgtagacttttcaaataattagcttttttcacttagtatcatacatttatgttttttccacgtcttttcttggcttgatagctcatttgtttttgacatgaataatattccactttctggttgtaccacagtttattcattcgtctatggaaggacatcttggttgcatccaagtttttgcaattatgaataaagatacaatcaacatccatgtgaggtttttatgaagacctaaattttcagctccttcgggtaaaaaccaaggagcacagttgttggattgcatggtaagagtatatatatttttgtgaaaaactgccaaactgtcttccaaagtggctattccattttgtattcccaccagcaattaattagagttcctgttgctttacaagcttaccagtatatggtgttgtcagtggtttggattttggccattctaatagttgtgtagtgctatctccttgttgttttaatttgcacttctctgatgacatgtaatgtgaagcaactttccagaaacttatttaccatctatatatcttctttggtaacatgtctgttaaggtctttactgcgtttttaaattggattatttgtttttccattgttgagttttaagatttctttttgtgtgtgtgtgtgtgtgtgtgtgtgtatattatatatatataaatgtacttttaattgaaaaaattgtatgtgtttatcatgtacaatatgatgttttcaaatatgtatccatagtggaatggctcagtcaagctaattaacatgtgaattacctgacataccattttttgcaatgaaaacacttaaagtctattcttgtagcaatttttaagaatacaatacattgttactaactgtaatccctattttaaacaatagatcgcttggacttattccccctttctaacttaaattttgtgtcctttgactcccctcctcctgccagccctggtaggcaccattttacgccctactgttttttttgtttgttttttttttttttttttgagacggagtcttgctcactaggctggagtgcagtggcacagtcttgactcacagcaatctctgcctcccaggttcaagtgattctcctgcttcagcctcccaagtagctgggactacaggcacacgccaccatgcccagctaatttttgtatttttagtagagacggggtttcaccatgttggccaggatggtctcgatctcttgacctcgtgatccacccgcctcagcctcccaaagtgctaggattacagatgtgagccaccgtgccaggcctttgtgccctacttctatgaattcagtgtttttagattttacatatgagtgagatcgttggcatatttgtatttctgtcgctgatttttttcacttaacacaataacacaatatcctccagttttatacctggggtctattctagttctgggaattttctgagcctagagctgctggggtcagcctggcagtaaggtctgttcaaacaactagtccaaaaggtaagcctggatcttagaggtgcaagatctcatctggcactggggtgtgccgggaggtgcagtccatgagtactggcctagtctaggatagtgggtgtattcatccattctcatactgatataaagaactgcccaaggccgagtaatttataaaggaaaggggtttgattgactcacagttccacattgctgggaaggccttgggaaacttacgatcatggtggaaggcaaaggggcagcaaggcaccttcttcacaaggtggcaagaaggagaagtgccagcaggggaaatgctagatgcttatgaaaccatcacatttcatgagaactcacttactactgcaagaacagcatgggagaaaccacccccatgatccagtcacttcccaccagccctcccacgacatgtggggatggaagctataattcaagatgagatttgggtggggacacagccaaaccatatcagtggggtcatgtttatcactgggttttactggggtaggccaagtgttgtggtctaaggcaaaatccagtgctcacttccttaattttcctccaagtagaaggtatctctcttcacagtgctgcctgggattgggggagggctcacacaggtaatgtaaaactgcccttcctactcttttccatacatcttttctcatttttatgctacacccaggtgctataatctctcaactgatttctttagctcttgtgaaggtgattttgcttgtggatagttgtgaaaattgatgtttctgcagagagatgagtgctggaaagtcctattctatggtcttgctgatgtccatctttgtgtattttgcatgacagtcttttatcagatatgtcttttgcaaatattttctcccatttttcactggtcttttcattctcttgacattatcttttgcagaacaaaaaggtttgattataaagtccatcttatcaattctttctttgataaatattgcctctagtgttttatttacaaagtcatcacctaacctaaggtcacctagattttatcttgttatcttctagtagtcttttaattttgtgtcttacatatcaatctatgacccattttgagttcattttcatgaatggtataaagtctttatcgagattctttttttttttttttggcttgtggatgtccaattgttccaacaccattggttgaaaaggctatctttttttcattgtattgcctttgcccctttgtcaaagatctgtcaactatatttatatgggatctatttctggaatatttatttcagtccattgatctatttgtctattttttttcactagtgccacactgtcttgattatcatagctttagaatatatctcagaattgaataaagtcagtcctctgaatttgttctttttcattactaagttggctattttgagtcctttgcctctccgtataaactttagaatcagtttcctgatattcacaaaataacttgctgggattttgattggaatttcattgaatccattgatcaagggggaaagaatggacactttaacaatattgagttttcatgtaatgaacacagtatgtatttctatttatttggttcttcttttgtaggttattttctgaacctgactaatgggtacataggtatttgttttactcctttacctgtgtattttttacctttttatgttttgcctgtatatgttttaccttttacaagataaaaggctaaaatattttatatttttgcctttgtgatactagttttttggcaaggatggggtaaaaagtaaaataggacattgacatttcgaattttgaatttcaaatctcctatcagggaaattgaataaatatgttgaacatggtagtttggcaataaagggctttggcaaagagggcagattcggtgtaatgatagttctattgagatctagaaatactcctatttgaagagtgaaaaagtgctaccaggtgttcagaagaaaagaaatgttaatgagaaggccaaagataaggtgaatcttatatcaaagtactaaagagaatgaaagtgggattcagttccttctgggtgataagactgtcttaaattatttctcaattatgacatcatatttcccccccatttcttcatcttgcataactttgtgtttaaatgagagtttttaaaatgtgtttaaagctagtaatgtatttgactttgattttgcaaggataacacttcccaatatcctttttgagctcatagaatttgttcatgttcttttaaatctcctgattattagtggtttacttttgatgaaggtgatagcatattcttcatgaaataactatcaagcttagtgttaagataatttaggaaactaaagcagaattataacttcttgatttttatgatagtgtcccttggatgtgtaaattaaattacttattttcatttctaatttttgctaaccatttcagaaaagtggttcagcacaatcgttgccaattctacttcaaatcaagaaatctttaagcatccttaaaagctaccataacaggcctatggcactgtgtgtctttaggagattgatttcttttgtgggtattctgtttacttaatgacataaagaatgagtgagggagaaggcaaaatattctcccaggaagatggagaagagtggtcattgtggattagttaggcttttagtaaaaacaacattgtaatgaccttgtgatttttatgaaaccacttataacttggtcttaatttacaaataagttcctttaagtttgcatcaaaagtacagagctctttcttgttattcttaacaaggtttgatacacagcatttcctcatggataatttgtgggtttaaaaaattgaaatgctattattggtaactatcttggtcattgttgcaagatgatttctatagtgggagcatcctttcatacaatcatacggatccttttacggtttttctggttataatatcagtaaaaagtaccacttggccacaagtgacttttgtttatacgttgaatgaaggaagaaattatttctaggtgtgcaacatggagaatatttaaagttctcggaatgtaagtttcttcatatgtcaaagaaggtgataatacctaattttaaatgatgttgaaaaggttgacatataacttatggaagtactacctacgtacccacctacctacttacctacctacttatctatctgtttttatgtctatctgtcatgcttagcatagtaactggcagattgtaggcagttaggaaatgttagttgtcttctcactcatcatatcatgtacttttaaagggatggttttcacatctgtgcaggttgtctactgtaccactttagagggcaatgttcatgtagcaaatattatgaatggcaccactggaattctgtagtatgcaacttgaaaaactaaacatagtgtctgtatatttttaaccctctatgttggtgattctccaaaagggagcaattaaactcttgcatcagaatcacctggagatgatttctaaaaatgcagcttcttctgttcatttccagatctacctaagcagaatccgttgagatggaacatacagatctgtattttttaaagctgctgaagtcattattttgctaacagctatcttataatatgattcatatatcatacaattcacctattttgcccaggtcattcttaagcatgctgaaccattgctctcttgattgtctttgtgagaaaaaaaaaaggtgtcccctggtcttttctttctctgcgattcttcatggatcaataacaaattcttgcacatattgtattgtacatatttcttctataactttcatcacattccttcattcttagtgcttaatctccattttttcttctagcttgcatgcatgcatgagcgtgcgctcacgtgggcatgcacacacacacacacacacacacacacatacagagacacaaaggcttagagtcaaattgaactgagtttgaattgcgggtctgccacttactgtttatggaaccatgggcaagttaccctttcttgattaactgaaaaatgaagcccctaataccaattttataaggttgtatgagaataaaatggaataaaatgtgagatgcttattatactgtgtgacaaataaggctaataatatgttttcattaggtcgtatgagaataaaatgtaagttgcttagtatattatgtgggacatataaaaatatgttagctataattaaatgagagctataattaaattgaagacagtaatatgtactcccttatattccttgaagttcctaattttaataaatttatcaatttattgattacttactaaatacaagatactgtgcctgatgcagtatggaatataaatataaatattatatgagctctgccctgaaggactttgccgtttatagtacacagataaccaaatacaataaatatttcatgatggaataatagaacaaatgctagagtggattttcacaaaaaaatattgtcagaacacagaagagaaaaaaattttatttgagacaagcactgaatcagatttcacaaagagggtagaatttggtctgggactttaagggtggttgaaacatgtctatggagaaagggaaatggggtttggctgagatatggatacacggtggagagtttgggagggtataggcgagatgggagagtcttgatcttagaggataacacacgacaactcaaagtctttgaatgacattctttaagctattagaaaccactcaagacttttaagtaaggcagtgacatccgctgttccatatctaggaaaagttgttttagtggtatgtggaatagtttcaaggagtcagggataggaaatgaaaacaccatttatagggttcttcggaatattagcaggattgtaaaacagaggttaggcaaagaaggtgcaaaaccatctttcaaaattctggacatgtaagatattttaaagctcccaaaagtgaagttttgtgcaaaagttaggtgttgagctagggcagtaccaatgagaatgaaaagaaaagggaaaagcaagaaatgggacacacacacacacacacacacacaaacatttgagagataattggatgaaataatggccatgccacataaaaagaaattatagtacctgccataataacataaatttattccaaataaatcaaatgagtctaacttggaaaccacatcagtcatttatattattgtctaaaaccttttttgacaaaagtgaacacacatgtcaaaaatgttgatacttctcacttcagaacttagtccattttcacatttattcaagtctttatgtcgcaagtattttatttgtatgtagatttttagatatttatgattattttattttctaatgctgatataagtgaaatttattggtttgtcttaatattctgattttgtaaccgagttctctatttagttctaagtgtttttcagttcatatttgatatttttcagacaatcatctttacatgactgctttaccttttatttttcttgtgttataatattagccaggacttctaaagcaatattaactaatatttgtaaaaatctggctacttgtttttaacttaagctttcgaccactgagcaggctgttttaaataatcttcatttgataaagaatggattcctctactcttagttggttctgaatcatcaagatagacactgaattttatcaagtgctttcaatagacttttaatatttttaacatgaaatgtgcctttttcatgtcgttttctggagtaacatttatactagttttacaaaataagttaggaattcatctttttagtgctttgcagtaattttattggctttagaatctttcatttctggaaactttccaagtgtttattggtaaaattattgaagcctggggcttttcttagaggaacttcttcaccagtgtttttaattcccaatatgtattttaaaaatcctagaataaatccatgcaaagtatttaattcttttttttttttttctttattgagacagagtcttgctctgtctgccagactggagtgcagtggcgggatctcgcctcactgcaagctctgcctcctgggttcacaccattctcctgcttcagccccctgagtagctgggactacaggtgcctgccaccacgcccggctaattttttgtattttgtttgtttgtttttagtagagacagggtttcatcgtgttagctacccacagtagctgggactgctaattttttgtatttgtttgtttgtttgtttgtttttagtaggacggggtttcaccgtgttagccaggtcgatctcctgaccttgtgatctgcccgcctcggcctcccaaagtgctgggattacaggcttgagccactgattatcaatttgcctttccaatgttaaatctccaataatttttaaaggaagtattgttatagtgagagacagacacctatgacacatccatggagcagaataatgaatgcaaaaacagcaatgaatttagatccaaatgtaacatattaaaaagatttcatttcaaataagggcaaaaatagtttatttttcaaatgatgtttgtaattatgataccatttagaaagaaaaaagttaggtacctactatatagcatacacctaagttaactttaggcgggttaaaaatgttaatgtaggaaggcagaaggcggagaattgcttgaacccaggagtcagagctgcaatgagccaggatcgcaccactgcactccagcttgggtgacagagcgagactccttcttaaaaaaaaaatgttaatataaaaataaagttgcaaaagtactagagaaaatgttacatgaacattaatatagcattggagtgaaaaaaatgctttaaagttataaaccataaaggaagaaaggcatactggaaaatgactaatgaatttaactatatcataacatttaaaggttgttcttaaatatttgaactactacccaagaatgcccaaagcccgtggtggaaattctaatttttattgtgatatgtttgtcatatttaaatgataggtttttgttttaacattccaaaatgcagctcccttttctgcctttgactgccttctatagaaattcccccagctgccaggccaaatttctcatccagattcaggtactcttattgactatccaatagggcattgatgctgccaagttcgcattaactctcttattagcttcgagaagacttgagacagaagctatcaacacttcttcattggcatctatgtggctgtgaaagatggtcacattttagtcaaaagacataatcctgtccagttatatttgaagagaatcatagctaaagaacacatgccatcttccactcctgtttttacagtgttcacaaatataaaatagttactaacttcttatactctttccacctgtaacataaagatggaattctgcagaaattgagaaagagggcaaaaacgcggattttctgagataatttaaaacagttaagaatctgcagccaataagaatttaactcacaaaggcagagcaattgaaactgtttccggccatcagtacacaaatagcaagccaagcttcataattctgtgtttaaatgcaagagttatttaaaacaatttggttttagtttattttcttacatctcttaattactgctggaaaatattgtcaaggttgggaagttcttttaatcaaagtctagaatattaaattttagaatctatagaggtagaaacatcacaaccatttatttacttttatctttgaataagcattgggaattatgattcctttagttttcttacctgcaaaaacctgtatgttcttcatctaattcaccaaaagtctattattctcaaaattctattattttgagaaataatagaatcaatacaggtcaatttttaaaatgtgtgcaggactcagaaccattaatgtgctaatgtgcattctgatgttccaaggggcattcataacatccagcctgtcctataaatttgaacctagaaccctttttgcatgcaatatctattgagttctgttgggaatattgtattactcgaaacataattttgaaagtgctactataagagcttttagaatatgtggtgttaaaagctgtacattatgttaaaatagctcttgctattaatacatctaaataatatttgttgaggacattcccttgaaggccctgtgctaaatggctttgtaactaaacttctgttctgcttcagtgttatactgtggattatatctgatgttcatgtatgaacataaatatgaccagttaaagcaatttcttgccagctaaaagaggatgttttatgtctgattatttaattcaaaaagcaattcactagtcttacctccttatttgccattgtacatgtggttaataagtaaaatctgaattcctaacaatgtcttttagattaatatgttttggttattgacacttcatacatttttgatatggtcaaagttagttcctagatagggaggagcaggatttttctcctcttgcttaactggtttctaatttcttgtgagattcctttatgtgagtttcaccatactaaaaatggaattattttaaaaaattataaaatagagtccccttctctattttaacaatcaatgtacctctgaatcaactggttattcccgtgatctgtgaagtagttaccgtgcttttcaaattgtatttcatgtgtgttcaaaatgaaggataatgactcacattataataaatagtatgacatttatgacccacaaggaggaggagtgtacaaatgaactttaagggttttaccttgaagatttgtgagatacaaaggcacagtttttctaaaacaggaatatacctcagctgtcaggaagaactagaaattatagttctgccttattgggatatagcatgagtccagtgacccctgttctcattgttcatctatctccaacacttcttgttaagaagacacaattaggtcagttttcaatgatccaatatggaacacctctgacaaacgaggtttcaaatcaaggtatctcagacagttggcctcctagcgccctgtcatccctttggcttatgcccaaattcagcccagagccaattagtggatcacagcctctagaatggcttcactctgctcacactcaacaagatccagacagagctgctatgcaaaaaaaaaaatgttcacagggtcctttcgcagaggggcaatggtttaggtactttgagacttcatggcgcatcaagtacacacatgttgaagtaatgcaagtgagaaattttgctgacaactgatggaaagtaacatttaaatctagagctctacctttgtgggcagcctgagacaaccctagattaaacattttaatttttctatttactgtttgtaggtttctgtaattcactgagcctgttctaatatgtacaggtagatatttgcacctagaaagcatgcatcttggatatttatcatatataaagaaaaaactatatatacagccatttaaatatgctacaaatagtaatagaacactaataaatatgtacatgaaatgagtatgtgtttatccttaaattagtggtttggttttcaacattgttttattccttgacactgtccccatgacccatcatgttctgatcactaatattctctttgaccaaaccatgcttctggagtgggggccattggtactagtcttcatgtgtggggacaaagggacagagttttaaaatatactgttgagactttttccagattagagttaatttagctaatgtcatcaagaccaatagttgttaggttaaagtggggaatcattaaaaaattgcacacttgaagtaaacattttacttaaaatatacaagtacattcatttattaaccttttcttctagggtcaagaccttttccttaaatattggattccttagtgggcttctaattctttcttaaaaaaaaactctacccatgatgcatcatctacaatttccaatttcagtttctctaaaggagagcaaaagcataacggtaactctaaagcaatatgcatatagaaaacttatttatttttttacttatccccgtctttaagaattgactcatccacacctaatttaacagcagttgttttagtgactcattttaacccattcttttcaaacgttttgtcttacttttaatagatacaacctttttttgcactcacattttgttcttttgttcaatttgtaattgcataattacattacatattaaactagtatacatagattctggaataaacatgccagactactattaagtagacaactcactggtcaaggaagcatacagaatgctgagggaacaaacatggcctttaatccagcaagtctgttataaaaaaaaagctcactctcaaagcctccttctggagttcataataaatgcttcccagggaggcagtcctctgctctgctttcctacttcttttcttctttgaaggtttccactttaaatcaggcaatactgtctgttgaatactgtctttctcctgaatgaattgttttcttcttcctgtaaaaacggaattcaggatagttttagccctttggtgtgccctatttattgagaaggacattttctgttatgcccagaagtttaggagccttgcatggctcgggcaagactgaagaagcagctcacttcagcctgtttctctactttgtcccctttgtgctctagcttttcactagtggaaatcgcccactctatcacaaatgttttcagaggctacaatccaacttaaggaggataagctatgagcaacttgaactataataatacatgaacatcttgaactataatagatttagaggaagtccaagaagtaacaatcctcaaaaaaaaaaaaaaaaaaaaaaatcctgaggcagtctaatggcaactggccaaagaccaaatcaagatattaaagttgcctgatttagcatccctcaggagatatgcttccaccataccctatatgcaaacaacaacaacaaaaatagagccataaatccccatcctaattgtacaacaaaatcatctgtggaatttttaaaatgcagatatctgggtcctctctaacaattatcaaattgagaccttccagatcaggggcctagatttaaaaaaatgaaaaacattatgggttattacaacggtcagttacatttgaaaagtcagtttaataaagacatgaaatatatttgtactgttggaaaagtgagtttctaagtgatattttcctccttacatatggatgttccttttagtctatgatagcttctaccttaaaacacaccttctgatgtgaatctgcatggggaaaaaagtggtcggctcagtgaatgggtgacaggcaagcagcctctcctgggaggttctttgctgtttcctctggacccaaaagagtcctcttgcttaaaccagctgcttctcaaaacattaaactgcacaaggatcatctggggatagagtgttattaaaagtagatgttgtttcagtaggtctgagatggggcttgaaattttgcatttccaatgagctctttgtgctgctccagagaccacattgtgtagccagggtttaagccacattaatccaccagttttcaccagctgcaactaattgagtgtcaaaatttaggtctacattgtctcttttccatttacaacttctaaactttattaaaatccatgaattattactctaaaaaggaaaaaaataaataaaaagaaacccttttcactttaaacaaagagataatgtgtaaggtgtgttcacgctttatggtgtaggttttttgcctgtgaagaccaggaagtgggtcggctcctaatcaagatcagatcaggtgattccataatggaactaaccacctacagtttccccaccaggctcatgtcagtaaatgccagtgacttctttgtttcaggtttatttgctaactgtagatgttgcagatgattggttagtgtgaaagcacaaacatggtgaaaataaagaggacattttacctttcttctaatatattatatttggtgtagcatttctagtttaataggaattgtcctcttttatagtggaatgagttttggactgaattctaaccaagagtgtatgaatccttcttaatgatagctgtgttatcatgtttcctcatagagcataaatattttagcaaatgttgttactgagtttgtcttcaagcagcccagtgaatgtctgcacccttgagtattaaggaaaaactcattcttttcacttataaaaaggcatatgatgtagagaacattggaagcctatctcaaatcttaatctgctttccctgagatcccatgggacgtatctgcaggcaggggggtggaatttactctcaactttattgctgctatctggtactctttgtctgcatgtagccaccaacttttatttatgagtatttgctggacctcatgctaggtccactgatacagcttacagacttgagaaagatatcctgcctctaaggagcttatagtctagtttatctcaatttatacaatttatacaagcaaccgagcagaaaattttacagttaaacgatgatgtgttgttttaaagtactttcaagattcattgtcagtttgtcttcatttgcatttctggtaacaaagacagaaacagtatagactaggcaataagtaagtgacagtgtgctgaaggagaaaatgatgacaaagaagatggagttgagatgatgggaattctaataacccatataccgtgtattagttctttatttcttctacaaacatttactgaacacctacttaggttcagccaaaaagatgacagttttatgataacagtatgtttccagtacagtataattgttgtcacaatgagctgttcactaaagcacggacattctgtcatctcatctgtaaaaagtagataataatatcctccttatcgaaaatcaatgagctggaacaagtgatttctagttttccttctatgcagtaatagctaagagggggagaaaggaaatgagaacaaatatgagcccgagtttacaatgtcttcctgggacagtatcagaaatgaaacctaatttgtagtgtctctgataaaacatgagcttcatcttctccttcttcccccaaaagatatcaattttcattttaccagtttacccctactagctggagctcagaacataggcccacatgcctatttctgccatgagcagaacaactatatttagatattccagattgttcttattccatagaggcccaatgaatttggtaactaagactgaatggaacttggtatctcatcagtgcctctcaaagatttcctttcacttgtttcttcaggaagacaactactagttggacacataaaagttttaactgtggctaggccccactcttctctagttcccattggaactagaaactgttgtaagaatgactccaaggaacattaaagacattttcagattgactttgaaggcacatataagtgtgttcaatgactttgtaatttggggaagactcttaaactccctattagcagattatcatatataacatatgaatagacctgtttgaggatgtaatgagctcatgcatataaaataactagtaaagtgacctgtacattttcagccctcattgtaagcgtaattatattatattattcatcttttgtaggaaaagttttattgaattggagaacaacagaagacaaaagcgttcctcctttccctttctagatttgtatatattacagaacacacataaaaatggacatttctctgcagattatcttactgttatgtataaaaataataaattggctctctgcctatggagcagacattcttttgtttctttacttctctaataaacttgctttcactttaccatagatagcaatagtaataagtcatggagaaaattaataactacttggactttctacgaaaatgtagggaaagtgtatatagatttttaattgatgttttgattccaaacaaaagaaaaaacttcttacaaatcatttaatttaaagctaaaaattgccttagatcacacatctgtcctggttgtactaggaaaattgatataaatattctcatggctgtcacacacctgttcttcctaaggcagttccatctgaggcatgatattaaaaggaatcagaggtgctcaccaagcaacataacacccttgactaagacaccaacattgtgatgatgtgtgaaatacttacatttctctatggctgccatagtaccttatattggcttcagatctttttatgtttgtgatctctttatccatgaaatctagtttatttgcccccttttgaaaatccatcccctatcctcatttttaattcatccattcttcttcctattcagagtaacctacctctcttaccaagggtgtggccagatgtgatctttttttttcagggccttaaatccagcaaattatgtcttgaaataatgacacgtcataaagtcacttaactttttttccgagtccaccagttctttttaacgtttttcactgtctaataaagggtctaaagccctgactggaatccatgcatggaggtgtcaaagcttaccactgttataaaaatatttccccctacatggcatgtcttcatttgggcatgaatcatgaattcatcccatgcgttctcctttatttcatgaacacccaactgtgtcagaatgccaatgaccttcattggcttggctaatctatggatctgaaccctcctgtaatccattaaaagaataatagcaaattgaaagtgaatgtaaagatacccaatgggaccataaaactaactattcaatgtgacgtgctttggcttaatagggcttttatttatttaatttcgagctccccttggtttctgacagggttagtggaggaaacaaacccagacatcttgtaagctgtcaagctgatactcatctcaggggagcttagagggtatcatgttttaagttttatttttctggagcttggaatatgtctgctgacagacggctcccctgggttatagcaatgcaaggctgttgagacaattgaataagctgaattagacaaaggatttttattacaataacaaccagatggaactttgaaggaaatttttttttaaggtcttagaagttctgttacagaaatcatttaaaacatatttatgggctgggcgtggtggcttatgcctgtaatcctagcactttgggaggccaaggcaggtggatcacttgaggtcaggagttcaaaaccagcctggccaacacggtgaaacccacctctactaaaaatacaaaattagccgagtatggttgcaggtgcctataattccagatactcaggaggctcaggcaggagaatcacttgaacctgggaggtggtggttacagtgagccaagatcgcgccactacactccagcctaggcaacagagtgagactccgtctctaaacaaataaataaataaataaataaaaagatatttatgatgatttttcctattataaggttaaaaaaaacaacataaagatctcattgctctgttttttttaatccctaatgattaatatgtggccagttacagagactcttccagccaacccgtgacatatacacattaataatgttcttttgtatttgcagatcttatttcttcagagtaatggaaaatcctgcccagtactgttctattaatcttcataacgaatgctagggggctaggtgggcggcatttggtgttatccacatgtaatagattttttaaaaatggggcaatgaaaacaaaataagtcttgaaacttgttaacacccacagtggaagtttagcagtggaaatgaactaatattaccagaagacctcttattctctattgcttttcatgattagctagtacatttattatttttctcatgaatgacaagattgcctgtaatgtatttgacatgtggtagttttccaatctccggcaggctgtgtgcatgggtgtgtgtgtatgtgattaataaatacttaaatattttttatatagggattgttttgccctctagaggcagctcaatagaaggagcattcaatgttagtgattgaaaaatggtagatgaaacttggacaggaaaactcgagaggtccaaggtaccttatttagctactgctgtcacggtggatcataatgcagtgggacagtcaggactcaaagcctttcctataaccacatacgatggatattgagcacaatacagaagcaaaagatttgttttaacttggatacttcaactgcaagcgtctctgggcctgatatccagttcagaattcactgtactttttatttcactatcggctttccaaaatatggtaactaaatgagtaaatgaaaacatggcaatacaaaccaacacaagttcttttgctgacagagcatgcaattgccaagtaaaaatattgttctttattaggtttcttttcatcgtacatgtacatattcatttggaaacacatttttttgagacataatcttgctctgtcacccaggctggagtgcagtggtacaatcatagctcactgtagcctcaatttcctaggctcgagggatcctcctgcctcagcctttcaagtaactagaactacaggcatgggcacttgccgggctaattttttaaaattattttttgtaaagactgggtcacctcagccttccaaagagctgggaagagctgggcatataggcaggcatgagccaccatgcccagtctacaaacacattttaaaaccataggccttctagttttttgttgttgttgtttaggttggcttttgacatgctacttattgcatactagtctgtcatgttcctaaattccagttactcctgtagccatttttaaagattattttttaaatttttcttcctcctcctccacctcctcctcctcctccttcttcctcctcctcctcctccttcttcctcctcctcctcctcctcctccttcttctcctccttcttcctcctcctcctccttcttcttcttgcttctttttcttcttcctcttcttctcctcctcctcctcctcctccttctttttcttcaggcatggccttgctctgccactcaggctggagagcaggggtgcaattatggttcactgcagcctcaacctccatagctcaatcaatcctcttgtctcagcttcctgagttgctgggactataggcatgtgtcaccacaactagctaattaaaaaaaaaaaaattctttttagagacgatggggccttactatgttacccagactggtgttgaactcctagcctcaagcgatcttcctgcattggcctcccaaagccctgggattgcagggttcccaagtggccatatcattggatttgtcttcagagtgatgtacttgtgaaacatggatatgaacagggatagagggcaatagcaacacatgtttattaagcactcattgtatgccaggctaagcactttgtcacagagagcctatttaatcctcagaagaataatccaatgaatcactctattttctaggtgtcaaaaccaagtcttaaataagccaagtaacttacccagaatcatatagccacagaaccgagatttgaattcatacattatgacagagtcagataagctagccatcctgcccctacctccagttccagaatcagtgattggctttggtcttactcagcactgtcagttacagaaattggtgtcatcagattatctgtctgcctaccacctctggagcatggcaattacagcatcattgatttcgattgtcctaaaatggaggaaaacttgctgctggcaaaaggaagacccataatcattcatcagctcaataggcttgaatggctaaagtgctcacagccatcttcctgtctcactaattgctgccatttaaagataaagggggaagaaactaccctttacttcagtttacaaaacccaccgaagttaagatataccaaaggatgtatccaagaacccagaacttctggatggaaggttctggaattgaatcctcatgccctgcagtataacctccatacacccacatggcttgggcctcttagttttgcttggctgctactacttttaagtaaaaaaataaaaattggttatgcagttttcagaatgtctttcatttcaaatacattcttaatccatcaaaagggacattctaaataaagacttgtctctacatgatgtgttaatgaagaatggcaggggcaagtaaaacaaaacaaaaagctatgtagtgaggttctttcaagccaaaccacagctgtttgaagaatgacaatatgatatcatgcaactgccactatccctcattaattgattttacagatttttaggtattcactgatgtgtcttgtacttatggctgaaaatgcacactaacaatctgtagcaatgttacaacacagatagcatattgtcaaatgctgccatggatgaaaacttctcatttgctgtggatctgttaagataaacctcttgagaattacagatacatttattattggcattttcaaaatggcaaagacatctgttgctaaaagtctctgactggaaaggatttgggaccaagggtaaggttagctaacacttcttaaactagacaagtatgaacagtgaacatctgaaactacctgtgaccacagagcccaagtaatgtttaatggaggcatacatctttaaccattcaatataaattcaacctttttttttttttgagatggagtctcacactgtcgcctgcattggagtacagtggtgtgatctcagctcactgcaacctctgcctcctgggttcaagcgatcctcctgcctcagcctcctaaattcaacctttttttaaagttttcctcattaactgaattgggcacttccccccctataatctcttacataatttgttttaattcttttgacgtatgcattacataccacccttgtattggaactatgtatgtatctctttttcattcactcccctttccttccctgtcccattccttaagagaactgttatcttccatgagggaagcactcctgcaacttttacgtgtatgtgtgtttgtcaccatcttctaccacgtattaatgtcacatattaatgtgccagcccatattagtgtctcattctatgaatgaatgaataaattaatgaagaatgaattatgtatgtaatgtagttcaacttactacataacaccaagtaaactaaaccatccaagataagtttttgaatcaaagccaccatcctactaataaatatggtttcttttgtataaaggtgctagaattcctagccaaatattttattagtgttctatgccaaaacttccattcatcaatgacttatttcaatgataattacttcaagtctctgagtgtaggtatcagatgttgaatattagtatcctggtgctcaaggagtctttcacaggcttttacatatgcttctccatgtgattccaattttagcatacaaatcttttatttactatcaacctacttagtctacttgttgagaaaaaagtgttcatcatatttcttgattctgcatatcttatcaattgcaatttttctgctctattaatgtttagatagagaggaaaattagggaaggacaccaatcctgtgtgtaagacaaaactggaagtcattcacaaatacaatatgcatcaaatgttttcttctgagtggttctatattggttctaaatataatagtaccagcttatatgaaaagcatgagggattggcctcaccagtttttatcaaatgtaagatgctattaatttcaagatgcatcactcttttatgaaccacaaaggaagaaaagaaatgctgccaaattaacaatgatgttgttgatcataagttatatcttgatttcagagatattaaaatgggtttagaatgtatgtcttagaatagacgaaatatagtatttgttcagtaagtatggagtgcattctcaatgctctattactttcaacattgatatgcttcttttacaaatggtgaagatatgatagggtgtttgtgacacatgcttttctagcaatctgtctaaaacctagcatgcattgcaagacatgtcactgcaactctgcatgtgctaccacagctttccagaaggtaacatgcatcccacaaagcttccaaatttcttttcagaccgttttattggcctgatggcaagctaactcaaagcagtttgccatacacagaacacattcaccaaccttggtataatgttccctccgcttctttctaacaagtcacattttgccttttaaggttatccatcatccagtgttttaaagcattttgctttcaatgaggtggcacaaaaaaccatatttttacaatagccctaagttttaatggcaggcaaagagaatatgactacatatctcagcagacaattagagtaaggagggtgaggtaagaagagtggtgcaatggaaccgtgaagatagggagccctgaccctttcattttctgttccgtacatatttgaccttcagtcctgcaattgcagaaaacaaactgcccaatcttacccatgggacattttgtaattactttcttgtctcttctcttatgggtgcattgactagcacatagtacttctgctactgatagctcatatttatctagcactcattatgtgcctgacagtattctgtttcacatatattaattaaactgattaactttttaaaataaactttttattttgaattaattttagttttacaaaaacattgcaaagataatacagagttctcatacattttttatccaattttgctaaatgcaatgttaacgtattatacaactgtggtacattcgttaaaactaagaaattaatattgataaattactgtaaactaaactccagacttcatttggatttcaccagcttctccactaatgttctttttctatttcaggatccaatccctgttggatccatattgcatttaattgtcatatctccttcacctctttggatctgtgagagtttctcagtctttccttgttttccatgactatcacactatttttttcagagatggagtctcattgtgttccccaggctggatttgaattcctgggctcaagcaatcttcctgccacagtgtccctagtggctccaactataggcatacaccacacccggcatgactatcacacttttgaagattaccgattgagtattgcataggatatcctttcatttgagtttgcctgctgttcttccgatgattggactttggttatgggtaactcatccacttttcacaacagcctataagacggtactattatgattctcttttatagatgaggcactgagggagagaacagttgagtaatttgaaggcctgggtgcttgaatccagagggtctggttatagacctaaagctcataatcactatgttattattgagttataatttctaaatttgaatcttgacacactacatactaactcatatttattggtatcagatcactcaactgtgaagcaggaatgatcattttacttacctcatatggcaatgcttagcacagtatctcggtcacaccaaatttctggaagatgttagctgttagttttacttaactgtttgccattatttttcaggaagctggccatgttaattttctgaactgcacaatcacaattttgtgaaccttaaggtgttctgaaattacgggctcgttgattctgccctttgtcttgcttctcaaagaaggtgtgctggcactccatttaagtgctttatttgtcaggagaaagtgctcatttgaatctgaaaagcaatccatgtacaaaggaagaaaacttggaaaccctgatagtctctgcatgtttgagaatcaatgaaaaaagtaatgccactttccacatgtgcttttagaattctaggaatagatcagtctcaggttatactacaggaataatatctttaaataacaccatagaaaaacattccaaaattgtttggtagtggactgtgtctacacagatacttatacatgttttttggaaggtcatattatgacatatagcaatatcagaatttctacaccaatagcattaaatgataatccctctctgtcaaaccggaacatgtgttgtaggtaagcatgtacataacagtgtcgatatctttgcctgaagtaagaatattgagggaaaataaaagcgttatgagatgtgttcctttcattttaaaaaatgaaaaaattactccaaaatggtgttatggactcaacattgattctcctggtttccaatcccacacaggttgagttcttactacaacaaggcattttccttggtgccatgtcctagatcatacttttctgtttaatgcagaattttcttccaggaggctagaatgcttggaaaagtgtttgtcatatgtcggaaagtgagcattttctcttatgaaaactattcgtgcttttatgtaaaagtattgaaaaggaaacttcacaaaccataagaaaatacctgaagaggagatagaaagcaatccggctggggatcacgtagcaagtgtcttcattgggcagggtagaaaccttggctaccttttgctgctttccaactctgaaatcctaagtttctctgatgttaagttacctggttgtaattataaagtgcttatcattcagacgtatgtgaaatacttggaagtcagacttcctgccagtgtttaacactttggaaggatcaataagtaggctttattcagatattccaaatggccaccttcttggtgtcatgtgacgctatgtctgtggcctataatacatgtagttgtgattaattgacttttgtccagcatcctgtattttcggctctcttttagcggtggcaagcaatggaaaacattatttctttgctcagatttctcactatatgtgtaaaaaggtgatattgtgattccatgtttccaaatgagtgagactctatggacaccttccatatattccctccatatcaggagtaaagaaaggtatgtcccaatttaaatgggaatttagcacctctattaaatttttcacacagcttccattctgtatttttatgaactataccaaatcaaacatatttatctttttgttcagagaaatgaacatgaactccttatttctgttaaacctgcttttcttgcagtcttcactgtgtcgaggatgtctattccatcccactagttactcctagggaaaatcttggggtttaactccttcctctcacacctcacaccctaaccatcaacaaatcctcttagctttacctccacagtatgtccagaattcagtcatttctcgtacctctcttacaagcacccagttaaagccaccatcttcacatttaaaattccctgtgttagcaattttgaggtatacaatacattattactaactatagtcacctggttgtgtaatagatcaccagaatgtattctttctgtctaactgaaattttgtaccctttgaccaacatttccccttttcctaccctcccccacccacctcagcctctggtaaccaccactctactcttatcttgtctgaatttgaattttcagattacacgtgtaagtgagatcattcaatatttatcttttaaaaaaattttttttgagatggagtcttgctctgttgcccaggctggaatgcaatggcatgatctcagctcactgcaaccgccgcctcccgggttcaagcgattctcctgcctcagcctcctgagtagctgggattacaggcacctgccaccacgcccggctaatttttgtattttttagtagagacagggtttctccatgttgtttaatttttattttagttcagggatacatgtgcaggtttcttatatagataaacttgtgtcatgggggtttgttgtacagattgttttgtcacccaggtattaagcccactacccattagttattttttctgatcctctccctgcttctatcctccaccctctgataggccccagtgtgtgttgttcccctttatgtgctcatgggttctcatcatttagctcccacttataagtgagaacatgtggtatttggttttctgttcctctgttagtttgctaaggataatggcctccagctccatccatgttcctgaaaaggacatgatttgttctttttttatggctgcatagtattccacgttgtataagtaccacattttatttatccagtctaccattgatgggcatttaggttgattccacatctttgctattgtaaatagtgctgcagtgaacatacacatacatatgtctttatgatagaaggatttatattcccttggatatatacccagtagtaggattgctgggtcaattagtagttctgtttttagttctttgaggaatcaccacactgctttccacaatggatgaactaatttacactcctaccaacagtatataagtgttcctttttctctgcaaccttgccagcacctgttatttttaataaataacagcacctgttgagtttttaataatagccattccgactagtgtgagatcagttgcttttggaattttcatcatgaaatctttgcccgttcctctgtccagaatggtattgcctaggttgtcttccaggaatttatagtttggggttttacatttaagtctttaatccatcttgagttgatttttgtatatggtgtaaggaaggggtccagtttcagtcttctgcatatggctagtcagttatcttagcaccatttattgaatagaaagtccttttttccattgcttgttttcttcaactttgtcgaatatcagataattgtaggagtgcagctttatttctgagctggtatttatctttctgtgcctggcttatttgacctaggataatgtcctctagattcatccatgttgttgcaaatggcagattttcattcttttttaaggctggatagtagtagttcattatgtatgtataccacatttgttattcattcatctgttaatggacgctaatgttgtttccaaatcttatcatgtctctctccatctcccttagatcaaaattcaaattctgtgtaacatatagaaagacttgccccctttacctgactgagagcatcacctctacttctctcttccccctctacaccagctataccacccacctcactgtgtttcaatatactattgttctcctgctcagaagctttgaaattgctattccctctttttgaaatgttcttctccaaggtattcattttcagagtttgctccctcactttattcagtctcatcagagaggcctttcttgactatccgaaaccaaataccgctgcctcccacttacccctcagtctccttattacgctttgtctgcatatcgcttaccaccacctgttaaaagataaagctgagctcattaaacatttaaagattttatttgagcagactgattcataaattaggcagcaccaaatcacaagctgtatgggctccaccaagaaggtgtgagaggaaaatttttgtaaggtgttctaggaagcaagacaaagaaaatatttgatttattgaagtggaaagtccctagttagaaattagttggcagtttcagattaagttaaatgtttacactgaattgggttttggtttgtctacataggaacccagggcactggagccatctcagcctagtggcctcccaaattattttttttcgacacacgtgacatactattttattttctgtctttatccattacaacgtaagttccatgagagcaggaatgtatctgttccttttgttgccttatcttcaaaatgtagaatagtacacaatacttaataggacattaataaatacttgttgaacaaatggaagaatgactaaatgtgattgaaaggcagactagtagtaaattggactaggtcaaatacatgtgcagaccagtgttcaatagtatgtagcatagtttatatttacacatattcaatatttagcctttcaaaatgttttccagttacctaaatataagtatttagcattataggtggaaatctgtcaaattattttaactcataccacatttgagaaactgtgtggaacctttactattcctcagttttgtttttctataaatataatatatatttccttttcctactgaatgttcccctcagtgcaatttttttccagctattttacttgtagttttgatgtcttgctttgtttttacctatgaagtctaatgaaagtccagataagagcctataattctatccatataattcagtaacttccagaacatgttttatctgtcagactatggttcacattatcgtaggtgtaatgcaaagtttagagctgaaaatgtagccacgttcctaattcttgctctagttatcaatgtcaaatgcactatcaataggacttgaaaaacatactcagtaatattggatgggtactgacattctctcaaattatagtattgagtgcgctatactaaaaatagtaaaaataacatggcttagacaagtgagaaaacaaagctatgtcctactttattttgagaagcaaaatacaattttcctgtttgttttttctttttctcaaaacaactaaaatttgtaggaggataatgtttaaaatttgttcacatggttaaaattagaaaaataaataaactgacatgaaacatacattaaatttaaagattcattgttttgtataaacacagtgtatagcttataagtcattatgctattagattgactttttaacttacgagaaattggcattctaatttagatgcatgtatatgacttcccatgtctattttaggatagatttaatcataaaatgatttaccttgggcaaattacaataaactcacttgagtaattaatcgaggtgtttcaaggagttaatttagttcacgtaaataagaacgttgtttcaaggaatcatttaccactctgtattgccatttggcctagactttttccattttacatccagaagacaaactgttgataaactatttgttatttttttgctaaaaattgatacctttagtatagatagtactgtatcagaaaccatagaaactgatgctttaatatggacatgaactcattagacatagaattttggtcagtctctagttagaatcattgcttctatttattttcaagtttgtacctgaggataattaatattattgaaaatgggttaatttgcaactgaccttgaatcacaaagtggtaggaaaggagatctcttgttttatttatttatttattaacaataaggatttgggcattgtcatatgcattcttctgtagcttacaattaccacaacacttcacatcaataatatactggtgctgatttagtttaaatctttcatatacgtgtttattgtaaatttctttgagtaatgctgggcactgatattaacagaggattaactttatggcacattttaatagaatgcacaatattacttccaccaaattttcttcttttctttgtgaactgttattcattttcagacatgaagaaagtatttctttatcttattttattttatgttccagggtatatgtgtaggatgtgcaggtttgttccataggtaaacatgtgccatgctggtttgctctacctatcgacctatcccctaggtcttaaacccatcatgcattaactatttttcctgatgctcatttcttagtagacatggcacttcaaccattctgaagcttaaaaattatttgttattttaagcccgtaagagcattttaaaatctgatacatctgagcagaaacttttggtttttagtttttttataaattaaatgaaattaacacattaactatttcaagcaaataagatccacttacataaatgaccatgttagtttgagaagttatagcttactgatctgaaaacattaattgaacctccaaaattatacccgtggggtaatttctatcctcgcagcggtgtgcactttaggacaattaaagtgccaaaggaatctcattttatttcttggttattatgtctaggtaaactgatggctcatttttaagatctgtttagtatccaatgattaaaataaaaatgatgacctcatcatgatattcacatagcacatttatccatttctcttttgatttatagcttatttttacctaatgcagtttactcaagtctcctgggcttatacattttttagtctttgataatctatactaatggaccacaagggtagcaatataatctaatgaagtggttaacccagagtcttgggagtgaactattgtggtttgaagcagatcatgtttgtttggcctactttttttttttctttttttttcttttttttgagacagagtttcgctcgtcacccaggatggagtgcaatggcacaatctcggctcactgcaacctcggcctcctgggttcaagtgattctcctgcctcagcctccttagtagctgagattacaggcacctgccaccatgcctggctaattttttgtatttttaatagagatggggtttcaccatgttggccaggctggtctcgaactcttgaccccaggtgatccgcccgcctcggcctcccaaagtgctgggattacaggcatgagccaccgtgcgcggcctgtttagcctacttttatgactgattcacatttattaaatagctcctagctggatggatcattcagaatggcatagatctgagtagagacttggagactattagcagagctagcttctaggaatagaagtagaagtcaaatatttaaaataatcaccgtgaatcaacatttggtattacctgatcattctcaaaaccctgttccctatttaagctttgatagaattatatgttaaatattcagatacgttatgtaaatgacgaccaggacttagaagttgtttattattaccttcctttatgtggctactaagtatttctgtccatgaaaaatgactgaaatcataatgttaaaaataggaaagaggccgggcgcagtggctcacgcttataatcccagcactttgggaggctgaggtgggcggatcacaaagtcaggagatcgagaccatcctggcctacatggtgaaacccccccgtctctaccaaaaatacaaaaattagctgggcgtggtggcacacacctgtagtcccagctactcgggaggctatggcaggagaatcacttgaacccgggaggcggaggttgcagtgagctgagatcacaccactgtactccagcctagcgacagagtgagattccatcttaaaataaaaaaaaggggaagaaaatacacttacacccattcccaggtaaaatgtcacatctctgtttgaaatgctcatttgcatgaatacattatgaattgcagttccaatatatacatttctgaatatggaaacctcaataatattttctctttgtgttttatatttagtactaaaaaagtgatttgtggctaatataacattcaattaaaattaacatttatcctaggggcattccaggtactacagtctgtctcattcattagagcattttgtacttatctgcagagcatctctcctcagaagagaatctgctgaatttttgcatcttatccagcatcaatcactttgattaggatctcactccatgaaccaggcagcttctcttccacagcagttccatatgtctcctacagctgttctactttctaagtggaacgtgactctcttcagctcatagtttgtgtccccatcaaaaaagactgtcaatagctcctttattcttttgatttgctgtactctcttatggcttggaatatgacttatagtcagtattgaattaggatatgttcgattaagagaaattgtgtccatgaatgttttgataagtgaaatatttacatcaaagctcatgctaagaaactatttgaagagcaaagacagagcagaaactttgcttgtgaaggaatttctccagggaaattttcaccgtgcaactcggtggtggaaggctgccataattttggtttatgttaatagaggttaagttgatttttattattttctttggttggtttataatcagcaaattttatcttggaaagtagatttttttttgcccaggtactatgtttgtgtgttagactatggaaagccagaacaactattatacattgactgcaaagataacagaattttgtgtgtgtgtttgaaacttcctttcaacctcaacacccgaaatgtttgctgcaataccttttctatatgaaaaccatagaataaatagaatggaagtaaaactaattcagaataaaagaaactatcatttctacaaatggcaacctcatttatttacacctaaaactatagttttcatagggcttaatgtgaaaagataaaagaagtgaaaaggtccttgagaaaataatagagtattacctgaagcttgctgagcaaacatttttggggaatgacaaaaaaagcttttgaacatgaacttctgggatttcaactgaatgatcaagcatgaagaaacttgattatcctgattaaagaataatgctgggaagtctttgcataatttgataatatttttagtatgagctgatgtctttaaccaaaatagctaccaaaattttagaaaacactatcacaccatgcatgttgtgaatgaaatttttatttactcacttgttgatttgggagagctatatgaacaattattatcaccaatagtattcatggtcttttttaaaaaaagactaacaggtcaaagaaaaggggtttaatggattcccaattttagtatgttgtacccttgagtatcagatgtctctgttcttagcaactttccttgcttgtggaaatctagaaatggtttactcaatgtcagttgatcatgttgttttatctgaaaggcaaaaacactaggatactttcaacttcccatagagaattacacattcaaactaaagtctagttgttcaaatggaaaaatcgagaggcagacaaattaatgtaattatagacttggtagggtgttgcaaatgaataagaaactggcaatttgagtagttaagaaccattgtatattttattatagctgtaatgttttgagttcataaagccatattgaagtaggaatacacacatacactcatttttagtaagcacaatagaagtaagtcatttcattatcattttagggctgattcttacactttttagcccacaattccgtaagttgtctaattcgactgatacagaccagttctagctaccaaaatattatgtgcacaaaactccctttcattctatttttctgatcacaatatccatgcccacaatatagctaattagttaagtgtgggaggaaggcttttgttagaattcttactccaatggattaatcattggaaatcctcaaattgcctgaagttgttagcatattttaaaatcaccagataaatacctaactagaacatcagataatacatgacaattagaattattctagcgagctgtagtcacatctgaaagttaccatattcttgctcctcaaacaccttaaatttaaactctgatgaaatccatctgtaccttctctaatatctccccagatagtcatgaggagtaaataacatactacaaaatgttaaaatatttcaaatacaaagttctatagaaatgttacacagtgctattatcactatttctcaattaaatgtacattttaatattaaatgttactgctaaaattattttgatagtagttatttataaacattcactattagtaatagccaactattatgtatggttactttcacttaggatgaaataaaaaatattggcttatttatatatttcagagtatgttctagattcctataatggggttctaatggggctaaatatgtcaaattcttataatatatattaaatgtgtgactacagcagtgccttttaatgtgggtcttcttttagtatctgaagaaagctaaccaaattttccattgtaaccaccaatatcatatttttaatattagaatataatacttaacaaatacaatagttaaatgtttatttaatactaactaaacattgaacaataattcttaaagagattcacaaactataaaacactataccagactataaggtgcttttactaatcaatttggaaaccataacacctgtctgatgagcatgcttattttaaaatgaacagatgcagggtgtgataatataccagattaaagttatgagtgaatagatttccttgtaattacaagtcatatagtgaaggtatcgatgctatatatatttctgtcaatgaagaaactgtataatttgaagtgttttaattttggggggatgggggacggagttttgctcttgttgcccatgctggagtgcagtggcacgatctcagctcactgcaacctccacctcctaggttcaagtgtttctccagcctcagcctcccaggtagctggtattacaggtgcccaccaccaggcccggctaatttttgtatttttagtggagacagggtttcaccattttggccaggctgctctcaaactcctgacctcaggtcatccgcccacctcggtctcccaaagtgccgggattataggcgtgagccaccgctcctggccacgtgttttacatcttatttataaactagcctttggaaaatgggtaagaactgtagtgctttttgttggtaatactgtgtagttgttctttagttgtcatttcaaaaccaaagctaaactgtttacaaggaaataaaaacttaacctgtgcacaaatttagcattatggatttacatactaccaagtactagaactttttcagtctcaaaaactaagcccttttgaaatttagctatttaatatcaggaattctgaaaacaagggatatgggatgtaaggagaaaattattcctattctatagactttgttatgtatgttttaaaatgtaattaatatcaacgtaatattgtatctttcagacactgacttccatttcctgattggttataggtaatttgaagatttttcactataccagtagagatacaaagtaaaacacaggtatagtctcctagaaaattaaataaaataacccttgagtagacttgtaaggtgacatagaaccagatatgcctgtcttctgttttgctaaaaagaccttgtttccaagtgttattgaaaagtgtcataatgaaatcagaatttaatgttatttgccctggcaaaatcatgtgtaatggtaatcataaatcagttaaggagtaatacaagatgttatgcaaataagcactaaagtttcacaccaggtaaatggctgccttcgtgagtcagtggtgaaatggtaaggttctagaatatggatattgcaatggacattaaaagcaaaatgcgtagagacattttcttaaagtagtaattaatggtacatggaggtgtgcttaatgtgaaggaataataaaagcaataaaatttcaaacaataagcattcatactgatttgatttgtgcttgtataattctctttacaactctatcatatatgttcatctatttattacattttggatgttactgcattcttgtcttagtttattaagcttcccttttaatatttgcctttattttaccctcttctcatattatgatttccttgatcctagcttcttttttcaagtccatgcatcttagtatttcatggctggcatcaggaagttttctaaaattttgtctggttttcatggaaaaaattgcaaagtctcatttattttctaagcttcaagacaagtgtatccatatggattcagaaaatttctataggcaacttctattgttcttttcactgagccttaaattagaagagctgtatgtagacttagtgttaagtacaattattgatgtactgaccttcttctcttatttttcttcataagtggagattgatatacataatctatacctattcccagtaccgacttagcctttacccagcactgctttcctgatggatgtggagttttctccaaataaaactaccatatcttgtaaccatattaaaaagtagaagcattctgtatttatattttaacttaaatatttattataaaaaattctaaatatatacaaaatagagaatgataagtgaagattcatctacctattagcaaatttcaataattataagcattttaccaacctttgtacctattttctatgtaggtgtaatacatggaagtctatatcctcactatgcactgttgtagactcttctctcaacacttctgcttttcctgaagtgcctagctatctgagcatacaatagggctaccaatccatttttgttctccaactatatttttatctgtgatttataatatctgaatgaaagcaggaagagacaagatagaaaggaggaaaaggaaaaaataaaaactataaataagagtgtagtagtttaaaggaaccagggaagtaaatgcctgatttgtggttagtgcagtgctgtatactagagtgaagaaaccttacactcttgacaatatcctggtaattcctgttgagagggcaaaacacgcgtagtccagaactgcatttctttaactgaatcatccccaaaaacttaaggtcgtggaaattctctctaaattttggtgtctggttctgacatatttttaaaattcagtgcttccccaacacctgtaatatgtatattttaacaggtagttggacatggtatttcaggctttcctatttttttcctatgtaaatatgaaagttactctatgggcctatttccctgaaatgttggacccactaacacaatcagactttctacaaactgccacactgattctttgccttcaggtacacctatagaaagatgagtgtgtggggatggcatagacccaaccagcagcaagagggagtcattatttcctacccaagagtagggcagagagaaagaagacacatttgctcagccattaagcataaaccaatgaatgccagactctttatgatcttgccagtcaggattgatccatcctttcatttagaggaggattgagcaagaggtggaaacacacgctagacatatttttctagtataggtcattacaaggaaataccaagatgaagaagacagttcttcctaacaacctctgccatgaaataattactgaccaaatatatttgggaatatgattatgctgaaagggccacatgaagtccttgtttttttattatttacagatttgactattttttttttctattctaatactgtgcttcctgatgctctattataaagaacagaggggattgggaagctggggttcaagccaaagaataaatccatgatgtattttaaagaagttggtagaagaaaagagaacaagtagatttttttgttgttgttttttgtttttgtttttgtttttgtttttgttttgttttgtttctttgagatggagtctcgctctgtcgtccaggctggagtgcagtggcgcgatctcggctcacggcaacctccacctcccgggttcacgccattctcctgcctcagcctcccgagtagctgggactacaggcgcccgccaccacacctggctaattttttatatttttagtagagatggggtttcattgtgttagccaggatggtctcaatctcctgacctcctgttccacctgccttggcctcccacaatgccgggattacaggcgtgagccattgcgcccggccgagaacaaataaatatttatagagtttggtgtagtaatatttttacttactctttcttattctctttattatttgctcctgaggatatgagttaccatctaactagcatcatttccttaagccaatatatctttgttcccttccacctcatttgttttgttgttgtcaaaaatgttatgtaatacataagttataggtcccaaaataaagttatatacatgttgttttatacagttgactttgaaatcaggtgaaggaaattgcctttatacttttttttttttaatatttacataattacctttactccttgtttttctgcaaggattttgcttatggttactttcagtttttgtttgtgtggggatgtctttacttcatcttcatttttaaaagataactttactacatataagattcttggttgatgattttgtttctttcagtactttgagtatgctatcccactgtgatcaccattgtttctgctgagaagtgagctgttggtagttcccttaaagttattgaagttcccttgtaactgataaattgtttttctcttgttgagttaaagattttctctttgtatttggctcttagcatttttcctacaatgtgttaggatgtggatctctttgtgtttattatacttgtagtttgttgagcttcttggttgtgtagattatttttcatcaaatttgaaaagctttcagccgtatttttatgtttctcttcactttctgtccttctgttctgatatgctcattacgtgcatgttgtgtgcttaatggttgcccaactttctgtgaggctctgttaagtttttccattctttttcctctctgttcttctgattgcataatttctattgatttatttcaggtttgctgattctttcttctgtcatttcaaacctactcttgagcccttctagcaaattgttatttcagctattataatttttaactccagaatttcatttggttcttttaaataatttctgcttcttcatcaaaaactccatttgatatagcattgccatcataatttcctttacttctttaaatatggtctcctttattattttgaacatgcttatatggctgctttggattatttgtattaatatattaaacctgacatttggcctctttcacagtcaatttatgttgcttggtttgtttcccgtatatggggaacacttttttctttctttgtgtgtcttttttcttattgaaaaatggacattttagatactttattatagcaactgtggatactgatatcccctaatctggagattgcttttgttgttgtttgcttgttcatttattctgttacataactggactattttagttaaatgtattttcctgacagtatgaagcttgcaatgtccttcctcagaggaggcaaatttgggcatgtgcatagtcactctgggatgacagtggttttaggaagattctctttgactgtatctttccctgatctctctgttaagctgtcttcctctgctggtattagaccaagtttttgtactacattatttgcctgcttattgttttggataatacgttggggtataaattgctccacattctgatccagttaaactcaagcccctttggaagccaattttgctccaaagttcagggcaaggccactggcctacttctcttgaagtgacacctgtgctttatgagcagggtgttgaatagagtctgtagcctctggccttctcagcttatctccctcagcatagaacctctgccctaggaacaagataaggtgagggcagtagaagtgggaggagcacctccagtattctcagcatgcctcacaggagctgaagcccctgccctatgtgcaggaattgggtggaggaggggagctccaattctctcaaatgcactcactagaaatttagcctctgtaacatagagcttcagggcatgacaaatgctggtagcctgctgctcttcagggagagagtcgtctttgtctgggagctggggagagtgttaagtcccacttttttggccacacctgtccagattggagcttccattctgcggtgcagagtggggaggaaggatgtagaccatgtgtaaacgccacagactctccttgttcttactgagatttggtagagtttcttcatttgctgcttgcccttagggaaccttatggagacttgaaatggttgttattgtttgtttgtttgtttttaataattgtcagtaattattgttgtttccttgggagttggactacagagctcatcatactgctgttctggaagtgaaagtactccatgctgtattttaaaggccttctgggatccctgttgcataaagattaaattaagtgttaaatgccactgtacgtttcatgatactagcaagaaaaataaaacaggattttccaaatatccttgattcagactgagaaatagcaaactctcaaaacaaaacattaatgtgttggtgaaatgtgcaaaatgctagcttctcaatcatctttggatgcggaattgcttaagcgaaatgaagaaaaatattccctcattgttaagctacaactgtttcatcattggagtgttccacgaaacagcctatttcataccagttaagggcctagctagaatttcaaatgaatgcaaataagaacgtttgtaatgcaagttgcaaggtgggaggaacaactgtttatgtaattttcctctcttttcaactttcacagagcattgcataatgttagaatcagactgcttgtattttaatcctggcttcatcactaagagatgtaggcttttgaccagttaatctaggtttcagtttcccattaaaaaatagaagtagtacaggacctacttgtaggtttattataaggagcataaataattgatcacttgggtaaagtgttaagcaattccccaatgtataaataataaatttaagatggtaataaaattaaaaaatcacaaaagcattaaataaatattatctctttagcagcttggcataatcagtagaaatttgagttctacaaaacttattgctgaatgaggtatagatttggatattagacaagaattttttaatggtccttatattcattggttttaatttagtgggtttccttaagcttaatgtatctctagtatgatcatctccacaagaatagataatactttttattaaatgctagcttagtccacaaaactttgttttattaaagtagataaattaagcaatgaaactattgatacaagatgtctttatatctttcactccaatcagttacatagctttaaaactcagaattatttttgtgtacatccactgtgtagtacctgaagtgagatgaacttttatgctatgctttttttctatttggtattcattgagtagcttttaaccaatctccttcttctattatacgagttgctctactgggcttttgggatgcagaaatgagtgagaagtggtttcttcagccaaaaccagatagccatttaagcacacaaataggatacatttttagaggtactattggagagatacctacaaggcgttgcagaaacacaaaaaacaaagagtccctggaggtatagggaaaagcttcaaagaggacacgaaggtgaagtcatttgagattgattatataacctagtgaagaattttccaggtacagagagatgcaggaagaccatttctggcacagggaacagcagatacaagagcatgaaataattaaagtactgtgttgttcaagagatgctgaaaagttcagatatttggaaagttcagtgaatgggatgcggaaggataacggaataggatagaaggggcaggttgaagccagatgtaaagaacttttatgccttttttaagagttcaggcttcattctttaggcaaaggcaagccagaaaggattttaaccagtaggagtgacatggtcagttaggtctttagaacaataactctggcttcattgtgaatgattgaagggcatggtgcttatatttccattgtaatagtctaggtcagagtaagtcagagctgaattaaaaatagctggatacaaaacagcttttctcttccatgcaatagtgtgtttcctccctaagccccactctctcccagcgaatacagttagtcttgttttatgaaaccagttaagttattaagattcaagcacccagctttctttgcttagctagctcaggtaaattgctttaatgatgtccatactgtaagggaagcatattctaatatgggaaaaatggatcagatgtctttgaaattatcctttttagtgcaatgaggaaattgaagtgcatagtgaaatgttttgaaatgttgttaataatgatattatctactaccgacatgctgtaatatccatttaaaagaaataaagttaattttgtatttttctgctctaacaatgaggaaaaatggtaaatatttgggaacgtaatcgaatgtggaggttgtcataaagtgagttatttttttccaaaggactgtaatgggaaaaatacataagtgcatacatatggaaatgacttgatttggtagttgagatttatatgtgacttttaaaaatgatttccagttgctattcctaatccattattttgttgtcttgagctgcagattgttgtctaggtcactaaatggcacactaaacacatttgctcaccatgcccctgtttcttcagatcttttcctatagaacacacacacacacacacacacacacacacacacacacacacccctccccttcacagtttttatattttcagagaaatctatgcatgatcttctgtcatgcaatcctatcaaacatccaattcttttaaacagctaattttttatttcttacttttgttcccaagatgtaaggcacttgtaagattgttctcctttcctgaatattagcaacaacagccccaccagccgttgcagattctgccatcaagttaacacatggggtgtgtagatttacaagtaggaatgaaattatattagagataatagctcttacattgctcaagaatagatcaccccatgaccacctggtcctatatcagttcatttctcttataattcaggaattagttaatgtttttggattgcacgggatgtgaaacatgcctagaagctttgccttatatgggaatctcttaaaatttatgaattcttatatcaaggaaatttttaaaaatgcttaatattacaaaacacaattctgttctttatattatcatatttgcttaaaacctttaggatccaaagaagtgtttttcattttgacatcctactttggttttaattgtcatgagcactagaatgatatgtattgcttccaaactgagtagattctattcgctagcttatgctgtacttagcgagccgtcatttgtcttaactgtatgaaccttagagtgtttataatttacttagaagcagcagatatcagcgccctaattaacaccttcaccattcctctcctggtacttgagaagttggcggcactacaaatggaacagaggctctgaaactaaacacggacctgacacaggatggacatcaattgtctttcatggccttgaggttcttccaattttattttgtgcaataattcccctggatcctgatttctatctcccagtgccatgttttcccacattgttcattgcccaaacctgatacatcatgcaccaaaattaggaagttgacacaagtctggatctcctagtatacgtaatgtggaatgaagatttgattagtaaagggaagtaaagatatgcaaaaaccacagaattattaatattttttcctgtacacttctatagtctggcaaaaaaaggtttggaaatttctaaagatagtagaaaatggactataaatgacttgtatacagaaaaaaagtgtttcaaaatattgattcatgaggttaataatagcttaatattaaagcatttatttgtgtcttttcttacatatctaaccatattgcacaaaaaacagggtcctagaattctatacagaatattacatatctatatcagacatgatcagaaatcagtatcagtacataaaatatactttatattacttaaatggaagaatttaaaatgatattaccatgtaattgaacagatttgaggtgcctgaagattgaaaaagaaataattattttcagatcttgagaaattctacaaggtaatcctgttgaagtcttcatcataagtgagttttccatttgtattattagtgtttgtattttttgttgtgagaaagcgatcctgattctgcttattttaacaaagacgagaataaatatatcagaaggtcattgggtcaggcaaagagttgtttgtttttcaacataggccacaaggatgaacaggaaaaggacatttctagaatgtactgttacagttttatgaaagtaattcaagcaaacaaaacagcaaaaagacatagctgccatttctcagtgttctagggaccaaagaatgtacttacagtgctaggatgtctgcatctttccagctctcacaactaaaataattcaagtatttatgccattattttaaattttgttattactgcccttgcctagatcttcattttcactcaattgaaatagtatgggaaattcctaagtgggatgcaaaccttcagtctttccaacaggattgtaataatctcctggctggactgtactgagtttatcttcttatcccctatagtatctagcacagagaaggaaagtgtgtgggaaatgcaaccacgccccttttcttcctttatgacagatggttttaatagattctagcattcttttcctcacaagtctcagcataacatgctgatttatcagagttggcacatgtcataaaatctacttaccatttctgaactgataatacttagtaggcctaaataaatgtttatcgaactaaagtattgcacatacccagaaatggaactgggaggataagtgaaaagaaattcttaaagaattatttcatagtttttctatttctattcctaaagctccccttttgtttccattgccttcagcggcaatggaagacttacaagagacaagtgctaggtctcatcaacttgagagtctgttcattattagtctcttctttgctcccagctgacttatatttaaatatatggcttccatccaatgattcccagcagggccattaaataaagtatgtattatggacaaaaaatggcaaaaatgtacttggctcagggacacacctttctccagtgacttggattcctttactcattaaggaaaaaaaaaaaatggttctatcgactcgtcattgttgttttatatcagcatgtcttaaccataggaggaaaaaggcagttacagttttaataatgaatcttaaattactggcacttcactcataaatgaagaaaggacagtataatattttattctcagaaacttttctcatctcccctttcctgggtcgtgaggtcaactaattttgattttatctgctctaaactcatcctaatcctataacttagtcacgttggttttaatatttgaagattgttttgtttcttgagattttcctacttctctctaaaattgcatctggggcatggagaaatggctttcatgacattgtgtagttgagaggaaatggatcccctcacctcctgctggttcttgggggattggtgacaggatttatctatgggatggtctttagcatatgctaattgaagttgacacttggtaaaattcatagtctaaattatctcagcttggttaaggcctcagaaagatccctagcttgttcatccactctaaactctaaactctgagagtgtctgctttgcctttcatctttctcctggtacaggctatccctttatttcaaggttgctagaccttcttttagaccttctttacagtggggtcagtggctaatctgcaaaacccgaggaaggcctgggagggcaaactagaccatctctctggctaatcatgccagtctgcttcataagctctgcgttttcacacaagactgtgctttcacagtcaccctgcacagcagccttgtgctagtgttcaaaatggcaacagaaacgtcctatttcctacaatttatggaacatatttcctcctctccactaaagcatgagggagggaagtggagatatgtatctccctcacctatatctgcctccagtccttttcctgtgagccttgaggaaaaagaaataaatcatattcttaagttttcaaaaatcttaatcatattacattatcagtagataatagaaattatagaaattttattaaactttttctttgtggtatctataaccttaatctcttcactctcactaaatcttcaatctgttatgtttgatgtattgcaatagtttttaacttgcttcttgcctccttttctctttccactccaggctattttgcatcctgttgccagactattcttcagctctctcgctttgattacaccgtttttcattaagacatttagaattttgtctcatcatttatctattattctttttcaatcatatgcctgctgagtcctaagactcttttcttcttattataatttctttactacattacccctaaatttgttccttcctcgtttctttatcatattaccttgtaatgataagacatccatatactgtctgattcttcaaagcctagctttagaccctcttgggtgaacctgactcactccataactagagtatttagtctgtagaacatatcttgatatgacattatgagtttgagtaggtattctctcttttcttcatatttatctttcccactaactcttttatttttttaaaaataatcttcccaacaacccttcagtgtgggtgttgatatctgcaaattacagacaagaaaactgaggttcagaaaagtgaagtcacctgcctaaagccacaaaactagttgatttttggagctgtgattcagatccaaatctggtttcagttttaagttcctcactggattaggctgcctcttcttaacagaaggggttttacagtatattttgagggatacttcacaaataaggtgatgtttgagggggcaatttattgattactaaatgctgaacacagtatatcatgttatcctttcaacaactctgagagttaggtgctaccaacagtctcgatttttcagttatggaaggtgagtgatagagggaatgcaggggctaaataatgaattgaacacaaggccctaatcatcatactgctctacttcccacttattgaactcaattctacacatcagacccttctcaatctagtttctgggctctggaggttgtggcgatggatggcctagcatttcctaggatctaagccctgggcatagcctgcttccaacattgggagcatagagatgagtcaggaaagcctgaccatggcctaactcatttttaagcatcttaaacaaagaatagtgtttagtatttgtccacggttattataatgtctaataggtggtacagagcactaaatatttacttcattatacaaaatctaataggacttaaaaaataaaagcacgtactgcaaaacacaggtttgaacaataagaatattgcttttttgctgttctttagacttcttttccatgttttcattaataagcatgtattattcttataatttacatctgtgttagttcaacaatactgtaatttaattacattgtgatccaaacaattagactgtgacattttatttaccaaacattactaagtctgcagttaatcataaagcagtatttctggtgttcatctccaaacattttatctacattattaacttagaatatttgcaacatgctgcttctcaactgtgactatgattattcacttatatttgtatttcatcattaaaaagaagccctcattttctcattattaggtcttaaactgaatcaacctgacatgaatataaaaaaattagagtagtttaaaacagttggttcatcagagatttgaactgaggtaaacaaaattaggtagattctgtaaataatcaaggcattttattttaattaatggccttgttacagttctgtttcaaaaactgaaggatttggatattacacccccttaggttttatatacatataatgacaacgttggtttggatgacgtctttgttctttctagctgttacattacattctgtagttatctgaactgcttgccagactgtttagggaaatgcatgtatcacagttaggggggattcacaaatggtaggtttctctgcaaaattgagacatatttagagtagaaaacactttgcctcttggaaatagaagtatagggtaatctctttttgtttgtaggccagaagtttctgtggactataaatagaaacagctcacagctaggatggagaaagctagagaaatgtacctatttgattgaaagggatagctaatgtactcaaaaattgctcttgagaaagagcaatgacacattcattctgaaggactacttaattgcccactcttggaacaagttggtcttcagctctaaactaaactgaagattttgaaaatgatagaaaaatagtgcagcaaatgttaaatttatgaaataggcttgcaattttctcatcaaacttagaccaaccttaacgatattgtaagagtaatatattctcaaggataaaatgttctctagttcaacttctacatagaaaatgagtttaaatgagccagtcgtcttaatatttggatacaatggtcattttgaaatatgtgaaatgtgttccactattattagaaaggaaaaaaaataaatatgcttatctttgatttgggcaatacccaggactgattcatagaaaaaaatctaatatatttatacataggagtgctttctctctacttgtacctacaataaaaaggtcgtcgtttgctttttaaaaattattttcactggagtatacttgaaactgtacatctcaaatgttttaacaaatatacctaaatattaaaattactaagtaattttgtccattgaaaaatgtggctactgcatatataataagacatagtttcttctcaaaagtgcctaataagactaaagagagtgaatcaatggaattatttatttgttaaaatcatgttaaatgtcttaaaggtgttattctttctttcctaattttcaaaagaaaatactttgtcttctttcatactcattgtttctaactctttctaacttttagtaattgtcaataacacttatattacttaaaatcttttccttaatttatcttcttctacccttctatccaactcttctttattaaaaacatgtcttcaggataccacaggagaaaaggtcagaaaaagaaaagggagttttagtgtatacctacctccaaacagtcattattactgtcaaggcataaagccatatgttgcatatgacaaattctgtatttctactggggtgcattgtactgtattttcataacatatgccaggcaacttctatgtatttcaggtcactaagtatacttttcaacaagacaaggaaactttctccctcccatcccttctgaaatctttatttggagatctagctctaagttttatgttttcctggtggtctttcgattcattccattccattccattccattcattcattcattcattcaaaaacattattattcacataccataggtcataaacctcattacttatgggaaatacgaaaatacttaccattctgtcttctctcttctttgaggcttgttctcatgaaataagacagatctatctatctgtctgtctgtctgtctgtctgtctatctatctatctatctatctatctatctaaacaatgaagtgatagattaagtatatgaaaggaaaatgaaaagcaaagaaaaaaggaaaaaggcctctgctagttgcgttgtggatttggaaaaacttcatggatgagatgatcctaaaagattactctgggtattccatgcagctaaaggtcgagggccaaggtggctgtaatagtccaagtaatgtggaaagaatttgggtgtgaaaagacttgccaggaagttttgactccagaaagattctaaaataaattggtaattataaagatgataatgtatggcctcgaaggccatgttcaggaatttggactgtgtacagacagattgtggaaagctattgcacgattttgggcagttacacaataaggttattctattggggagtacacagatttggctgggtgaaaaaggctagcagagaaaaaggccattttgaaagctgttggaaatagtcctgtgagaaataataagaaaacctatcaaataggccaggcacggtggctcacgcttgtaatcccagcactttgggaggccaaggtgagcagatcatgaggtcaggagttcaagaccagcctggtcagcatggtgaaaccccatctctactaaaaatacaaaaattacctgggcatggtggtgtgcacctgtaatcccagctactcaggaggctgaggtcggagaatcgcttaaacccaggaggcagaggttgcagtgagccgagattgtgccactgcactccagcctgggcaacagaaaaagactctgtctcaaaaagaaaaaaaaaaaaaagaaaaagaaaaccgaaaacctaccaaataagtggagataaaataaagaataagaagcataccagactatagtgagagcatatgaaagccaatttgatggttgaaggagaaaacattcagtattagaacaatcacaagacacggcaaatctaggggggaatactgtttagttagaggcatgttgcctttgaagtgcctgagttgagaaacattggacatttagaaagtgagggtggtggtcataaatctgggagtcccagagaggtagactgatccatgggattgtctaagttgggagtgggaagagagcatcttgataaagaagaaaagccacgctacaagactagagaaaatcaacataaagaacaacaggcggcccagcacggtggctcgtgcctgtaatcccagcactttgggaggccgaggcaggcggatcacctgaggtcgggaccagcctagctaacatggtgaaactccgtgtctactaaaaatacaaaaaaattagcccagtgtggtagcgcacgcctgtaatcccagctactcgggaagctgaggcaagagaatcacttgaacctgggaggtggaggttgcattgaggcaagatcgtgccattgcactcctttgcactccagcctgggcaacaagaacaaaattccatctcaaacaaaacaaaacaaaaaaaacaaaaacaaaaacaaaaaacaaaaagcaaagagagaggtttgtcaatcacagtttaaaaaattaaggcaactgggataagcaactaatatttcagccatttgagaatgactctatctcttcgtacacttgcaaatagaattgtaatcacatgagatttcaaccagataaatttggttacccagaaaaaaatgaggtcatgacatagatttgaaggccaacaaaaattacataatcagtgctccgtaaattagctattacgtaggtggatgcacattttgtttcatgtccatgaagattcgaagcgttaagttattttactcatgataacaatctacttcctatcgaaatttcatggagagataatagatcagtatttattctatactgagtatagaccatgaagattaaaaatagctcatgaataagggaaagggaaactctatatgtgggattttatgtaattatggtaacaattccttggagatattgtggtctgttatgtaaatatgtgtaattatgataatttcaaaaaccatgttatttactcagtagtttaacagctccttcacaaagcagtcactttcagaactcaggaggggtatagcaatactttccataaaaatgaggtaaacttaacatctcatgtgaatttaaaatatatttttataagaaagacatcagaatttaagggtatatttaccccatttttactttcacacaataaagtactgctgtagcacagatcattattacccaagttcagggatgacatacacaaagattattattgataaataatcagaatgaattggtagtatttgcatagatttttctggaccatagttgtttttacctgttgtttgagggcctattatggggggcatatttaatatatgagtgctataactagaaattcaaactgtcagagggaaggaaaccatccatctacccattcattaaatgaatatttattcaaggccaagatgtgctaaatgtgggactgaattttgggaccaaaatcttaaatgatgcatatgtcctactattacatgctgtctaacaggcagaggtaatcaggtaaataagtcagtgaaataacatcattggagtcttcacatttcacttttccgggggacaccattcccattgttgtgaaatgcaaagaccctgagtgttctaggtgttataatagaaagaaaagtagggtacaaaaggggaacaattttatatggtagagctaaggtcacttaggatgatccaagttttaatgtctccactagacagccagagtaataggtgaatgtgtgtgtgattaagaaaaatcatccattgccactcattgatatgtaagggacaagcagaggaggggaagcactatcagaggagaatgagaaggaatagttaaggcagaaaagaaaaaaagtgaaaagtacatttttttctgaatgtaagattccagaaggcagtcggtaaaagttccaagagatccacggaagtcaagtaaaatgagagggaagagtccattggatttgaaaattaagtcatgagcaacttcacttagagcatgttcagtaaagacatacaaataaataaaagtgactttgatgataacttttggttggcaacaccaacaaaccaattttgaataattcctccaagaaccgtcatagtgaaggaaaacggagtggtgttcctattctaggaaaggtttttgtttgttctattttggttttgttcttggattttttttagttttagtttcctgtggtattaaaacatgtttatataaagtaaagggggctgggcacagtgtctcacccctgtaatcccagcacttttaggaggcggagacagaaggattacttgagcccgggagttcaagacaagcctgggcgacaaagtgagaccccatctctacaaaaaattagttgaccgtggtggtgcatgcctgtgatcccaagtacatgcgaggctgaggtgggaggatcacttgagcccggaagattgaggttgcagtgagccgtatttgtgccactgcactccagcatgagtgacagaacaagaccccgtctcaaataaataaataaataaacaaaaataaaaacaaaaaaataaaaaagggaagaatggttatatatggtaaaccaggactcctcaagaaagggagaaattagattcagaccaaagaaggagtaagtggctttaatctatgaacaagataaagggttcatccttatctgaagcaggaaagaggaagggaaagagagaaggatggattctaatataaatacatgcagaaagttcttaaccatatttttcacttagaatcacaaaaaaaagacatataaaacaaagtcactaaagaacataataatgtgcttatattacactgaaatgatactctactttcctctaattattattcttccaagcaaatacttttttttttttttttgacacagtatctcactctgtcatccaggctggagggcagtggcgtgattttggctcgctgcaacctcccactcctgggctcaagcaatcctcccacctcagcgtttgtagtggctgggactacaggagcccattaccacatccagctattttttttaaatattttttctttctttctttctttctttctttctttctttctttctttctttctttctttctttctttctttctttctctctctctctctctctctctctctttcttttcttttcttttcttttcttttcttttcttttctttctttttttttgatggagttttgctcttgttgcccaggctggagtgcagtggtgcaatctaggctcactgcaacctctgcttcccgggttcaagcgattctcctgcctcggcctcctgagtagctgggattacaggcatgtgccaccacacctggctaatttttgcgtatttttagtagagatgggatttctccatgttggtcaggctggtcttgaactcccgacctcaggtgatccacccgcctcggccccccaaagtgctaggattataggcgtgagccaccgtgcccagacacacacccagctaatttttgtatgttttgtagagatggggttttgccatgttgccctggctggcctcaaactcctgggctcaagcgatctgcccacctcagcctcccaaagtactgggattacaggcatgagccaccacgcccagcctcaaatacttttttgacccgaatatcctgcctaattgtgtaagagttaatctatattgtccaaagtaccagtaaggtttttcttcttaggcaaggatgttagaaacatattaggtttttctgatcaatatggctcactttttaagaggaaattgttaatatttttgagtcattgactgcctttgtgctgtttcagagaatgtacaagagtgcggcaataaaaaatggcatacgtattgaaaatattattgctctggttttcagttatttagctcaggttttagaagtttcatctgcctggaaatattttcaaacatccatctatattattgccatgtgagtagtggatctagtgtgacattgcctcttctactggcaatgatatggcataactctagtttgaggagtcaaaataggaggtagcagatctattgtgaatatccaaagtgcagactgcctgttcataacaaattctcttatgaaattatacctttgtaagagcttccataatatatatcttatagagaaactcccaaatggaatttctctaacagactttgccaaactttgatttcttggttaccgggctatagttaatgtgttcataatagcatattgctaacacaaccattaacatgacccttgaaaaataaaatttgatttcacaatgtcacagccgtacatggaattttgaaactaagtcttcttataaaatcattttgagaggtagtttatttctaagtgaaggttacttgtaaataatggtataaccattagcttttgacttttaccacaatattgttggctagtcataatgttcccattcataaaggataactgtgtaatcatttgttattcagatgttgtgccaaaaatccaaaataacatttattcttatttctaaaagtatcagaacatttacaatgaagctgcagttgttttttggtttttgagtgaaatatacaaccaataaacaggataggattacagtatattctgataaaaagctaatttggggcaaatgagccatattacagttgttacctatcacttgattgaaaccaaatcattatctagctttggataaccatgcaccttaaattgaaaattctacaacccattctatggcatacttctgaaaggctctggagtttctctagatgaaatcaaacacccaaagaacatgaaattttggtcagttttcttttacgtgcacatgaaatcatgttctgtcaagtgtgaagattgcggcaggtgttatgagtcagcacacagcataagcaaagctgtatgattgtctacctaatgttctcacgatgatgtttctgcatagttatggaaataaatgtctgtctgaatttttagagcttcatcaccacttatctgaggctaaggtaaatccaaggaggatgtaacatctttttctttacatttttgactatatatatatatttcttttaaaagttagcaattaagccatttctatgtgcctaacacagtgctaaatccttgatagctgtggaaaaatagctgtcataaatcactgtccttgtatttgtggatgctggtatataattttctgtagaaaggtttctgatttgtatttactttcatggaaatcagtgacaggaaactggaaagtatgtagggggtggaaagatcatttgagaatgatgcaaatattgtttgaaaaacttgtatttatatttgtatgctctggagatgcatatatccaaatttaacctcatgaaaattccaggaactaaaaccttgaagaccagaagatgcataatctccttaacaaacaggcttgtttcacatcagcaagctatgatattaaaagggtcagcctatctcaatttgattgaccaaattagaaacctatttaggatgcaattataatgcataagagatcactgtgctctaataaatcctgaaacacatttcatggccagcaccaaggtaaggggctgcccaagttaaatatagaaacatgtactgtgaagggtcagaagtttgcttcttggcatgcttttattcagcactccatgattatgcagtagtggccagtgtggtgtggactttgaggacttgccttaccaccaactagccaagtgagcttggaaagaccccttgaactgttctgttactgcaatgatctatgagacaatagatttgaactaaatcattcctaatagtcttaatgaatagcagtttcattagtttagtaatgggataatactaaagaaaataaaaaccccaacctttgttaggtacatagagtatagtaaagtgattcagataaaggttatatacagagaacaaactaagaattttttttaagaagtaattgacaaaaattgtgtgaaggcaaagagagctaccagtataaaaaccattccaggtagtgtttgtgtcttcagagagaaagaaaagagaccagacaggtctggttaggatattgttggggaataggtagccaagcaactgcatgaaaagccaccaaagggagccttcttcaaagggatgggcgcatcactgagataatccctggcttagcctttgacaggcttgcatctcagcattcacttctgtttgagctattatgtgctgacttcagcatgggagcaatgaaattggggcatgactacacatttcattaccgactcccaagccctgggaaaataatacttttttaaaaaccctgtacctaccatctaataaggtaatagtcaagttgtcttattagattattcattaatgaaacaaatctgtgatgaaacagacttcagatgaatatagctgtaatttttttatcaatgacataaaactgacctgctaaaacagtatagcaactggtaaaatagtttattaaattcttttaaaatatgaccagttacattatatagaaataactggactgtggtccctaaaaaaagagaaatctgcttaggaaaaatgtaattaaaggcgacaaaagaattggactgtcttactcaatgtaaaacttttaaatcaatcttattattttaggagattcatacatgaggactgttgcttttgtattagcttaacaagcacccagggagtcctcctaatagttaagtttatagaattaaaagaagtagggctaatgtgggcttattttcctaatgtgcaacattatttggtattccaaaaaaagtacgtgatcatttattcttttctttgacagagtttcagtcttgtcgcccaggctggagtgcagtggtgccatcttggctcactgcaacctctgcctccccgcttcaagcgattctcctgcctcagcctcccgagtagctgggattacaggcacctgccaccatacctggctaattttttgtatttttagtagagacggggtttcgccatgttgggcaggctggtcccgaactcctgacctcaggtgatccacctgcctcggcctcccaaagtgctgggattacaggtgtgagccactgcgcccagccgcatttattcttttaataagcatatattgaaattccactcaaattaaagggatacatatgtaaataaggactctgcactgagaaggttaactttagtggtgatccaatagaattctattagaatagactaatggatttatataatgatagtacataataataaaactaacaaatatataataaagtataatattatattctagagaatttggaggaattttatctagataagccagatatattttggtcagttgtgagaaagagtgaaattaaaagtaaacagctgggaatagtgcatattaaaaagctgtagcaacagtagtggtgataatggtgatgactgtgatcatgagaaaaagaaaagaagatagaggaggaggaaaaggagaggaatgctagctaaccctgtagatcttactgtgtgctagacatttttctaagagggtttttatatatgaacgagttaatcctcacagcaatcttttgaagtatatgctattattggtcccattttacagttagggaaactcagatacagaggatttagcttgcccaagatcacatagtaagtgtataattgcttttaaaatcagagcatacccattaaatataaaggtaaatattccagagaaagtctgaaaatgttgacagtttatatcactcaaatatctaccgtagccaaatagaaatgtgtataaaatagggcataagaaggagtggtgggcacgatagcaaattggagagcatggatgataaactggagagctacagcccagctaaacatggctagtgaactacaattgttgtggcccgctagaaatgctgtctccgtgttatcagatcatccaagtttggaaaggatctgaaatctggattcataagtgaaacctccaggttattaaatatttggcatttaattaatttttaagataaaatgttagtgggcttgagaaaacacatcagtcactgtgtttgatatatcctgagagccaccagttcatcattccatcattatacagaggcatttattgacttttcccaaatgtctaataatctgaactcagaacgaaatatgtagtagctaaaagtcactttccctcaataataaatattgcttatagcttagtgggttgatttcagtgctaagatattcatttgaagaataaacacaggaacatgtgaaaatcaaagtctagcaacctattttcagtttgttgctttagcttttcagctccaacattgtgagcatccctacgtttagtctgaataacttctcatggactgtggctgtcttattttatgtctctaataccagattatgaaaatcacagaaaaaaggaaaaaatattatttccaaagagtaagttatgaagccatgttagaaacccatatgacaatatgaatttcttttatctgtcaatctcaaggtagaattcctcatatttctgataatgccaaataccatgaaatgtctcaaaaaagacttgactttatataccagttgtttgtcttgctgcctcacttcttcctttcttttctttctcccttttatctgcacccaagttatttctattctgtgttttattggttcttaatatattattatccttgatctctagtcctatcataacttcattttttgtaccaaatgttgctttgtaacatagagaacttaaatgccaatcacctattaacaagctaataaatgtcctggctagaagtgtcataaatggtgaagggtcttgacacaataccatgtgaggattacttaaatagattagggaaataaataatatgtagggaaaatataatagctatgctgaaatatttggaagattggcaatgaagaagctatagtgtttggctagtttgaaaatttattctgacttggaacgtgtggaagctatgagaggtagagtttagtttaacaagtgaaaatatctcttcataaagagattaacctaaaaagtataatggatacctcaaaaaatagtatgttatagagaaagttccagaattgtcaggcagaaatagttaacctctgaatctgtgctctgtctccagaaatctagacagaagctattaagtaatattatcatttaagatgatttttatgacatgacagaggacattatttaaaaattttttttttttttttttttttgagacggagccttgctctgtcgccaggctggagtgcagtggcacaatctcggctcactgcaacctacgcctcctgggttcaagcgattttcctgcctcagcctcccaagtagcttggaccacaggcgcatgccaccatacccagctaatttttgtatttttagtagagacggggtttcaccatgttggccaggctggtctggatctcttgacctcgtgatctgcccgcctcggcctcccaaagtgctgtgattacaggcatgagccaccgtgcctggccagccagaggacattattttatcgacagcaactacaaacattgaaagagactacaacataaactgttattattagagaccaagggtttgttgctagataagaatatgaataaataccatattctcttgtattgagcttgtttttcaataagtcactgaacaacaataattaagcaatgaagccaatacatctagagaaaaaatttaagaaaacatcacaatgtttcaataactatttccatctatacatatttcacacattataaaataatcagttatatcacatggttttatttttaagttcaaaaagtcttcataggctgagctcaatggctcacacctgtaatcctagaacttgggaggccaaggccaaggcaggtgtgcttgagcccaggagttgagaccggcctgggcaacatggcaaaaccccgtctctacaaaaaatacaaaaattaaggcatggtagcatgtgcctgtagccccagctattcaggaggctgaagtggaagggtcacttgagccccatggatgttgaggctgcagtgagccatgattgtgccacttcacactaacctgggtgacagaacgagatcctgtctcaacaacaacaacaaatgtcttcatagcactttctccctactcgagtcttccataaagctgttgaaacacatgcacattatatctgttttttagcactctatctggtaatagtttgtcaaatacgtgctggactcactattttaacccatatttaacccaaggttgtggcaattatcaaagaaaatcaagcaacattactgaacaaaaaaatattttctatgttgaattatgtagttaatgttccatcttctctttgctttcctatccaggtctagctttaggtacattacaaagtgaactgggaagaaaatgctgacatttaagtggttcttgttgcatgtttacattaagaaataataaggccgggcgtggtggctcatgcctgtaatcccagcactttgggaggccaaggagggcaaatcacctgaggtcaagagttcaagaccagcctggccaacatggtgaaaccctgtctctactaaaaatacaaaaattagccgggcatggtggtatgtgcctgtaatcccagctacttgggaggctgagccaggagaattgcttgaacccaggaggcggaggttgcagtgagccgacatgcgccattgtactccagcatgggcaagagtgacactccttctcaaaaaaaaaaaaaaaaaaaaaaagaaaagaaaaatgcactactgtagaatatcttaataattgtcttcagaataagtagattttaaataactacgaactaacacatagtgctttgcaagtgaagtggaaataaattcttaaacaattatatttaatgcaaaaaagaattataaaaaatccctataaagaaaataatgtagactgcattataatcttagtctgtggccctgaaaattttagtcactaccattagtctctacagacttaaccatgtcatgcttcagtgttcgccagttgtcaagaaaaaaatgtttcctggagaaaatgagaacagtcctacctttaagcaaattgattttgatgccttttgtcctagaaatgcacttgtactttattaatgttcttatgtggatcattttgttttgctggtgattttttcaggtaattctgcatgagggagacagcagtaaagaggggagtagtaaagagggaagatgtagaaaaaacactgctggatttagggtagacatagcttgaattactcaaaagcatattccccttcagctttattgagatatgattgatgaataaaaaagtatacatttatggtgcactacatgatgattttatatgcatatacattgcaaaatggttactaccatcaagctaattaacatactcatcaccttacatagttaacttttttttggtggagaggacatgtaagatctactctttttttgtagtctacagtttataattatacaaaacagtgttaactgtagtcatcatgctgtccatcagaattcaagaacttatttatcatataaccgaaagtttgtaccctttgatatttcactgtcttttttcagcatgtttttaatatgtttgtacctttttttttatttcatattttgtgattcctcttcaatctctttgcttttactctacaggtttggcttaggggaagtgtggagatgttggtcaaaagtgtattttgatttaagtttgaaatctttccctctattttccttatggtcgtcgttcgtttttctacatgaaagcagagaaatatgaatatatatatatatatatatatatatatatatatatatgtgcatacacagacacacatgtatatgaatgacacttttttgcattccctgttttgcccaaagctgatagtgaactgttatgttagaatatgagatgaaacatctgattcaggtcagcatgctcaaaacaaattgtagggcttcatttcctgaagtctttttcttattcatttcatcccagagaaatagaagccctctcatagcttaaatttgaagcctaggtgtcaacagaaccggtcactatgaaagtacaactgtaattaagtggtctgcaggtcatctcaacattactgcattgtataatgttctggggtgcatatctcaagctctttatttctgtttcttccctacacctatgtcagctttttcactgtgcaataataactcctatttatcagtaaaatagatgttttaaaacatgatattcttaaagctagtttgacaacttaaaaatagggaaatatgttaaacagatatgtttttaaattttccgtacgtttccttttatttgcctactccccactattgtagattatttaaaactgccctctgtccaaattgtatccttttggagaaagcattttaagtaggagaatccattaaacgcttttttctaaagctcaaactgagaggaaaacttttacatttaattaatgagaattcagctctttaaaagtttgatgacttttcaaacttatataatctgattccatctctggggaggaaaaaagacattttggttttattaaagaagaaatgaccaaaaacattgaccacacgtttgctgttaaagataaccgtacttaattcaacagaaatgggtttttcaccgagtctaaatgacctgcagcattatagaattggctgccattctctctcagtcagaaatcaggctgtggaaagccagaactcttctctacatctagtacaaagattgtgcttagggtttaaataaaatgaaaagaataaggtggaaaattagaatatgttgaaggttgaaagatttgattctgtgacttttacataactcaggaaggaaataacccaattcctctccacatttagtgaaaaagcaactcaaaaccatagaggctgagaactttctctgcatggcttttcaaacgatttatataaagatgttggagaaattcacaaagacctggataatgttggaaaatcttgtgttttgaagacaggacagagctgtatgatgcaacaatgccatctattggcttccaaggaatggcactgaccacagctagtttgtagtgtctggaaaaggaagagattatcagtttggaacatgtgaatataaacttattaatgaactagatgctatctttcgtattctttactcctgaatgtggaactatacatgatgcatataccacacacatataaacataatgcatagagatatgctcacctgcatcttcaacaatcctctccttgatgctagaagatgagcttgccttatcatcatactgatacagtagctgggttttgtcttcctgtggactagtagttgtcatacaagaggatgtgtttttaccagaactctttattcagggtgttactcatgtcttagtctcccctgctctgctaatcccaactgttactgtaatttctaagcacactcagacaaaaacgtacaggactggggcttctctcagttgagccaaatcaattctacttccagatattgcaatccagagtttgatagagaatttttggctgctttgaggaaagaataaaacatttgattgtgactgtcttagtttccttgtttgccctttaagttcattaaaagatacgtcctataagagtcagttgtgaaacctgtgcaatcatttgaaatgagagtatagatttaaaaataaatacatgcctgatatttacatgtgatttagaaaatatacagggagtacacatattatttcaaataatattaatactaagaggctcagaagtgccataacctaaaaacaataaagacatcaaaattgtttccctaaaatggaactagaagttaataaagcaatagttccaaaaactttttgtttttaaatattgagaaaatacaaaacaataaggattttgttgggcaataaattgggaggcattttcccctgattttcttaaagatggtcaaaaaaagtaaaataaaataataggttcccaaaattcttccattgtatgtagtttttaggttgatggttgcacatgtgtagtatagtttttgaacaaccattgcaaataaaaaatctgtgctaaaaataacctttttatttaataactcccttctcattttcatcaatttgatcacttgctttaattcatgggggttctaggtggcacttcaactgactgctactgattagtaatttaactaattgattgtcaaattgtaattattgctatgcagcataagtgtttacttgaggatagtaaggagtagccaagtctttcttatttaaaacacttacactaataagactctagtcaaacaaacatatttatttgaatactgtggctcatttgaaagcagaattaagttataaaacaataacccattgtattgtttctgctttctgagtaaaaacaaaatagcacactgtttcccaaacttaagtgcttctaggcccaccttgtctatgtctgccatgtctgattactaactgtggtttatacacaatatatttccttaagttgactctcattttttactgaaatatattttcaaaggaaattttatatcactttcataaatgaaaaaaactagaatatctataaatagtaaacaaccatttaaaaattgatcataatactactgttttaattaatataataaaccattattacatctaattgatttatcaaaaatgaaataacttcttcaggattaaaaaaatatatgtcatcagtcagcaataatgacatgtttggcttaatttaagttaaggaaaggttcttggttaacaggaagtttctatttttagttctaatgatgactagcagtgagaatcacaatttgcatatgtaagttttgaaaaaaataaacatcatttaactagttattgtgatagtgttggacactgaaatcaatcctggcaacatgttgtgagtgactttgactcagcaaatctttgtgtcaagaggccatttgaagcttctgctctttagaatgggctacgttatttaatagaatctatattaaccagtcattactgccatgttgcttggaaactgcaaagatgttatatcaagttacttagccatcttttcataaattttcattaaaatatgactgccaaacaagatcaatcaggtgaccttgatatattaggcttttctcatattgctataaagaaatacctgagactgggcaatttataaagaaaaatggttcaattggctcacaattccacaggctgtacaggaagcataaggctggcatctgcttggcttctggggaagcctcaggaaacttacaatcatggtggaaggtaaaggggtagcaggcagttcacatggccagagcaggaggaggggggtgggagataccagttacttttaaatgaccagaatctcaagagagctcactcaccatcactagaacagcatcaaaggggaaatctgcctccatgatccagtcacctcccaccaggcattggagattataattcgacatgagatttggtggggacatagatccaaaccgtatcactttgttattggtagttgtttgtgggttgaaagcatgaatgatagaaagacatgttctcaggatgcaggctgggataaagtagaagaacacgttctataaaggaacacttattatgtgttaggtactatgctaaatatgttacattaattatcatctcatttaatcctcactacaaccttcctaggtaggcattatttctactcctactttgcagctagggaactgagatcagacaaggtgaagtgatttgattagtctcttaagttaaacttactgccttggtgagcaatggtaaggtattagatgctacaggtctgctgcatacccaaaatcctgaactttggctccaggcctggtctgtgggtcccaagaaaccaaagtgtaggcgagcctagccctgagggatcattcccaggtttctcctcaacccttcttgcccagcctttccctggaaacccaatagcagagagcataatcaagaatgtataaatgtgattataaggagccagagcaagaaatatttcttttttcttccttactgtctacctcacctggtttaatattccctaccacctcattctcacagtctatgcacctatactttagtctgggtacccctaaaaaattatttcttgtaccatgagtgtgcatgcccccctttgggatcactgacgattaaaaccagttccaaatttacaagcctcttgggatatgtttgactcccatataaatgtagctattttatatatttttgtgtatatatgcccattttaatatatgatgaaaatgagttctctaaaaatgttaaaatatgtaatgcatttctgaaatttacaatgagtgcctttcaattcactatggcattgttataaggcggatttttagttgtatcgtagttgataacatattggttttcttttaaatttctagattttttgttttacttaaagaaacatctattggctgggcatggtggctcacgcctgtaatccctgcactttgggaggctgaggtgggtggatcaactgaggtcaggagtttgagaccagcctggccaacatgatgaaactctatctctacttaaaaaaaaaaaaaaaaaaaatcagccgggcagggcatggtggcaggtacctgtaatcatagctactcgggaggctgaggcaggggaatggcttgaacccaggaggcggaggttgcagtgagctgagattgcaccactgcactccagccttggtgacaagagtgaaactccatctcaaaaaaaaaaaaaaaaaaaaaaaaaaaaaagaaacatctatttaatagaaaacacacctaaaaactaaaaaaaaaaaaaaaaagaaaacaactactgatctcactgcctggtattaactacttttaagatttttgtgtatatctttctccatttacattgatttttaatttcagttaagtgagaattccatctcttttttatagctttcactttaggagtaatttactttagttgagaatttcacattcatgtatcttaaagtcctttctctttttggattatattattattttatttttagtatagacaaagtattcttgcttccccaacaagatatggaaattcatatattttgacaaaatatgatgctattttccatgtaaaggacagatatgttttctttgatttctttttctcatagacttgtttatcatttctcttgctctaaattttagaaaggtgttgtttttgccttcctgttaggcttcacctgaacagttatagtgatggtgtggaaggcaattcttactatattagtcatttgatggtagtctgcaacttcaggggctctgtcttaatagttttacattgctataattcagtggctttgaggtctagcttaatacccaaattactaatatatttaggattgttgaaactgcaaatgttcaagctttacctcaaacagtccacaagatattccctaggcttcagggtttgagaatcctctaaatgaacaaagcccattaatccatgctgtatcatagtgactgacacatggtaaactcaataaatttatctattttaagttaatagaattctggcaagattatctgttcattgcatgtataacatggtgaccttaatcttttgggtagaaataaatcagctatcacttatgattttctcaaggaataatggtaccttttcaaaaggataggttttatatactatgagatgtcctgatataatttgaattcatggcaatactgcatttgcctttttttttttttttaccatctttcaagagggctgcctagagataagaatttaagggccatgtgttgtatttttgctagtaccttgaaagaagtttttgctttgtttttaatggcaatacaaataaaatccaaaaatcctggacacatatgataagttcagttgtttatttgaaaagtaaatgcctcacatgccttgctcataccactttaaaatgggattgattgataaacacaaactctaactctcttacattaaagagtatcaacactctgaatttttaattatctttgataatccccatgaacatttttaggactcacacgtaaaatagtcaagtctatttcaagttatgtcagacaatgctttttaatatactgttcagtgcagcaccctaccaaaaactagtcctgtggttgctttatctaattgtgccttggtaagggatttgttaagagtggggaaaaaatacccccagaaatgctttaattaaacagcttcaaatacagccattgttcttacaacagaattgtgtaagtcttctccctgaagagaaatattgctgtagccaatatagctatacaattagtctatgtatattaatgtaaatataatttcattataaaaatgcttactcgtacagaatctaatttttatctgattattttttcaaacactggccagtcccatgagtgaaaatacctataatgtaaggtcagttgccaattataaaaaacattgtttagatggaaacccagggtattcacccaatgtggttattacttgtgcttacataatgaaatttgatcagcttgttttaaaataatctatttaggtcctagtattcacaatatctcttcccagaaataaagacttccttgaagaaagtaaatgatttgaactggaaaaacatgtaagaaatttaaaaaaattaaatatatatttattttaatatatgtatgaagaaagtttttcaagatgttatgatgaaattgattttctttgaggtccaaaatggcctttacatgaggtataggactaagattttagtaaaaagcacgtaccttggtcatcacagaattgttgggaatcattcagagaccatgtagaaatgtttcccagggtgagaaagactgaaccctagactaatattggctctgccaaaaataaaataaaataattttttaaaaattaaagaacttatggagggcacaccctttcattctgtgatttccacgtcaagaggtctcagtggagcatacatctgaaacaaatcatttaagctataaatttagtcactaagatcatctttagatccaacattgatatgttaatttatgaaatcaaaaagtaatatactttatagcttcctcctaaatcttagaaggtactggaacacccatactttgaccattcttttacgttcactaaatttcctaagagtgtcatggaaacagaagaggaatagaaaatctatcaggtaaccctgccctacctggcaaatttttgtgttgtagttgcttttgtttaacatttcttttatcagttaattatacgctgatagagattttagatggactcttggaactccaagaaaaaagaggttctgattcagatgctcttggaaatatagacacatttgagtgtcttaaaagcatacacgagacaaggtctattttccaaaggtgcagagcaagtactgaagcttctccacttgaaaacaacagtataaaaactaccattaaggccatttgttcatttgcccaaagtatccaaggagttgtttaagctttcagccccttatgcatttccatcaaatatgaatatgtgttgctccttctagtagttaagaccagtgacacccatttcttccttgatggtctatattttattgggtatttaattacagagcaatcaactacactgaaaaaaaaataacttgattcagttaagttcttaccccacaatgctcacaggctttactgattatacaccacctcttatgtgcaattgtctttggactaatcagatgtgatgggcttaatgttgtttttaaaccctaacaaatctggtcataggcaaagcaaacctgctaaagatgaagggactagatttaaatgaccttgctgacttccagacccttcttttgatcgtgggcagaatggatatgctcttgttgtggaatataactatgtatggatttataaaagtttgtcaaatgaaagttgaaagttctatattcactttacccaatttactagaaagggaaccaattttctcgttaattacaggctgttagaaaggcgtaatgaaatttcacaactgtccaactggtgcttgatgagaagattactatctatggatgagggttatgtctacagttctttaatctttcctttctttctttttttcctctatagtgtctcctctgtttctcccaaacatctgctctattccttttgatgtcctgttagtcatccccattccatgccactaccactgctctccttttacacttcctttcttctgtcttgtgtcttctacttactcattgcatcccctgaattgttgttgttgttgttattgctgtagtttaaacacatattgacctccatggttaccctgttcaccttttgtgtcaattcatcattttacaattattataatgtatcattttatttatttggaaataatatttatttggaaaaatgtatttatttggaaataaatgtttcatttccaagtttcatattagagcttggatactcaacttgtggtccttggaccagcagctgcaacatcacctagggacttgttagaaatgcaaaacctcagcctctaccctaggccttgagtcagaatctgaaattcaaaaagttactgaggtcactggtgtgcacctgagagtttgagaagcactgtgttggaatacattctcattaacagaagaatttacaaaatagtgttagttatttggtatttaatgaggaaaatggtaaaagatgtttagtcctttttttctcattacattggaagcatatgaggatgcagacatccttcttaactatttaataatgttttaaaaactttaatgtatggccgggtgcagaggctcacgcctgtaatcccagcactttgggaggctgaggctggtggatcatctgaggtcaggagtttgacaccagcctggccaacatggtgaaaccctgtctctactaaaaatgcaaaaaattagctgggcatggtggtgggcgcctgtaatcccagctactcgggaggctgagacaggagaatcgtttgaacccgggaggcagaggttgcagtgacccaagatcacgccattgcaccctagcctgggtgacaagagtgaaactgcgtctcaaacaaaacaaaacaaaacaaaacaatctttaacgtatgatggtattagctgtcatttaaagaagatttttaatcagtaggtcttgcaaacgttacgatttatcacatgtatacagtcaaaagacacaggtaaaaataaacttcaattatttcctttgaagtctgaaggccataaattatattatattgatgtttggttgataaatcaattatgtttgattattaataatactattataggtagtgtttgtggaaaatttactatttgacaaacagtgtacaaaacactttataaaagttaacttatttggtccttacaataacattactaaatttcaaaattacaactttcattttcagaataggaatctgaaggcaagtttcatagcttaaatagtgggcagaactgagatttaaacccaagtctgtctcatgctacaactgcagtttgtaaatcccatgtgttattacctccgttagtcgataatgtacagtttagttcatcagctatgctagtgatagaaaacaatgataccataacagcagcaaattataggcatttgtaaacttttcagaatgaaagttggtagttcttttaataatctcactggaataaataatctcccttcattttagtctttttatgttagacacgttttctccataatttctaagaccttcaaaacattgcaattatatattattaattattaatagcttttatttggtaactttgtaattatatttatatgagtttctctcctcagtattatgtattaggccgggcgtggtggctcatgcctgtaatcctagcacttagggaggccgaggcgggcagatcatgaggtcaggagatcaagaccatcctggccaacatggtgaaaccccgtctctattaaaaatacaaaaattagctgggtgtggtggcatgcgcttgtaatgccagctacttgggaggctgaggcaggagaatcacttgaacccgggaggtggaggttgcagtgagccaagatcgtgccactgccctccagcctggctacagagtgagactccatctccaaaaaataaataaataaaaactttagacaaatttaatattccaggattaattgagcaaataatgatttacaaatcagacagccctcagaaccaacagaggttcagaaatctccacttcacaatgtggacaggcagcctttatggacagaaaacagaagagctgtaaagagaccacttgatgagttacagtctggagcttgcctcccttgaacatggtatgatcagttggctacctgtgattgactgaagttcacctactagctactttgattggctgagactcagctagttgttatgaaagtctactcctgtggtagactttcagttagtttacatactaagttatattgtagtttgttacataaggactcaagtacagaggcatgcttaagtcaaatttagtttaacatgtggtagttagacccttagtttcagagtccaactcttcgggttctgatctgggctttagcatttattagatgggtgaccttagacatattagccttctctacttcaaatatctattagccttctgtacttcaaatatctcattgttaaaatgaggatataaaaaaggcacttatctcacagttttgttgtcaggtttaagttagataacttatgtaaattgcttaacacattgccttacaaaaattaaacactcaataaatagtaactattactattatattttgaaatattgacaatagagattttatcacatgcatccttttatatgtgaatgttggtatacaatgggtagttttgggaatgtgtataactgtaagcatgggcaacctatcagtaacttaaactgataatggcttattttatcatataaaaagaaatccaaactggggtttttgaaggaataaataaaattaacaaacctttagccagactaactaagaaaaagaggggaaacccaaataaataaaataagagatgaaagaggagacattacaaccgataccgcagaaattcaaatgaccattagaggctactatgagcaactatatgccaattacttggaaaatctggaagaaatagacaaattcctagacacatacaacttaccaagattaagtcatgaagaaattcaaaacctgaacagaccaataacaagtaatgagatcgaagctgtaataacaatcttccagcaaagtgcagcttcggactcagtggcttcactgctgaattttaccaaacatttaaagaagaactaatactaatcctagtcaaactcttccccaaaatagaggatgaggaaatacttccaaactcactctacgaggccagtattaccctgacaccgaaaccagacaaagacacatcaaaaaaagaaaactataggccaatatcccagataaacattggtgcaaaaatcctcatcaaaatatgagcagacataattcagcaacacattaaaaagatcattcatcagctgggcgcggtggctcatgcctgtaatcccagcactttgggaggccgagacgggaggatcacttgaggtcaggagttccagaccagcctggccaacacggtgaaactccgtctctgctaaaaatacgaaaaatgagctgggtatggtggcggacacctgtaatcccagctactcaggaggctgaggcaggagaattgcttgaacccgggaggcggaggttgcagtgagctgagatcgtgccattgcactccagcctgggcaacaagaacgaaactctctcgaaaaaataaataattaaaaaatatcatttatcatgaccaagtggaatttatcccagggatgtgaggatggttcaacataggcaaatcaatcagtgtggtaaatcatatcaaccgaatgaaggaaaaaaacataggatcatttcaattgatgcttaaaaagcatttgataaaattcaacatcccttcatgattaaaaaaaaacacccttaaaaaaaactgggtatagatggaacgtacttcaacacaatgaaagccatggatgacaaacccacagctagtatcatagtgaatagaaaaaattgaaagcctttcctctaagatctggaacatgacaaagatgcccactttcaccactgctattcagtgtagtactggaagtcctagctagaggagtcagacaagagaaagaaataaaaagtatccaatttggaaagagagaagttaaactggccaggcacggtggctcacgcctataatcccaccactttgggaggctgaggcgggcggatcacctgaggtcaggagtttgagaccagcctgaccaacatggagaaaccctgtctctactaaaaatacagaattagctgggcatggtggctcatgcctgtgatcccagctactcaggaggcggaggcaggagaatcgcttgaacccaggaggcagaggttgcagtgagccaagatcatgcctttgcactccagcctgggcaacaaaagcaaaactccatctcaaaaaaaaaaaaaaagtaaaattatccttgtttgtagatgatatgatcttatatttggaaaacactaacgactccacaaaaaatattagaactgataaacaaattcagtaaagttgcaggttacaaaatcaacatacaaaaatcggtagcatttctatatgccaacaatgaataatctgaaaaaagaaatcaagaaagtaatcccatttacaatagctacaaataaaataaaatacctaggaattaaccaaagaagaaaaaggtctctacaataaaaactataaaacgttgaataaagacattgatgaagacacaaaaaatggaaagatattccatgttcatggattggaagaatcaatattgttaaaatatccacactatccaaagcaatctacagattcaatgcaattcctatcaaaataccaacaacattcttcacagaaatagaaaaagcaatccaagaatttatatggaaccaaaaaatacccagaatagccaaagctatcctgagtgaaaagaataaacctggaagaagcacattaccgagcccacgttatgctacaggccactgtaatcaaaacagcatggtactggcctagaaatagaaacatagaccaatgaaagagcatagagaacccagaaacaaatctatacatctacagtgaacttatcttccacaaaggtgccaagaacatacattgagtaaaaaaccatctcttcaataagtggtggtgggcaaactggatatccatatgcagaagaatgaatctagacctctatctcgaccatttacaaaagcaaaatcaaaatggattaaagacttaagtctaagacctgaaactatgaaactaccagaagaaaacactggggaaactctctaggacattggactgggcaaagatttttagagtaataccccacaagcacaggcaaccaaagcaaaaatagacaagtgggatcacatcaagttaaaaagcttctgcacaacaaaggatacattcagaaaagagaagacacagccccaagaatgaaagaaaatattagccaactatccatgtgacaaggcgttaataaccacaatatacaaggagctccaacaattctatgggaaaaaattaataatcaaattttaaaatgggcaaaagatctgaacagacacttctcaaaagaagacaagtaaatggtaaataggtctatgaaaaggtactcaacatcactgatcatcagagaaatgcaaatcaaaactacaatgagatatcatcccaccccagttaaaatgggttttatccaaaagacaggcaataacaaatgctggttaggatgtggggaaaagggaacccttgtacactgttggtgggaatgtaaattagtacaaccactatggagaatagttttgtggttcctcgaaaaactaaaaatagaactaccatatgatcttgccagccccctgcaaggtatatacccaaaagaaaggaaatcagtgtattgaagtgatatctgcactctcgtgtttgattactgcactactcacaatggcaaagatttggaagcaacctgtgttcatcaacagatgactgaataaagaaaatgtggtacatatacacaatggagtactattcagccataaaaagaatgagaccctatcttttgcaacaacatagatgtaactggaggtaattatgttaagtgaaatgagccaggcacagaaatagaaacattgcatgttctcacttatttgtgggagctaaaaattaaaacaattgaactcagggagatagagagtagaatgatggttaccagatatgagaaagggtaaattgggagggggagtgggagtggttaatgggtacaaaatttagttaaatcaaatgaataagatctagtatttgatagcacaacaggctgactacactaagcaataatttattgtacatttaaaaataactaaaagaatataattggattgcttctaacacaaaggataaatgcttgaggtgatagatatctcatttactatgatgtgattgtcaggtattacatgcctgtatcaatacatctcatgtaccccataaaaatatacacctactatgtacccacaaaaaaaaatttaagaaaaaatctaaaggcaggcatatgagaactgatgtgccactaagcattaaggtttctttcatttttctgccccgctatcttttaatttgtaagtttcatcctcatgttcacagaatggctgcagtaagctggatattacattcatatttcaggaagatatgggggagaagagcaaaaggggaaatacaaaaacctgggaatgatggggaatgctatctgagtctgtccatgctaaaaaatccttcctggttttcctatgaaaagatttctgcttccatcatcttggcaaaaacctggctaggtagctacccctggctgcgggaaagtctaggatggtaagtattttagttttctattctctatataaaggaagacattggaattgaatggctttggggtaattgattcataatatctactatagtactcattaatcagtcagcagccagtcaatgaaccaaagaaaaaagtcaatatgaaaccctttaaatgaagcatatcaaacctttttaaacaaaatgaaattcatgtatatttaaatatgatgatccctcttacccagtattttgccactaaagtgttagaagtaaggaatgaaactttacacagataatttattttggcagcattgctatggtgctaggaaaaaaattgtccctagaacagaccctgaaaacaactgctcatagcaaatactcataggtgtttctgctgctacagataatcacagaagttgccagaaattaaaatgtgcaaaggataaatacaaatctttctcctttgcaatgttggagagatcttgcttcttttttaacctccataattttgttgccctgttttgcagcatctttgcaatgtttctgggacagctcagtcatcaccatctcaatctcattcaccacagaacaagtgcttgtcaattgtaaatgtgtaatctcaggaaattcttgcctgctctcttcatctctggccatttgtcctccaacccatccattcatagtgctgttataagcttcccaccccagggttagtaatcttccagggctctgtttcatccagaaagccatcaatgggctgtacctgctgcagggggatctttcactttccacacccttacagcctcacatttatgaaagtcttctccaaaaaatcttccttattctattttgaaggaaataccttctacctagaatatgtttcattaatcctcaaggcaagatataattcttccatcaacttgacttgaactaaactgacaccatgctaattttttctttccattctttcctcattgtcaatatgtttttactgattccttgcttcattcattgattcatctggcaaatactttttgagcatagaatatgtgcgagaacttttgtgaaagataggatttatagagatcaagaaaatttagggcatgttctcaagggggtcacaagcttttgaggaggaatgattctacgtttatattgggatagcctctggtgttttggaagtcttgagctgtaaccgaccaacctttcattctccctttccatcacccctttgccaaacacacataccttgctatgaaaaattcttaagggcaacagggattcattctttccttttcttttggctttacatcccgttctacaaggactcagtgggattctaaaaaaaaaattattttttctaaaatattctggaaaaatatttggaataaaattgagatggagtgagataaggatattttcttgacttgtgagaaaaataacacaaccaaacatcatacaatgtgattcaatgaagattcatgaaaaaaatacaatttcaaacttcagaaattaaaaataatagacctaataatatttccctttgtatgtatgtggcatgatgttgttatattacttggtagcagagtggaaatttgagcataatctaggttgagagaaaaggtcattattcttagttctgtgtttttccaatatactgtgttcttcaaaatataccaaaaattataaatcagtaataattgatactttgtacagatttttttattttatattttcttgtttctcttgcaatatcttttctttgattttttgtttgtttgtttgaaacacgtatttgccactgttcaactcttacacctacattctcttttgcttactgaggggaaatgggccccataaaataggtgtaactcagtatctcagttcatgttcaaacatgtataaagatgacctctttttctattcttgagcaaaaactaaatgctcatgatatattcttttatgtaaaatctagttattcaagttaagttctaaatgaatttttcttcatcttatttaagagtaagtactttttttcttccatagtactaggtaatcgttttcagtgatctgaaatacttacgaagaagttaggatctttgcaactgtttgaatctcaaattattatttgttctctgttggctgtaagagctcactcattggaattacaaaaccctttctctttatagctgaaagcgtttaatgtatgcaaacttacatttggcttgagaacatttttaaaaataaacttttcaaattggaatgttcttactgaattcaggcttttatgatgctgtttgatttggcatatgttcctcctgatatctgcattgaaaacactttgcatttgagagacttttcctgccttattgggacatttcaactcaatttatagttatcagtaggaaaagaaagaaaacatttccatccaaaagaggtttcagtaggatttagcagtaagtgctttaaaaagaacaacagcagcaagcttgaacctttgcccattaaaaaaaatatatcaaaaacaaagaaacattacaagattctctttccctttttaaaggatccacagaaggaaggttcttcctagtctatttgaaaatatatcagacttactcaagagactttttttgtctattttacctgatccacttacattcagaatcagtctgaatttattacacaatgttacgtttactgctaaaatgctggtcgttggttcaatacttggatccttcagagagagcacatatccatcaggatgcatttggctttacgtaatagtcaatttttggaagtttagaccatgaagatgactactctttacttaacagaagtctggggtaggtgttgctgtggttggaaaggtgcatgtatgataggtggacagctccctgtttctttataaatggcacatacctggagaactagcacataggtagctcaataaacagaatgttaccaggacccccagaaactccctttttattctgttttggttctcactctccaaaggcaatcagcgttcagagttctgacaatgtaagttatttttcctatttttgtaccttttataaatgcaattatgcatgatatactcctttgtgtcaggcttcttttcttcaacattatgcttgtgagatttactcacactgtggcttgtagttgtagatagttcattctcattactgtatagtgttacagtgtcagaaatatgcaccaatttatatgtctattctactgcttgaggagtttccagtttatggctattacaaataatgttacaatgagcattttgtttttgtttgtttgtttgtttttttgagacggagtttcactcttcttgcccgggctggaatgcaatggcatgatctcggctcactgcaacctccgcctcccaggttcaagcgattctcctgccttagcctcctgagtagctgggattacaggcatgcgccaccatgcccggctaattttgtatttttagtagagatggggtttctccatgttggtcaggctggtctcgaactccagacctcaggtgatctgcctgcctcagcctcccaaagtgctgggattacaggagtgagccaccacgcccagcctatacaatgagcatttttgtatatgagcatttagtatacgtctttgagtaaatacaaacatacaattcggcttgatatatatctaagaaaggaattactgagtcatagggcatacatatgttgagcttcaatgacgctgaagagaaaataacacaagcaaacattatgcaatgtgattcaatgaagattcatgaaaaaaatgcatttcaaacttcagaaattaaaaataatagaccagttttccagagtaagacatctttttttttcattcttagatcatattttgcgttttgtaaatgcgtttcccaatcagcagggaaaaaaatataatatgcaaactaaagcatgtatacaatgaattgcatttagtttaaaacaaaagatttgaaaaacgtaggaggagagagttatatttgtattagttcacaaaagaacatattcaaaaaaaagcaaataattgtattttgagtgtatcatagagttaaaaaggatggagtcaggctttttgaaaattgacttgttttccttctccccttttaaagaagataggttattgaggaaaaataaatttttgtcatttcagagagtacctgttcttttttttttttttttgtagaaaataaaacccacctataaaacatgaagattaagcttggggtagctcaagggaaatgactcaaaccatccaaacacttgttttttcttttttcagtttttctaatgtaaagttaaatcattaaataaaattttggtagctatatttaagtctcccttattttattttttagtaatattaaattattttaggacgcctgattttgtggtaagaaacatcaaaggtcttgatataatttttgaccgatgggctttgaatcaaccaattctagcctgtgggtagaggacagagcactgctgtctcttgcatattaacctttatggggctgctggagttgtggacattgagtatatagtgctagtttgtactcggattgatttattttcaaattttcaaaagaatatctaagttcaatgatattcttttagtttatctctcactgtcaaaaagtctcctccaatgtcattttaagtgagaaagttaaatgatattttgaaacactggcttggggaaaactgcagttcagtttgcttcaatgagaaggaaaaataatttccaatattagattacagtgaaaagaaatataaaagagagttttactggaaggtctgccttttatccttttaacgtttcatggaactagaataagaatatcccattttgtctaagatgtacctttaagcaactttttaagcctcaaggcacttatcttatacattgtgctcttcagctgtattaccagaagtcttttgtttaaaaaagcctttggtaaaattcttcaaatatgaatttaagcctgaacaacaacaacaaaaaggtacttaacattgctgcctttctttatgtaatgatcaagtcctcccatgttctcctttatatcagtaagccattttcttgaatccctttctaaaatgaggttaaagaaaaatgtgacataaatcctatatgtatgttctgatttttaaagggtctttatctttacttttactggttcgaatatagaaattatctcctcccgtttccttctcctcaattagctgccaatggtctggaatttaacgattttacctcatgtgattctatttgtttgtaatcctatattcaacattgtactgaagtctgttaaacattgataagccggtttttatgcagcaggtcctcagagagcattgcactaaaatgctgcaaagactgggattaggtttacgtattgtaaggtggtttcgagacgttttcctagtgtctgttctttcaaaggtgccaaatcaagttggccttgatttaatattgcgaaaattgtaatgctgagctgacttggagcttcacgtacttcaaaacgagtttttccgggggtgatttaacaaacagttctaattttttgagtgctgccgaatgtaacgcacatatgggacattattgtgtagtttctgtgagacgctgaactctttgccaaaaacttaagtttctttcattgctattcaagttataccttcttctgttatctcttgccaggattccaacagcctcagctgatactggtttcatttagtaaggagagtggcattggattgtatttcttctgatttttacaaaataaaaatcctcctgcatcccatagataaccactattagcatttgggattatatctttttcatatgtttcctataggtagatataaattttgaaaaaaaaggtattttgtttgaaagattcttttgtaactcactttaaaaattttttattatgtaatcatatatataaaagaatatatatgcatatatgatacaaagaataataaaatgaacacctgtgtaaacaccacctaccttacagaatagtaccaatgttttgaacccccatgtgtctctaccaaatgttcatcttttccctatcttgcaaagataactgcgcttctgaattttgtatttgtcattctcttcctttaaaaaaactgtttcactaaatacatacgtgttcctaaataatatattgttagtttgggtgtgtttttgaactcgatataaatgtgataatgcatataatcttttctgactcgtttataattccacattttctccgaggtgcctccacactgatgagtacactggtagttccattgttttgactgctatttagtattgtatgatataaacatatggtgctttttacttaagttcttgttgatggtgggtggcttgatctcaacttttgcactgacaagcaatcgtcttatgaaaattcctgtatacgtctcctggtgcacatgagcaagaatttcttcagggccagtgactagggatgagactgttgggttattagataaatgcagtcaaacttcaaggcgatgccatattattttccaaaatgattcacaaataacgctaagatgtcattgtgtcaaagtttctacactttcctcgatccttaatattgttctaaagccttcataaaatactatctcattgaatttacatttccctgatagtgatgttgcacatcattttataagaggtaactatctgtccctcctgttctgtattataattttcatcagcttttatattgttaaatattttctccctgtttgtaggttgtattttcacttttcttttttttttttttttttttttgagacggcgtctcactctgtcacccaggctggagtacagtggcgccatcttggcttactgcaacctccatctctcaggttcaagcgattctctcacctctgccccccgagtagctgggactacaggcaggcaccaccacgcccggctaatttttgtatttttagtagagatggggtttcaccatgttggccaggctggtctagaactcctcaaagtgatccgcctgcctcggcctcccaaagtgatgggattataggtgtgagccatggcacctggccatattttcactttattaatagtataatttgaagattagaagttcttaattttaaatattatcaaatttattgttaatatttgccttaacggttagtgatttgagtctcatttaaaggattatttcctaccctaagatcatacaaatattctccaatattttcttctgtaatgttaatacattttctgtttatctttataatctaccaggaattgagtctttgaatggtgtgagtgatttgatttcttttttttttttttcaataggaacagtcaggttttccatcactgcatattgaagagtctattcttcccctactgaactgcagtaactaccctggtcctgtatcacatgtattagaatagaaccagctgctataataaatattcgccaaatgtcagtgacccaatacagtgtgactggttttagtcaatgctttcctccacttgcttatttaatgacccaaggtccttctctttcatgtctgaccattcactaggacattatagtctactgcagccagctggcagatggaagaagaaagggtagagaaggcatgtcaactttggtttttttttttttttttttttcctgaggtggagtcttgctctgttccccaggctggagggcagtggcgagatctcagctcactgcaacctccgccccccaggttcaagcagttctctgggcctcagtctcctgagtagctacgattacaagcgtgtgccaccacgctgccaccatgcccagctagttttttgtatttttagtagagacggggtttcaccatgttggccaggctggtctcgaactcctgacctcgtgaacctcccacctcggcctcccaaagtgctgggattacaggcgtgagccaccgtgcccagtcagcatgtcaacttcttaaacaccttgtttagcaagtgattatatcacaaccgttcataatccattggtgaaaactagtcatttagccctatgtaaatgaaaagattgctgggaaatgttccctgatggaaagcagcttctcagaagcatctctatctacagtgtgggataatatgaatttggggtgtttagctagctgtctcaattatatcaagttttcgtatatgcactggtctttgtctggtagggctagtccctcctctttattgatcttcttcaagtgtgtctcagctattctttgtcccttttcaagtatcacaaagaaaaaagtcactgtttgaattgggaagctctgaatctacagggcagtctggaaataatatatttacataatgaggctacttacccattagcagtgtacctctctgtttacttacatggtctgaaatgtctttcagtatactttacagtcttattcaaaaggtcttatatcacttttgttggatttattcctagagattctgcttttttgctactattataacctgccttttctaaacttccctttcatgtctgccaatacatagacatgaaattgatttttgtatgtaaattttgtatcttgacatcttggtttggtttgttattaattccagtaatttgtgttcagaacttttggagggggcttgtatgcagatgatcatattatatatgaataatgataagtttttatttctcttctaatttttatcttttatttgcttgtctaactgaaaagcagtgataggcatctttgatttgttccttattttagagggaattattttgacatttcatcatcatatatagtttgctctagtttttttgtaatgcattatatcttctttaatacattgcgtgattctgtttgccaatatcttctttagaattttccatttatgttcacaagtataatattagtttatgattttctgttcttatactgttctgtgcttagttttggtatcaagattattctagcttcattttggagttgaaattttcccattttctgtttcctaagaatttcttatgagtttggaatcatctgtttttcaaaagtatagtagaactcacccataaaaccatttgaggctgctgttttctttaagaggacattttaacgctaattttgattttctaatagttaaagagcttttcagttttctcagctcttcttagatcagtgttgataaattctgtgtttcaaaaaatgtgtttgatttattttagctttcaagtttatgggcatacttccttcatggcttttaaatctcttgtgagaatatatgcacacctcttccctttattgatgtcttctttccttttgtcctgatcaatttttcaagtaatttaaaattttgtctcttcaaatattgtctctttaaatattggatattttgaagttctatattgatttctgcccatttatttttttttctgctgctttattagtatttgtttggtttttcttttgttggtttgtttgtttttttgagacggagtttcactcttgttggccaggctggagtgcagtggtgtgatctctgggctcactgcaacctctgccttctgatttcaagcaattctcctgcctcagccgcccgagtagctgggattacaggcatctgccaccacacctggctaatttttgtatttttagtagagatggggtttcaccatgttggtcaggctggtctcaaactcctgaccttgtgattcgcccgcctctacctcccaaagtgctgggattagaagcatgagccactgagtccagcctatttgtttttccaattaagtgtttattatgtgtatttatgttaactttctactataaatattacgaatttttaaaattattccttaaaggacctcaaatattttgctcatttacttctactatgtttacatttccattatgatttcttcttttacccatgaattatttggaactgtatttttaaattttcaaatgtattttcaggttatctgtgttatttctgtctaatttgattatattgtatggtatcaattttttaaaattctgagaatgttttattgcacagtgcatgacagctttctgcaactgtttcatatgtgcttaagaagaatgtgttgagtacacatttggaaacgtgatttttgcaggttcattaaatcaggcttgttgattgggttaatgggatcttccacatgcatgtgttgaaatgacccactaagctcccagatttgattagttaccttgtagttctgtctgtctagtttcccctatatatgcggaggctgttttctgaactcatttaaagtttggaataattttattcaccaggaggattgacctttttattgttatgtagtcttttgtctgatatattattatataatttatatgttagctttcttttagtttgtattttcctggcatatctttagctcgtatcctcaagttttctgttctcggtgtttatatgtctctctctcccttataaaaagtctattgctggatttaaaaaatctgtaactccacagatatcctgtctgaccacttttgcctttcatatagggcttttagttcactcatattttcatgtatatttattacaattacttttatacttgaacttatttatagcattatattttctgatgttgactttctttgtctttgctcctctttttccttctttactgccttctttttgagtggttgagttttatattcttactctaattttccttcttccattttggaatttgtgcactctttctattattttaggtgttactcttaaaattttactatgggttatttagcaaattaaagaataatcaatggtttagtttttctttccagataaattaagaacctttatgaataataacttctctctcattgtacccgttctcattatccagtgtttagttctattttgtatactttaatcttcaatattacatattatagctatagttttatataattaattttatttaaatgtattcacatgtttaccacactctttgtataccatttccaaaatgcttgggtaagaattgatactttgtccaatagcaagggggggattatggacatttttcatctgaggaaagacatgatcaaaatgatactttaggaagattaatctgatgcagtcaaaaaagaatggagggaggaggagatgataagtagaaacacaaattaaaggctatgacccgggaacttggtacaatgatttgaactagaggggtggtaaaggagaaaaggagtaagaacaggaagtaaaagtcactgtgaaagaggaatacacagaaattaacaagtggtttgcttgaagtattgaagaaaacaaaaataagaatgagatttttgaaccaaggttactgaaatattggtgaaatattagcaagtaggaagtcagagaaaagagctgctttcaggagaaagataaagaaatgcccatggcatataccaatgatacactcagcacagaggtctacatacaacagagtacttgtaaatacaatagggtacttgagagaagttaagactggggaaataggtgttatagtggtaagcatatatgggtcattagtggagaaaaatatcgaagagagtgaatgatgtcaaataaaagtgctttgtgtaatgttggacagagatatacccccaaagaaaatgttcaaattttgaaagcccaacaagagtcagcactggagatacagaagtcaagtcagggagaatctgcttttgtggaatatcatctatatgtggtactgagatagatatttcatatatattacctgatataactatcaaatgaggaggtggtatggtaccagtggaggagaatcattcaaaaagaacaaggtgttcagcagtgtcaaacgatgcagaagcactaagatgagaatgagaattaaagaagatgtaattgtgtgattaggatgtgattgaaacgtttgcagataatgagttcccagggaaagagacagaaacaaaactgtaaggacttgatatggaaatgaatcctgtgccagtgaacactgaaatgcaaacaagacttaataattcagtgacaagggattgtagcaaggctcagagaagatgcttctgatttaaaatagaatagctaagttatgtgacgaccatactgtctatacataatagacactaaatttatttgttgaatgaaaagctaagtgttcagagtttgaaaaataggaaccagagggaaggacaaataagcaattgaaagttactgaattgataagttctgtgatttaaaaattccagcaatatctgtaagaaacacaacttcgtggaattctacagataaagcacaagctttggactttttgtgatttcttttctgtacgtgtttttaaatgtacagcaagtgtaggaagataagcgttgataaaacattacttgagaaatgttaatttgctattaataacaattgacatttaccattttaaaggccaaagagaggtgaattttgataaaagataggttcttacttggaaacgtgtatgcaagtacactgaagaggtcttcttaatatagcattttataactcatctcaaatgttagcagccctgtttttcattcgtttccaaaactcatcaaccccagtcataataccagccacttaatacagatcccataagtctgtcatgtgttgtttacttaaatgtgactgtttctgatgacttttaaagtccccaaagcagttttgtccacgttaattttgctctgtatctcagcattcattgcagtacctattgaaagtgatttcactagcataagataaaaatttgatgacacatttaataggcttactctcaaacaacggattgactcaaatattatcaacaatgcaaggtgggctcttatgccaagatgtgttcggtttttcaaattttaatctaacgcctgaaatttgtgttgcataaatgtttgtcttattctgtgtataacatatttgcatatgtatatttgtgttctgtataagtacagaatagttaaaatgtgttctctctatgcttacataaatgtagcagtgagatattgataatagcaataatagctacatttattgattgttaagtgcgaagctctgataaaaatgttttataggtatcattgtacaaatcattcaaataaacttctgtggaacatacaatggttattcctattttacagaatggggtgaataaagggacacagagaagttaaaataatttactcgtggttacagagccaggaagttctagagctagatttctaacccatgcatgctcactctattgtgtacccagtaatcaactggatatactgtgattttatattaatcaaaatgcaaagatgcagaagttgtgagaaaattccctatctctagccatttattttcctgaataaaaatacatctataaatttccccttatctgatgacatcttaaggaaatggtcatgtaagccaagaatatatattatagtttactactaagttgttagaacaagctaggcaccagtttatatagtctagaacaatatactcaagtactgatgcttattatgcccaggtggtagtggcattatttgagaggttatgttttgtgtgaaatttctactttaaaaaaaatgaatttgttttgacaaaaaatataaaatgggcaagagattttgaaacaagtttacctagatttgcaacaatatatgttagaaactgtttgctttgattatacacacatatatgatatcctaacatgtatgaagcaattctttagttgatagtgacttatcttaaaaatgtataatccaagaatcatggagcattgtatttagaatttaagagtatacattttaacaaaacacataagaatataatttttatacaaaacgaccaaaactgagtctttaggatcatagtttaaaaaatgcaatatatgttctcataaatatatgtaaatatgtatcatatatagtaaatatatagttacataaaatacatatatttacatagatgtaaggatgtataaaatgtacccttaaacatgtttaaataataaaagaacacataaacattatacctacatttattttattctatattctataattctccaaaagtgggaaccattttcttacaattacttatggacccaaattcctcaaaattaaaagatcatttcattggcacacttacaagagacttagctgacaggggtagtttttaaaatcaaattaagtggactccagtttcagattcatcagttaaggagcttagaaattaccactcaattcttaacaagtaaaaagctgaacaaattgaaaatcaacaacttttctcagatctgtcagacaactgaggtcacagggcaaaaagctgcccccaaaattgcagaaacagattgatggatacaaagaatcacaattttctgagcagaaacctccaagggaactagttccagggtacaaaaacctgtaattgacgaatctttggaggctaagtgtggaccaagtctgagagttaaaaactacaggacagcccagtcataaatcatagtagggggctgatgcttttgtgagttttaccttcaggagccttaccaagtcctaatagtgagcatcagagaaaaatccctggtgcatccatcaaggaaagggggaaaatacagattttgaattatacacaagataattctgttgttagcaaagtctgcccttaggagaaactatttttccagaccctagccttatggggtttaatcagagcctaacctacctggaaggaattgaaataattcaacttcagctccttctagtattctacaggggcatagggaaataacaaattccaccccgctctggccatcctgcccacccaaagagggaaagaaaacaactcagactcacttgtgaagctaacagtctaatcacacagacttacccaagatagtttcttttgctgtgcagaagctctttagtttagttcggtcctacttgtcaatttttgtttttggtgtacttgcttttcaggactttgtcataaattcttgcccaaggcagatgtctgcaatggtgtttcttaggttttctgctagaattattatagcttagagacttacatttaagtctttaattcatctcgagttattttttatatatggtgaaagacaggggttcagtttcattcttctgcatatgactagccagttatcccagcaccattgattaaataaggagtcctttccccattgcttatttttgctgatttggtctaagatcagatggctgtagatgtgtgactttatttctgggttctgtattctgttccattggtttatatgttgggttttgtactggtaccatgctgttttggttactgtagccttgtagtatagtttgaagttaggtaatgtgattcctctgattttgttcttttcacttcagatgactttggctattgaggctattttttgggttccgtatgaattttagagtagtttttttttctaaaattgtttcaaatctctacaatgtcttccagaagctagaaccagaggaactagttcttaactcattctatgaggccaacattaccttaattacaaaattagtcaaagacattacttgacaagaaaaatgcaatccaatttctctcaagaacatagacgcaaaaatcctcaactaaatattacaaatgaatccaataatgtataaatagcatcatgcatcatggccaagtgggatttatcccagttatgcaaaactggctcaacactcaaaacttaattaatgtaatctaaaatatcaatggactgaagaagaataatcactttatcttatcaatagaggcagaaaaagcatgtgacacatcccaaaaccctttcatgataagaagtctcagcaagtagggataaaagaaaacttcctcaactcgataaagaacatctacaaaatacctacagctaaggtcatagttaatggtgagaaacaccaagctttcctgctaagatcaggaacaagacaaggatgactccactcaccactgcttttcaacatcatactggaagtcttagctaatgcaataaaacaacaaaaaaagaaaataaaaggtacagatgctccttgatttatgacaaggttacatctgcaaaaacccctgatcagtagaaaatattgttaagtcaaaagtgcatttttcaacttaccatatttttcacttattgatgtgcttatccagatgtaacactatcttaagttgaggagtgtactgaatgtgtatcccttttgcaacatgataaggctgaaaaattgcaagtcaaaccactgtaagttgtagactatctatatagacagggaaagaagaaatagaattgtctttgttttcagatagtatcattgactatgcagaaaaccctaaagaattgacaaaacagcagcagcaacaataacaaaaaaacacctggaacatttccctctgatcctagacagaaaaggttctccacctttaggtccttaaggactcatgtgattcagttgagaccactcagataatccacaataatctcctcatctcaaattcttaaccttaatcacgtctgcaaagtcccttttaccatgtaaatttgcatgttcacaggttgccaggattagaacatgaacattttcgcaaagggctttgttttgccttctatatccagtcaattacttccagttaaaaaacttatttatgttatataacacttgatatttgccaggtgttatgctaggtgatatttaatattttaaaatatctgtgaaattagtgatatcagccttagaaacatagatggaggggttggtcaccactcattatttaatgtaagtaacttatctttgtgtttttatgtaattattctctgaaatactcttattcaacaagcaagagtattcatccagcattaggaaaatattttatctttaaatttaactagaactataacgttttagaagtaggccatcactatttaaactcttaaaaagtcatagttaattaacaccctcatatgggtctttgattatcgctataataaaatctccatttatagataagagcaatgtgcatcacatgtaatgtaaacctgtattaatagattagatgaaatattattttctaactgtaagagttaattactctgaacaattccacaataaatagtcatagaaattgatttgggatatatacatctctctctctctttctctctctctctcacacacacacacacacacacacacacacacacacacactcgccccccccacccccaccccacccacacacacttctttctttgcttcttgcctggctgtaaatcggctatttttccatatcccatcatgagcctaaagggaaacatttgtatatttcaggctcctaggaaagcattttgaaaattcatttaacaaaattgggcaatatcaatgacttcaaaattagcaatggcagaaaagaagtagtaattaatagcagcggaaggattaaaatgtgttaagattaagttaaacatgtcgttgaatcactgtaagagactgctgattgcagagcctcttagtgtttgatattactctgacttgatgctgtggaattatatttctgaaataaatagttcttagttctgaggttatgctaaaggacatgttcaggaagagctttcctttcttactgcctagtcatacccttaggcaaagaagcagtaattttgaagggacaatgtaaaatagaagaataggcaatcttggatatgtgtagtttcacatttcatgtttatagatgtaaaagtattatgttaattatagaatagcacgttttatttatttatttatttatttatttatttatttattttttgagatggagtctcattctgttgctcaggctggagtgcagtggcgcaacctcagctcactgcaatctctgcctcctggtttcaagcaattctcctgcctcagcctcccaagtagctggaactacaagtgcctgcccccacacccagctaatttttgtacttttagtagagtcggggtttcaccatggtggccaggctggtctcgaactcctgacctcaagtgatccacccgcctcagcctcccaaagtgttgggattacacccggcccaatagcacattttaaagtgaatttatgttcaggtaacatgaatagaaagatttcttgaagtttcaaccagcttctgaaactttgtaaacagattaaataaaatttgatgattaaaatatattcagttaatacatatgaaaagattcaactgtaaaatatgactaaggcttcccgctaataaatggcattatgacgaaatctgtagtaaactgtgggcaatgtatatggatatgattttaaaatcatgagaaagctcattactgttggctatgtcattatagcatgatttttttccttataatatgccaatcaagagtaactatgttatgttaaaaggagaaaatgtggtgttttaaaagtgataaacctgatgtatttaaaaattttttgagatttcctctggagctgcactgcccaatatggtagccactggccccatgtggctgttgagcacttgaagtgtggctagtagactgagacatgttgttagtgtgaacacacactacgtttcaaagacttcatatcaaacagtaaaatactttattattaattttaatattgattacatgttgaaatggtaatattttagatagattgtgttaaatatgcatattattaaaattaaatttagggtttttttcacctagtttaatgtggctactagagcatcttaaaattatacatggggttcacatttgtggtctgcatcttatttgtgatggacactgttgttctaaactttcctaattactgagacatttcccttcatcactttttgggatgcagttttcatttataagttaatggtaaaactgcacaagtaacggaaatatacttaaaagatcaaaatatgaaatttagcactttcaaaattcctcatttaatgcttgagtcaatccttggaaaataattgatccagaggatatttacaaatagtccatcatcaaaaataaagaggggcatagaaggtactagagctctatgtataaaatcctgccctctggcctattctattatactcagaagagtctgtgtcactaatatatagtaattatcgtcggaaattatttgctatattaggattccctatggaaaagtgaattgattgaaaagatttagcaaagagttaactatcaactttggtttttaaataacatgtgaaagctaacttactctaatcactctgtggccataaaaaaggctctgcctccaacctccagaatctacatccaacaagaagtcttggtgaaaaggattggcaaaaagactgcaggttctggcaagggtttgtaagtggaccaacgaattggcatttgaaattgttagtcttataaaatgaatcattgagactggaaggtcaatgtaattggcaagccatgtgtcacctttttcttgggagaaaaacacatcatttccataaaaaagtatagagcatataaaagaataagaaagtaatgataaaacagaacttacagtgacattaaacagaaaggtatttatggtaatggatttggtactgaataataattaggctaataggataaattgctcacaaatggtacatttgggcaggaatagtgtattgttcactaatgtatctacaaaactgaatctaatgcccagcattttgtggaagggaaaaatgaattaacgactaatgtcatatatacataaactagctatcaacaagacaagctagggattagagaagacagggaaagaggaagtaatgctgatgcctctaaacatgaccaagatttattcttcactccttttagtgttttcaacgttaattcctgtagtgttctcttgccttctcaaaccagacttatttttaaagcagcttaggctgagtagcatatttttataaaatggtcctctgcgccatttctaagaatcataggtcaaattagtcaggctgctgttctaacactgataattatatccacctcctaccaaaatctgtagttaattggtagaaattcaagctttgtagattttagttgttaaaagcgtcacatggagaaagtacaaaggctgtcctaagtaaatgactttaagattgatttttgaagccttttctttactcaaaaaaagtaatggccagcttaacaaatgcctccagatgaattgcttgttgtgttcatcattattatattacacattcccctggaaactgcagatgataagggtgcattttattctgaatgttgtgtaaggcacactgcattttgaaagagttcagtgatgttaggataaatgtgtatgagaaatacgtttgaatagattcagtaagtctattcactagtccctttttcaccatttgctgtttggaatcaagtttgggatgttccatgcatggtcatcttactttagggtatagaacatcaggagtttaagaaactggggtttttgttttgactgccatcattttgctgtgtattacttgacaaggaatagaaggggaggcagggattagatcaagcaaagaagtacccagtaagaaagacctttcaacaatgtataaagaatttattttaaataaatttctgaaatggttaaaaaaaaaaggcagagatgagttaggtgaggtgagtcaagcaaggtggctgagggtttagattttggaaagtcacaacataaccttttacaactgaaatacatcatctgtaccatgcggataattgcatttatgtcttggtggtgttggaagaattaaagggtataatatatttaattcacttaatagagtgcctgacatatattaaattttcaaattgttgttagagtggctgcttcaaagaatagctaattttacagtatggtatcatggacacagactgtcaaaagccaacagaataatttcaaattcaactttttttccacatatggctttgtgagttgagtgcatactttagtcaaaaatatgttttcacagagtgataatttctaggggtgattaaaagtttgattataaccactcttgggtttcataatctaaaaacattttcagaaagtctgtgattaatttttcccatttaaaattttattctcaataatgtgcagtattaaatagaatttcacaaggcatcttgggagttacgctctcacatattaaactacacagaaaaagttatatgtcatagctggtcaagaactcagagcaaaatgaaaagataagcagatagtgcaatgtggttcatggtccttaaaagaccttttaatgtggttggttattttctaatgaatgcaagtaacacattgaatgcccacctatgaacagaaccgaaattaacaatttagaaatgtgaaagtgacataaacttttactttcaccatttttcacagggtcatttgttggtaaaattatctcctgtacttgcttcttgtcttactacatcagtcacctgtgaatttaaattagaggcattttgaaaatataattagtaagtcattgcttggatctattgagtagtaaatttatatttttatagtacctcagatatagtgtgaaactttgaataattcatttctcacatgaaataggcacattacaaatatccagcaagttgtaattctgggtaagagtccttcaaagaatgaagaacaacagttaagctgtacctttggtcatgcatggcaatatgtaattactatctgcaggtcctcaagatcaacttaatctctagtatgtaagtcaaatgcctgttgaactgtacagtataatacatggataaacaatccaaatgactcattttataagtaggtaccactttttataaacagagcgttttataacaacctgctgttggtggtggtggtggtggttttgttctcctcctgtttcttattctttattattgtcatcatctatacttactagatacaggaaaaatgcttttacaaaaatgacccaattcagtggtgctgaaactctagagacatcagaatcacctggatggcatgtcaaaacacgatgcatggtgcttgcctcagaatttttgattcagcagacataatgtggaaccttaggatctgcatacatagcaagtacccagatgatgctgatgctgctggtccagggaccacactttgagaatccctgctcttgtaaatgcttctttgtttcctgatctagcccttcttctatcattttaatgctaattatgcccaaaagtatagtagtactgctctttgcgtctttgcacaccaatctctgtggacaatctcatccacacgtgtggctactcacaaatataaatcaccagccctaatctccttttgagtgtcagactaatatatcaactgcctacagcacacctccacgtggaaatcccacaggatctttaaatttaatatggctggctgggtgccgtggctcacgcctgtaatcccagcactttgggagtccgaggcgggtggatcatgaggtcaggagttcaagaccagcttggttaagatggtgaaaccccatctctactgaaagtacaaaaaaataaaattagccaggcatggtggcgggcgcctgtaatcccagctactcaagaggttgaggcagagaattgctcgaacccgggaggcagaggttgcagtgagctgagattgtgccactgcactccagtctgggagacagagtgagactcgatctaaaaaaaaaaaaaaaatattaacatggccaaattggatctcttaagtcaacccccatgaagattgtttcaatcaagaattgtcgcattttcatgaggagcatatttttatggtcttaaaggatccccccacaaattacttattagttgcataggaaaaataataactatacattgaggaaattgaagaacatcttggacaaggtgatcaaaaatatcatcaccaaggaggggcaaatgagcatcatgtaatgccctaagatacattacctcattgctcttaaagcatgacccaatacattacctcattgctctttaagcatgacccaaacccatggcctaccatgcaagtctcctcctttcccagcctcacttctcctcaattcacacctcacagtcagctttacagttttaccaatacacctgagtattgaagaacgtgccatattctctcttgctttagggtctttattcctgctatttcctttgcttggctcgccttgcctcctccccaagcaccttctgtctctttgactagtgaaaacccatggtccttcaagactaaaattaatattatcttttcagagaaaacttccatgctgattcccctttcatgagtggtttaacagctctgtcctgcttggggcctcctagcacttaccacagtttattataatttcttacttgcttctctgtttcctggcttgcctctgagttctgaaaggtgggaattgtgttattcaccattgtttcctcagttcttagaatactgttaattaagatacagttccttaatgaatggatggatggatggatggatagaaaaaattgaaaatgtcatgcattttaataaacacattaagtgtttatttttatttggtagaaaactgatggaggaaatgaacaataatgtttagttttatatttggtgctgagtcctggataaagacaattgaatatgtttggtgttcatctaatttgcaattcaaaaccaccacgtgtagggaccttttctgccttactatttaaaatagtttacaaaattttgagaaaacgtagttttaattttacctagaatctttttttttttttttttttttgagatggagtttcactcttgttgcccaggctggagtgcaatggcaccatctaggctcaccgcgacctccgcctcctgggttgaagaaattctcctgcctcagcctgccaagtagctgggattacaggcatgtgccaccacgcctggctaattttgtatttttagtagagacagggtttctccatgttggtcaggctggtctcaaactcccgacctcaggtgatccccctgcctcggcctcccaaagttctgggattacaggcatgagccaccacgccagcctacatagaatcattttacatcagtgttttagatatgaatatttactaatctattatatttgatagcaaccataaatgcttaaactcacaattttttgtttttatgtgtgggaaaatttaaaaaacaaagactaaaaggatatgtataacaaaattttatctctatattgtgagattaatcttctctttgtattttttaacttttctaaattaatgtgaattaactgtatatgcagaaataatgtaaattttttttttttttttttttttttgagacggagtctcgctctgtcacccaggctggagtgcagtggcgcgatctcggctcactgcaagctccacctcctgggttcacgccattctgctgcctcagcctcccaagtagctgggactacaggcacctgccaccacgtccagctaattttttgtatttttagtagagacggggttttgctgtgttagtcaggatggtctcaatctcctgacctcatgatccgcccgcctcggcctcccaaagtgctgggattacaggcgtgagccactgcgcccggccaatagtgtaaaatttttacatagccaatgtttgctatgaatgtggttttctaaagaaccctcatattttctatatttatttgaaagggaagattttgggtttttcaatcgttttctgaccaactatcattacatttttggctgtaaagtgaattgatacacaaaagtcttggaagcaatttactacccacccctagctctggtattcttacgagggatgatacaaagacactaccttttctacaagctcttgtgtttacaagcataagagaaaaacaatatgtttaaggtattaattacccagaattcagcagtacattcctttgatttttgtatacaaatgctaacatatcacgaaggggaaagtgttcactgttttgtattggcatttaaaaactttttatgtatcatttataattgtgagagtaaatctgtagttggcttcttaaaaattcttgattacattggttctttatccacttatttatgttgatccgatgacaaagagttgttaataagtcaagacattttaacttacttattgacaagctaactaagaaaatagccaaaatagaggtattacaaatttcttattcaactcagcatgttcactgttcacttagccaaacattctccaactgaagaactccaaactagtttactcttcatatgactatattgagcattaccttactttaaattgtgccacttaatagtgaagttcggtgactatttcagcattatgatggatcctcttggactaagatacaaaatttacagttaaatttggtatttgccatcataaatggcccagattagctggtccttcccctatcactggagaggagtaatagtagctggaacccagaaacccagtgggtactagtttcctttctctatcccactttactcccctttatctcctttgcttacttcaagttttaaaaattacttacctggctaaccatgttttaaaatacattttattctgaaaatgtgaaagcattcataatacggattttttaggtcaaacttgccacattggtgatagttggggattgcggctgatttgtcagatgtatcttaccattggagtctgtgataattaagagcagtgttggactgtggtcatgtcagacactgcggagaagaaaaccgtgttttacatgcatattcagctgctgcatgatgtgttactgcatttcacattacatatagtagcccagtgccaactcactgcagtaaatctcagtgctaggctcttgccatttgtcatagtaacagaaaaacatgtgcagttttccattttattgaatgaatttgaattcatagaggacatcagattgtgctcactctctagtttatatgcctgtgtgtgtgtgtatatatatatatatatgctggcaatacaaataagctgaccatcccaggcagactaatcgaagatcttgtctaatattttggaattgtgattatttctatttctctttaccttaacttagggtacttcatctgatcaccacccctctaaagtatagaggggggtatttttggctcttgttctcattaatttaaaagttctcaatttttttgcagaggaaaggaaaacctacctgttggctgttttgacctatccatttaaccagtaatgcaccacagttagcacttctgggactaatctggccctccaaccttgaatagggtttacatggcattgccttaaggatatgtagtctttctattcctctaaatcagtggctctcaaatttgacaggtgtcagtcacctagggaacttggtaaaaatacaaaaccctgattcttactccagtgagtctggccaattctgatatgcactaaagtttgagaaccactgctctagacactaaaacaaatcaaaacaaaaagacagatgatctgaccaaggtagaaatgcagacagcattgagttgtccaattggcctgctatccccgtgccccaggctacttttactgaactctctcctgctttatggctttacttgaaggcgacgttataagaaacagccctcccagtatctgtgaactgcaaatcacagatctctcaaaatggaatgctttctgtaagtctgatgtcaaaattcatttgggggtaaatttaagaaaatatattattccttgtagtgtaaatatttatgtgtttaagtgcagaaatgttaatacgcttaactctagggtgctgccctaaagcctgctagggttttttcaaaatatttgaaatgcatactgaattagcttccaaaatccaaaaaaagtccactttaataaacatcttagtcccaaagatttcagattataattataaacaatgtgcttattaatacagtcatatgccacataatgacattttggtcaatgatggaccacatatttgactgtggtctcataagattataacagagctgaaaaatgcctattgcctaatgacatcatattttctataatgtcatagtgtaacacattaccttttctatgtttagatacacaaataattaccattgtgttacagttgcctatagtattcagtacagtcagatgcagtactggtttgtagcctagaaacaaataggctgtaccatatagcctaggtgtgtagtaggctctaccatctaggtttgtgtaagtaggctctgtgatgtttgtacaacagtgaagttgcctaaggacgcatttctcagaatgtatccctgtcattaagtgatgcacgattgtggtgtgcttctggagaaatggcttatttttatcttgtggacattgaaaatgacttggcagaccatactgtaaagctctaagccaggcttttgtcttcccttgatcaggagctctgtgacgttattctacctttatctttttttcttggtatcttcctacctttttattggtattattattatccattataatgattttgctgagtgcatttactcgttggctttttagatttttttgaatgtgtataaactaattgcttcttcatttagttggatatatagggtgataaaaatagataaatatattacttgttctggggcattgtctgggggagatttagcatagttgtcctcagttgtctctttctttcatgccataataaaataacctctattgtgaggataatttttcaaaaggacttagtgtaatgagcatacatttttggctaggtcagatttctaatagttggcagcccaggtattagcaacctcatattctacttccctgaataagaagtctctaggagtatctatctaccaaaaccactcaaatccctacaatccaaagaattccaggcttttaagttatgtttctgattctaatcattatttattcagtaaatggttgtataaaagtgacacaccctcaactgcaatttcagtttccctgggggaaacaaggaccctgaagggaaaacttgtacatagtgttgctttcttgctccagatcactggctcagagcatgaaagaagtgaaataacaaaccactgagtttcccctcaggtcttaaactatcagcctggatagcaaacaatttttattgcaaatttgagtagttactatgctttaggtttttttttggattaatgcagtttattttagagctgttctgagtttatacaaaaattgcaccaaaagtacagagagttcctatacacaccttcattctccatcccacagttttccctattaatagcatcttgcatttgtgtggtaaatttgttacaattgatggacagttgtaatacaatatattgacatattattgttaactaaatccatagtttatgctggggttcactttttgtgttgtacaattctatgcattttgacaagtacatgatgtcatgtgtcaccattacagtatcatacagaatagttttattgccttaaaaatttcctgtactccacttgtttatccctccttctcccaacccctaacccttggcaaccagtgatctttttactgtctccatagttttgcctctcaagaatgtcatatagttagaatcataaagtatgtagccttttcagattggcttatttcacttagtgatatgcatttcaatttccttcatgtatttttgtgacttaatagctcatttctttttgctactgaataatattccatggtaaggacttaccacagtttatttattcattaacctgttgaaaaatggcttaaacttttggtcgtttccaccttttggaaaatataaataaagctgctataaatatttgtgtgcaggtttttttgtggctgtgttttcaactcatttaaataaatactttggagtgtgacagctggatcttatgggaagaatatatttagttttgttagaaactataaaactctcttccgaagtgactgtaccatatttgtttcacaccagcaatgaataagggtccctgttggtctatatcctgtctgccagcatttggagttgtcagtgttcaggattttacccaatctaatgtgtgccatgctttatttttaacatttaacaaatagaaaatttgtgctcatggcatttgtttcttccaattactaatgaatagcatcatggttaaatgggatcattaccctgcttctttttccacccaccttagcttcctccagagttcactgttatctcttctctcagcaggtctgtggttggctattcttgtcttaccagtttgctgttattcctgcactcagtttctgttcttgtatgtgcctctctagtgtctagcataaatccctcaggactcaaaaagtggtattaatatgtcagtgagtcctattctgattccatttttcccaaatgagcctcctctttcaggctcctttggtaaagttcttctaattccttgggtctattacctactttttatattgttatagagaatgtcaaacatattcaaatacataaagaatgatatactggactaacgtatacctatcacacagtcccagccaccaacaacccatggccaatagtgctccatcctctcccatttactttttctaaatgttgtattattttgaaacaaatatcagatatcatattattttacatattcatgtgaccaaagatatagagcaatgacttctttttctaacaaacacatagcattattatcacacctaaaataacagcaatcatttattatcatcaaatatctaaataatgatctcattaaagttaagatccaataatgtccatgtgctttgactggttgatgcatattttaagtctcttttaatctatgggctctccctctattgtttgccctgccaacccccacaatttatttattgaataatcaaaattatcctgtaaagtttatcttataatctgatatttttactgattgtatttccgagatgtagtttaacataatctctgtattctgtattgcctgtaaataagtagaacctccatacaggtttgacttattttgatgtgactactataacttaattttttgttttgtattaatgccagttcattactggttctctcctaagctaatcttagagggcataccagtgtatcaattcatgcttattctgaaatctttaataaagttgtaaatgaattatacaataaatttcacagtgtcaggaatctaattaatgaaatagctagattagaaccctggaccccagacttttacatacaatttcctttccctgtaagcactatgttagcctcatgatagtagcatgcctctttgtaacttttaaatatcctgcagcagcaaattgagaaacacatttgcagaacattccctttactgtgtaatgtggttcttagtagagaatttatttatttatttattttgagacagggtttcactcccgtcacccaggctggagtgcagtggtgtgctcttggctcactacaacttccatctcccatgctcaagcgatcctcctgcctcagcctcccaagtaactgggactacaggcacacacgccaccacgcctggctaatttttgtatttttagtagagatggggtttcgccatgttggccaggctggtctcaaactcctgacctcaagtgatctgcctgccttggccttccaaagtgctggcattacaggcatgagccactgtgctcagccattaagtcttacatttgtatacaactttaaattatctacgtaatgtcactgcatagtcatatagcttggtagttaagcatttgaactcttttttttttttttttttttgagacagagttttgctcttgttgcctaggctggagtacaatggcacaatcttggctcaccacaacctccgcctcccaggttcaagtgattctcctgcctcagcctccccagtagctgggattataggcatgcaccaccatgcctggctaattttgtatttttagtagagacggggtttcttcatgttggtcaggctggtcttgatctcctgacctcaggtgatcagcctgcctcagcctcccaaagggctgggattacaggcgtgagctaacactcccggctgcatttgaactctttattctaatgtctaaataggactcactatttagggtactcactgtgtgatcttttttattattattacttcatagagacaaggtcttgctctgttgcccattctggagtgtagtagtgtgattgtaactcattgcaactttcaactcctggcctcaagcgatcctcccaccttagcctcccaaagtgttgagataacaggtgtgacgcactgcacccagcctcactgtgtgatcttgaataagttactgagcctagtttctctgcctgccagatgagacttttactagtaacaaccttatgaatttgctttgattattcagtatggataatgtatggatgatgcttagtacaatgcctgggatataatagcaaatgttcaatatagtttggaactataggcagagagaagtgttattatgagaaaactgaggcagtgatagggttggggcattggcctaatattacatagctgacatgtactttcacataagagcctgtcttttgtgtgagaactgactctgtaagtgtctctactgttatgaaggcaggaacctacttaggtactaggctatgtgaaagaagctggtgattagttgaatctaaagttggtgatgcactcacattgccaactacacacagtcataaaatccattagcctattttagacggcttactgcttaccttggcctcagctaccttactgcttaccttggcctcagctaccttggcctcagctactgcttaccttggcctcaggatatttaaagactaagattgtttcagtttgtttaaaaaattacacacacacacttgcgctcacacacacacacacacacacacacacacagtgggagagtatttttgccaaaacgtatgaaataattttctcctcttcacagatattgaaatggtgatttgttttatacatattccacacaaggtatatatatgtaagggataatttttttgtggtgaaatttaagtaacggaaataacatccactattatttgggtaaaaattacaaaagcacttcatagagacttttttccttagtgtatgaaccacatttatcaggtggtacaatagctgaattaagttgaaattgttctaaaatatgcttgagattttcgtctttcttcaagttgtcctgaataggtagacagatacctgaaaataggaataaaacctaaacctctactttaaaatgaggatattttacctttaaatgtctatttcacttgatgaatatttaacctttttgttagttgacctatctaaaatcttaagttacttgaaaaatatattttcttgtctgtggcttcttaaatggtgcacatgtggttagcaagcaacagctattggcttgccaaagctaaaagttaaaatataagatgataaagttgatgtaatatgtgaccttttataagtcactttcccatttgaaattaaatgtgccagatttgacaaacttaatatattgaataggttaccctaatatttttgttgacttttagcaagaacactataaagcaactataaagtgttatttattttagcttttctaaataaaaatcactgaagcaattttaatttgtacatataactcttccttaaaatttaaatacctgttttacttcatgtgcttccatgccttatttcattaaattttcaaacacgtatagaaagccacatctacaagctatcagatttccctgagattactatattaaaacatacactgaatcagactccatttcttccaacgctgattcagcactttaaaaataatctttgattttatattaaaataacttatcaccctttactgcatgatatcagaatgacactagttatttcactacaaaaaaatgtcagtgatcaaatcttgctggtccacaaataactctccacttgctaatttgcattttagcatcaactgtaaatatgtagataaaagaactgacagttgacagctaggtataacttatatatatttcatacagtaactcaataataccagattaatatttaaaaacattagtaggccgggcatggtggctcatgccggtaatcccggcactttgggaggccgaggtgggtggattacttgaggtcaggagttcgagaccagcctggccaacatggtgaaaccccatctctactaaaaattaaaaaaaaaaaaaaattagcaggacttggtaatgcgtgcctgtaatcccaattactcgggaggctgtggcaggagaatcgcttgaacccgggaggcggagcttgcagtgagctgagatcccgccactgcactccaggctgggtgacagagcgagactccatctaaaaaaaaaaaaaaaaaagaaagaaaacaaacaatgaaagacattaacaggagtatggcagaataaagaaatgtcaaaatatcatcctttaatctttaatgttataatttgtgtttgaattatgaaggatatattgaataataacaaatagaagtatttcaggaagcatagaggtgctgtttaaacacaatatgaaagtaatgagaatcattttccaacacggcattggatccagtctcatgacagtgtaaagaaactgtgggaaaagtgctctgtattttccaggtgaacctggttgcccatctcttgcaaccagctacagaaggtcagccagtagcactggatttccatggtcactcatttctccattctacttgtagtctgtgtagtgagaggaaaacaaatgtgtcccaaaaacttggtttcacatgagaagttcttcaaataattttcacctttagaaaaaaaatttatggagcatgatgatagtcaggagggaagaatggcagtttggaaggtaaggcaagaagaataatcttgagagtttctaatgagaaaaataatggaaaagggtaaaaaaaaaatagagcagctatgttaaagtataatattataattattgaatagaactcaataatatataattctgagcactctttttttcttctgactttatcatacaattttatctttagcctacctttaccttaatttgtatattcttagccttaggttattgaatagatttttataaaccatttgttttagtcagcttttgcttagtaaaaatacaataatatacaatccccaaatatcagtgccttttaacagcattgatttacttctctctcattttacatgtggcagctctctatggttctgtgtatcttcttcattcttgagtccagaataaataaataacttctctctggggcaaggcatagggaaaagagcaatggcagaaacatgcaatagatttttaaaattgtatttgagtataatttgaaaaaataatataatttaccctaccaacaaaatccattctggaataagatgtcatatagtaacataaaatttatattaatgtatgtaaaagaataatattaaggttgaaacttaaagaaccatttagtgtcttagtcaattttgtgttgctataaaggaatccctgagagtggataatttataaagaaaagaggtttatttcgctcatggttctgcaggttgtacaagaagcatggagccagcatctgctcctggttagggcctcaggaagcatccactcatggtagaaggtgcaagggagcaaacataatatggtgagagagaaggaaagagagatgggagggaggtgccagacttttttaaacaaccagatctcacaggaactaggactagaattcactccatcctgggagcattctccaagccatttatgaggaatccactcccatgacccaaacacctctcactaggccacacctctaatattggagatcaattttcaagatgagatttgacggggacaaatacccaaactatatgaaatggttagcatcattttcacttattaaaattttatcaaacatctacgatacagatgataccaggaagaagcaaagatgaataaatacctgtactctacatttaaaattctctggattcagtgaggaatatagcaaaatatataaaaccaatatagatgcatccactgatgagtgctttcttgaggattaaaagaggtgctaataagcagaaactgtgaatgaaactgtcaaccactgatacctagaaaccttaggatagtttctgtgtaagaatctgttaaattatctcagtccattcagactattatagcaaaatactctaaattggatagcttatgaagaaaggcaatttattgctcacagtcctggaggctgagaagtccaagatcaagtcaccatcagattcagtgtgtggtgagggctcgttctctgcttcacagagggcaccatcttgctgagtcctcacatggtggaagggcttcatcagcctcttttataagggcactaattccatcgatgaaggtgtagcctttatgacctaattacctgctaaacaccccatctcttaatactgttacattggtgattaggtttcaacatatgagttttgagaggacacagtcagaccatagcagatgaggataataataaagatattaatagtaataataactatctgtcttatgcatttactatatatcaagtactttagaaacctcattgtactctcacaatgaatttttgacataaattcaattattattctcattgtacagatgagaatataaaggcacagacacatattgaaagactatttataaagcttgtagtacctgagtggattaatggtgtttatattcagtttgtaaaacaaaactattatgagattatatatatatatatatgaatgaaaagtttccatgcctgttttcttgcaatattgattgtgaatgttaccgcagcctaagctcataaagcattttcttaacagaagcaatcacaggctatttgcaaagccatctcaataaaacttacaaacatgagtcctaagggtagaatcaattggtgagatgctacatttctttgtttgaattattggggaaaataaaacagtatgaaccattgatggtgttttgaaaaatatttttacactctattacttttattcttacccttaatatgtagttctatcattattttccatagaattaatctccactcttacatatattctttatgtaaatgagaaataaaatttcaaaggggaaaaatgtaagtagccaaaaatttctacataatgctttattaatgagcaaaattggggcattttatcttctgggtgagaaatgtaatattcaggaaaagtgtggtataattaatcatagtttatgtatttattactctagggttctttttgtaaatgttccatagttctttagcagtgaactcttctctaagttgcaaacagtacacctctattgtcaaaaaaggaccaatttctttgtttgcagcatattgtcaatatcaaatatgcatgctgaaagacagcagactatcaatagctagtaaattcacaaaaccattgggtgatatgctaatatttcacaagacaaacagtgaagggagaatattgtagtaatatttgcaaacaatattttctttagttttgtatttaaaatatgtcatttttttcttactcttgtgtgacttctttttcagtcagaacagaaaccttaaaatagataacctttgatttttatatttattccatttttctctgacagagtatggatgaatagcatgaaactagtcaaaattgctaagggaattaatttatctacaaaccttgttcaatcttattatttaaaaataacttttattaagataaaaattactaaaaatagattagactcttatgatgcacttagaaggacagaagatcatttctctgatagtcttgcctcaagttacaacctgattctaataaggagaatgcattagacaaacccaaattgagttacatgctacaaaatggctgaccagtactctgaaaagtttctaggtcaggaaagagaaagactgtagaactgtcacagtttggaggagactaagaagacatggcaactaatgcaatgtgggaacaactggaccttgaatcagaaaagaaccctagtggacaaactggttttgaaatttgaatacgtactatagatcagttcatcatattgtatcgacgttaatttcctcattttaataattgttctagggtttggaaaatgttaacattatggcaacctacctgaaggatgtgcagtaattattttctattcttgcatgttttctgtaaatctaaaattatttcaagatgttagagaatttttttttttttggagacacagtcttgctcttgctctgttgcccaggctggagtgcagtggcactatcttggctcactgcaacctccacctcccgggttcaagcaattcttgtgcctcagcctcccaagtagctgggattacagatgtgtgccaccacacctgactaatttttgtatttttagtagagacagggtttcaccatgttggccaggctggtctcctgacctcaagtgatctgcctgcctcgacctcccaaagtgctgggattacaggtgagccaccgcgcctggccaaaatgtcaaagaaatatttttaacttcgggagcaaagaagaactccaatctctggaatcagaaaaaataaaatattatttttatttgaggttatttaaacctcccatggagtatattaatatctgcaaactgagtgcctgctacgcaaggctacaaggtgctgtatgagacggaaacatggagacaatttattttttttattattttatgatgacatttattaagcttctaaaattatgtaacaaaatgaaagacatggacaatcacactttttgatatgataagaaaagagattatttgaatctgggacacagtgttccagaatttagaagatccatacaaagtgttgaggagaatctgattctaatttagggtttagggggaacaaagatacagtagttcccccttaaccatagttttgctttctatggtttcagttacctgtggtcagccacagttcaaaaacattaaacagaaaattccagaaccaaacggtgcacgattctgagtagtgtgatgaaatctcgtgcagtctccctctgtcctgtccaggacatgaatcatccctttgtccagcagatccatgttgtatatgctacccacccatttagtcacttagtagcaggctaggttatcagatcaactgtcatggtatcgcatgacagtaatccttattttacttagtaattgttccacagcacaagagtagtgatgatggcatattgttataattgttctattttattattcgttgttaatatcttactgtgcctaatttacaaattaagccttatcacaggtatgtatgtataggagaaaatgtattatagatcaggtttggtgctaaccacaggttcaggcattcactggggatcttggaatgtattcccgtcagataagagggaactacgatatgtcgatacaacagtggttgaactattgagtcatgcttggagctcttgagtatgaatatcaggaaataagcctggaattaatccaattgtggccaatttttaatgccatattagggcacttaaccttcattgtgtagtcagtcttaagtgatcaaataaaccacacaattggttctatggttcacaaagttaatggcgatatcaagtgaaaattggagtgaggcaagatgggtttccaggagaccagagaggcaacaagggctatataccttaagagcaatttacaaaagattaaaggagggcagtggcaatggggatgagaacaaataaaaaatagcaaaaaataatatattgaacttattgtaattatgtcaagctactgttatctttaaaggtaggaaaataaagatcttggctgggtgcggtggctcacacttgtaatcccagcactttgggaggccgaggcaggtggatcacctgaggtcaggagttcgagaccaacctggccgacatggtgaaaccccaactctactaaaaatacagtaattagctgggtgtgatggtgggtgcctgtaatcccagctacttgggaggctgaggcaggagaatcgcttgaacctgagagacagagattgcagtgagccgagatcacaccattgcattccagcctgggcgacaagaatgaaactcagtctcaaaaaaaaaaaaaaaaaaaaaaggaaagatctgaataaataatctcctttccttaatataaattttaatgattacaattacaactaattgatgagactggccagaggagtaaggcatgttgatcttcttttttttttttttgagatggagtcttgctctgttgcccaggctggagtgcagtggttcaatctcagctcacttcaacctccgcctcccgggttcaaggaattctcctgcctcagcctcctgaggagctgggattacaggcgcgcaccaccatgcctggcttatttttttgtatttttagtagagacagggtttcactatgttcaccaggctagtcttgaactcctgacttcaagtgatctgcccgccttgacctcctaaagtgctgggattacaggcatgagccaccatgcccggcctgatcttatttttaaagagtgtaaatgtaatctaattataaatttaaactttagagagaatgttgagagatacggacataataataaaaaaaacctgagccggataattgtgcttgtctgaaatgagctaatgaaataattttgttcatatcctttgggggtatttctgaaaatcagtaaagactatgcacagccattttatgtttttacaatagtgccattaatgatgccttatgagtgaagaaagttggatgattgggtgtaaaagatgtaaggttaatgggaaaacttccctagtccacaaatcatcttattatccagtctgtaattctttgttccatgccaaaaatctatatttcgtcaagtaataatagatgctttcaggcaaacagccttatatgttgaaatgcaaatgattacttttaccccgtctcctatgcttctccttaaacactgaagtgagtcagaagaaagaactcttaccctttctatttacactcactgctttggtggtatcactgaatctcatggctttaaataccatttgtcttctgatgattaccaaatactaatctccagctcagacctttctctccaacacgagacaggccactggactttcaataggtagctcaacctcatcctcacgtggtggaaagctctggattgtcccccaaaactatttatctcatcattcttttcccatctcagttaattgcatcgtcattcttctagttactcggcacaaaaactttaatgtaattcttgactcatatctctctcacccatcatttgattcatcagaaaatcctattgtctgtaccttcaaatcatttccaaaatctgaccacttctcaccagctccaacgctagcatcctggtcagagccacatttcactttgcttattgcaagagcaccctaactgacttccaacttctgccttgcttcccatcaattcactcttaactctgctgctggagtaattctgttaaaacagagattagtatgtgtcacttatttgctcaaaaacctccaaagacctctactttcactgtgagaaaaggccagaatacaaaattacaagggtccgtaaggccccagaaagacttgacctggcctgacctcatctaccgctacctttccctcttgctcactcttgcttattttcagcaacacaaggcttcttcccttttcacaatcactgcaggaacactcctgcctctgagactcagaccttgctctttcctctagctgaactgctcttccaaatgccttttttgttcactccttcaccttcttcaggtcttgacttgaaacaccctataaatagggcatttccaggccactctaaaattgcaaacttacctccattccttgcaccctttccctccttacagctgttatcaccatgtaatttactatagtttttgcttacttgttttttatctcttacgcaaccatcccattagaaagtaaactctattaaggcaagaatttttgttttttcaggactctacactaaatctcataattataagacaatatttggtgactaattttaataggaaatattgcctagagtaagtccagattttcttcttaatttaatcattaggcaaaatattttgagcaccttttatgtacttgattagaacataagggcataatgcattttaggatgtctgagattattggggagtaggcatgaaaacaagtattaatggtccattgttacaagaaaaagagtgaaatctgggctgatgctctctagtttgagcaggaaaatatctcatagcctctaaccttacttaaattctgccagctctggcctgtagaagcagtgaggcaaaatgacccactggaagaagctacttcttttgcagaagcaacctaactctgagaagaaaaaaattaagcctatcatcttcagttctacttgagatcttaattataaaataaactcagatttctatttccagttcagatggtttggtataagatgggccataatccctgaaaagtggcaattccaaggaagtttggcacaagtcttaatatgcttattcaggctgaagttccagcagttccttcccataagcagacctgctagagtgtggaagacacataatgtaaatacgttaggagcaattgttgtttctttcattttcttctgaatcagtccacagcccaaggattctgtgaagtaacaaaattggctgttacagattatagccacattcccatcttaatagcagcagttgaaatttcttgggcatttcaaggtagagatttatgttttatttgcagttcatgattattctgattcaaatatctgtaaatataaagggagggggagaatgctaacacaaaaaatattgtacccagttaaactttatgtctgtattaataaagcagtctttgatttagaattcttagtccctttcttttagaggattgaggttagggtatgtgggtttgtgtatgttttgtcaccaaggttggggtgatattaccacagtgaccagaactataaccaaattcccatttatactagtgatggttgtatcctgtctaccagagaggggaaaaatgctttgacaaattcatcattgttatgttttcttgccacagtttattctcttctgcattctgtggaagttcttttggccctgtggcttcctcaatcataagctaccacatacaaagactattttttcaaagaagccaattagttttttactaatcatacgaacttagaaaaatagatattaaatattactgataaataacacagccttgtcagaaatctctcaaagtgtgtgatcattgtctatagagtagaactttttaggggcaatacagtactgtttttatattcaatgaagataagttagattaaaaatgtaagatatctttttgtgaattgccacatggtagaattttgtaagaggtttttataatgctattcaattacttctccatggaagaattttgctcacagagaaagagagacagtgtgtgtgtatacacaaacatatataaatgtacatatatctgcatgcattatatatgcatatattgtatgtgtatgtaaagtatgtatagacatacaaatacagtcatatatacatacatatatagtctatacataatagctatatgtgatatactctctagatgttataaaagcttttcaaatttcaacttattggatttgttttggtgagtgttcaggtttattggtggaagaattatgagtttataaatcactgattagtcctctattctcacaagagtaaaagaatattttaatgatacatagtcaccaagggattgcacattttcaaatgaactcactgttactgcccctgttgtcaagatggtatctccctctttctcctcggcaaaaacaccatgaatcaatttatttagagtgaaaacaaacgtcaatcattaggtgaagatgctttttctcaatatctaaatggtttaaaattgaatttctcacgtaactgcccatttaaagactcaaacatggttctttgtttttgaggaatattctttataaagtctctgaaaacacttttactctcttagcaagataccttctttacttggcaacaaaaaccacattgaaacaatcgtattcccttttgtcagcctgagccagctgaaatctttggagttatcaacctctgccaacaacttgaagtagcggttgcacaatggataactgagatgtagtttattccaagctaatgattttctgaagctttcgggatggttatatttatactgacagatacagacctaactttcccataaaaagaacagactgtgttcaacgtacccagataataccagcctcttttttgtataatcctttaatttcagatgcttatagctgcttcagtcctgtcaataccagcactctgaagtcttgccctgcttgataatcatttgtctctgtaatttctttatcattgctttacttagggacaacacaaataatctatttagaccagaagagaccaactttctttcttctttatgatcaaaatattttgtagactccctacaaaataattatgataattgtagtagccattgggtaagaaatgcataatgacaaaaatctagttttaattcagtcgtgctaagcatatactctgctttattacatcagctacatatgtttaaaaatactaatatatattatttatctagtctgcatttggacttgcctaatcctttcaactagaatgccctctcaaagatccgtatcttgaagcacgagaaccaatagtttgaaacaactgatataaagtggataacatcaggtgtccaatgacctaccacatttgacactgaaaatattttccaaagaaatacagagtatgaaaataagaaagaactactctatcactcattgtcccatcgtctgatggccctgttgactcattgtacaccaagggccttttgaagtagggaaatacatgtgaccaatagagatagaacaataagacaatttcagatttgaaagaaacctgagcaaccacggagcccaaccctctctttttctccagtaatccaaagaggtcaagtagcttgttaagggcacccaagaagttgatggcaaagccaggcctaaacctggattatacaaacttgaaactatcttgaaatgtagtaagcactatcgcagtgttgggtaatacccttacactcaatcccagaagattgagttcagaagatgaagatgtggaggctgaaattataaccctggggattcgttgattgtgatgtactttatgcaggtttagaggcaaaaacacatggcttggcatcagaagtggaaaggaaagtagagtgttgtagaatgagtgctggatttgaggtcagaagacctcttttaattcccggtactgtcaccgattagatgtgacctatggcataacccttaaatatccttgacctcctctgtttccttttatgttaaaatgggaataataatgcatgctttgaccatcatttagaaaggttgagagaatcaaaatcagtatcagaaaatgcttttttaatctgtgcagagcttgaggtaacaaagcagtatacctcaataaatatcgttgcattcctctatgccaggcttcgtgcaaggcactgggaatagagcactgaataaaatagaaatgatcatagtttaaggaattttcattctagaaaataattacttaaatgtggctctatgtaacttaccaggagctttcttatccgttgttcctcttgagctttgcaacagtactaggcagacaggatagataagtaatgataataacaaaacaacaataatagcagcagcagcagcagctaacatttctattatttcaatgtaaaaaaagaatttcagattgtttaaatacagaaatgtggtggagtagaaagaaggccaagatggggacaaggggaaccatgaccccaaaagcaaataaagcatctgagcattcctttctgtttggttatgaacatctgagggtacataatcataatgagctcctttcagtaaatacaagatgggtgtttccatcttgatattataaattaagaaacaaggctgggcgcggtggctcactcctgtaatcccagcactttgggaggctgaggagggcagatcacgaggtcaggagtttgagaccagcctgaccaacatggtgaaaccccgtctctactaaaaatacaaaacttagctgggcgtgttggtgcatgcctgtaatcccagctactcaggaggccgaggcaggagaatcgcttgaaaccgggaggcggaggttgcagtgagctgagatcgtgccactgcactctagcctgggtgacagagcaagactccatctcaaaaaaaaaaaaaaagaaaaaaaaagaaacaaaagcacaatatgatcgtgtgacctgccctagatgctaaacctaatgagcagagaagcaagcaaagattgattccaggatttcctggctccaaagcctaggttatctccattgtatcaggctccttccaccacatctggatgttgactacatccagaacatgaaacaaaagcttcagtgctaaaaacaaacaaacaaacaagcaaaccaaactatcacattaagaagcaagtcaccaactgatcattttctgattttgctgtttccatggatggttccaaaatcctacctaactcatcaagcttaaatcaaagttgactcatccttacttgtcatcccatgtaaaataagttgccaattcctatctgtttcactttcaaaatgtttttaatcctgctgcttctgtgtagttttgaactggatagttctaataattgttgccaaagttccatactagcatctctggcttggactccttacatgctgaatccaactctcttagtttgcatcccctcactggcagatcctgagacaaggctttaagtgctggtagtttatttggagcatgaccccccaaacacaacagtctgggaatgaagtgagatgggaaaaggaagctgaccaataaaaggtgtgttatcaagaaagttacaactgtacatagctggaacttagtcctaacagagaaccctaggaaacaggatagagcatctgacttggagttattctaactgaggatcaaaagagcatcatttatagactggttcccattggttattggtttaggctacccccaagaactttttggtgttgaactcttcctgcgtgtagtgcaagtgagaagagaatgcttctgcagccagggaaatccctcagatgaaaggacttagatatgaaagttggaagtcagagttcagagaaaagatactggccaggggagtttatctgggtcactgtatttgctctgccagcctatatattatttctaaattaatcttcttagtgtacatctgtattagtccattttcatgctgctatgaagaaatacccaagattggttaatttataaagaaaaagaggtttgatggactcacagttccacatggctggggaggcctcacaatcatggcggaaggcaaaagaggagcaaagtcacgtcttacatggtggcaggcaggagagcatgtgcaggggaactgccctttataaagccaccagatctcatgagacttattcactatcatgagaccaacatgggattaaacccatccccatgattcaactacctcccaccaggcccctcccatgcataacatgggattatggaaactacaattaaagatgagatttgagtggggacacagccaaaccatatcaacatctttgctggagaaagctactctagctattaggctactcagagtatgccttgtgactttcatccttcatgcctttctcatattgtctccttttcttgattattgttttcagtcttaccctactccccgtcccacatagtcaaatgttacctatttatgaagactcacactgtgggcatttgtgattacatattatttttaattacattataacttgatgtaatccactagcacagtgttctaaatataatagaggcctaatggatgtttttggactcattgtctgacaacataacaacttgtgattgtctgaaaatgtaacaacttgtgattgtctgaaaatgtaacagcctgtgaactcttcgttgttcaaagaaaacagaaaaattccaaatatgtaactctttgaaattatgtcaatgtagatttgtttcaaatgttaatatatagtaaccagggaataatagcaatgaatttgttcagttacgatatttggtacttccaaatagcttcccatgatgaggataagataactaataattcttacagtaaaatattctttgattgggttgtttcctattgctgctataataaattaacataaacttagtggcttaaacaacccaaatttattatcttacagttctggaagtcagaattccaaaatggattttactaagctaaagttaaggtgtcatcatggctgcattcttttctggagactctgggagagaatctgttttcttgccttctttggcttctagagactgtctacatttcttatctcttggccctcttccatcgtcaaagctagcagtagccagttgaatctcacagagcatccctttgacattaactcttctgcctccttttctcatatttaatacccttgcgattacactgggctcatctggataaccctggcttatctctgtatcataaagtcagctaactagtagtcctaattatatctgctacgttaactcccctttgccttataaggtaatatattcgcaggttcaggagattaggacacagatgtctttgggaggccattattctgcctaccacaattgatatgtcccactcttccctcctaatttaataagacaatcctatactggtttacccttatctcgtaaaatattcaagatgtagtacagatgttcttgatgctagatgttgaattatgattttaacaaatggaggcttgtgtctcataatgtatatttcgttttgaaatagaaaagttgacttagaaaattagacttccatgtgtacacataatagttctgctacttgagatccagcgattagcctacttctagcattttcaaaataaacttgtcatttgtgtcattatcatagctgattagaaagtaaattatttgtattgaccacattgagaaaattaccatttagcttatggaactctttgtcatagagtgtggatattatatttgtacttgattctaatagtggttagggacattagaaggatatggagctcatcattcaactaagtccttacaaaataattcaatctctgttttagaagtttatcataatattagtacataaactgaacacaagaaggaatttataccatagaaaaattagagagaaaacttagaaaccatctcctacgagctctttgcttttcttgcgaagtggctgctatcaacagaaagagccgttgttaggctttgcatgttctggagtgacatctattagagaaggtttatcatctttgaccactttgcacttcctctcccaacaaagccttacaagcatgtgtttcctagagtggccacttggatcttcatcttccagtaatgttcatgatttgggtattcctagttctctctatccaaaatggccagttggtatcttcttaacccagttgtgcattttaaaatattttgtgggccaggtgcggtggttcactcctgtaatcccagcactttgggaggccgaggcgggtggatcacctgagatcaggagttcgagaccagcctggccaacatggtgaaacctggtctctactaacaataaaaaaattagctgggcatggtggcgcatgcctgtaatcccagttactcaggaggctgaggcaagagaatcacctgaacccaggaggcggaggttgcagtgagccaagatcatgccattgcactccagcctgagtgacagagtgagactgtctcaaaaaaaaaaaaattgtggagtccaaactgttactagttaatctggaaaattaatctataaaaagttcctaataatttatactattttttcttcctgtcacaatataaaaaataaacattacctgttgtaatctgaatatgtgattgtaaaatgattaagcccgatttttcaaccaaagagattatgacttaaagtgtttattatgaagttcgtggtaaatgaagaaccagaatgtataaaggtgattcagctataaataaaatttaattttgtgttaataaaagtaaaattagggaattatgaaaagatattttcaaatacaaagatgcatttaatattcacacaatattgatacttagtacccccatttaactaattaagaaattaagactagtaatgattaagtaactttcccacaattacttagctggctagagtctaacatggtatctttttctttctttctgtcttttttttttttttcttgagacagagtttcgctcttgttgcccaggctggattgcaatggcatgatcttggctcactgcaacctccgcctcctgggctcaagtgattctcctgcctcagcctcccaagtagctgggattacaggcacacgccaccacatgccaccacgcctggctaatttttttagtggagacggggtttcatcatattggtcaggctggtctcaaactcatgacctcaggtaatccacccgcctcagcctcccaaagtgctgggattacgggcatgagccaccatgcctggtgaaacaaacgtggtatctttttcataagaggaactcaaacattctattgagttgaaatacattgaatgaggcatcctttgttttttgcactgaataagctctggtgagagctctattgttgtctttaaataagtctattcttctaggactggctaaaagcccacttaaatgggagccctcaggtacactcattgtcttcattaacttcctttgttagaaacaccattcattcaacaatatatccaccaaaaatattcagaagtggatgacctttcttatgctgatttttgaattgtagaaaattgcggagattcttactaagttttgggatagaactctctctcactggtctttcctttaaatataaaatagaaccttgaatatggtaatttcaaatatgcatgcttttaagtgaattgtaagtttcttgcaaacagggattttgttacagtctacctttattctaacaagataatagtagctaccatttcagggcgtgtatgtcattaactgcttcataacacatgatttgacttttgcttttatatttctaacatttataagcagtacaatgtaatagtcacacataaatactttataatatttatcaataattaaaaataaattaatacaggaatctaataatttatagtatatgaatttagaattcattatttatattataataaatatacatttgtaattcattattacattatttatttattgcatctaccctcttgacactatttcaaagtgtgcataagtattgcactttggctttgagaaatctaaactaagaaaagataagcaaattttccaagggctcttagctagcatttgacaaaggaaaaattctaaccctggtctgtctgactccaaagatggattttattcctttttagtgtgctacattgcttgcaattttccatgagcctagcaaagtgtatcctgttggattgaagcatattttcgagtggagatactgtggtaaatgagatggaaggagaagatggtaactgggacacctactgaggtgtgttcttagaaccaaagacttcgacttaaactctatcatagatcacagttggtattagattcacttagaagaatataaaacacaaatgaacattatgtgtccttcctccttgagaatagtcatcacacaaatctatgtagcagttcccacagccatctgggtagttatctttagcgattcctttcccccatgtctcacatcatggaatacgaatcacattgtgtaggtgtagaaatcacctgggcgtaaaaacctcattccccagtagccagtatctcttatatcaaatctgtagtcacagcccctgaaaacatgctcagttgcaagtcatcacactcagggaagtgcaaagatatgacatccagatcaggcatctatacttcatttatagtttcttctagttcatgtgaaacttaccaatcaggactcatttttatcatagccagtatgaccttgtaacacatttgacataccacgtttatctgtcttcaggggatcagaactaaaaagttaccaaagatccaattttaacacaggtcgaagggttttgatagccttttacccaaaataattacagaatggatttcttgaaaagtagttttgaggattttgttctatttttaaggatgggaggatttggatatgacctcaacagttggtggctgagaaagagtggagaaaaagatccttggagttaaagagataagagaacagagaggctagaatgttagacagagcccctttgtatatgttgaaataagcaaaatgtggacatgtgggtaggtgaatgggacagtgatccaggctctaaaactcttactaaatgagagaaaatgacagggagatctgtagataactatagctttgagggaagatgggtgatggtggctgatggcacaacctcaaatgagttccttttattgaaagaagacaattcatttggaagaagtaattgggagcaagggaaacacctactctatctctaggccctaatttttctcatgataattcattgaagtgctgtaaaatatccaaacaaagtaattcagtaataagggaaaaaacttaaaaatatacacacaaatttataaatgtcatgtgtatatatttgtcctcaatacaatttctcctgatcagttgtgtgtaactaggatgtgtaataaatgaacacaaggacaaacacactgcagatatttaccctaaatatctcagtgtattttaatacatggaatattattgtgctgctttgttagtggggtataatttaggggggatctttcttgatagcatagcagaaattgatctgaatcctaaatactccatttattagctgtatgactttgggcaaattagtttactcagcctcagattcatttctcaagaaattagcccaccagtatgacttacctcttaggattatagttaagattatatgagataaagcacatgaagattttagctcagtgactagtgtagtaaatgcttaataaagctattattgtcattgtaattacattaaatcacattaaaaaatttagttcccctattaaatcatatgaagagtttaaagaaagtcaacggggtaatgtgttcagtttcttttttaaataaaaagtatgcaatattataatgattagagtcccatgtagtagaaggaagagaataaaggactgaaattataagactatttgtgcccttgattttaatttcttaccttgagtccttttgttatttagaatgaccccaagggaatcattccttatttgattagcagtgctacactttaaagagcattacttcccccttatctcactcccattccaaagaccactagggtataaccgttgcaaacatttgtactttgtctaactacaggaaaacataggaaagggtaccttgcattccaaactcaattttaaatcactggtaatggttttgactggctaatgcaatgggaacacctccaatatatgttggccagtattaatcttagcatagaaaatattcacttttaatttgatggtcattttttttctttttttggaggcagagtctcgctctatcccccaggctggagtgcagtggcacgatctccctcactgcaacctctgcctaccgggttcaagtgatactcaagtcttagcctcccctgagtagctgagattgcaggcacctgccaccatgcctggctaaatttttatatttttagtagagatgagattttgccatgttgaacaggctggtctcgaactcctgacctcaggttatctgcccgactcggcctcccaaagtgctgggattacaggcgtgagccaccactgcacctgggctggtgctgatatttagcaatactgccatctgtggtgttcatagaaacaaaaaaaatcctccaaatactgcttaaaggagtctcatcacacttgacacacatcttttaaaaatttgtgtttttctattgctctttcatctcaaagaggcctatagcagagaatgagtagcacgttgcgctgtctttggggtcctggataaacaacctctttcttttcttttttcttttcttttctctctctctctctctctctccccccccctccctccctctccctctctctctctctctctctttcctttctttctttgtttctttccttcctcttctttttttttgagatggagtttccctcttgttgcccaggctggagtgcaatggcgtgatctcggctcactgcaacctctgcctcttcatttcttcatctgtaacaagagaataaaaatgacttcttcacagatttatataaataatattttaactaagtaattcattttgaaatgtttatagaatgccatttacagataaggtagaaatagagtccttcctaaaagtctgttttagataattaatcactaaaattataattggagttgtcataatcaattatgtagcattgtttcaatgatgttaacattgctctttttcactggataaattgttatgtggcatgtcatcattctaatattcagtttacatgacacttcttctttaactctcctctgcagatattcaatctagagtttgtggcacagtatacataatttttggcagatgatagctaagtgcattgtataaaagatacattatttaccagatcaaaggtcaatgtgttcataatttaatatgccgagggtcatacagtccagaaatgtctgtgaatttctgaagtgacacacatttttgatagaaaactgccattttgtaatggatagcacatcaattggatagcccagcattcttttcagatttacatgtcaagttcatcagtgaggccctacataaatctactctaggattaatttccagatttcatctttaactgtatcacaattctttttttttgagacaaagtttcgctcttgttgcccaggctggagtgcaatggcgcgatcctctgcctcccaggttcaagtgattctcctgccttagcctcccgagtagctgggattacaggcaagagccaccacatctggataattttgtatttttaggagagatggggtttctccatgttggtcaggctggtcttgaactcccgacctcaggtgatctgcctacctcagcctcccaaaatgctgggattataggtgtgagccacagcacccagcctcttttcttcttaaataagtctttctcaaggaaattttcacaatattgctcttgggactcaatgtccttatgtggtaggacactacgttttctgaaaaattgcttattaatctggtatatgtgaactatgcaaattatgttttctattttagtctttagatgcagtagttttactattttagttttctcagatatattcacagcaaaagtactatcattgtagagtagtttcacttagcagtgaaagtaactctgctatgatgtggacactgcttctcatttttcttaataaatattatgtttgttatttttataaaatttgttcattagatatggagttttattccaatttaatgatgatagatgggttttatttttatttaattttactgttgtgttctatgaaagtatcttctttaaaatattgtgtaaagatgtcttaattttactaaaacgatagtaataataatatagatgatactactactaataaaactactattttctgaatatgtacaattgccaagcatgatttatgatttacataggatgccaaatttccattatatatcttcaaatttatatgttcattggtttgttcatctatgccacaaatgttaatggagtacctactaagtgccaacaactatgccatcaaccatgaatcagtcacttaacaagatagatataatcccttccttcagaaagcttgtagtctgggagaaaatttaacagttaaacaagacattgaaaaaagtgtgggccgggttgggtggctcatgcctgtcatcccagcactttgggaggccaaggcgggtagatcgcctgaggtcaggagttcgagaccagcctggccaacatggtgaaaccctgtctctactaaaaatacagaaattagccaggcaggcgtggtggtgcatgcctgtaatcccaggtacttgggaggctgaggcaggagaatcgcttgagcccgggaggcggaggttgcagtgagcagagaagattgtaccactgccctccagcctgggtgcaaagcgagactctgtctcaaaaaaaaaaaaaagtgtgataactgttttgatacagcaagtggatggatggaagaagctctatgagtatacagcagggatacatggcctgggaggaaaaagggctgaccatccattgaaaggtttaattaggtcagtgaagttgctcaagtacagctataaaatgaggcaatcaattactggtgatgcaggagagaaagtgatgtatggagaactttctgaactatagtaagaaatgtaatctgtattctaagggcatacttaattactgaaatagtgtattcaaaataggtatcataatcaaggaaacaatcttaaatcatcatgttccaattgcttgatgattattgaagctaacgtattaggaatagatgtattagctaatgtattaggaatagatgtttcctactgctgagttgaaataacgaacccacttgaactttcgcagacacctctaggtttaccttttatttaataagtaaataaaaatgttcatgttttctataatactttgcatcagctttcccttaatcttggaaacatttatttgactgaagaaattaagcactctcacctgcataaaatattcttctgtatgctatagtggagccagttgtaaagatttagttcagttaataaatatctgttgagatgctggcaaggctgtggagaaataacaacgcttttacactgttggtgggagtgtaaattagttcaaccattgtggaagacagtgtggcgattccttaaggatctagaaccagaaataccatttgacacagcaatcccattactgggtatatacccaaaggattataaatcattctactataaagacacatgcacatgtatgtgtattgcagcactattcacaatagcaaagacttggaactaacccaaatatgcatcaatgatagactggataaagaaaatgtggcacatatacactatggaatactatgcagccataaaaaagaatgagttcatgtcctttgcagggaaatggatgaagctggaagccatcatccttagcaaactaacacaggagcagaaaaccaaacaccacatgttctcactcataagtgggagttgaacaatgagaacacatggacacagggaggggaacatcacacacgggggcctgtctggggttaggagacaaggggagggagagcattaggacaaatagctaatgcatgtgggcttaaaacctagatgatgggttgataggtgcagcataccaccatgtcacatgtatacctatgtaacaaacctgcacgttctgcacatgtatcccagaacttcaagtaaaataataaataaataaataaataaatatctgtttaatttctgcagaagaccataaatatacttggtgtgtcaggcagtgatctgtaagtatttttgttcatgcaatcacaccaatcaaaattttgagcaaataccccaatatgtgtatatttttctaataacaaataatacatatattactatattaatatatagtatacattaatacctaaataaaatagagaattgaaataatggaatacaaataaatttttaaacagctgtaaatatttttctcatggctcaatcgaggaaatcttaaatatcgcccagggagtaggagcttattttgcataccatcacaatggggaaaagaaaaatgaatacactgttatgtctaccttcaaggaggcagcaatatggtaatagaaaagttcacaggggccaggcatggtggctcacgcctgtaatcccagcactttgggaggccagggcaggtggatcatgaggtcaggatttcgagaccagcctgaccaacatggtaaaaccccatatctactaaaaatacaaaaaattagccaggcatggtggtgggcgcctgtaatcccagctactcgggaggctgaggcaggagaatcacttgaacctgggaggcggaggttgcagtgagccgagatcacgccactgtactgcagcctgggcgacagagcaagactccgtctcaaaaaaaaaaaaaagaaagaaagaagaaaagttcactaaagctaaatgctgtgccctgtggtattagaagttagagctgttgtggttcaaagtcaggaagatattttcagggcaaatttacttgtaagttggggccaaagaaaggaaggtaatagggaacaaaggctggaaatacagcatgatggttctttagagcaatgcttctcccagtgtaatgtgtctttgaatcagctagaaatctgagctgcggcctgggagtctgcatttctaacaagctcctaggtgctgctaatgttgctggtatacagaccacactttcagtgtcaaggctttaaaggactttctcatctaaaatgaggagtttgtgcttaaattgataggcagtaggcaatttggaaaggtgttccagctcagagcaacatgatcaagttgaactctaggcaaagtaatttagcagtaatttatagattggaggccaagactggaggcagagagataagtctagaggcaattacaggtgagaggtaataagacctctgaagtaggacatggcagtagacacagaaaagggacatggtagaagcagaatcaacctgagaagagagataacaaaggaacacaggtataatatatagaacaaattaaaacgaagactagagaaactaatgagaaatgtgtcctttactgttcatctagtaatttggaaatttgaattttcatatatttaaatacatatgcataaatgatattttcagctaaccaccagaaaatttctggtagaaaatatcacaaaataaaactggctttgaatatgtttgtctttttccttgatccttatttccagaaagaaatacatgtcctggaagtatatgtccatagaggtccaataaatctcaatgattgtaaatagagctttattcatattgagcaaatgtttcctgttcacttgcctctaggtgaaaaacataaatgtctttatacaaatctctgaaatgtttgaagcataaggaaggtgaaagtggcaaggagacatgtattttcattataggctctgaatatccatagctgttttctgctatttagccacttcttcctttgtgacctgactttggacggcacacattatcaatcaggaagaccattatgttccttttacttgtacttgtcaatgtctggctgctcctactgcaagataagctccttgagagccaagactgtgtactattcattttgtatccccagatcccagtgcagatgctgaataattgacttataaataaatgtgtaaatgatcccagaaccaagcacagatatgaacacaaaaaaaattcctttggagtgaacgaatgaattaataagtaggcaagtgaaagaatgaatgttgacttagcccttagaatggccattgacaggttctgtttttttattactagataagcaccaaccttattctactcaaagtatgtgatcaatatttcactcattcatgtccacatactataagaagccttcacattatatagtgactttgaaatcaaagtctaagtctaaattttattataggagaaaaatgtgtgtgttgtgcattgtggtttagtataaatataagtcagattccttgacatcaaatcagttcaccattttttcactcacagactttttcgtcatccttttaagcctcccattttttctttttttaaaaaatgatttcattatactccattattgtgtatgtgtgtgtgtgtatgtgtatctgtgtatgtgtgtctaagtcaaaaactaacctcttctatgggtattttgttactatcctctgtaatataatgtgggaatctttgtccgtgagcataaacagggtgagtgcaggaatctagccatcagttctttctgtactatgcatgcacagcgtctaacttgtgcttgtaatttgtgattacgtcttcaggatacatagttttaaactaggccgagtgcggtggctcacgcttgtaatcccagcactttagggggccgaggcgggtggatcacctgaggtcaggagtttgagaacagcctggccaatgaggtgaaacctcatctctactaaaaatacaaaaattagctgggcgtggtggtgggcacctgtaattccagctacttgggaggctgaggcaggagaatcgcttgaacctaggaggtagaggttgcagtcagcggagatcgcgccattacactccaacctgggcagcaagagcaaaacttcatctcaaaacagaataaagtaaaataaatgaaaaaaataaaattaaactaacagctaactcacagtcttctgctaaaaaagtgtcatacattcagattgtttactctatcaggttagttactcatgctgctatactgtttccaaactcttaggattctagcacattgttttagtttaattttcactgttcctttaaatgtttatttaattcattttctaaaatcacagatatgagcagagccttggagaccatctagtagaatccttccgtggaatagatattaaaataaaaactcatattggttaagttactttacaaaggacatatagctggttattgaaaaaagtggagtaaaaatgaaaatctcccaaatccctaggacagtgatttctcttacgctgtgctatatcactaaaagattttatagtttccctttggccatcagagaagctatgtttaatgtcaagcctgattcatagttaacatcatatcttttgggagcctagatatgataaaagcaaaagagctacaggcattttgaagaagcacttcctacacactactatataccttgaatttgtactggaattgtttgataccctctcagtttattgatactccaaaagaccgaatttctaggtttgttttctaagctttgtcaataagggtagtatttagtcatgcaacactttagctcaaaatattatcattacacattgtctatatgtaaaaataactttgcatatgcatatagattttccagttccattcagcatgaggcatcaactctttgtagtcttttttatataaacacacaaaaattagtttatgacttgtgctatcatgtgttcatgctggaagacggtcagatgtatgtagaatatagcttctgttagtgctcatagtctggtggttcacaggaaaatgaagaataacacaaggaagtgcatgtaattattttaataacttcattcttgcaaataacagaatgaatgaaacaatgttttgcacaacctattttatttgattttcaaaggaagtcatcatgcaatagtccattgactttaattctacctgcttactgtcataaagtaatcttcatggcttgaacaatccagagcctgtgaaatctcccttgaatctctgcatctctccatttccaacaccatcagcctactcgaagtgacaatcttctgaacaattgaaactgcattcactcttgcctggtttgtttactcatcattcaggcctattttttaatgtgtaaaattttaaattttttgtttaaaaatgcaagtatgatcaagctgctctctgacttaaaaccatttggtaacttcctgttggtcttaataacttcccattgctcccaaatccttaatgagaccaacatattttgcttacttttttctctttctcctcctatcttcaccccattcctctcatcttactctctcagcttctctcaccatgaaagtgcatgccttgactttttcatcccagggcctttgcacatgctgcttactccatttgcaaagtattgtctgtcaaatgacttgcaccacttcagccaattatctccttttcatgcgtgaatttccagattcaatgtcacttccttaggaaagctttttcttcaaagactgggttagaattccctgtcacataccttctaacacctaacaccgtgcagtcctgcttcacagcaataatcatagatataatgtggaatttattgattttgttgaatttattgttaaattttatgctaaataaggccgtatgttctttgttcacttcctccatgagaaccttgcatcttgttttgaacacggtgaattctcagtaagtatttcctatcatttcaaattttttgtgcctattttattttttacataatatattggtagaatattacaggtatataatttatatagtgataaatgtagagagagaatatgtactcccttcccattccgcttccccttccccttcccttcccttcttcctttccttccctccctcctttcctcacttcctcctttccttcttatttttttctgtaacctaataatattgtataatcaaaaagtctggagacttctgcttgttttttacttaatacgtattttccttctatttaataaaaggagactggcctgtcttttaaattgcattttatggcctaaatttctactatatgattcaaaaattgctctgccatagtttgtgagaagacactatgttattttacttcctaaagaaagggtagtgaacaaaataataaaagctttatattaaagacaataaagttgatagtgttgtgaaatcatgttactcttattttcggtctgttttctttccagatctctttcctgatctatggtatatatgccagaagccataaatacttaatacagggtgaataaaagacattttaaattaagcatgcccccccaccaacattatcaagagtaaaatgaaatagaccaataaatcggcttacttactggccaacacctaaattgattattagatgtaatggtacaaatttgtataaatatcacacttccctctaatctttttaaatgaaatatgcaggaaggattgtcaaatggaagtactatactaaaaagcgattatcaccatggtaatgttggcttgcttttctgttccttttaatttggttaccctctttattgttaaattttttaaaaagttttctacttttacattttttatttatacttaacacataataatttaaatattggggtacaatatgatgtttcagtgcatgtatacatagtatgaggataaaatcagggtaattatatacaccaatttagacatttatcatttctttttggtgacagcattcaaaatcttcacttctatctgtcttgaaatatatattacattgttatttgctatagtcaccctagtgtgtaatagaatagcaaaacttattctttcctgtctaactaattttgtaccaattgactaataacctttcccaagaaccccctcccacataccctcaccaatgtttgctaactactattctactctctacttatataaaatcaacttttttaggttccacataggagtgagatcatgcagtgtttttctttctgaacctggcttatttcatttaacataatatcctccaggttcatccatgttgttgaaataacaagatttcattctgttttatggctgaatagtattcaattgtatatatatatatatacacacacaattgtatatatatattcatatatacaattgtatatttatattcatatatatacatctattgtatatgtattgtatatgtattgtatatatattgtatatatattcatatgtacaattgtatatatatattcatatgtacaattgtatatatatattcatatgtacaattgtatatatatattcatatgtacaattgtatatatatattcatatgtacaattgtatatatatattcatatgtacaattgtatatgtatattcatatgtacaattgtatatgtatattcatatgtacaattgtatatatatattcatatgtacaattgtatatatattcatatgtacaattgtatatatatattcatatgtacaattgtatatatattcatatgtacaattgtatatatattttcatatatatgaatatatatgataaatgtgatatattaataaatgtgatatatatcacattttcttcatttgtaaatgggcatttatgttgattctatatcttggctactgtgaatagtgctgcaataaacatgggtgtgcatatgtctctttgacatactgatttcatttcctttggatatatatctagtaatgggattgctggatcatatggaagttctatttttatttttttgaggaaactccatactgttttccataatggctattctaatttacattcccaccaacaatatataaggtaaattctttaggcattgccttaacctatacagtcactgcctcactatagaagttattttactctgattttgtggcatcattgtgttttaaacaaaaagtgtcatctattatgataatattatggcagctgtatttattttcctgctttctgtaaattagggtctcaagacttccttaagtacaattatagccaaaatctcatatgaaaaaaatgacagaaacatgcatcagataaaaaaatataaaaatcttcagtgactccaaaaatatatggtcatttagttttaaaagcaatttcaaactacctggtaggatctaatttaatgattcttaccatgatttcttaaagagtattcatcgttgcctccccttaacttttaatgaaaataactaccaaatctctttgttatttggaaactaaataaataaactggatcattaacctgaaaatgttatcagtggtcccaaagtttcactaatggaattttacatatttaaattaagcaataaaggataagaaaatatgtaataaaataattagatttaatatctatatgtggttcatggaaaaatcaaatgttactttgaaactttgtccctataataatatttaattataaaatacacaatagaaattactcttgagaataatttttatgtacctgattgcatttcaatccacatttcccatggaacctgaagcaaataccttacaaaaaagtaaaaattctataaggaatgtactaaatttgtaccccagcattagtgatagaatagatgtctacacagattacaaataagtcaacaagttatttgataatgccaattcttagatgaaactaaaaccttttacattatctatattgttcccttttatatcaacaatgatctttttcctttacctagtcaagttgctagagaattcccctttcaattcatgtagaaatcactttctttataaatctgtgcccatctgaaaacagccaatacttcttggatttttctttattcattcttcacatgactttctttatctgaaggaaaaatagtagatataacctatgaatcttattattcatcaaaaagacagagaatgaacatgtctttagggattactatgaaaatttgacaaaaactatatatgaagatgaaggcgagtatttgagatgacttgcaacctgtttttctgtttctctttcttagtttagaaattcaatataactatgatttcagataatacaaaccttgtcagttttgttttatgaataggttggatgtctcctttactagaaaaatgggaaatatgtttagtgaatattcaacgtatatgtagaagtgattagtatattatttattgcaatttgagaaaccaaattgaaaagtcaccataaattatgaagaaaaatgcataacattccaacccctcgataaaatttctttgaagttaatatgaccatataataacttttggtgttagaaatatatattttatttttacttgaactccgataacttcagcaaaatgctgttaaaagtattctgtgcctccctccattattgtattagatgttttaagaacataacaatgtggtgattattaagagtgaataattatatttaatgaactatgaccatgatttgaattttatatggatggtggtttactttctgttactgaatgttgcacccagtgttgtgggattttgttttgttttgtttttgagatggagtctcactctgtcgcccaagctggagtacagtggcacgatctcggctcactgcaacctccacctcccaggttcaagcaattctcctgcctcagcctcccgagtagctgggattacagatgcccaccaccatgcccggctaatttttgtatctttagtagagacagggtttcaccatattggtcaggctggccttgaactcctgacctcaggtgattcagcctcccaaagtgctgggattacaggcgtgagccactgtgcccggtcataccaattgtttttaagtcatagggtaaaattgaaagggcacagacaccagaattaaaatgcaggtctgtgtgaatgacctgaactactctggtcctcaatttttttcacccataaaatcggtgttagatttcctactttcccaggaagtggtgaggatggtgttgtcattattgaataaattcaaacatgagtcatgtaccacagcatctaactaatataaaacgcttagttgatattaattctattgtctctatgtgagtatgattaaatgtaaaaaagtaacactttataaggcaaaagatatttctcaaaacaggctgaagataaagattatagctatagaattatcaagaattatgaaatatataaatagaagtaaagttagttaacatttgggagatacagtgttcaatcagtaatttattaggcatgcaaaattaaggctgtagacatagaaaaataattatctgagagcaaaactaaatatcatgtctatgtttctaaatgtcagtacaaatagcaaatggagggaaagaaaaaaaaaagggacattttgctttcagcataacactccatgcatttgaatgtttattgtggttttttaatgggtaaaatagggcttcttaactgagagaatgaatttgtgttcaaatagtggttttcaatttgttctaagcttcttaccaaattgaaaataatgacccattttgccaataataacctcaagatgtctttaataacccaaggtattttgaaccattaaactggcttgaccaaattctgcttagtagcacacatgcagtttctttcagcatcaagaaaattactacatttttcttttcaaaaggttaagttagctgtgaactgaagtttttctaatttaaaggttttttaatactctataggtatagctaaatctcagtaattgaatttgttcgtgaaagcaattgtatgatcctagaatacatatgtggttttcagttcattgcttatggcattggttctcaacgtgtggttccttgaacactagtagcatcacccaggaacctagagatgcaaatttctggtccctgttcaagacatagtgaatcagaaactcaggagttggagcccagcaacctatttttttaaatcaattttattgtatatatttgaggcttacaacgtaatgttttgggttacatatagacagttactctagtgaagcaaattaggaaagctattgtcttggtgtagcttgtttatatgtgacaagaaccacaaaaatctacttacttaacaaaaattgctaatacaatacaattaacatgccctccaggtgattctaatgcattctgaaaatctatcaagtccatatctggcatttaataccatacattagtgtttgcagcagggaagcaaaagttttgaggagagagccctcatcagataggtctaatgaagtttaatgagtcttgtgtgattaaacattgacaagccggaagactttggggaatcataataagaatcattcgagtcatgagagtctcattggataactttcttcagcaattcattaaacattggagaatcaggatgggaagaggaggcactgaaagaaaaactggtgaatttggcatgggatcatttatctgaccacaagctgagcagggagactgttgtcttttcatggatgtcatgtctcttacagaacagagaggtcttggacttgctgctaaacccacccaaggcaaccaaattatggttgtttttattccagtaaagtggtggttctcagatcccagtgtacttgataatcccctgcgtaattattttgaatacgtatgcctgagtcacttcctgagagattgtgatttaggaggtccaaggaacatacttacaaaacagtgctaatggattgtaggtaggcggatgattttattcagatgccttgtacaaaatcagtattatttttggattgaaaaacagctaataaaaaaataaacacttaaataaagtattatcaagaaagctgttttaggaatctccacatatgggaaatactttttggtgcaatttctagtatcactgatttaataaactaaaaataatatcagataattgtttatattgttaatgacaatgaatagatagctactctatggtttactagtgttctgcattatgaaaggaacagaaaattcatacctttgtggtccagcagctactctaagtaaagtctcattttgactgttctgtaagtactttccttatcattgctaatggtgattacagggccactctattattgtaagttagctcaagcaacctggaagctgaggctacttcaatgatcatttacaagttataagaggaaattggttgtgaagagatatcccgcaaattcagaattagcatggcatatgctacttccatagagtaagaggaaacctaaaaggtaaaatgtagaagacgcagatagggaaaagcaaaaataaagcataaaagaatatgaaactgtctggatgatatgtgtgaaactttgccaaaagatgactcaaaaatcttcaatataagccgcataatgcttccatatatgtattaaaaggtcaacataagcatatggatttataaaaatgaacaatcaacaagatgcttttttttttttgagacggagtttcactcttgttgcccaggctagagtgcaatggaacgatctcggctcactacaccctccacctcctgggttcaagggattctcctgcctcagcctcccgagtagctgggattacaggcatgagccagccaccatgccctgcgaattttgtatttctggtagagacggggtttctccatgttggtcaggctggtctcgaactcccaacctcaggtgatcagcctgcctcagcctcccaaagtgctgggattacaggtgtgagccaccacgcccgccacagtcaacaagtttaaagtagttgacagtgtattgatatgagatgatttgcatggaagtaggaagatgaatgtgcagaaaaattgctgattttcaagagacataatttcagacaaagatttactaaattgttctggcttggctgatggtaacccatcacttgtgccgtgactcggagccataaaggaaaatatatcaaatagaaaaatgaaatatattaaggtgttattgcaaaatgcatgtgatgtttaggttacattgtcttgcttatgaagacacagctaagtaatagtacatatcaaatgtaaacttcatggagagatgaccagtggttaatagttttatgtaatatttgttatcgcataaaacacagaaaattcagaagtagatttatagtaaaaaccaatggggtttaatgatataggaattgctattccagtaaagtacagaaaaaaaactctcattaaaaagcataaaggttgatttatttaaattgcggtgggtttgtttactaacttcagtggataaagttctatagtaagaaaaaggaggcacaaaaagatccaggagacctggcgtgctggctcacgcctgcaatcccagcaactttgggaggccaaggtgggtggatcacgaggtcaggggatcgacaccatactggctaacacagtgaaaccccgtctctactaaaaatacaaaaaattagccgggcgtggtggcgggcacctgtagtcccagctacttgggaggctgaggcaggggaatggcgtgaacccgggaggcggagcttgcagtgagctgagattgcggcactgcactccagcctgggcaacagtgtgagactccgtctcaaaaaaaaaaaaaaaaaaaaagagaaaaatagaaaaaaagaaaggatccaggagtcttaactttgtataccaagtaaaaacctcacgctcaaaatggatattggttgtcataatgtgtttaaaatactctagcataatctttaaagaaaaatgatggtcatccttttgttatagtgacaagtcactacttatttatgttttgaattgagatttgtttatttttttccactgccttattgcaaagcacttgtcacataaaatatatgctcaagggccttggaaagccaatgaagtgagttatacatgggctgagattaatcagtttattatttcttaagcttagtagctataagtaaaagtaaaatgcaattcagtatttgaaaatgccacatactgccctctggagttttccatgcagaagaagaaatagaaaaatgagaattgcgaggatttagaaacgacatggagtagcttttaaaaataagattccaagctgggtgtggtggctcacacttgtaatctcagcactttgggaggccgaggcgggaggatcatgaggtcaggaatttgagaccagcctggccaacatgacaaaaccccttctctaccaaaaatataaaaaattagccgagtgtggtggcactcacctgtaatcccagctactcgtgaggctgaggcaggagaattgcttgaacccaggaggtagaggttgcattgagccaagatcatgccactgcactccagcctgggcaacagagtgagactctgtctcaaaaaaaaaaaaaaaaaaaaaaaaagattccagtgtatattccatgtagaaatgggaaaatttacatttttcttgaaatagtatactgcccaatatgatgcttttatttactctagcttagtagtgctaaaactttagcctgcatcagaattagctagggagctggttatacacaacttgttaggcctcagccctggagtttctgataccgtaggtctggggtagagtttggtaatttgcttttttttttttttttttttctttttgatacggagtcttgctctgccgcccaggctgaagtgcagtggtgcgatctcggctcactacaagctccacctcccgggttcacgccattctcctgcctcagccgcctgagtagctgggaccacaggcgcccaccaccacgcctggctaatttttttttttttttgtatttttttagtagagacggggtttcaccgtgttagccaggatggtctcaatctcctgacctcatgatccatccacccatgtaggcctcccaaagtgggtacttcgcttttttgacaggtttctaggtgatgttgatgctgctggtctaggaaccacactttgagaacccttgtccgagtttctcataagcaaatttgaaacaaacaaaaaaagcaacttcaaaggaattcctcaactgttttataaatgcacttactatggatggttacctttagaaaatttacaaggaaaaatcttgaaattttatggggattgttgaaagaggaacatttgtttcattcgatttttttcctctctagcaacttaagggatccatacttacgtctgatggtcatttctggacttacaaagacaatacgatacaattctgtttgtggtgaatagactttctgtatgatgaatgggtattagtttgaaaatgtgtcccctttctgctgtattgtgcccccttccccactaaaatcctcaatgccatttaccaatcttttcctgaagatttcttgttattgacaagcagagggagattggaccgtgattcaaatgaggttgacaaaaaccagaaagcatttgatttcaagactctaaatttacccaacgttttgttctggggatttggatattttggttataatggtcgtgatacttcctgactcatcagtcttctcagcattctcatttcccttacaactcaattgaaggctggccccagaggaactggggatctgtcaagtagtgttcatctcccttctcctataaagggagatgactgtatagtcaactgagctgaattctgcttcagtggagaagaaacaaataagggagaagcagttctgcccattagaggacataccataatacattgttgatgatggagcaggggggatgcctttctttttctctgagaaagaacagaccagttttgctttaatcacttgttttattggctcattttgaagatgtattgaatcatctgatcattacattcacaattatactcttaatgaactattttttctcactgtagttacactgaacttctcccaaaaattcgattgctgtctccagctgaatagacctattttattttatgaaaaattggcacaaaatgcttctgttcttttctagggcagagtggttaatttcatttgaaatatacttggttttcttataagaatcactgtgtatacatataagtacatttgcataaaatacaacatttacaataaaagtattgtttaaggtactgtattgtttaaattaattttctattattatactttaagttctagggtacatgtgcacaacgtgcaggtttgttacataggtatacatgtgccatgttggtttgctgcacccatcaactcatcacttacattaggtatttctcctaatgctatccctcccccagcccccgaccccatgacaggcccggtgtgtgatgttcccctccctgtatccaagtgttctcattgttcagttcccacttatgagtgagaatatgtcgtgtttggttttctgtccttgtgatagtttgctcagaatgatggtttccagcttcatctatgtccctgcaaaggacatgaattcatccttttttatggctgcatagtattccatggtgtatatgtgccacattttcttaatccagtctatcattgatggacatttgagttggttccaagtctttgctattgtgaatagtgttgtaataaacgtacgtgtgcatgtgtctttatagtagcatgatttataatcctttgggtatatactcagtaatgggatggctgggtcaaatggtatttctagttctagatccctgaggaatcgccacactgtctttcacaatggttgaactaatttacacacccaccaacagtgtaaaagcattcctttttctccacatcctctccagcatctgttgttttctgacttttgaatgatcaccattctaactggtgtgaaatggtatctcattgtggttttgatttgcatttctgtgatgaccagtgatgatgagcattttgtcatgtgtctattggctgcataaatgtcttcttttgagaagtgtctgttcatatccttcgcccacttttggatggggttgtttgatttttttcttgaaaatttgttcaagttctttatagattctagatattagccctttgtcagataggtagattacaaaagttttctcccattctgtatgttgcctgttcactctgatggtagtttgttttgctgtgcagaagctctttagtttaattagatcccatttgtcaattttgccttttgttgccattgcttttggtgtttcagtcatgaagtccttgcccatgcctatgtcctgaatggtattgcctaggttttcttctagggtttttatggttttaggtctaacatttatgtctttaatccatcttgaattaatttttgtaaaaggtgtaaggaagggatccagtttcagctttctacatatggctagccagttttcccagcaccatttattaaatagggaatcctttccccattgcttgtttttgtcaggtttgtcaaagatcagatggttgtagatgtgtggaattatttctgagggctctgttctgttccattggtctatatctctgttttgataccagtaccatcctgttttggttactgtagccttgtagtatagtttgaagtcaggtagtgtgatgcctccagctttgttcttttggcttaggattgtcttggcaatgctggctcttttttggttccatatgaactttaaagtagttttttccaattctgtgaaggaagtcattggtagcttgatgggaatggcattgaatctataaattaccttgggcagtatggccattttcacgatattgattcttcctacccatgagcatggaatgttcttccatttgtttgtgtccccttttatttcattgagcagtggtttgtagttctccttgaagaggtccttcacatcccttgtaagttggattcctaggtattttattctctttgtagcaattgtgaatgggagttcactcatgatttggcaataaaaaatccttctcaaccagttcaagttttatatttgtgtattctaggatagctagtgtggtagttagaataatgactccccagagatgttcatgtgtttatagctggagctatgttacctagtatggcaaaaaaagaaaagactgtagatgtgattaaattaaatgttaggggatgggatatgatcctggattatctgggtgggcctggtgcagtcacaatggttcttataaagtctgactcagaaaaggaactctaagtaaagctttggtaatcaacattattactgaacgcatgctgagtttgaataggctctgctgtgacttttaatttttttgtacaaccccaaaacataagtgatattctcttattggttttgagtattgagtccttataagagtacatgaaaggacagttcctacctcactgctgactagaacagtggttctcaaattttagtttgcactggaattacctggagggcttgctaaaagacaaaagtatccgattcagaaagttgggtggggcacagaaatttgcatttctaagttttccaggtgtgggtttgtgaatgagtggaatgggtaatctactcgtgagcactactggcccagaagaaggtttcataatctttgaaggaaatgaaaaaaaaatctactttaggcttattgatcaaattaacaacaaatcaatctctctctctctctcaagatttcactaatccttgtatttcaggccctttgttgatcatctcattgaataagccatgttacattggatagcatcacatataaggatggttgtcagtgcaatgagaactactgtcaaaaaaaaaaattgaggaacaatgttttatataaagcacctctgaaaacctgcagatataacgaatatttattattaaatatttttaatcctttttcatccttttgagattagtaagactcaagtacttctctattttcaagaagaaactcattattattattattattattttttgagatggagttttgctgtcgttgcccaggctggagtgcaatggtgctgtcttggctaactgcaacctccacctcccgggttcaagcaattctcctgcctcaacctcccaagtagctgggattacaggcacccaccaccacacctggctgatttttgtatttttagtagagacggggtttcaccgtgttggccaggctggtctcaaactcctgacctcaggtgatctgcccaccttggcctcccgaaatggtgggattacagatgtgagccaccacatctggccagaaactcaattatttttgttttttgaaaaaatagtggaacctccattaggctattcccttaattccaaatcttgtgctctatcagttgatcctcatgacctaatccaaacataattcctttttcatactttgctacattgctaagaatgtaaacattacagtgacgttttagattcctgtatctttatctgtatgtacatgtgtgtgcaatacatgctcaagtatgtctgtgtatatatcaaattgtttctgtgaaacaaagaaacggaggggtggtgagagttgaattgattcttggaaaatgcatccatgcttttgtgtttccttcttttgataaatataattactttaaaataaaaccttctatattgtctttccactgtgtgaactatttaaaattcccaaagaaagagtttaaggaacatgtgatctgactgagttgctaacatgtgacctggaggagtttacctggcctcttttagtctcaattttctcatctgtagtgaaaacaataatagtctcatcctaggtttctgatgaggattatataatatagtacttggaaggtttttagcacaccatgtgttcattaataattacttattagtattctcagctatttaatactatattctcactactcctatttgcaaaatagcactgttaggtctccatggagctctgaataaatcttttgaccataagaacattatgattcagcatctaaacctataattttttacatgctaatagtctaggtattactgtttgaaatacattatgttaagcatctgacctcttccttgtactttgaataccttgatcatttcagctaaagttcactgatggggcaaactttagaaagaattaggtagaagcattcactgactaattcagtcaaggaacaattctagaattcctactatgtaccacatactcttttttagagatacagcagtgaaccaaacataccaaaaattatgcccctgtggtatttatattctagtggagtgattgctctcaaaattgcataaaataaaggatggcaattatatttatataactgctaattcaactttatccatgtttcagattttcaagaaatgctcctttttaaattatcataataaagcagatgcaactgaagaccatttacgttcatttttacaattcatctagactcataagcactaataataaataatctctaagtcattgaaatattgtcatttatagtaagtatgtatttggtctttttctccatttcttggcaaacaactgctaaagcccatggaatctccaaaatagtgtctttgtgtgtaataatgagatgactgatggctctggcctcttagatagctttaagatggagggcggttgccaggggaaccaaccatgttattagagagttggaacttttagccttgcccccccccaccccatgccttccctgacctctggtagaggagaagggctgaaggttgacttgatcactgatagccagtgatttaatcaatcatgcctatgtaatgaagccttcataaaaccccacaattcttatggaaacagaaaaactgaatctggcactctgctttactagactaactcctgggcttttccattctgtagcatccaaaggaaaaaataagttttgtgttggttgatttgcagacaggtgtgtagcactaatgactgcattccagaagtggcagagctaaggtgatttgattttctaaaatggtaaaaaagcctttgtaaaattgcaaagaaaacaaaccaaaatcttcctttggattgcacatagttgaattgctagagaaatcaattacattaaactttgaaaaaagattttacatgtttatattacgtggagttaaattacacgctcatgtacttagttttttttttttttcacctttgtcaatgtctaaagaggcatcccaaagtcacaaaaattgtgaaacattgttttgtcatttggtaacggccagcatatgacaaaacttgtaacatatgtgccctgtggtaggcacaataatggccttcccaaagacattcatatcctgatttttggaacctgtgaatatgttagcatacatggcaaaaggaactttgcagatatgattaaataaagatcttgagatggggagattgccctagattatccaggtggactcagtgtattcacagggtctttataagagggaggcaggagagttagagtcagagaggatgagatagaagcagaatttgaagtgatgcgggaccatgagacaaggaatataggcagcctttagaagctgaaaaaggcaaacagaagggattcttccttagagcctccagaaggaaagcattcctgcttacccattttagacttctcacttccagaaatataataaatttttgtagttttaaggcactaagttttggttacttgtttacagcagcaataggagattaattcatgtcccaagtacttaaggccagtattgtcttccaatgaatgtgacgtcaaaaaaagaaaccaaatatttctatactgtttcctgtggagatgtactactctgattttttccctcttctccatccctgcagatgctgactgagttcgctctgatcatctcccatctgaatcaatatagctttctagaattttcccattcttcaaacttgcatccctccaatccagccccccaccatttgattgttcaaacattttttgtcaaacctaaatcctgttatttctctgcctaagcatccttatggtctcctatgtttctgtggaataaagtgcaagcaggtgactttgactgacaaacccctccatgatctacatcttgattgccttttcagtcatctccctcatcacatactcatctctataccctgtggtacaaactgtcatccccagtacagatgagattattttcttgcctctggctctttgttcaaacttttcctactgaatgagatgccctcctctctcctcttcactcccattccctattttattttattttatttacttattttgaaacagaattttgctcatgttgcccaggccagagtgcaatggcacgatctcagctcactgcaacttctgcctcccgggttcaagcgattctcctgcctcagcctcccaagtagctgggattacaggcatgtgccaccaggcccagctgatttttgtatttttagtagaaatgggttttcaccatgttggtcaggccggtctcgaactcctgacctcagatgatctgcccttctcggccttccaaattggtgggattacaggagtgggccaccgtgtccagcccccctttttttaaaaacaaaacaaaactttttcttgtttttaggacgtttgctcaaagaagctttgtgttattcctctagttagaactgaccatgttcttctttaggaacccatttcaacgtgtatatacttctattataaaatatacacatatttctattataaaatatacaccgtcatcctgacttgtttgcgtttccatttctcatttctagcccatgagtgcctaggtggcaggaatgatgttttattagtctctgtgttcccagcaacgaatatagtatttcagagagtagtagggtgcctaataaaggcttgatgagtgaattaaattaaccagtgctcacctgaggacatatgacatttgatgaaaattatacattgatttcagctgtaagaaatgatatttaaattattatccagccaaggtttgttttcttcaacgcatcacttaacatgcccctgtagaatgccattgagccacttaaattatgtatttttgtatgtttgtttgttttcttttttgagacagagactatctctgtcgcccaggctggagcacagaggcttgatctgggctcactgcaacctctgcctcccggattcaagtgattctcctgcctcggactcctgagtagctgggcctacaggctcatgccaccacacatggctactttttgtatttttagtagagatggggtttcaccatgttggccaggctggtctcgaactcctgacctcaagtcatctgcctgcctcggcttcccaaagtgctaggattgcaagcatgagccaccgcacccacccacattatgtattcttcattgagactgtgttcctattcttttttccccggatttcttgatgagcattttgtgaaagcacaagtaaaataatgttctcaagtcaaaacaaattaaataaatcaattcctattagtacactggacttgtcatagaagacaattttgtgagtctatatgagatgtactgtgttgttcctaaagccatgatgatttctgttattccatagaagtctaataaagcattcacagagtaaattgtacagtgttaaaaacctgccatctttatcactttcagtaacaccttctaaatgatcgtgagtaatttgtgattttaaaaattatatttttaggtatcaaagcaataatgaaagctttttgtcaagtgaatcactaagtaaaagtttgcatttatcattcatgtaattacagaatattcaattgactggaaacattccttaacactttcttcttaaataagcatggtggtaaatttccaatgatgtctatattcttacgttttgttttttcacagaggatcttaatggcatgtattcctaacctgactttatattgctatatgactttggggaaattacttacccatgctaggcctctgcttctctaactctaaaatgagaataataatgttgataatttcaggaggttgttgtgaatatcaaatgaaaatgccagtaaagcacttaccgcaatgcctggctcaaagtaaacgcttgatcaagattagctataaatatcattactagttgtggatacctgtgctttatttgtttatgacataatgctcttcatttaggaggcactctatgagtgctgttgactccatgatactccaagtcataaaacataattaaactacaaacctggatgtcaaggtgatttacaatgtaacagagatatgataaatctacaactaattataaggaagtatatgattaattgcttgagaaggtcaaatgtgtaataggtttataaagaaagcagaaatgacatttttagctgggctcaggtatcatggtgtcacagcagcaaaaaaaaaaggctccatttaagcatttaagaatgggtctaattttgacaaaggaaataaagaggtattctaggcaaggggcagcaaatgactaagaagaaggaggagagtggaaatacttaaataaagcaaatagttttagttttacttcagtcaccctactattagtttgagaatttttattacctttatctctaaataaaactcactgttaataggtgtttacataacagcctgtaataagcttttaatatttgttttcatgttgatgtgtgaaggtttttttattcataaaaattatgacacatacaaaatatagtgttgctataaaaatgaatgatgatcataccaattttttaaacagctagatacatgcagcagagttgaaagcaaataacaaaaattctggtatgaaaaatgatgtaattggcctcataagtcttctttgtgaccaacttggacagttgctctggctgatacaattcgttttgctataatcaactattaggatgccagaaatgagtttgacaccttgagtacaatcctttagtccagttttgaaaaaggctaggaactctgcaatagtaaaaatattaaaaagtcagtttaggttgagaaacccttgatttaaaagacttttatttgcaacaatggcctagtagaaaggaaagaaagatagaatataagaaaaaggaggaggaaagacaagtatatttgtaatcttgttcccatagttgtggcattaagttaccacggttgcaggaaaaagaaaattcatctctaaactgatctaaggtaggactggagtgtcatatctttaatacatatttctgttattactaataattataatgataataataggtatttacttattgactagtatatgacagatattctatgtggtgtttgtgtacataatttataatgcaagagaaatttttaaaaaggtatgtacatttcataggtaaggaagtcaaggtttaatgaataagtgacaaaatcagcatttgaaattttttctgcagaaaagtaaataccacatattctcacttataagtgggagctgaattatgagaacacatgaacacatggaggggaacaccacacactcgagcctgttggagttgggggggagggagagcatcaggaagaatagctaatagatgttggtcttaatacctaggtgatgggatgatctgtgcagcaaaccaccatctacctatgtaacaaacctgcacatcctgcatatgtatccctgaacttaaaagttggaaatccaaaataaaaataaagaaacttgttctgtataacaacaaagtatttagccattcctctgttctagacttggtctagaagggtcttgcatgatgtttggcttataaattgaggagcaaatgaatattttatgaaaacatttactaatcctcagaatcttctgccaagaattatgacatgtgtaagacttgactctacttgaaagctaacaaggtagcttgccacaggttcatgaatactggcacaaaagacacagagtattgggacagaggcaaatggccttattactcatggcaataaaaactccccaaaccccaattctgagggtgtggcatgaaaaaggtcagatgacgcctgtttgtactgtgagttgcattataggataggaaccctgagtatagggaaggtaaatctttatactggacagtaagcatgcatgcccattgctctgaaaggagacactgtcttcatcttccaaggccgttcacaatgcaaacatcttttaaaacatcatctgcaccaaagtacctctacttgcaagacttaaaaaaatgtgagcaattcaagaagaattttctcctaacacctttcatttacacaaatgtattcttaggcacatggaaccaatctatcccgttttcaccccttactcccctatcctcatactcttctgctttaactgttatttagattccaccatgctgccataggagagactctagctgtaatacattcaaactgacattgaccagcctgaaactggaaggaaaccatatacttatttggcacaagggaacttggctaactctgaaaagctggtctaaactgccctctagagctctactctaccaattagtgccaaatctaaccaattacatgcagttcccatgcatattcctctctttgtaaatgaaaagtaagagctaagtaagcagtgggtcacccagcttctggctaaactagaatagcttgcttccccaggagcctgcaatacttacagcctcaaccatgtggttaaaatcattctccttccacagactactcctctgtgtctttacaatgaacttccatccctttaagcaatctctgcatgtctcttcctttgtgactctgagaaatttgactggcaggataggactatatttatcttcctaattttaaaagcatttaattaccaataattaccaccaatgtgattttttcccctagtgcacattaaaaattttgaatcccattttctgtaataatttaagttgatctggagggacagagagtaattaattatctataatttctcaaactgtaaatgccgaatttattgaagtgaaacaaatccagggtagaataaggctgaaataaataggattgcatgagaaagaaggatgcagcaaaattaaatattttttcaaaattgaaagagcttaaagctcttaagtactgtagttgggttaaaacatacactttttttttttttttttttgagatggagtcttgctctgttgcccagactagagtgcagtggcacaatctgggctcactgcaacctccgcctcctgggttcaagcgattctcctgcctcggcctcccaagtagctaggattgcaggtgcccgccaccatgcctggctaatttttttatttttagtagagatagggtttcactgtcttggccaggctggtctcgaactcctaacctcgtgatctaccagcttcggcctcaatgtgctgggattacaggtgtgagccaccacgcccgcccactattttaatcagtatgtcaggtcatgtctcctaaagccctttttaaacaaaaattgagtgtttattgcttgcaaaatgtttttactgtaatgagtttaatatacaactgtgagccataagaagggaacaattgagaattgtgttgtttttgttttttgtttttccactgtggttctttaataattggtatagtttagatagtacgtgttttttatttgccaaatatgtaaacgttcttatgagcttctttacagaacgtcttcagtgtgaataagaataaagcagaatataagatgtgtctgtgcattttgcaacgtattgccatttaaagggcatggattttggactcaatcacacttaagtgttataagctctgaatgtattaatgatatgattttggacaagatatttaacctctctgatactattttcattatctctaagctggtgataatatttatgttgcaaatctcttgtgagggcattatggaataaattataaagatatctaaatcagtgtctagaactctttaaatgttatcttcatttccccctctttttcctagtttttcttgttcccttatgttccctaattatcttaatatctaattcttcctgttatataagttctcagaagaattatatattcatataaagtaagtgttcacctgttttcagtaatttcattatctcccatttgagaaattagaattatttcattactgctggtaaatatgaaaagaacaagaagaagagggaaaatattatatattttcctacccaactttttcctaaagcttagcactaaaagctcaatttttatatatacgttcataaattacttgaatcattcaaaagttgtctgggataatgtgtgattcatattttatatctctactctggcactatcagatctgtatatcaggaaatgtactttgaaaactctagatctttataccacaaacacaaggcattactattgataataatataatccagttatgggccacacattgtatgaggcattagaagaagtatgacgtgaatggcatgttgggtcatggtttaagagataagtggtttagagcatggaccttgaagttaggcagatcttgtttcaatcctgactatcactcactgtttgaacttagacatatcatctaaactctccaagcctcagtttcctcatctctaagatgtgactaatacttactaccttacagtatcattgtaggatacgataatgtatgcaaagtgtgatgtatactgactagtacttaatgcaaatttaataaatggtaattattagtactattgctaataagacaagacatctgtccttatggactgtcagtgtagttgagaatagaggatcatacgctatttggtatcatatgaagccagatgtcctatttccaataatagaggttttttaaaaagtactaaatgggtataagaaagattaagtttcattggttgactctccaaatcgatttcagtagcaaccatattccttgcacggactatcaaactgtggtacctgctgcagagggattctactgatattaacttatgttggtgttaaggattagtcaaagttgttgtgaacatgacaaaatactaaaagcacttagcacagttgatgggatacaccagtaattttatagatgttgcccatttgtatattcttgtcaagaaccaattttgtaaggcagagcttacaaaagactgttccttgctgagaaggctgacagattcctggtaattgatgccgatgtgtgttgaaccataattatgaactataattagtactatcctccatagattagaatggtctttatggaaatccttttttcaattaagtactgtttatggcttatgccaatacattcagtattaagtcagaactcttccctgatgaaagcatgatgaatcttgcaatgacctttataaacttaataaaataacattaattttaaaatcttgtatccaactcaattatatactggtgtattgaggatctgttctctataactgaggtgaataatacgagaaaatcaaataatattgaccagttgacatgaaaaaatacttattttggaattggctgtattgatattatattctctgaaatgcgcatatatttcaccatgtctcaaataatagattgtatatagttaagaaacatttgtcattcaagcaaaaaatgagtttcatgtatttgcaatctaatatatataggtatatgtatatatttgtgtttgcactgatcaaacaaggttaaatgtggctttcttgcctatttatataactaattgtgatgtacattaattgaggtaatgatttaataattataaaaattaaataaataagcactacgtatataatgtaataaacagaaatcaaccttatcacttacttttcttttaagtgtattgggctattgttcctcatgttccatgaaacctagtccgcattttataaccctcggagtcactttcaggagaaaaaagaaaagccctcctctcagtgattaatgtggcctgtaataatcaaaactctgtacttattttaaagcagtggtttccttcttcatttccccccacctccccatcagtctggcccagcagcaagctaaaagcccagtcagaaaaggagatattatttgatttcttctttctttccctgccatgtactttgacaccttttgctgtatctttcaaaccaggttttggattccttatgattagagtgtggggagggaaaagaaataaagggggcagcagagtgttaacttaactggcattgtggtaatagtccacagggcgcttcagaggtagcaccgacctcccccatggagaaaccttctgcctgtggtttctttcactggataaaagtacctccatttcagcttactacagtctccgccctcatccccaggcatttagaagctcttttcacatccttctgctgaggcatgtggcccttacagagatttatcttggtcagggtctaagatgcgactaccccagctccttgtcgcacgtggcccacctctgttccattcatgctccaacaaaatttgagaccaactccaatgcaagagcaaactctcctttgctatggaactccccagctagccagtctactcagctatgtatcaggcagcagtctattctttcgttctccacaaaccgaagggtgaaggttttctcttgactcagagtgaaggggaaagtattccccacccctccaaaggggacacgactcgcaggcatatggacagttgactccaaaagctgtttcaacttcttacccctttatgcccttgtgtgtgggtagtcaagagccatggcagatagaaggtgtcttgttcttcaactgaaacttaaattttaaattgcattacataatttttcagtatttctctattatctttacaaaagaacatatacttactgaaaacaaggtatctggcatccctagtgtgcattttggtggccccaaaatttctttgcagtgaacacatttaatagatggagtgattatttaacagggaagcatttatttgaactcttaactgtttaatataaccaactagtttatttcttttacattgtaatgcactaaaagtaactataaactagaaaaccaaatctatatcattgaggaacaattctattctcaacattgaatgccattttaagattaatggttttggcttataataagaactaaatataattttaaaaagctattttcctatttatccatttatgatatcttccaaataaaatgtgattccactaaaattattgatgatattaccataaattcctaatataaaacagacaaaaaatatatgtagcaatctattttctttgactgttgtcataaaaactattggatatgtggcgtgtgtgaatatattatggttatgttcagaacttattatctaactttttctcatgaggaaaaatgattaggaagtatgttagtactaaccattaactagaacagttaatatgttaaatgttcataatattaacaatagcgttttaagcacataccttaaagaacagtttagatattagccaaagaatagtattattattattattggttgagtgttctatatttacattataggatttttattagatagcatgcttataaacattcttcatataaaatatagctaaaagttgagtgattgaagataactttattgttttttagtttataatttactttgctataataatctttcccatatgaatatcatattgattatcagattttccactttgaattttgtatttgttttttcaaattgtcagtgttgttaatattgacaagtagaaataggtaaattgaacaaccaagctacattagtatttcctactaattttttaaattgctagtgattaaattaaatgtcttatataacacaaattctcagaattcccatattaccatcttctaaaataaagttttctgttttttaatttataatattcatcaatagaaactgcatcagaaaatagcccatatattaactcttgcatttaagattttggcagaataaaagataaatagccttttaggaaaaaatgtaccctatttctcccccaatacatcgtagatctagggtaaaactactcttttatagaaaggcaaatcaattgaaatatagaattattctatagatatagtgtagtaaaagattagggcaggttggaggcgggtgtcatgataaaaatgtagaacaagggagtaattttatgatgatgaaatgaaacagcctatatcttggttgtcatagtggttccacaaaatgatacatataataaaattgtaaagaattaatacacacataggcaaataaattccaataaaaactggcaaaatctaaaatactatatgtagattgtaccaatgtcaatttcctagttttgatattgtactagggttacatgttacttatggagtaaactggataaagaggacaggagacttctctgtattatttttgcaacttcttgatctatatttatttcaagttaaacgttgaggaaagataacctcttgaatgttttagagtttcttccatttaaccaaagttgtgaattgtttttcctcaagagacctgtttttcacagtaaggttgcttaaaattagagaatggcctaggaaattaggtatatcattaatatcaaatatacttaagtaaattaaaagagcatttaaaaatcattggactgaaatactttgaatcaaattctgaaagagaaacattaccatatataaattaggcaaagattattatgattatttaacaaataaatttagccatgtaaatgctttgtttttttctcatgaacatcatttatattcatggcattgttagtaaaagctagtacctctgtttttatagattttcatttttttaaaacattaacacaaaaatgatttatacagtgtattaaaagatcagtcctctattgcactgttagcaagggctatctaaagcaaataggaccttgagatctaaatgtattgctgcattcatgtgtagatatctaatgtgtacccaccatgtgctagacactattacagaagctgtggtgtagcatttggggagaaaaagaaaacaaaccccttttcctcaaagacttttctttctgttctggggagatggaaaaacaaatacatgtgtttcaggtaaaaatatttaaaacgagatttggtctataaaaagttgtttaaaagacactggtatttaataaagacgaaggaattacttgggtatgaaatggtaattatatttattaatagagcccacaaatgtagtattagcatcatactcagcatttagagaattctcaggagtggagtcgatgcatatcttttttctcacatgccccacagttcctttaccagaggaaatgttccctatatataatttgaatgcattgtcattactttttttttttaacactgctccccttgaagtgggtcttccagtattggagatcaagttccacagtcacctcagtttataggtgagaaaacctatttgaagttaactcgccccaacccatttaatcagcaaatggcaaagatgaatttcagttctggtcctctgactccaagtccagaacactttcagggtaggaagaattatctcagaatatcttttcaaatagatctagcacaacactctcaacttcattttcccagagtcttatatattgatatgcttttcacagatatttactgagtactctgtatgtacatggtttctaggtgctgggggtgagaagagatatagtgaagaatgagacctaggttctgacgtcagtcctaaactgtgaagtagaaattctgtgtgtgcacaaatgattacagtattaatacaagggagaaagtggatcatgccatgagggaggcatagataaagtgctatggaagaccacagaaagatcaactgcttctatttccagacacccaggaaggtttcccaaaggaagtggcttttgttttaggctttgaattgggaggattgtggcaatggaactgaggctgtacttgggataagtacttttatctctccaatatagtaaattcaccaatatcgtccaaaagtttgttcatttatctaactaattactttttttttttttttttttggagacagagtctcactctgtcacccaggctggagtgcagtggcgccatctgggctcactgcaacctccgcctcccgggttcaagcgattctcctccctcagcctcccaagtagctgggattacagacatgcgctaccacgactggctaatttttgtatttttctgtagagacggggttttgccatgttggccaggctggtctcgagctcctgacctcaggtgatccacccgcctcggccttccaaagtgctgggattacaggcatgagccactgcacccggcctatctaacttcttaacctaaatccctgaaccttccaatttctgtagaaatttacactctgaagcagttaggtggattcctaaatttcctagatagtaatatgtctaaacaaattttcttcggtaatacttgacaatactaccccattatcaaaataacttgaagttagctgccaaaaagtccagatttatgccaggctgtcaccatgatgattttaaatttctgcattagtagatattaaacatttccaaaagtgcttaaatttccatccactaatttttttgtcataaaatagagattgcagatgtattttgtactttgaagaatattaagggctgaataaggtggaagcacttacaactaatgagcctgcacatcttgagtgagctacctagagaatgtttctccttagcaataaagaacgacaactgctttgttctagctcagtaataacaataatatcgtagtatgtcctttgggaaactaactgaaatataagttcagataagttcacatccttgtaaagcaatgatattttgctatgttgctttcctacttaaagctgccatggataatgcacaattaagtcaacacatctaggcttaccaaaaataaattcctagattgtatttggtcttatccatacaaatgcttttggtttatgggcctgacaatggaggagattggaggtcagaataatctcataacagttactggttgaaggcctcttgttaacccatcattattgctttgttcctatgacctggcatcagacttacccttctaatcagcagtgcagacctcccccaccacccctcctcccattttaactagaactctgcagggaacctcacacttgcttgactgagccataactcattgtttaggtctggccagttttttctcttgggggcagtaagttcctatatcttaactgccaactcctgtaaagggtaattctccatgatgctgcatggtattacactatactatataatataatactatactattatattaatataatgggaagcaataatattgcatcctgccttaccttctatctagtgtatattttcctaatcataggagctggcttttggatagcgatgccagtcctgctcaaacccaacttcatctttttcttttagatacgattttaggattcttagaggttagagccacatactttccttattctgtgtcccttcagtcttgttggccctttaggttacatctataaagcctaaatatatgcgttttaagttttaattattcactgtgagtttttgtttaactgaattatttaatttacttatatacaagttgaacaaaaaattaagtagaatctgaaagttatcattcttgctttctacttagaaatatagaaatcatttccaaagaaacaactgctttattgtaaccaaggcttgatttagaaaaaaacaatccatgatttttaaatgtctgatgtctgtttggagaattatctcaggctctctggggggaaaaaagaattagtgtatttgattcatactgcccatctctaaacccaattgacagccccactttaatgaaaatgcagcctgactttcctgagtgaatcactatctgattatacaaatggcccacaaatttctctgcattctctatgcctatacttccttcattcttggcagtaaattttagaaaggttgctgattttttatatacatcctatattatagggcatgtgagtgacattctaattttttaaagtaggcaatttagactgttatttaaattataagtttactgggtatcagcattatattttcttagttctttaaggaggtatttcagtgagaattttttttttttttttttgagatggagttttgctcatgttgcctaggctggagtgcagtggtgcaatctcgcctcaccgcaacctccgcctccctggttcaagcgattctcctgcctcagcctcccgagtagctgggaatacaggcatgcaccaccacaccaagctaatttttgtatttttagtagagacagggtttctctgtgttggttaggctggtcttgaactcctgacctcaggtgatccaccggtctcggcctcccaaagtgctgagattacaggcgtgagccaccgtgcccggcctcttctacccattttattttggccatcattgtacaatattttgatccttgagttggataaaaatagaagacatgcttttcaaatatatggattatgcaaattaaagtaacagaatagagatttatgaaccactctcaggctagaaggaagtgacaatttaataagagaacatttaataaggatacacacagaatcctgttcttggtcacagtagtgcactgcagaaataaagaacaaggaagatgccgctagatttggcaaaaaagattttaggttttttttttctttttttctttttctttttttgagatggagtcttactctgtcacccagactggaatgcagtggcatgatctcggctcactgcagtcaccgcctcccaggttcaagcaattctctgcctcaggctcccgagtagctgggattacaggtgtccgccacgacacccacctaatgtttgtatttttagtagacacggagtttcaccatgttggccaggctggtctcgaactcctgacctcatgatccacccacctctgcctcccaaagtgctgggattacagatgtaagccactgcgcccagccagattttagagttttcatgcattggtaagctcagcataagttgacagtttgatgtgactattaagcaggcaatggcaattgttggccactttaatataaatatattccctgggtcagtatttctcagagtggcttattgcatcaaaattacctggagaaattgtaaagtatagaatgcaagacccaacaagttatccactgaaacgaaatctcttggtgtgggatctgtatttttaaaaaaactttcaggcagtttttatgcaaattaaactttaataaccattaaaatggactaagggcaattttgatgctattctgttttatcctgttttatcactgcaggatagttgcgttttactctcttgcttatactttaagaagggtgtgaaattttggctgcattcgggaaaaaagcaactttacaaaaatggggaactaattcatgtccatgagtaatgcatggagaaaatggaacttttacatatttaggatataattgaacaattaaataaattatggtggttaatttgactgttattcatgaatatctgataaatatccactaccataaagagattgttgtgaatatcagatagtaacatgagaaaatgtttgtataaataacgttacacaaatattttgattacaagtgtctaaaaagaagatgcacattaaataacaccagaaaaaatacacccaaatgataagtggttttctttgaatgatactataatcacttttttttttgcaaaatagtctctgtttatgaatatgctcttatatacttaaattaattttcaaagttaataaaaactatgatattgttaattacctcaaataataaagtatactgtagatgagcagttcccagtctttttggcaccggggactggtttcatggaagacagtttttgcgcagattagggggcggtgcagctgatttcggggtgaaactgttccacctcagatcatcaggcattactaagattctcataaggagcacataacctagatccctcgcatgcgcagttcacaataggtttgctctcctatgagaatctaatgctgctgctgatgtgacaggaggcggagctcaggtggtaattcttgctagcctcctgctgtgcggcctggttactaacaggccacggactggccctggtctgcggccttggggttggggacctctgttctagatgataaaacattatttttttctaatacaggcaaatataaagaataatggtatgaaacgaatggaagtaaattctgactggatttaggaaaaaattttttctgggtctcaataggatgtgataaaattcacttatttaatcatatgtaccaagttctactttttaaattttgttgaagcaaatgcaatttatactttttttacaccatattcattaagtacctactgtttgttcaggatatacccatggctgttttgctatactgatggaagtttataaggctatgtattaaataaataatgttctggtttttaagttgtgtatttagaacataggcctgaaagcaaatgcttgtgtaaaaagaaaaaaaaaatccaacagtcaaaaagtcaggtctatgttataagaaatacagcattcctggaaaattgcagtgctttacattgcccagatgttatcatcgctgttgggttccttggcagagtcattcagaggctctgcatagctaatactatcatggttctctgtggcacagcccccccttgattgcatttagtatcttcttcctccagcttggggcttagcagtttctactcaaaaaagtgacacagcaataaaatttgaaaccatagaatgatcactcatcctagtgatgtgttatttggcatctttgaatatatgactattgcaaatagttcatttcaaattttagcagattgttttttctcaattcaaaatcacattgaaagggggagagaaaactgccacagtggaacgtttgcaggtactccattttttcccaataaaataatgttttatcataaattcagcatgtgttaagattgacatatttatagcatatctgggcaggatatagcaactagagctgtaatgattgctttctctactataaaaactatgacgctcatattaatacttaagacatatttatattattaagctcacattaatattaccataaaatatgacagtttacaggccatgtattactacacgggatttttcttttcttttttttcttaacttttattttaagttcaggggtatatgtacaggtttgttacatgggtaaacttgtgtcatgggggtgtgttgtacagattatttcattacccaggtattaagcccagtacccagtagttatttttcctgatcctctctctcctgccaccctccaccctctgataggctccagtgtgtgttgttcccctccatgtgttacatgggaatttttcattcactcttttactcacttcatgatttttggtatttgattaggagcaagaaaaacaaggaaaaatagatacagtgtctctttccatctgacattttccaatgcctagagtctataattctatctttcatcctattagatatcataatccagaatattatttaccaattttatgtcttattaactacaagtatatttagccaaatatttgcatagttatttcaagtacatttatatttattattttatatttttcattgcctattttgaaattatattttttaaatttctaaaataaaattaattttgataactgtaatttttacattggtaacttttgtgcattttgtcagtttttatagtcattgtaacacatttaaaaaaaaatatgacgttgtctctgttttttaactaaaggcaatttacattaccattaacaaggatttgtatatttttaagtcataatataaagagtcccttccagagagtcctccattccagtaacatacttaggaaataaataatgcatatgcaaaagacatagaaccattgtcaagatagcactttccgttttctttctttattgggcagacctatacacagttcaatttgcattaaactattttgactttagtataatcattattgatttttttttttttttgagatggagtttcactcttgttgcctgggctagagtgcaatggcacgctctcggctcgcggcaacctccgcctcgcaggttcaagcgattctcctgcctcagcctcccgagtagctgggattaacaggcatgcgccaccacgcctggctaatttttttgtatttttagtagagacgggatttctccatgttggtcaggctggttgcgaactcctgacctcaggtgatccaccagcctcggcctcccaaagtgctgggattacaggcgtgagccaccaagcccgacctattgatttctttttaatgaagtttctaggtttaaatatgattaagtttccctaccactgtaaaagaaaagttttgcatcagacacttgatacaattggcaagacatatgcaaactatgcaaccgacaaaggtctaatatccagcatctatagggaactaaaacaagtttacaagaattgaacaatcctataaaaaagtgggcaaaggacatgaacagaaacttttcaatagaagacagacatacagccaacaatcatgaaaaaaagctcaacatcactgatcattaggggaatgcaaatcaaaatcacaatgagataccatctcacatcagtcagaatggctattatcaaaaatttaaaaataacagattctggcaaggttatggaggaaagggaatgcttatccactgctactgggaatgtaaattacttaagccattctggaaagtagtttggctgtttctcaaagaactcaaagcagaattatcatttacctagcagtcccattactgagtatatacccagaggaatataaatcattctatcataaagaaacacacatgcgtatgttcaccacagcattattcataatagcaaagtcatggaatcaacctacatgcccatcaatggtagactggataaagaaactgtggtacatatacaccatggaatattatgctgccataaaaaagaatgaaatcatgtcctttccagcaacatggatggagctggaggccattatcctaagtgaactaacacaggaacagaaaaccaaatactatgtgttctgacctataagtgggaaccaaacattcagtacatgtggaaagaaagaaggggacaacggatgccaaggcctacttgaaggtggagggtgggagtaggatgaaggttgaaaaactaccttattgggtattgtgcctatctgggtggtgaaataatctgtacatcaaacccccatgacatgcaatttacctatataacaaacctgcacatccacccctgaagctagaataaaagataaaacaaaaaattgtcaagacagactactacaacaggggagaaagattttagtacagaactgagatctgtactaggtgagaggatttttaaatgctgaagtatagtaacagaaaagtaccgaatggcactggggaaggagggaaatttgtccaatgtgattggaccatctatatgtggtcattgccccatttcaaagttaggctactaccatctcacagagactggaagatagggcccctatctttatttgtttttattgatacacaatagttgtacacatatgtggggtacatgtgatattttgatacatgtttacaatgtgtaataaccaaatcagggcagttgggataaccatcacctcaaatgtttatcttttttttgtgttgtgaacacttcaattctttcaagctgttttgaaatatacaaaaaaattatttttggcagggcccagtgcctcatgcctgaggccaaggctggtggatcacctgatgttgggagttcgagaccagcctgaccaacatggagaaaccccgtctctactaaaaatacaaattagttgggcgtagtggcgcatgcctgtaataccagctactcaggaggctgaggcaggagaatcgcttgaacccgggaggcagaggttgcagtgagctgagatcgtaccattgcactccggcctgggcaacaagagcaaaactccgtctcaaaatatatatatatatatatatatatatatatatatatatagttaactatagtcagtccactgtactgtcaaacactggaatttattttttaactgtatttttgtacccattagtcaacttcatttcctccccctctctctaccaccctcccaagtctctggcagcaaacattctactctacctccatgagatccaaatttaagctcccacatatgagtaagaacatgtgaaattgtttgtcattttgcatcttcctgtttcatttaacataatgacctccaaatatccatgttgatgcaaatgacaatattttatgacttttatgactgaatagcattccattgtgtatatacaccacattttcttcacccattcacacatcatttagtcaactgcccgttgatagacacttaggtagattccatatcttggctattgggaatagtgctgcaagaaacaggagtgagaatatctcttcaatatactaatcgcctttcttttggatacattctcagcagtggaattgctggatcatatggtagttctatttttagtttttctgaataaatttcttacagttctccacagtggctgtactactttacattcccaccaacagtgtacaagagttcccctttccgcacatccttgccaccatccactgtttttgtctttttgatgatagccattttaactgggctgagatgacatctcatgtgcttttgatttgcatttccctgataattagtgatgctgagcattttttccatatacctgttggccatttgtatgtcttcttttaagaaatgtctattcatctattcaggtcttttgcttatttttaataggattatgtgttcctatacgctctttgtcaagtgatgttatgtattcatttaatactcaactataatgattaataatagttgtagtaattatatttttcctataagtaaaataaaattagacggatatattgtattcctatacataatcctgttatgagttccctatacattgtgcttattaatccctttgtcttttgcaaatatttactcccattttgcagcctttctcttcactttgttgattgtttccttcttgatgattacacttcaaagggatggttcctaggcccttgagaaattcattcttgggttgtagaagattcatctcaaacagtcagaggatttataattgcaaggttcctaaactaaatgctctaagaaacggaggtttgggttggaacaaagattaaaattttttggtagcattgaactttttcaggaagaaatttaagggaactggtgtcagcatcctagggacttggccctgagttgttagaaactatgctattatttgttcaagtctcttattatggggggtagacaaaattgtttgtactgaaaattgcagttcccatagaccaaggttgaggcctagccgaggagagagttcagaggagactgacaaaagttggtcaaggaaagagtctttttcactgacccttcaccttaggaaaattgcctgcaagtaatggcttatattagtgaatgtaaattttgtaaatattttacttttctatacttatagttgcaattcaaacattcgaattaaagaaacaagttgtgaatttaggccataatatttgattttatacattctgtgagattctcccaaaacgcatgccatcccagtgtaagcctggtcatatatatattgatgttatatagcatgttatcagctacattttgcataatcagtgtggtagattctggattcagagttcatgacctcaaaaattgactccacctcttatcaactgtataacattatcaaattgattaaactgtccaagcttcagtttcctcatctgcaaaatgggcattatagtaataggtattgcataaagtaactgtgaggattaaatgatccaagtgctttgcagaattcctggccagcagtaatgactcaatagatattagtttctttttattttattttattttttttattattattattttttttgagatggagtctcactctgtcgcccaggctggagtgcagtggtgtgacgtcggctcactgcaacctctgccacccgggttcaagcgattctcctgcctcagcctcctgagtagctgggactacaggagcatgccacaacacccagctaatttttttttttgtatttttagtagagacagagtttcaccatcttggccaggctggtcttgaattcctgacctcgtgatctacccacctcagcctcccaaaatgcatgctgggattataggcgtgagccactgcgcctggccgatattagtttctataatttgtattagatattattagtactgaataagtactagtggagaaagtaattacctgatctatatcattaacttatttgaaaactcttgaaaataagagatttcagtttttatttgaattttcttctgtcatttgctctgtatacttgctgttcttagcccattttcctttatttattttgtgtatgtataggataattaatttaaaatgtgtcatatttaaaagaaaataattttatcagttaaatgttaattctgttttttttcaagaacaaagacatcttttcttctgattcataactcgcctgagagggagtagacctttgagtatgtataacctatatatagtctggcttatttattaatagaggtttattttaaattataattgaacacagagtttaggaagacaattacatttgagattgctaatcttggggtcagagaaacttgattgcatacaattccaaactctttgtcaagtgatgttacgtattcatttaatactcaactataatgattaataatagttgtagtaattatacttttcctataagtaaaataaaattagacggatgtttacatggattatctcattgcatttttacataaattacataaaacacattttccccctgaaggaaacagtaatatatacatatgtatacaagtatttgtaccattttaataccaaatagatctagtttttaaaagatatatgtactgaaaagataaaaaaatgtaaaaattggaagggataattattgaaaaataaggtgaagatagtggtaagttaatacacaaaatacatgccatacagttctggaaactttgctgtagttggcctataagtgtttaacctaatagtcacatacattttattgatggatcagagactattttatttaaaacgctttcccaaattcagatgtcatgaattcacatgccttccagtcctcaccccaagggctagaaatgtgcttttatgaagtctttcttgcctttttttgtggagtgggggcaggggggaggattgaaagagggaatggtactgcacggctaaatttcaaaattttgttctgtaagtggaattttaatgtattcttcattttctaaaatccaagaaacaagagaggccataaactatttcctcaaataaacttagaaacacagagacagttttgaagtcatcaaagataaagtaaaataacataaatgattgaggttgaattatctgcgaaaagaacaaacatactttacattttgccatatcctgggtcatgaagtcaaaatgaaatagtcattcaagatctaaactctttgaaaactctgtcagccaaaatttcgaattttgaccatgtttgctaagcatattgccttctaactcaaaaagcagaaagagcaatgcttatttttaattttcttgcactatgtagtatttcattacatttggccagtgttgtgttgagaatgctcctgaacagttcaatggataactatatcaccttaatttctttcttacgagttttagtgtggtttctcaagagaaccattatacccatgctgacctagcatgggatatactagaggagtatgtgtgcttggttatctgagacagtattcttttatcatatttgcctgtatttcactgctttgacttcattatagatatcttatatagactgaaaaatcatggacttatgaaggcaacaattcataccaaaaataaagagtgaactactaaattatgttacaaatgaaggaagacgttaatatcaaagcaaaacttcctgtcaacacgtgagcagtataattctaataagcagttaaaatagcttaagaacgtaaaacttgggttttataaatacatatatatttgtaaatattgatctggatagttattttaagctgctttgaaatcacatttgttccctttggaaatatgcaagagagacaattacttgcctctcagtggactattaaggtttgcctttgcttatacctggtacaaaataactatatatctgatgtaagcaacagagatatgttatgcaagagtagatacggtatgagcagaatcatgcaaataagattcatattagaaatcttgtgtcccaactctggtttgtcagtggtgaaaacagagttaacaggtaatgcataggttcccaaattcctgatgaagtaacatctctctaaactacagatcaaacctccaacagactcagtcaacaaaagccataagtctaaaaacccaaaatgaatttggcaatgagaaatagagcagcgagaaacagtactgggcctaaagagccagaatccattgacttagaatcatttttagttggttggatttaaaagtcttaggtaggggccgggcacggtggctcacgcctgtaatcccagcactttgggaggccgaggtgggcggatcacgaggtcaggagatcgagaccatcctggctaacacggtgaaactccatctctactaaaactacaaaaaattagccgggcgtggtggtgggcgcctgtagtcccagctactctggaggctgagccaggagaatggcgtgaacccaggaggtggagattgcagtgatccgagatcccaccactgcactccagcctgggtgacagagcaagattccaaaaataataataataataataataataataaataaataaataaataaaagtcttagctaatctttcttcattagtacttctcagagtataggaagaatacattaaaaactccaagcaaggggtgggaggtctaagatggagagtaaagtgttggcagtagacatcacacagtatacagccaagcatttttggccaacttcctgctttaggataaagaaggcatcatttttcccatttgacaattgagaatgttgagacccagaaatgatagataacttacaaaggttatacagcaagaaagaaatgaaaatagtagtagagcctgattctcttaccttctatttagcactctttcccagatgccatgttgatagcactgcctaaaatgtgtctagtttcgtacttttgtcattgttttgatataaggtgcagtgggtcaagagaaccatgatattcaattcgtgacatttaatctatttttattttgtttctatgtgtgactgcatgtgtatgttcttttttctgcatactgcatttcatttccactctcctccccagtacaaacattgtgttttaagtataaatttttttatttgaatggtgtcctttcaaagtatgaattgctttctgtttgtgaattataatttatgtaaaatacattctgttagatatttcatttttcatcttgttttctcactaaggtttattatttgttaggatccttccacattgctatacacctactctatgacttctcacttcatggtgtgtatatattgaatctccatgaaaattgggaatagcgaattccaagctatttatttccttgccaggcagccccttggctaggtgcgcttatacaggcacaagctatgcatctgtacatatctgcaatgaagcccatggttgtgtatccagcaaattttgcctctttggccttgatggaaactcaggttacttctagctctcaccattaccaatagcactgtaatgaatagccttgtatatgtgtcttatgcacctgcgtgaaaattttcctgggataaatgccaattgtagaattgctatgtcaaagggtatgtatatacttaatttgactaagtagtaacagatggataggcagattgctgctgctgtctaccctaccaccagtagagcaccaaggctcctatgtcaccatatacatgtggttggttccttttgtatttcatatattcttgccttgtttctctagctgcagtgaaggaagggaccattttaaatggctcagattataaatcctaggaattattaaactaccagtgaatatacttggcaggtgaaagtcaaccaactttcaaagtggttcaaattaatcatgtgttttgtgaggtataactgttgtttaatttgtgtttttagagctaaacaatgttctcaatcagacccaacttagagttgttttgcttttatctctgatttgtttctttctttcacccaattaaatatgatttaattttacccattatttgctttttaaactaagacagaatgaaaatgtcaaaaataatatgacgcttctaaacctgtcaagtatgaatgtcatggatcacgaggatttactgttatattttgggaagttggcataatataaatcgtgacgctcttctgatagaatgtgtcatcactttaaacccagatgtctgaattttacagcaaaggactctgaataaggaaattcttcccattgatctgataatgttcaaatatatcttaaggaagggatagtcaaatgtgcatcatttaaatgtgatcttagatattttaatctattcatttaatttattctttactcatttgcttctctaataaaatgaatgacaataatctaacttcagccagcttcagaaatgtattcagtcatattatcatgaaatatgtaattctcatgagtgacactgcctggcccactcactgtgtcattgggattgccctttctctaagctcgcatgataaaatgtcattccaggtgcaacttaagagtcacgctccccttgtcctttacaataatgctaggtaaatagcaggaactcagtaaatatgcaccaactaactgataggtaacttttaaaatatgaaatcttctattctttgactctgtagagaaagtgtttttcttcagctctatatgaataccagatatttactgaatgttttgccacgtctcagtcttgcatttgcacgtccgcacactacttttatgccatctgttgtctttcgtcattcaactgcttatataggtgaagaataaaaacggagagtgacagattagctgtattctatcttctaacagtttattataacagtttagttagctttcatcccttcttaaacacacacacacagagtgagagagagagagggaaagagaaagggagagagagagagagagagagaaccgaaacaaagtattctctcactttcttctcttttaaatataattaattttagtaaccattgtgggatagaggtggggccggtctgagatgaaaacaaaaattgagcaaaacagccataaattgtttgtatagagtgagcatctcattcccaattatttgttcaatgctattgacataaagtttcctgtgttctaaagaattaatggcatcacatcctcttgactgtgctgttgcttacttggccatgggtgtcctgaagtaggtgaccataaaatgtattattgaaattggggcaggcttttagctttgttaataattctgttgacaacaggggtgaaacaagacatatgcttatcctgccctcaggaagcatcagaatgagtagcttttaaattcgctgccaccatgatgacttgaaggatcagaaagcctcttatacttgacgcagaaacattgtagaacacctgtaaagtggccaaggtagtggaaaaaacattcaattgggagtagttaaacctgtatgatactgaaccaaggagcaaaatgatgagtctaaggcaaggagaagtcagacgtagaattcctaatccgtacgagactgtacctcgtcaagcaaaacttgggagttttaaaatgaaattttggaagaaatgaattattacaatagcaataaccatttttgttaccatcctggttttcctgatctctacatattggcatgccctggattcagtccttggtgtcttggatcttccctttctatacttacagtcttatagtctcagaaaatcaccttatatatcaatgccctcaaatttacatctgtggctcaaagccttctactcatatccaaacttggatatacaacttgctactcaacatctctaacagtaagtcagtggacatcttcacatgtcctaacctgaactcctgtccccccgcaaagcctgtgactttcaatttttaattgataacaacttcatctgtgtttgctcaggctaaatggtttggtgttgccccgacttctctcctcatttcacatcccatccctaataaatcagctttaacactaaaatacagctgaccctcgaataacatggaggttcaggggtctggcagctccccacgaccatgcagttgaaaattcatgtaaaacttaggagtccccccaatttttttttcaaaatggagtctcaccctgtcacccaagctggagtgcagtggcacgatctcagctcactgcaacctctgcctcccaggttcaagcaattctcgtgcctcagcctcctgagtagccagaattacaggcgcccaccaccatgcccagctaatttttgtattttaagtagagacggggtttctgcatgttggcaaggctggtctcaaactcctgacctcaggtgatccacccacctcggcctcccaaagtgctgggattacaggcgtgagccaccacgcccagcctgagtcccccagaatttaactactaatagcctactcttgaccagaagccttactgataacataaacagtctattaacacatattttgtgtattatatgtatcgcatactgtattcttgcaataaagtatgttagagaaaaaaatgttaagaaaatcataaggaagtacaaatatatttactgttcattaactgaaagaggatcatgatataagtcttcattatcttcattgtcatcttcaagttgagtaggctgaggagaaggaacaggaggagttggccttactgtttcacagatggcagaggcagaagaaaattcatgtgtaaatggacccgtgcagttcaaacctgtgttgtccgagagtcaactgtatattcagaattagacaacttttttttttctttttttgacatggagttttgctgttgtcttccaggctggagtgcgatggcacaatctcggctcaccgcaacctctgcctcccaggttcaaatgattctcctgcctcagcctcccgagtagctgggattacaggcatccaccaccacgcctggctaattttgtatttttagtagagacggagtttctccatgttggtcaggctagtctcaaacttccgacctcaggtgatctgcccgcctcagcctcccaaagtgctgggattacaggcgtgagccaccgcgcctggccagaattagacaacttctaatctctattcccgatcttcatcactgttatgatctcttgtctcaattactgctagagtttctcaagtggtctgaaaatcagcactttctacccatgcctcaaactgcctagtctttgtatagtaaccggaatgttcctctttaagcaaagagcagaatgtgtaattgctctgtgcccactcttgcaattgcttccattgcattccaaagaaaagctagagtttttacaagagctagtaaggctttttataatgtggcctcctgtgtcctctctaaccttattcattattctcatctgcagtcaattcacttgagccacagatgcttcccacatacatgtctgtgcatgccttggggcatggacactgcttgttctttctcctttcttctggaggctgtccttccagatatgccagaattaactttttcatcttagtctttacttcgatatattcttctcaatgaggccaatttaaaattcaagcgtaacttcccccacctccagcacctacctatttcccctacaattttctttgatccataacatttatcatcctcaaatatactctgtacttgatttatttttaatgtttatattacgttcctccaacaggaatagaagctccataagggcagagatctttgtcaattttgctcatagataattcccaagtacctaggacagtatctactagatgcttataaatatttgcagaatgaatagataaagtaagaagcccagtgatgtcaagaaaatgaattaccctctgtgcacctcaagttgtgcaaactaaaaagattaaataaaatggtttctatatgtcaaccaagcgcacatgtgtacattttgtgtcttgtggggatcctgattcagaaatcaaatgcaaaaaaaaagaaaaaagagagtgagatactaagaggtatttgaccatggcttgttattccattattttaaaaaattattcttatgtcaatacatgtgataatcataagccctttggttaagggcttatgtgtttgggatgcaaaatgaagtatttagaaataaactgatatgaaattgaggatgtggttttaaatattccaggaaaaaaaataagtgaaaggaataaatcaaacaaaattggcaaatactgctaattgttgatgaggggtgataggtgcataggagtatattgtagtgttctcattacttttgtgcatgtttgaaatatcccataataaaagaattaaaattggtaacctctgaagtccctcactactcaaaaaatcttttattagagccatcattttataagtagatcatttgtatcagatattaagaggatcattgggatccccgagataattccacagtataacgaaaacataaaggaagataaagagagaaaatccaatagaatgtcatttataaactaaaccttcaactgtaaatgatagttgttctaaactgtggctctgtctaaagaattttacccaaatttccattcattgtgaataactaatgcaagtaaatgggtaaattatgtctgtatatttaatcattgtacaaattatatcccataattccattagcagaatggagtacaaacttttttctaaataagtccttactaaatagatttaacagcaataactatgcaatttgactaagcaacaaactgccatttaaactatatattactatataatataatatgtcattaaaatataaatactaaaggctgtcaagatttttttttaaaggattgggccaggtgcggtggctcatgcctgtaatcccagcacttcgggaggccgaggtgggtggatcacctgaggtcaggagtttgagaccagcctggccaacatggcgaaaccccgtctctactaaaaatacaaaaaaaattagctgggtgtggtggtgtaatcccagctacttgggaggctgaggcaggagaattgcttgaacctgggaggcggaggttgcagtgagccgagatggcaccgttgcattccagcctgggccacagagcaagactctgtctcaaaaaaaaaaaaaaagattgtttatcttctatgtgtatgcatattcatagattggtatagatataaattgtgtaatgtggatatacaagtaatgagacactgttacatgaataagttctgaatcgtgagtcattttgatgataaaacatagaggagaaacagatgagatcatggatataacttgtttgaaaatggtctcatcccataaagtatagagaggcagaacattataaataggacagttaggtgaagaaaaaaatatatatgggatttgacacaagggcaaaatattcttattaattgttgaaaatctaggaaaaataataatgaaaaactttaataattgagtaatttaaccatgatttcttgaggctatgtctttttttatgacaaaacatgctgatatagaggatcaaaattagatcatagaaatcatagagacagcaaacagcatttttgttttctttgctgtcattttgttatcttggcttcagacttttttatcattgttttgtttattacttatatgttataaactgtctcccctggcccccaatctcctgaaagttttagaagcttgatctggtccattctctgcttgaaccacagtaacaagtatctcctggcccctccttccatccgcaaagttggattaaatcctacattctcaattgaactcaaatgaaaatgatcacttcttccttaaacattaactctctcaacaaatagcttcagatttatggtcttaatgagcctttcaagcatgttttgttagtcaacgaaattggactttaggcttatttgtttctttgtttttttgttgttattgttgttgttgttttgttttttgttttttgtttttgttgagacagggtctcactctgtctcccaggctggagtgcagtggtgcgatcacaattcgctgtagcctcaacctaccaggctcaagtgatcctcccacctcagcctccttagtagctgggactacaggcacgtgccaccacgcctggctaatttttttaatttttgttttgtagacatggagttttgccatgttgcctaggctggtctcaaattcctggactcgagcgatccatttgccttggcctccaaaagtgctggaattacaggcatgagacactctgcctggcctgtttcttgtattttctacagcagtgattttcaaacttttttgatgtattgacacatatacaatactgtaacactcgtgacacctcctggagttttgcagcactttgcctacaaacacctgcaactcaaacaaaagttcgctgagctaacacttattttcactatattctcaggtaagaatccaaccttatggagggtggcaaaggttaagatttcaaaggagatggctaagcaagcaaaatgttggcctgtcacaactccataggtgctcaaagtagacaatgagattcaatgggttagagcatgagtctttaatattcacaatatagcaaatagcaggaacagtagcatggtagtaccagttcctctgcctcaagtattacgaggtgacacaagaggccaaaacggtgactatgcacacagtgggttgtgctgcagctggggaatacagggccaaggtctcaccatgtagtaaacaactaacaagacagtctcctttccctggagagaaaagccttatggtagtcatgctgtggtcacttttacctaattaattgcctacgtgactagctacagaaactgctcagtaccatggtatcaagggatgataaagccttagaatttgtcacacttaaaaaggacaggcagggttgtttatcgcccatgatggactgcccttttcaacaaacctgtgatacatgattgaattgtttattttactccactttgataaaatgctagtctagaccaaatcaattgacttcatgacccaataatagatacaactcacagtttgaaaatcactgccttagattcctagtaaatgccttgcagattctaattcaaaaagccattgttaaacaccaaatatttgccaggtagtgtgttccatgctcagaagacaatgttatagctgttacagcagaagaatcatggtctttgtaacaactgtagtttaacttcccattttgctatttatttagtcattgtttagtattttggtctttattatcttattttgttcttgcgaagttaaaacatgataatcttggtgaggcaccttgtgcattgccaggtagctgccaggtatttatcttaaataatctgccttccatggatttctttgcagtgaaatattacacataagttaaagaaaaaatattgaagtggcactttaagaaactgcatgaaaattgaaattactgattgaactcttgaacttagaaaacacaaatcatctatattaaaatttatacattttttctctctctctctctctctctcacacacacacacacacacacacacacacacacacacacacttacttgtattatacaaaagccagttaatgagatgtaaaataaacttgaagcccgatgtggcaaagaccaaaggaaacagaagaaagaaaaatctgagattaaaaaaataaatttgtttttccttatatcctataggtagctttgaaactttgtgtaattgatattacttactattcattaattttctggttataattctttaaagacaaagtcaatcaaaatgttatgtttgctgttttttgtacagaaaaaaatctcatttgtttcctctaccaataaaatgccatgacaatgtagaataaatatataatttacttcatagtgcaggattatgctgaagtatacatgaaactattgtccaatgaaactgctttggtatgataagtttttatataaatatcaacctggacacatccggtataatttttattttgtaatgtttggcttaaccagtgcactctctttgttaccatttacaaatgaccatgctagctatttcttcagtctatggagaaacatggaagcctaaaatatttttttaaatagctatttcctcatatctcctaggtaagacatatccaaagcacgacaaaagaaagctaccctgtctttatattaaatcttgttgaggaatatttatagcatcccagagttataactattttagggtgacaatgcaactgatgttgagcaattatgttctgctgctatatcctatgtctatggtcttaattattaaaaaccaagaaatataaacctaaaattgttgactgctacctaaagataaagatcattattaaaatactgatgacaagaagtttcattattaaaacaataatgtacaactatggattcactttaaaaacttggtttattcatctgtattcaagaaacagagttaatatcaaagaaggcaaagaatattgaagcatattaaggaatgctgtgatttagcatttgtagtcatgttaatggcatcagactataaaattataatattccctcaatttagccacgtaaaaataaatcacttaatgacaaaagtacatattttagcaatctgggatttcatgtggaagaaatattgatttgccactgcatctgcatgtcaactcacatacttgagtaaaaactagtatttctgagaagacacgaaatcactttgaacctattaaaatggacaaaagtgacaatcagttgatgatatgaaatgcggtcttttgagccaaactttgacaatttataattttctgttgtgtgataaattttaaatggaaacagttgcataactcactagagtcagaacatacattataaataatttagtccataccctttgattaatcgataattgggaaataagtgaaatgtcagaagtctgccaagtagttattgggtgagccaagactcaaatctagataaagtatttattctactatacaaattaatgtcattaaaattattgctttatttatgtattcacgtgaatattctctaagtgtttttaaacacttacaatgtaccaggccctgtgctaggacctggggataaaaatggaaaagatatgggtctgtcatctagagatactgtggtttagcaagggagtgagctactaatatgaagaaggagaaggagaaggataaattattatagtacagtatgataattgtgctaaaagtcatcacagagttctaggattgtgcccagtaccctttgactagtagagaggggagaggtctcacttgaattacatcccttcttatctggactgttgcatcttgaaagatctcgccacttccagtttgaccttcctccaaatatttcctccaaattgctgctggggtggtctttctaaaatctgaaatttaatcagagcactcacctgtataagaaccatcagagtttctccatttcttcaaaatgaagttcaaattcattatcttatcatgagacctttcatgatctggctttagtcaatcactccagccttacttcctgctactctttcagaaacattctccaattcaaaagcatagatctacttatagtcacctctaggtctgggtcaaagagcttgagagcattgtagctcgaaggccaccattaactcaatgaaatcagcagtaatctttaaagaaaaaaaaaaaagaaaaattggcaataggagtcctgtgggagaagttaaagtttgtaatagtgactaagatgatagggagagaggaattctgggccgttaataaatcaatgataaggtacagttagggctaagcgtgcttttgtttccctaataatttatgtgtaatttaacaactaaattaattgaaaaccatgtttgaatctcaccttaccaactgcccacctggttgaaaattaaatactattgaatcttaaagacaggtattttttagaccaatttatatattttgctgttcatgttatagatttcaatttgacataataattcaccacaattaaaaatgttcttgaagtaaaagatatttacatgtctaacatatctaaatagcttgaaaaattacatgaaacattagtacatttttggagactcttatcttgcccttattttccaaaggataagttcttgaaattgagtaaacgacagaaatagcatagctagattataattttgaataatgctgaatactttctgatctggaacctgtaaaacgtggctgtagtgagggagctactcttggttgcacaagggaattgggaactgattgtggttacgtgaaaatcgtaaatgtcggatctcagtttaattgtggtagaaatatgtggtagatgattctgagtattaaacagctgtgtaaatattggaagagcagaaaatctaacataatacaacaaatacatagatcttctgatgttcttctttttaaaaagctgtaaattaaaatcctgtgtaggaaaaataaaggtaagatgcagtgtacaaatcagggtttctcaactctggctacacattgcagtcactcagggagatttcaaaataaactcatatctgggtcccactgctagacattctgcatcagttggtctgaggtaatggctaggcattagtattgcttttcttttccttttttctttttaagatgtagtctcactttgtcacccaggctagagtgcagtggtgcaatcttggctccctggctcaatgcaacctccacctaccgggttcaagcgattctactgcctcggcctcctgagtagctgggactacaggcacccgccaccacgcccagctaatatttgtatttttagtagagatggggccaccacacccggccttagtgtatatctgtttctgctgtgcaacctgagttgagaactactggttaacatagatgaaaataaggttcatatatttcagttataaaaaataaggcagaaaacttatccaatgttattagaatttttccttgcatagctatcatgcaatgatgtagttaacaaaaattaaattgcttacctgcaattttatgatgaaactgaccaaacacaccttccaaagatcaatggaatgaaggcaaaatcagatagaagtgtatttcactgtcttttgtgatttcacctctacctgactaaaactactaatgctcaggagaacgaatcaactgacagtgcatttttatataccccgtgaaggtctcataaataagacatggctgaaattaggtaggaggaacatttatcttgaaaatccaaaattcctaaagcaagggatcatatactgcatatgttaccgtcattatgccaaaggagcaatgtatacacacacatacacacacacacacacacacacacacacacacacacacacacacacacacacatatgacagacttctccagctctctgaactacaagatgctttataaaaccttcacatgggccaggcgcagtggctcacgcccgtaatgccagcactttgggaggccgaggcgggcggatcacgaggtcaggagtttgaaaccaacctgaccaacatggtgaaatcccatctctactaaaagtacaaaaataagccaggcgtggtggcatgcgcctgtaatcccagctactcaggaggctgaggcaggagaatcgcttgacccaggaggcggaggttgcagtgagccaagatcttgccattgcactccaacctgggcgacagagtgagagagcgagattccgtcaaaaaaaaaaaaaaaaaaacctgcacatgtatatatttcaccaaacaaatataagcacaaacaaaggaatgcagctgtcttaaatagtccccatctatttggtgtagatgtattgcaccatttttccccggtgcaagaagactagacatgtttccaatagaggattcacctcaaagcgttcagctttgccaccatcaagaatatttgaaagaatgtgccacacaaacacaaaaattaacacttattgtgaggccacaaacgttagctgaaacctcatttctgcctaacttctataaatattggcaatttcattgataaaattttgatacttttccagcttcctaggattcttgttaggattaaaaactaagctccctgaagggagagggttttgattattttattacctgctcccaagcctctggaacaatgtttagaacttaatgctaggtcaatatttgttcaatgaattattggaacataaggacatatgactgactaccttgcacttaggagttgttcagaaaattgtagttagtattatttctcttttattttattcatttcaagagatgcttgcctaacttgagttgccaaaaaaatgagatgggatactaagacagcggaaatgggtccttcaaaaagattgtctgtttctatattgcaatgatatctgaaatctgatgctgtgataagaaccaaaaacttatcaggggtggaaggattttgccctgaatgagaggaggccccggtgaagatggtgtcttataatatttggtcatcatatgcagggctggcatcttttaaagtgtagcagttttagacctagactgaaaatccattatatgtgtcgtattccaacctcttcccaaacaagactcggattgtctcctatggtttctggtcacaaaacagataaaataaaaccatccctcctgttaccctattcagaaactctgatagcattcttcatatctctcattctcaatataaatcactctccaccaaaatttgtttattctccttgtctctactcagacacctgcccaaccctactcaatgtaatattttctatatgttatagccagaatgatctttcataaaggtaaagttgataagtatcctgaagttttaaaaaaaaatggtacattctctttgcccttgaggtaatgtcagcatactttaaaagacttacaaggtttttcatcattttgcccctttggactctataggaaaaatacgtgtatgcacacacatacacatatgtgtgtctattttcatttatgtctaactgaaatttagtatttgcttcatttggaaatactagccacactaattagtggctattgaaagaaactgttactttatcacttgaagttacaaatattttcttattatattatggtttttgtaggtttctcagatattatttgcattcattgtcactccaaaattaggcctgccactatctcctgtcatgtaagtgtcaataaagaattacatgttactatattgcaaattcattttattactttttttttttttttgagatggagtctcactctgtcacccaggctggagtgcaatggtgcgatctcggctcactgcaacttccgcctccccggttcaagagattttcctgccttagcctcctgagtaggtggggttacaggtgcatgccaccgcacccggctaatttttgtatttttagtagagatggggtttcatcatgttggtcaggctggtctcgatctcctgacctcatgatccacccgcctcgtcctcccaaagcgctgggattacaagtgtgagccactgcacccagcctattatgttttgattattgcctttcaatataactggttttcatcataattcaatgaagttttattttgtgcatatataaacattccagaaaggcatccataatcaccaaatgccaaaggagtccatctctctctcctgtacgcacacacaatgttaagatcctcaggactatattgtaataccttgcatattattgttcacttgttttccatgtaaaatgtttacaccattagaacaggttttgtttcagaatgataacctcccagactgattcagtagggactaaattaatatgcatctaattaaattgaaatgaaacaaagccccgagatacggacagaatttcagatggtaattttgagaacacctttagcatttagtaaggtggtactctttaaactcatgctatgttgtcagtattaacatttccaaagtcactaggtttaaattttagagacttactttctgactaccggctccaagcatttattttagcctatgtgtacaaacattcagactggctatgtgatggaaaagtaaaaaaaaaaagatgacttttgtcctggccctcaaaatcttatagcttaagatctaattctccaaaagtagacaaaagttgcttgagtattgggttgcacttgtttgtatagtttttattcagataagaataatgaagactcttgttctctctttctatctattcctttataataatagtaatcatcatcatcatctcaggcaacagcatcctcaatgcggtaaattttgcctatcatataaaaaatacatttgaatatatagttgtatcatgtttactttcacttttttgtaacatttcaaaaagtattattctgctatgacattttttgggcttagtcatagaacaaatgtgagctgttagggaactttaaatgtcttagttttattgtttatttataactaaagagcatttttagtctactgtaaaggcaagttatcatatgctaaacaacataaaaatgactgaatattaaagttaaaacttttttatgagaaaatgagagacccctatgtgatttattttaaaataatcattgcatatgccctcacacagaaaatcagaatggtgtgattgttgcctgcatgaccaaaatcgattctgcctcctttgtggttagccaacacagtgacttcagcacctagtagacacaggttgtgtagttgtagtggtgcatccttagtgttatgctctccattgctggcaggacagattctttcatgcttgtcttctttaaagcattgacttaatttttcaactgaaaacagtaagtgacaaatggagcacagagtattttagaacatacccagaaagagcacttaaagacaataagaaatactcaaataattgaaataggaatatttttattattatgtcattaaactagctggtgcttatctgacatttccatgttagacatccgtgcttatctaacattgtaatgttccacgttccaagtctgttttatcttgacctgtgcactattaagtaccagcagagagtgatcaatattattgtccaaagcagtgcatcacaacctttactgggcactggaaacacctgaggatcttgttaaactgcaaattcggattcagacatgaggctgagagtcttgtaaaagaaaaattgaacagatcggttaaacaggtaaagtagactttattgaggactgttgtaataggagagagtttcatctcaactcttccactgaagcaaaaggtgaaaggatttttaaatgctggggtgagctaatggaaaagtactggaggacataggcaggatggagaatgtgattgggctggttaatatgattaggccacctgtgtttgctaatggtaccttatcaaagttaggctcctacactcctatagagactgggaagtagggccctatctttcttgatgattacatttcaaaggattggcgcccaggtccttgagaaagaatttcctaggttgtagaaggtttacatctgaaaggggcagagaaggaatttacaattgcaaattttccaaagtaatcgctctacaaaaaaggaggtaataggcctatctatagtcagaaagaagcttgtctaaagttgggagggggggaccattaaggccattgtggtcagtcagtatttctacaaactcccaggtggtgtcaatgccattggtctgcaaaccacaggtctgcactgttacactgataggaaagattccatattgatgattcatgttaacgcattttctagcttatacagtgtactgtatatagaagtgtgtatttgaaatggtcaataccattgtctgtctagatggataataaaagttgttgtgtacaatatttatagaatgatatcttttcatacttctagaggcctactcagaacatctgagtctctcctgatgagatgaaatttggaataagttatgtcccagaattcaggacacatttgatgtttaacttatttcactatgagaaaagtagtgttataatgatgttccacagttgtattttgttttaattattctcattaagcccctagcaaacaggttgcttcatcatttttttctttctttctttttttttttttttttgaaatggtgttttgctcttggaatgcagtggcacaatctcggctcactgcaacctccgcctcctgggttcaagcaattttccttccttagcctcccgagtagctgggattacagtgcccgccaccacatctggctaattttttttgtatttttagtagagacggggtttcatcacgttggccaggctggtcttgaactcctgacctcagacgatccacatgcctcggcctcccaaagtgcagggattacaggcgtgagccactgtactggctgattcgtccatttttaacagatgaaaaaaaaactgtaatcaattttggtcagtgacagtgcaaaaaatgcaatttaatactacaaatacttattacctgataaagttctcaaataatgagctaaaatagaatggatatgccaaaactgtagcaaatcattaaagacaaaataataacattccagggacttaaaacaaattgaattctccaaagaacattattataaactaatattcctaattgcataggaatggaagatttttttttttttaatgttagtcataggagtttcaagacatttgaatcacctgcgtggacactggcttttatcctattaaatttaatgtggtaatttagagtgtttttattagaataatcaacattctaaaatgcaatcattagcatatttggcatagaaaatagatctgaaatgaacccaaaaaatgagctttaaaaattgctaaaactagcagtgtataatggtaacacaatccaaaggtcaaaaaacacaatgattaattaaaactaaagaataataattaattagtagtattaagaaagctttgcctccttttcaaaaaaaaaaagctaaaaaggaaagttgttgaatgttattgtttttaaagaccagcttttcatgaatgaagtttttaatcctttcaaagcctaatctaaatttaagaattcaaacaaaaaatccctaatattttaatttgcaatcaggagaggttcaatcagactaagactttttaatttgacagtctcctttttaacacatagagctacttctttgatctgccttggttaatgaaatggatgagttccaataaatttggatgcaaagtaataatcaacagaattccatttcccattgattttcattgtaaacttgtatcacttttttgacataaaataagcactctctggaatgaataatttaatttgaaatatgaataaaaaataaattatggtgcagaatattgctaagtccttcatacatttgcagcactttgcatctaccactgcttacttcctagacagagaaccatttcctataataatagctaaaacccatgaaggatttcctatctggaaatagtttctataacctttacatctattcatcttcatgattacattgtttaatgggtactatagagatcgtcagcatccccattttacataaattgtaagtgccagagttttggtttaaaccaggttgtctgactccaaactcttcacttaaaaaatatattttatttttatagataataatacaaatactgaaaatatttacaaaacaaatttacaggtaatgaacactcttattactaatgaaggcaaatgcctttattactatccttgatgtcagaagctagaaccttgcgagccattccagaaactttccacgtgccttcttataaccatctccggacacacgcgtgcacacacacacacacacacacacacacacacacacacacacacacaactgtgaccattatgatgattttattttttggaatggcatccttacttttcttcatagttttgtcactcaaatatgcatccctaaacactgtagtttagttttgcctagtgtgtgtgtgtgtgtgtgtgtgtgtgtgtgtgtgtgtgtgagacagagtctcaccctgttacccaggctggagtgcagtgatgcgatctctgctcactgcaacctccgccttctgggttcaaacgattctcctccctcagcctcccgagtagctgggattacagatgcgtgccaccacacctggctaatttttgtatttttagtagagatgcggtttcaccatgttagccaggctggtctcaaactcctgacctcctgatccacccgcctcgtcctcccaaagtgctgggattacaggcgtgagccaccgcacctggccagttttgcctaatttttaaaatctattaagtttcttttaatctataggtttcttcctttatctttttcttttatttaaacagtatatgtgttgaggaagctaaatagtttgttctgtagtcttccgtggactggcttttgctgcctgtgtttttgtgatgcaatttgttttgtttcactatcatccgtattccctatctgccttgttgccttgcctgaagatcaccaaatttcaaggacttctttcctgctctgctccaaggcacttctcagcccactctggatgtgcgtgggtggtggccagtagaggtgggctgcaattactggcttctttagtaagagctgtgaggttacatatattcaactctgggtttctaaaggcccatccaaggacaagttccagggaagatagggcatgcatgagtttgaggcagaatgagaaaaataagcaacatacaatacattttttcataaaattaaatttctccttttaaagaagtgttctttattatatttcagttagcctactgtttcattggcatcgtttccctttcattgtttgtatttttgttttggtgaaacaaaaaattagaaacccaatgtcagtctttgttctcttcttatgatgctaatttccaaaattgaaaagtgttggaaactctgctttagccttaaattttctgcagaaaattacattttgaattttcataaaagaaattattggtcttaacccattctgtatgataatttttaaaaaaaaaaaactctctaaagtgtaccttgaaaaatagtacctgtgatttgtctaagcttttgaataattcattctatctcaaatgtatttctaccactaaagttgctataccactttatggaaagaagaaaagcaactttccttttttgtacaggaaacttgaaagttcatctcatggaaggtgtggagagaaaggtggctatgtaattctcctttggatatttctggatctgtttctcaatcagattggttccgttcacactgcctgctgtcatgaaagtttatgcctcgcatgcaatgccagcataaatttctcagcacaaaacagctctgcttgttaaggaagatgttctgaattatcaaatatatattttttaattagccaccctttcttatgctttcagaatatatattaaagtgatctggggtatttcatgttaatgtaagaaaaacaatccaaactccctttgtttcttgacttagcttattatatcttcagtacttgcaaactgtgtgatacatgatcagtcacagcacactgctatttactgagcatccatggccactggctgacgtggcattgaatataacattgtattgttgctctaagccttttagccttcgtgctaaatgactcaacccatcacaagaaatttataatggacatataactcacctagttagtctgcatgagattgatttgttgtgaagttattggctataatgtctttgagaggataggccttcatttcaaataaagacagcctcatttatggatttcaaagcatgtctatacactgtaagtctgtattaaagaaatgggatgaagccagctgttaaaaacaagaaaatatgtgcaaaaggatttggagttgactgtattatatagaagtattaaattaggagctttagggcatactgaagcttcatattgtttgaaagtttattttgaattctgtagaaaaatgagtactgttaattaggtgatgtggtttcagcattctcaggcgtctgctccccacagtatcaaaacctttgcccaagtccactcactttattgtgacccctgtagatgctctatcattatggtccctttaccaaaaaaaaaaaaaaaaaaaaaaaaaaaaaaaccttgttgtctctcaggcaaccagcgctttttgtcagcctatttcatctccccatcccttcctacaatcgtttatactactgaaaacttgaaagcccacatcccattctctcctggatctctaggcctaccaaagtttctttctaaaaccatgaaatgaccacaagttaatttgatgaagtgattcataataaattgttaataagaagtgacctacaactaggtcaggtcattcttcaaccacctattttattagtgatcccccacaggcaatacatgtgactgaagctggaatttgaactttctgtgatgagggccctgtagcgtatatgtgagacctctggtagcaggagtctctgagagcctctaactcatggtagtctgaaatagacataggcaaagccccagggacatttttaagagagctgttgtaagtaatccagtattataagttaagtctgtcctgtattcatcagaaaaaaacagaatctgctgctacaagatattaggatttctggtcttaagcaacagacttgaatttcactacctggattcttctctttggcttcatgtttgcagataggatggttgaggaggatggagctattgagagggtggctgctctgtgcagttgcttttgtttatattcttactgacctggcacagtgtaggtggaggtgatgcatgttttctgacattgggccagtgatgtatggcctgaccttcaaaatgagaaacatcatctctgtgggtgagactatagccgtgcaaatgcttttatcccatattgctcagcagtttgcaaccggttctgataaaaagcacccaccccgctgagttcgctgaagcttgtatattggttttaggttgaacattttggcaaattaacgactgagtgaaaccataaaattggttttatttacaacaaagccttgtggtgtctgttggttgttcttacatctctttcctttaatctttgaggttgtttctgtaggtggcttatctaactttacattgaaatttgcattcatttcaggataatacttcccctgggtttcttcttaattgacattggacatggtctgcattctcaaactttgtgcataaagttggtaactatacagagtcctagtttacgcctaccccaggtgattctgattcgggagatgtgagatggaaacccaaactacacattgttagtcagtaggtgactcccccagtgtgaatctactgatctcatgtttagaaatactgctgtataccatgcaaagctgtcattttctaactctgctaaacaataaaggttcacaagccatacttctgatttgccataaagttcgagtttttctccatttggttcaatggtgttgctatggatggcattcatagcaaatgataagattgggcatagtatactttgagtgaattcttagttttccttagaacaacaagataatgagttagaattataagagagccatctagtggataaggatataggcctgttgcatcttgtcttaatgtcggctttatggttttatcagattacagatttaaatataaatgaaattaagtgtagatatatactctgaatatattacattaaatatatattaaatgttagtgaattttgtttttgttctttttgttttaaaaaaataatttcttattttataaatgagtctgtacttttaagtagttctactcctttaaatgaaacatggatacagagatgataagacatgattttaccgtaaaataaaacacacattatatttttagggacataaatataggctagtaactaaaacatattttttaatgcctactatatgttccttggatttgaatgtaaaagagatttcaggacttaaatagtagtttatgcaattagagaatgcagaaatagcgtgaaagaattatagtctagatacattactattttttatatactctggaagtttttaacagttcgtaacaaatgccttgggcagattagggcattgccaaaaatcaacatcatgctacttacatttacaatcatctgacagtcatctctcagacgagcatcctcctgattgcctaacatgtttcttttataatgtaataaaggtgagttacacatttgagcaacagtgtttgtctgttatacctagagagaagaaaaaagattgtaggagagcaagatacccaagatactaacttttccaggcccacattttaagtgtattgtcaaaagaagcattttatttttatttttttttacttttttattttttttgaggcaagtgtcttgctctgtcgcccaggctggaatgcagtggcccaatcttggctcactgcaacctccacctcctgggttcaagtgattctcctgtctcggcctcccttggagctggggttacaggcacccgccaccgcacccagctaatttttatatttttaacagagacagggtttcaccatgttggccaggctggtcttgaactcctgacctcaagtgatccactggccttggcctcccaaagtgctgaaattacaggtgtgagccaccgtgcctggccgaaagaagcattttaaaagtttgatattttaaattaaattgaagatactctatcacaacttaacattcttatgctgggtcatccctccttcccctgtactcaagctcctagaaatctcatctatttatacctgactctgctattcaagtaacttccaggttttcttcccccagcgctacatcttttcttctcttctccaggatcctgctggacatcacttcctgatattcttctggcacctcaacatggcccaaatcaaattagttatctttgcactgtttttgtattgtgtatttcagttaaaggggcttacctttaattttcttaagaataaaagattatagtcttatttaatctttctttttttcttatctccttcccccagtttcctgttggttctacctctaaaacctatctggcatcattcatcaggatactttgcaaaatgaggattatgaggtcaggtcctgtggtaagcagggagccaaaaataagaccctcagagtttcttgcctccctgttgtacacacccagtaaaatccccttcccttgagtgtgtatgagactatgaataggatggataccacacccccgactaggttacgttatacagcaaaatggaagataattttgtgtatataatttaggctgcaaatcagttgattttgagctaatcaaaggaagattattctgggtgggcctgactttatcaggtgaaagcccctaaactaggaactgggctcttcctgaagagataaattctcctgctaggaatgaagtactccttgacaaagtaagcagccatgttgtaagcgggcccatgagagggccatgtggccatgaatttcaagtggcctctaggagcaaagagtggctcttgtctgacaactagcaggaacagagatctataaccacaaggaaatgaatgctgccaacaaccacatgagcttggaagagcacccaagctccataaataaatgcagcgtggctggcacctcaatactgcttcgtgagactcggagcaggggacccagttaaaccgcacttggactcctgacccacaaaaactgtgaaataataaattcaggttgttttaagcactattttttaatttttaatttttatggatatataatggttgcacatatttataaagtaagccactaaatttgtggttatttgttatgcagcaataaataacaataaatgtcctcattatcttttgctttggatcagtgcagtaaccttcaaatgaagctctcttagctcatccgtctccatgaaatcctacataacacagccaaagtcatcttccttatcctacataagacagccaaagtaatctcccttataaacagactataatgtaacctccatgagatagggttatagatagagttttgttcaaagctgtatctctagaagaacgctaacatttatgcatgctataaatattgactgatggactcaatgaataaatatcatctgtcctcctacacatacatcaaaacctttgctggtcccttgcctacagagacatcctccagatacaagaagagggaaggtatataataaaatgcttcagcatacaggttctagagtaaaaccttgggtttagatttcagctctaatatttcctagctttgtgatctcttggaagatgtatgactttactaagcttcggttttccaatttataaaacatgaataacttttaccactcaagactgtattgaatattaaataagacaatgcatttaacatattttcacagtgcctggcctatgcaatagatcaacaagtattatttatgattataacatttaaggccctttactatatacctttccttcctgtcctccagccttatgaagctggcacccttgtgtttcctgcctttgcagcatgatggagagtgagatgcatggatacttttaaagtgtccacttctacgcatcccctgctaaatgaccttgagcaagtttcttcccggtctcagtttggttatctgagtaatggggctaatttgaatacatagttctcgagtttgtattgagtcgatccctgcattagtcagtcacattgaacaataaccaaatattggccactgaggtcacttactgcaggaacaatataatggacgtctttcataacattatgaagacccatggaaaacttttcttaatattagaaatagttgtgttggtactgaacaatcaacggttgttattgtttttatctgaccaggcttttctctttgaattagcttctagttgagacaatctgtactgactctagttcagaccttgttccctgtctctgtgtatttccttttttctcgttacaaatttctaatttatgttttcctgctatatttaggtaagttaccttaaattcattctttaaaaaaaaggtagaagtaagtatataaaaaccttccatggttgttacatatgtaacaagcactattcctgtgtcatttgtgtgagggtatgtgtgtgttttaatggtgagagttaacaaattatgtaagaaacactgacattggaaaactgattttaaaaaaacaacttgcaaaatttcatcaaatgagtcttgtttcttgcattgaacagatcataaaagcaattcataaaaaggcaaatatagtgattcttacatcacccatttagttaaagtatcccaaatgctatagcataaggaagtacatgtgctaggcagcctttgagttaatgaactgatgttgatgttaaaactggtgcactcttttctcccggaggtatggctgaatctgtgccacagccagccactttttcatcagattccatttgaaagtcaattgatgaatcagccctgatgcctcattgaacataatgtcgagaagcaagatttctgtactctattgatgtgtttaagcagcatcaaacaagcacacacatcaatggaaatatcggtcaaatcatttgtcaacaattttatagagaatacagttgacttcctaatttctccactgtttgggttgctatagtctaataaatcatgcttctgcatggagacatactaatacttcgtggaaaagtaatcagaagtcttaattgaaataaaattatatttgtccctgtttaaagatattcaaacactacttcagttcacagacttaaaagtgaataacttctttatgaccttattgaatgaggatgtgattaatgttactaaagtcacacttacgttggattgggggactgaccgaccatgctgtgagatctttagcgagaaaattgagctctcttctggttagcgttgactggctatactttgtgctagccatcactgacttccacctaaaaagataaactgtaggtgtaagcagcaaatatcaagccgtcttaggctgtattcttctattccttctctttttttttttttcctttctttttctttttttttctttttttttttttttttttttttttgagatggagtcttgctctgtcacccaggctggagtacagtggtgcgatctctgctcactgcaagctccgcctcctgggttcacaccattctcctgcattctcctgcctcagcctccccagtagctgggactacaggcgcccaccacgcctggctaatttttttttttttttgtatttttagtagagacgggggtttcaccgtgttagccaggatggtctcgatctcctgacctcatgatctgcccaccttggcctcccaaagtgctgggattacaggcatgagccaccgcacctggccccattccttcttcttcttaatatttttccatttcaaggtcacaactgcaataccttatatatcccatattagtaatgaggacatctgtgttgcactggtattgttaaattggccttcagtaaaatcaaaccattccttgcagtaatgggtgagaacttgcctttcacctagagccaagttcattacaaattcatgctcacagcccagagaaaaacagggtttttatgaggtttcaacaagtaatatatctgcatgatgggttgttccaagaaactaagcaaatggaaatgtcagtttgcagaaactgtcaaaacgaacataacctaattagaattgctgcttatttaataagccatcagtagccctaccagatagagtcctgccaatcttgcaagtactcattcatcttgcatttaagtttgtagatactctaggctctgctaatgggaaaacaacgttaattagataccgcacccaatcattaaacagctgcaagcatagttagtgcccttagctatgaaatgctgtaagccttcatgtgaatataccttgatatgtcaacatgggaccccagtgtgtattgcagttataaaacagtgtgcatcactgtatgctttgcacatggcagatcctcgcaatgtacacatcgataagtagtttttattaatgtatattccatgtgtttgaattgcatgtcacccacttaaggtaggttcttatttgatgcccgtagtgtttgcatattaagggccctgaatactactactttgcttagtaacgtgtctttacagacattacctctgacttcatgttttatggttgttagtaattgtgaaacaaatgtgtctgactgccactgggcaatgctgcttcaatagagtacacacattaagtgtatgacattcaaaactagcagaggaggaactctgaaggaggtagggcaggggatgacaagagtgtgggaggaggagaggtgtaaggagaggtattatgaaagaaaaaataatcatgcttttttaattgcataaaataatttgattgcaagtttcaaagacaaactaaaaaagaatgtaatcaattatctgcgtgttggcacaatagaaatttatggggagactgtggaggaaacgaaatgagaacagctgaatgaagtcaatcgctgtgatgtggcgccttccctattgttgagaatggaaaagagtgcaaatgcacagtgcaccggatttgtcagcaagctgtgttttctcggtatggtagatctctattgctcatgactattgagaaagacctacacacctgcttctgttattctcaagctgaatgatgaggacagagtttataaatagcctttctttcctctctgttaagtgtttcctcatatgtgggagaaggtagattatctggctatctaaatatcacctggaattgttacaccatgcagtgaatgtttaagaaatgagagtggacgattttggttgatggttttagttagctacaatgttttcaacatctttaatcatattatccagacttcttatttgttcttcctgtattacctattgattattataattctggctccatatacctgttacctagagtcacattgatacatttttgtcatcatgtgacattgctttccctcaatctcatatgccatttctaatctcattcttgctttactgtttactcgattacatctgaatctgggaatcactctctcatccaacataacagcagcccctcacatggctcctttgcttctaacttgcctcaatttctttctagccagtagagatcaccaagacccaatttggtcatccattatgtttgggaggacagaaatattattttagttatatattcagtgacttacaattgtttatcacaaacctaaagttacctgtagtaagcactggatctgtttcaggtacactgtcaattgtagaaggtagttgtggacatgaataaaatgttagagatgtcagaggccgatgtggctgtctttagaggtagagttttattggaatatggcctagaactttattttcaaaacaaaacaaagaaatggataatcacctcttttccttatcaatgatctcttaatctctactgaattagttttgcaaattatcactgaaagaggatttcaagaaatatgattttaaattatctttttcatatttctctagattttaaaaagctttctttaaaaagatgacaacctttaaaaataacttttagataccatatatgccttccaatctaaaaaaaatgaaaatattgataataaaacatttttctccatggtctgtgttaaaatttatagtctgactcactcaatactaatctatgtggaatttatcttgggtagtctaatctttgttgcaaaaagtgcaatacatgtcttccttgctttaagtactgctttcttatgtgatagaaaactgttacaactaaattacattatttttaaaaatatgatattttttaaatggagatctttttgaatatcataccacattcaatttccagttaatcaaatggcaagttaaaaataagtagtgtgcattagatttttattgctgcagttgtaaattaccaaaggcttagtggcttaaaacaacataatgttattatcatactgacacaggtcatactgatcaaggtctcagcaggactgtatttcattctggaggctctaggagagaatcagtttcctttgccttttccaacttctagagcaagtttgtccaacacgtggcctgcgggctgcatgcagcccaggatggctttgaatgaggctcaacacaaatttgtaaactttcttaaaacattgtgagatttttttttttttgcaattttttttagctcatcagctatcattagtgttagtgtattttatgtgtggcccaagacaattcttcttcttctaatgtggccaggggaagccaaaagattggacacccatgttctagaggcttaccacattcccatgacttatggcacctttcttcaatctttaaagtcagtaacattgcatttttctcatccttcttcagtagccatatctacctctctgactcttctgcttccttcttccacttaaggatggttattattaaattggatccacctggataatctaggctagtcttcctttaaggtcagttgattaacaacagtaattccatctgcaagcttattgccccctttactatgtagcctaaaatattcacaggttctggggattaggacatggatctttttgttgggggaggcattcttctgcctaccacatagtagtatataggtacacacacacacatatatatatatatatatatatatatatattttttttttttttttttttttttttttgaggcagagtctcactcagtcgtccaggctggagtgcagcggcatgatctccgctcactgcaacctctgtctcccaggttcaagcgattttcctgcctcagcctccctagtagctgggattataggcgcacgccacctcacccggctaatttttgtatttttagtagagacggggtttcatcatgttggccaggctggtcttgaactcctggcctcaggtgatccgcccttctcggcctcccaaagtgctgggattacaggcgtgagccacctcgcccggccttataaatatatttatacctaggtttgcacatggaagcaagcatcactattttagattatggacatcttaattttcaactttggcagtaggtttttacctgtaaaatgaaaggaaatcaacctgattatatactgtgtactttgaatccatttgaggcctacaaattgtttgtaaaaacaattgtttttgtccaactgctttttttccaactgcatatatgatttatggaatttgatgataagatcatggaatttttctcaaccaaaagtaatggtttgtgacactaatacatgaagcacattccagaatgatactccagattttaaaaagagtaaaggcaaaaaattgctaacgtctccaaacattttcctgtgagccactaaccattgctaatgtttccttgacaagtgaagaaaacaattattttttaaatattctgtcaaatggtactattttcttcaggtcaattctaaattccaaaatttcagggattatgagcaagctctcgatcgctctcatccagaatttatagtgtccgtgaaactttatgtgcagtacaggaacattttacattttggggttaagagttgcaatagtttggatgattcctctgcaaactgaaactaatagagtcatacaatacaggaccatgttcttaaggcaaatatactatatagtgaatgaaagaaatggattttggtaactccctttcgggctgaactgagtaagcagttcttcacacaaaggcaccatgatacagtgataaaaatggtgagttgggataccagaaacttggtttctggtcctggctctgtctctaattattgcatccttttaaacaagttaaaggatagctttttgcctcatttctctcatttaaaaatgagtttaagaggaattatcgctgaagtcctggatcatgcacagcttctgtgatgttataatcccagttttacatggccaccacatgcctaacatcatctgtggtggctcctggaaaaaagaggggatgtgagcaaaaaaaaggaaatacagcagggagatgtgatatgacaaaaatcttgctaccacaattgttggaaacagaaagcttactcaatcgctgagagctaaaaagggcttttatgcacatctccttgctactttactgttttctgagttcaattccaatggaaatggtaaatatgaaggggccttaaaaagaaatagcatcaggatgttttactatagttctgccttattgtatatggaatagacttgatactagaaaattgacagcaaagtgtagttctctatataacattttttttccccaactgcttttgtagaactgaaactgcactcccaggggaagataaacgatcccacaaggtgcagtaaaagtcagagaatgctattgcagtagggacaagatggcccagagacacagtctacccaacacccacatttaactgatgcagacctgcaaacagagagtcttcatgattcactcaaggtcaagaagccggttagttacagagtcagagctgaggctgtatttactctttcccacaagcaaggttcaactgttcctacttgaattgcatatgattacatacagtatgaaaaaggatttttttctgttaactgttgacaatattaacatcagtcactaattttaataatagtacttaattgatgctttgtatgtgctaaacagtcttgtaggtgttttactcaatatagttttattaactcatctaatcatcccaagaattctgtgaaataattctacgtacactcctactttacaggaggggcgcccatgccccatttaaagatgacatttgaacttagacactttggctgtaaatccagtgttcccaattgtgctataatgcctctgaacttaaatgctacaagaaaaatcaaactaccaggttggacctcaattatgattacagtcatatgagatgagccacttaattgtatggatctttagatatataacattttataacttgaggctcattcattcaacatgtagtgattaagcatctattatatgtacagggatttaccaggtgttataaaggctaccaaggataatgtaattgataatgctagtatgcgtgataaaatggtataattcaaagtataacgaatagcattaataacaacagttcttagatagtacgtatttaatatgggccagcctttttgctaggcaccttgcatatattatctcataattttcaccccagtcattaagccaagtcatatttttccattttagaaatgatgaaacagacgtgaataggtaagcaacttacccatacttacaaaggaagtgacagagttggtattcaaatctaggtctgtgtgaataacaacctcattttatttcaactactctgctttaaattagaaaacccaatcctatcaaaagaacacgtgaggcccctctccaggcccagctgggaggcttattgctgaatgcatggccagaatccattgtggcttctttttgcacagatcttacatgttccccggggggtttattatctccccatatatggtaaagaggagaaatcctggagttcatctccagtctttctgtttaggctttgcccaccagtgaaatttaagagcagagtattgcaaagcgtatttggaatatgttaagaacccttcattttgcgttcatgctttgatgcttcaacatccttctcattgtcctaattttgagtccacattcaaaaccagctgaaaccccttgaaaataaacccaaccgctggcatctggctccgcagccacccaccttgcttggtttgctttcaaattgcccggtgaaattcactggcaccaatcacaagtcctcatgctctctctgctcatcacctattaggtcaagcactcatgggttgtgccgtgttgtggccctgcatggcatactgtcaccctctctctgggacctgtgagaataagaaatgtcatcctctcaaatcactttctcttgttctcctgtggcgggaccaactttcccataccttaaccaacacctacattcttagaacagatggaatgaatggaaacgaagctacacaactttctaaacttgtgattctaacttcaaaagtaatgattactttttctctttcctgctgcttttctattttatctctcatttttctaacatcttttctctcatctacctctgaagatccactctacctaggatctggagccttccttaattcagtcactcatttagggactgtactgagtttcaccaggggtttcaccaaataatgatataatttcagctctttatgccttttgagtgacactcataggaagagaaggattgcatctctacctctaaagggtcttgaattgtgaaagagtttccctcccctcttctcttgtgctctacttcctctgctttcctcccctccttttccctctcccccacacatgtaaacattgtgtaattccatgtgtgtccctgttatctatttgtttctagtgttaaggtgacttacagcttaggggtacaactgtatatgtattatattcagatgcagacttgtcaagacaaatacagtcttcctgacactgatgcatgcagtcaacactggaacagaaagttgatagctgcattaaaatttttgcaatggctgccatagaaacccacgcaagagtgactttgcgctgaaatatgacatctcagggatctgtctggtgaatctttgacacagaaagagaaataaattagaaaacagttttccacagagccttttagatccttaaaacttgagtctcaaagcacttgaacaaagtaactatttggaaaaagaaaaggtattcgttcttggcatttttaaattcattgaatagattctccttaaatgttaatagcattttgatgggagaattactctattcagagcattcggctcacctcagaaatgatttaaaaattttatgttatgccttttaaatattaagcttctcattttccatcccatatcaaaactggcataacatttcagaagtcaaggtttaacagtcagcaaataaacatatttgcaaaactgttaaatgatgattatttttgcatttgatacgcaattgtatctacaatatatgtcttgaggaatatgtgttttattcactgcatgtatgcaagcaataaaatttcactaagcagactccatggcaaattagttacctgagtattccaattactgaggttcctcaaaccactagaactttcatcttttttttcagtcctttttttttaatcatactctaagtctgggatacatgtgcagaacgtgcaggtttgctgcacccatccacccgtcatctatgttaggtatttctcttaatgctatctctcccctagccccccaccccccgacaggccctggtgtgtgatgttcccctccctgtgtccatgtgttcttatacttcacctcccacttatgagtgagaacatgcggtgtttggttttctgttcctgtgttagtttgctgaaaatgatggtttccagtttcatccatgtccctgcgaaggacatgatctcatcctttcttatggctgcatagtattccatggtgtatgtgtgccacattttctttatctggtctatcattgatgggcatttgggctggttccaagtctttgctattgtgtacagtgctgcaataaacatacatgtgcatgtgtctttatagtagaatgatttataatcctctgggtatatacccagtaatgggattactgggtcaaatgatatttctggttctagatccttgaggaatcaccacactgtcttccacaatggttgaactaatttacactcccaccaacagtgtaaaagcattcctatttctccacatcctctccagcatctgttgtttcctgactttttaatgatcaccattctaactggcatgagatggtatctcattgtggttttgatttgcatttgtctaatgaccagtgatgatgagctttttttcatatgtttgttggctacataaatgtcttcttttgagaagtatctgttcatatcctttgcccactttttgatggggttgtttgtttttctcttgtaaatttgtttaagttctttgtagattgtggatattagccatttgtcagatggatagattgcaaaaattttctcccattctgtaggttgcctttcacttcgatgattgtttcttttgctgtgcagaagctttttagtttaattagctcccgtttgccacttttggcttttgttgccatcgcttttggtgttttaatcatgaagtctttgcccatgcctatgtcctgaatggtattgcctaggttagggaactttcatctttactagatgaatcaaacctggcaatcctcagataccaaaacaaaaacaccttcatatacatgttagccctcatagaattcttcaaaggcatactttctgtcttaaagtataaaataattcaaatataaattttcttttctcttgatgattctgcaccgtagtacttttgggtgttagtgtaatctactggtgcttttgtgtagatacaagatgcaagtcaagaatcagatttgttgtcatctctcatcgctctttttttttttttttttttttttttacaaatgtaaccttgtgcaagatgcctttagcaatcaatgcctcaagaaaaaaagagatgattgccaagtggttaattagccttctgccaggtcttccccacctcagcaacctatttaccaacatgcaaacttgatgcccactaacagtggaaaagtcttaggcctttaggggtcacagtgatgaggtacaggtgactctttacccaccccacccctgatagctgatctacctctcatcatccttctagtcatgacttcaaattaccaccatgctgcctggacagctgatgaggggattttcataacagccagtatggctgctttgaatgattgccatggaattttttccctcttctttcggtttccctcccttttactttcttctatctcctgttgctactacaaattttctgtgaaaagctggtttatatatagattaccaacccatcagagaatacttttgctttcaagtaggaaatcaaataatcatagcatactgggtactattttttatgggttctctcttctatgttgtttattacttggattcatggggatgcttcattcttcccaatgaggtaaggtttccagccctctttttgtaaccataattgttttgaagtctagagctgttcccaaagattgagagttctgaaagtttggcctcaggagtgggtggggtgggggagagtagtaggtaagctgttgtgtgtatatttatgcttattgtttgctcagcaagcagtagacatatacttgaattaatctggcaaagtgtttagttttaatgtaaggtgaaacacaggaaaatactcctatcccaaagatgtgaaaaaatagtttgttaggggaaacaggaaagagcagctctacaaccaatgatatattcatatctaagttgaagtcatatattctgttttatgtggagcacacaaattagctttgcaagttggtcggctatgcctagatatttactgtaacatatatttttctaaaagcatatatgggtgccttaaaattaaaatctgtaccacaaggaatattggatattagaaattatgaaacaatagggcttatacaaaagaggtatgtttattcatttacttactgttttttattggatacatgtgattaaaagaaaaatttttatataatcctattgtctcaaggacaaatgattctgtgctcatctgggcatgggacatgtcacacagatattaaagacactacagagccatactgaaataacacggacagagaaataaaaaaaaaaaattaaaaacagggtcaatagtggcaaaaagtgagcttgttaaaaaacagaattggccaggtgcggtggctcatgcttgtaatcccagcactttgggaggctgaagcaggcagatcatgaggtcaggagttcaagaccagcctggccaacagtgaaaccctgtctctactaaaattacaaaaattagctgggtgtggtggcgggcgcctataatcccagctactcaggaggctgaggcaggagaatcgcttgaacccagaaggcagaggttgcagtgagccaagatcatgccactgcaatccagcctggttgacagagctagactctgtctcaaaaataaataattaataaattaattaaagtgaaggcatgcaaaatatcctctttggagtctaatttagacatcatggaaggataattatttggtggtggggatgacatggagattaaaaacaggagaaggaaagccctgtgtgttttggcattttagacatttagtggaacacactagggttcttgacactttctctgtaacttggagaggatacttttatattgtagataaccttgtggagaggtagaagaactatggtggagtctgaagaagtaatacagttcaaggtgtttccaatttgctctaagttagcaaaagaaaaagacaaacacaaacaaatagaaagtattggctgggcatggtggctcacactagtaatcccagcactttgggaggctgaagcagacgggtcgcttgaggtcagtagtttgagaccagcctggccaacatagcgaaaccccctccctactaaaaatataaaaaattagctgagtgtggtggcacacgcctgtagtcccagctacttgggaggctgaggcacgagaattgcttgaacgtgggaggcggaggcagaggctgcagtgaaccgagatcatgccactgcactacagcctgggcgacagagcgagacaccatttcaaaaacaagaaaaaagaaagtgttatacaagttatatcacgaacaagataatataaaaagctattgcacatcaataagaaaagttcaactcaatgcaaaaatgcacatatgatatgaatagacaactcataggaaaggaaattcaattgactttgaaatatatgaaaatatattcaacctcatttgtaataaaataaacataaattaacattaaacattttacccatcggattaacaaagttaaaaaatggtatagagaattaggtgttcgtacactgctgatgggagtttaattgttacagcctaaattcaggcaagtcagcaatacctatcaagaacaaaatgatgcatattctttaggcaattctcaaatgtatcttgcaaatatggtcattcatgccatctcatgctcattcatacacattcatgccgttgtgtgtctgtgtgtttgcagccattgtgtgttgaattgcataagattggaaattactgacatatacatcaatggaggactagtcaagaaagttataggtcattcacaaaaagagactattctatatctattagtatggaaagaagttgaaaaggtatcattaaatgaaaaagtaggggattcgaaacaacggttatagtacggtatttcttgggggaaagaatacacatattgtgataatggaatatctctggcctgtttatacttgggtttggctaagggattgtctctagggaggggaactcggctggggagattggagtgggacaaaaatttacttttcaatttacacagttttatagcttttacattttatatcttattgtatggtcaactcagaaagaatagttaaaactaaagggattagaggaaattatgaattctaagaacttactttgtctgggaatttaactgtgcattgagctagaattatttttgttgtattaggaatctggtaatagtgaacatgaaacaggagagaaaaatttttcacagatattttgacatcaaactgagatcatttgatagtttttgcctgattaatattcttaaatgattatggagaaggtgttgtgacccagaaatgcaataacccattatagtatcttgtttacaccccattaacactgatagcactctatgttactttattttcaatttttttccttcagagtctcagttatttaaccattttccaattactaagcgatatatgaatctgactcacattctatattcagaacaatgaagatcaaaatatgtatttcttatagcagttatagattacaatagtggaaaatgggcttcagagtatgaaaaagtggagagcaagtcaaaatcttatatgaatatgagagaacattttagttataattacaaagccccaatggcctaattttcctcattaatgctgagtgatatttttgaaaagtatgtagaatttaaggtaccaattgccaaaacagtgaaataaaggaaaggcgtgagaaagaaagataaatgaaattcccaggtattacacaatttacatcaaagtattttctaattggtaatgtaaaatgttatataggaaattttacacatcattttatatatctctttacttgaagtgttaaagtgatttcccatataataattcagaaaattatgtataagctaacaaaacttagacctgtagactctagttgtatgtagaaactgccaatagctgctaattcaattctctcttcaatgtaccccaactgatatcttgtttactgggaatatcacattcttctctctcattggactttatttcactggaaaaataagtcctaaagggaataacaaagaaaactacaattgagaaatagaaacaacaacaacaaaaagtttagctaaataattaaagatatttgatgagcatcctggggatatccaagttaatgaacttgagtgagtaggatgggcattcatctctgattcccacctttcagaagagtgaagaaagcattaaaccatgaaactatggcttgtgaagatttccgagggccagtttactgagtgctgagaatgccagttttttaaggcttctcattaccttttagcatttggaacccaaagtggagaatgattgcttctgaaataacaagaggtcatttcctcttccttcaggtctcttcctaaatgttctcttgttccttatgctgcatgatatgtaagataaaatttatttttttcattgtatcattaaaaataagaatctttctgcaaggaaaaagaagggtatttagataaaaccaggagtttactttgatacttccatgtaaactcctgtttgtatcagcagtggtaccttggctgttgtccagcggtttaattggctcttgtttgcctaatctcctgtaacagataatgttattacagaatcgtaggactccaaaatttcccatcagacaaaacaagccttttaatgagaatcactttgttttacctggcatttggcttggtttgagccacctcaatcccatctcacttgtgagaaatgcattatttttcctaacaaccatgctaattctaagccaggaaacatttttttggatcacttcttttctggaatgattcaaagttcaggaaagtaaaagtgggaaggaatttaaattaagctgagatgggaaggagacataattaaattggactttattacccctgttttgcaactaggttgatgttaattggtatctcaaaagacatagcactataacatttgctgtttttgaatttacattaatttcttctataatagtacgtcagtgtatataatttgtctaaattctgtatcttttatttatccatttagtaattcttacattcaaccaatatttggtgagtgtatttcgtgtttaaggcactgttctagggaccactaatagagtaaagcaaaacaaaccgacaaacacaaaataaagtcctaactgtaatggagctttttgttcaggtagtgaaaattgttttaagaaaaataatatatggggataacagtagaccgtgtatgcaggagtaggacagttatatttatacatctatacacacacacaaatacatgtatgtattcacatccatatacatctgtctacatagatatagattataatgttatattataggatgtcaaaaagaatctctttttgataggctggcttttgagagaattaaaaggaagtgaaggggcaagacatgtagccatatggacaaaaggaaattacagacaggacacagaaagttgcaaaaacctgaagtaaaagaatgttttgtgtttaaggggcaacaaacagtgatgtgagttgggggaatatgctagaagaggagatgagagagacaaggtgggaatggaaaaagtccagtaggacttccgtgacaaatatttaggaatggattttgttaaacaacatgtatacgatattgtggttaaagtagaaaatcaatgatagactggattaagaaaatgtggcacatatacaccatggaatactatgcagccataaaaactgatgagttcatgtcctttgtagggacatggatgaaattggaaatcatcattctcagtaaactatcgcaagaacaaaaaaccaaacaccgcgtgttctcactcataagtgggaattgaacaatgagaacacgtggacacaggaaggggaacatcacactctggggactgttgtggggtaaggggaggggggagggatagctttaggagatatacctaatgctagatgacgagttagtgggtgcagcacaccagcatggcacatgtatacatatgtaactaacctgcacattgtgcacatgtaccctaaaacttaaagtacaataatagtaaaagaaaaaagaaaaaaaaaaagaaaatcagggccatagagaaaagatggaagcaaatatagtgtagagaaagctaatatgtttctgtagttgatcactagatttctctatcagtttcctagtggccagggcatacagggaaataaaaatgttgtatgtctggttaaatacatttttttaaagcaagcaagtataccaattatttagggaaattgaaacaaaattacaaaacaattgttgctcttgtttgtcttctttgttagccaaaaaatgcctcccctttatttttatttgttgttgttttggttcttcagtttctattaaataaatttccacacttgagacgctgtgtaatttcatctagttttgtacaaggttgtgggtgatacaatcttatgtcatttttaaattgtccactaccatactgaaattttcatgacttgccttcatatatgagtatgtttttatttcaatcccaagattcaagtatacaaacgcagtgcttttttaataggaagaacatattaaaagtcttcatataccaagagaaaacttacttctcttagaatactgattgtctctttataaccactcttttataagtaattgtataaactcttacattgggattatggtagtttcttattgatctggtaaatgttttctcgtgtctataacaattcaaggtaaaatacactacaatcaccagaaataaactatgttttctggtactaaaatcattattttagtaatttttaaaaataatgttcattattatccattatctgagagatacctctcattacctctctcaaaaatgacaagaaagtgaaataacatgtctaagattattgttacctaatgtttataaaaatagataaacccaagaaaaatatcgaaaagtattaattgtatgaaaagatggagaagaggaaaatatcccttataatgaaaatcagtcatgctagatgataaagtggtgagatttaaacaattttctgggcattgtattctcaaatggatagtgagttgagcaaatagattaaaaatagtgtaaagtaatgcaatagtaaaataaacatgctgagtaggaagagttaagtcttagataacaaaaggcagaagacaaattaaatcaaaataatgtagaggcatgacaatgaaagctaagtagtctatggaaaactgttaagagacctgaattaattaatgatgataatggtcgtaactaacatatatatgtagtgacaggaatcaatccaagtattttacacaaactcctcatttaattggccccacaactcctttaggttggtattattatcatttccatttacacatgacgaaactgagagcacctagaggattaactggatcctaacactcaaaggctttgtgatatgaagtgttcagtgattaatgtgtttgataaggttgaagatttggggtgcatcatttcatatcaactatagtaggtggaccctgtcaggagaccagggaagagatgattagaaaacccagatgaaagaaactaggacctttatcaggaactaaaggtgaaactatacatttagatggtgtaaatgccttaggggacctgaaaaatggcaagcatttaaggtgaaaggtaaataggtgagtagccccaattgaatgtataatattaatgaaagtcacatttaaagatgtttagacataaagcaaatggtcttgttatttagcgggacttaaaaggtaaatcagtaagtggagaaaatctcatctacaatgggaaaatataattgagcttagactggatataaaagggcagaagtggagagctagatctatgtgtatttatccagggtttgttatgagcccagagaaaatgtaggaaaagaaattcaacaactgaaaaagcaaaaaattaaatgaatctgaacaaagaaagctgcttatattagatatattttctggaaaaagatataggtgtcctgtcttagcaaaataggaactagaacaaatgccaccatctttcaaaatttaatattttcttgctacaatttatgtttatgatttatacttatggatatgatactctattaagaggcatcttgtgtgaaacaattatcatatacattgcaaaatagaatatgtataaatgtttccgtgtatatgtgtagatgggtttgtgtgtatgtgagagagagcaaagagggggagggagagagagggaggagaggagaagggagagagagaggcagcaatttctaagtatttctaaacataggagggttataagattatattcatggaaaaaagacatgttccagttcaagctgtatgcatttatacagtggactactagtatgatgaagctggagaacaagtcaaaacactggagtggaagcagaataatcacacacaagacaggtgaaatattccagagtcaccttgaaataaatataaaattgatgttggcagcctgacagtgacaggagtcaagaaatgatgctgctgtgaaatcacaaaagatgcaattgatattttaatctcaaataccacgtctgaggagaaagcctgaaactaggaattgtttgtaaaagtgtatctgttgatagatttctgattttgctgcttttcatttttatcctcttatggagaataataataaaagtagtcacatttttagtttatattgctctttaatttttttcttaaaatgaatttgaatttttttaagacaagaacataatatgctctgaaatcgtgtcattagatttaaaaaacattattggagatatttttcttgttagaccactgcttttcttaagtgaagttgaccttttgagtttttagtaactaaggtatttgtgtgtgtgtgtgtgtgcgtgtgtgtgtgtgtgtgtgtgtgaaattcattatatttgttcttctaaaactattttcttcagttctaggtttcctagtttggagcagaattctatatttttcttgttttatgccctaggaagggcataaaattattttgaatatttttttccctcttcttcctgacccatgtaatcgcctagctgaatcaggcctccccagaaactgattcatggtcgttgaagtatctcatatgacccccatcccacctagtccgatattaaccctataaaatgtctcaaataaactcttattttcgtggcctctaatctccttaattttttaattttagattcagggtgtacatgtacaggtttgttacatgggcatattgcatgatactgaagtttgggcttctaatgatcctgttgccgaagtcctgaacatagtacacaaataggcagttttctaacttttgcttcactcctgtctttcccccttttggaatccccagtgcttattgttcccctctttgtattcatgcgtacccagtgcttagctcccacttttaagtgagaacatgtggtaattggttttctattcctgcattaattcgcttaggtgatggcccccagctgcatccgtgttgctgcaaaggacatgattttgttatttttttatggcaatgtagtattccatggtgtatatgtaccacagtttctttatccagtccactgttgatgggcacctgggttgattccatatctgctatcacgaacagtgctgcaataaacatatgagtgcaggtgtatttttgctagaagaatttattttcctttgggtatatacccagtaatgagattgctgggttgaatagtagttttgtttttggttaactgagaaatctccaaaatgttttcacatcagctaaactaatttccattcccaccaacagcgtataagcattcccttttctctgaaacctcgccaacatttgttattttttgactttttaataatagacattctgactggtgtgagatggtatcttgttgtggttttgatttgcatctgtctgattatctaatctcctttaaaagcttcctacatcttcctgaaaatatatattgcttgattaattaatttatttatttttcccttccctttttcacaaaggattgctggctgcttatactaaaaccacatattattaaataaacaacaacaatgtaaaggacacaaatgatgcaaattaatcatataaaagggacaacaattttgctgtgactatttttcttactgtcatttgagcttcctagcagggaatataaaaggcaagacacagtctccaatgcaggactcaacataagataggaagatatgttaattgctgatttcattaaattttatccagccggttcattctaatgcctctgttttttcaactgtgcaatgaagatcatgcctaccttgtagagctactataagtagtctgatagttcagtgacacatatttcagtgtgctcatcacatttatccaagggtagcttccgagatcaccgtcagtttcacaggaccttatctatataaatgatgatgatgatggtggtgatgataattatggtgattacagttagcacttattggtaacttgtaactgggaagtatggtaagtattttcttggcttacctcatttaatcctgaaaacagctctatacagtgggtacttttaaaatgtgcattttgcattgaggagaccttaggctgagtgacttgatgtccacacatataatatgaatctgctatatgtttatatatatagcatttgaatttgtgtatttgaatttgtaatgataaatatgggagaattaccctgttttcttacctcctctcactactgcaacttattaattggacgaaatatgaaagtaataaattcagaagagacagagagcatttttcaatgttcattatttcagtaaaatataaacagctcacagagatatttgaaaaatagtgagccaaacacattcatttcatttttccttgttcttcttttagaataacaagcctagtatgtctctgaaactttttgcaatctatccggttataatgttagcaccaatgtagccataagtaatttttttttgccaagtttgccctaatgcattatatcatttgagtgcatgggaagatattagcgccattaaaaatattagtaaaactgatttcagttcaacaacctgtacattgaagttgttgcatttatctatttacatctctctgttctgtacaaaagcagcaacttaaacgatgtagataaataatagtgacattttatctccctttctaaagttgaattccagaaggtaggaaagatcctttcatgcttacattaccatgacaaactgaaagagataaatccctaacggatgggatgagatgtgggagttagaggattaatgcttagatgcttcctccaatttatttctcctattatatgtgttaaaaatatataccatatgtcatgcagcatgttttaatcccatcaaaatgtctcacacaattccttaggggatatgctttttgctgccaagttttcaccgctggaatgctgacttactattcctttgcagagagcttcatggtttattttatgataacatgttgttataacttctctggctgtaatttttataaggagaattagtcccgggggaatttattttgagagtcatatgcttaatggtgacagaaaaggagagaaatatttccaaaaagcaatgtatccttcagttgttttaatagaacagaaattcctttgacaacatttgtgaaagcctttattatacccagcatttaaattcagtccttgaaatggggttttcccggatcatttgaaggtcaattttggaatagttcttgtgtcctatgacacctttcaatgatagcactttacagagaggaacaaatttaaggcaaaaagtctcttttagtgatactaagtatacatgacttatagcaggtgacaaaaaagctgcatataattgccctagggagaattttctttgtgccacgttgtcgctttaaaaaaaaatgcatgtagcaaaatttcacatgtaccccataaatatatacaaatataacatatcgaacaatttaaaaaatattgaataacaatgtgagcgattaggtaaagaggacaacttgaactaattttcacgtcacaaaaaaacaaggttaaaactttacaccaggaattaacaacatgttaccttcgggttcctctgtgtgatgttttagtttgaaatctcagtatccttaaagttaccatttgttttatacgacattgttcagctaactcatgtaggctagggcccactctggcccccaggtatatgattttcaccaatcagggatcactacaagatttacttaagtactcaaatataataaagccaaagttattatttagttttttttttttagaaattaagttgctccgaaatgtatgcaccctgtttccaatcaagccttctaattgtaataacattcccccacagaggctctgttagcatttatgggctatattaagaagaaaaaatacacacacatgagcacaattccagagatgccctttgggttttgctttccttattggaagatataacctaaatggatgtcaggtgtgcaaatagactatattttttttgttccataaaatctgctgggcatggttcaaatgctgtcttttaagccctttgatggtacttaataaatgcagggatgcaaactgaggagttacttgacacatcatcatgccattggcagtatattgatggtaaatatgaaataatttgtttctcccctccccaactctaacctcataagtttcacacatatcagaccttagcttctctttgtcagactcaaattggatttccttttctatcatctctaggctcagacttcgatgaccctaatttggcagctcttcaaggggtttatggtgtaagccttttctatttctaacaaaaaacacagctcaaatcctcttcacattagtgaatactgtttgaagtttcattttccaaaagataccatactttcttaactcaatttttaaaattatttttactttttctgtactgaatagttagtacattttaattttgagtgaaaaaaagttggtttgaatagaaagtatgcattaaaattctccataactggatttcgtagtcaaatctaggacagaaataatataaactattttatatactattaaataaatgggatatttatttaagcaactgttatttataatttaggtgctacttctacatttagggatttagtatatactcctgttggccagattttaacagagttcaaatttcttaaatggtgttctctttagcttaaataactatatgtcacaaaaatctgaaaaaaacatataagattaatcatgattttaaaatttaattgatgctggataaatgtaattagaaacaaaatttcaaagttgtattactactagaaattctcatctgatctatatattaaaatatagtcaaatatttaaggttgcctacattacagtgggaaaaggtaaattgaagttgcagcttcttatgacatataacctatacatggtatcatgggtcattttgcttgtttcatttcccattagaggaattttaatgaaggaggccagtaaaatgttgattaataagtgttgatgtgaaatacacttactgggccatataaaagtggcaagcttatgtagactaccccccaccattattatattttttaattctatgagtatggaactccagaagactggaaaccatagcttttatctttttcccatgagagttatttatccagcattttcttcaataattctacaagatataactagagacatagatcctattagtttggtaaacagttataattattacagtagccttccttatttttcacctctttgtcccaattcattcttattaagatttaaatgttggggataatttattttaccaaatgttatagaagacagagaaattaaaagcaaatggctaaagccgacataaggtttcaagagctaactgaggataaaactctaatcgtgcagactttagttgctgtattagtctgttctcatggtgctaataaagacatacccaagacagagtaatttataaaggaaagaagtttaacggactcgcagttccacatggctagggaggcctcacaatcatggcagaaggcaaatgaggagcaaagtcatgtcttacatggcagcacacaaaacagcttgtgctgggaaacgcccatttataaaaccatcagatctcctgagacttattcactaccatgaaaacagtatgagggaaaccgcccctatgattcaattatctccacctggccccgcccttgacacatggggattattacaattcaaggtgagatttgagtggggacacagtcaaaccacaccaatcacgtcggtaagggtgagtcaaatggctagtgttccctcaaaagtgagtgtgctgcaagagggtatatgtgatatatgtatgtgtgcataagcacaatcacaagattaatggattttaataaaagatgaaaaagtattacccagaatactctatcaccccagtttgcttgattgatcaattggcttccggtatcataacttgcattctcatcccacttatatagttaatttttatatttgtaataaaatgtatagacagtaaaaataatatagtaaatatatatattatatataataaatatagtataactgaacgaataaaataataaaatgtatagacagtaaaaataatatagtcaatatatattatatataataaatatagtataactgaataaataaaataatatttttatttccttgcttttatagatattatctccaagaaaatcataggggaaaactttaaactgttattgttggtcagtcacttaatcattaaagtaccctaaactttttttccaacttgaagtcgactttcctaggtatgattttaatggctgcaacacatgccactgcatgattctccattgttgcctttcagattgctgtgattttttttaaaactacaaccaggtacatgcagataatgtcttcaatgttatctgataaataagataatttgtaggcaaaaaataataataacccttcaggctctttataaatgtttttaatctaagtttccaagagacctggaatcaattccatgccttaggctaaattcttaatcttccttggagacatgttcttcctccagacctcctcaatttagtgagtggtaccaaaacccaccctcttgctcaactcaaaaacctggctgcctctttctccctctcccttacccctgctttttgccgttatacgctatcatgtttctttccttctacttccttgcagtggtttccatcacatttagaataaaatccacctttttaaaaaaatataatctacatgctgcccacccctctaacagatcactaactcccaggcacacggagcagacagactctcctgtacatgctgttcatctgtttggaatgttcttctcgcacttgccatgtctggtttctttttgttcttcaggggtcaattttaatgttccatttgcacagaggccttcctagatgacctcaatctgaagtggctatccttcgcttgcataatacctttcctttctttggtgcctttttgcaatgtataatattatttaatatgtttgttggcttacttgtttaaatatctctctttacaactagatatactcatgaaggttgctaccatgtctgttttgtttaccagcatatatgccatgctaatcatgttgcctgacacattgggttatagtggattggactgcttgggtttttgtcctggctctgaaatgtattaactgctgtccttgagtacaaatgtaagatgggcataatgataatacctaccgtgaataaaccaaattattcatatacagttattagcatagtgcttggcacaatatacattctcaatacattgtagttactattattttgttctagtaggcattcttgaaatattttttgaaagagtgaaataatgagtttattttgtgatataaataagtaagtaattacctctttggtatatgagtatgccatttttatcccaatctttattgctttgagtatcatcctttaagttactaataggtagctgggcatggtgactcaccatggtgacccagcattttgggaggccgaggtcggcagatgacctgaggtcgggagtttgagaccagcctgaccaacatggagaaaccaagtctctactaaaaatacaaaattagccaggcatagtggtgcatgccagtaatcctagctactcgggaggctgaagcaggagaatctcttgaacccaagagacggaggttgcagtgagctgagatcgcgccactgaactccagccttggcaacaagagcgaaactccatctcaaaaaaaaaaaaaaagttgctaatatgctaaaaataagaataatgctcatgtttttacttccatacaattgattgttagaggtgaaaccttttcccatctgcacaaatttctggaagacaataaatgtttcttcttctttcattaatattttaactgtggaggtatctgtttcaaaatgtaaaatccaataggtaatcagtgaggaatataacctagattaacttttttttttcaaaataaccaaagcacactcagtttaagtttcatgttaaagtgagccaaatgccagttaccaaaatattggatggctatgtatataatcctttgctgatgagtaatttagcatcaatttagagatgttattttttttctaccagatgctcgaaagcattaaggcaagattagaagtcattgtcccttcttctgttatcagtggtcccacaatatttgtttatatcaccattagaaacaaattgtactgtattatagttatttttttgtttgtccctcctattagagagtgagttcactaagggcagacattatgttttatactttattgatgtggaaagcaggcagtaaagaaagaatgaaggactgattattggacatttgttattaatgatcttagcttattattttcctccaaatgaaaatgttttagtgaacataaactgggaaaacagcaggagcaattcagttaatactcagttaccttgaagaggttgaagcagaaagtgtttgtgtcagttgttttaacataattgccagtaaagatactgaaagtattccctcatgataatgagaaaaatccagaacacaaggcttgattactcctacaatatttgcctgctttgactctgactgtgcttaagtatatccaggcatgctgtgcaaagtacagaactgaaataaaataatccctagtccaatcataggcttacgttactaggataagtcaagtttgtggtttcacctgaagtaagaaagcattaagtcttcttatcacacccaatcatccatattaggcttgggatagaaaaggcactagagacagtagggataagatttagtccagggagtaagtacttggtttcattaaaactaccctagaattggctcaccagtattaattaagtcctttttatttgtaatctcattcatcattctctctctctctctttctctctctctctcccccccccccgctctcatagagcaatgttaaacaatgtacacttctttttttaaagttatagatttctaaatttaaaatgttctgatatagtctagctctccaattagggagaagtagaaacatatgctgctcagcttttctaaaatcttttaaagtaatcaattagcatatgggctaagttcactttagatggatacacacatgcactatatatatatattttctttagacatgttaaggcagtggataaaatttccttttgcaatcctttgctcatggtatattaatgctgatagtattttatgctattttgtgttgatgctctcagcacaaattggccccaaaatattctgtattcaaaagcatgtatttttttcctaagcgtactatgattttaatagaagcagaaatgagtgtttccttcttttgtgaatttttgggagggcatgcttccctgcagtctctggagtgtgtgttgacattttttgtgccatgatttcccataagtaacacactcttttgatagtgaagcagtgagggaaagttgctaagttccatctgtaagaaagcattatcagaagtggaagaagggaaatttactaagttccatctgtaagaaagcattatcagaagtggaagaagggaagtgacaagaaaagattcaaagttgttttgttttagctccagtagatgctttataacacactcctaaaaagagtgtgaatataatatagttaatataaaatttattttatataaataatttataatcttcaaatataaatttgtttttactatataagcaatgtaacattgacctaaaaattgaattgaaaaaatataaactttcttctcagaaactgggttctcaattactctctatgtacctgtttataaaatacaaaccatctagataatcattgcaccacaatttgtatcaaactctgtttcttagccatcctagagtacaatcaatatcattgatcttttcgaaaaaccagcttttggtttcattaattttctttattgtagagttctgtttctttaatttttttattattatttttgagaccgagttttcctcttattgcccaggctggagtgcagtggcgctatctgggctcactgcaacctccgcctcccgggttcaagcgattctcgtgccccagcttcccgagtagctgggattgcaggcatacgccacgacacccagctaattttttgtattttagaagagtcggaatttcaccatgttggtcaggctggtctcgaactcctggcctcaggtgatccgcccacctcggcctcccaaagtgctgggattacaggcatgagccaccacgcctggccctgtttctttaatttttagataaggatctacctttaacttatgaatataatatataatatgaattatgaatattatgaatataatatgaattatgaatattatgaatataatatgaatggcattgttgtagggtgataactattttaattcaccttcttgaaatagataacatttggcttttggttagattttagatttatctgttaatgttcagaaaaagataaaagataaatcatggaatctttttttttatttttttattttattattattatactttaagttttatggtacatgtgcacaatgtgcaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccagtttcatccatgtccccacaaaggacatgaactcatcattttttatggctgcacagtattccatggtgtatatgtgccaccatccatggtgtaaaaatgctcaccatcactggccatcagagaaatgcaaatcaaaaccacaatgagatactatctcacaccagttagaatggcagtcattaaaaagtcaggaaacaacaggtgctggagaggatgtggagaaataggaacacttttacactgttggtgggactgtaaactagttcaacccttgtggaggtcagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaacccaaatgtccaacaatgatagactggattaagaaaatatggtgcaaatcatggaatctttaaaaaagaaattttattcctgtgttaatgtgtagttttaaagatttgtttaacagtgtgtactaatgaagcataatagataccaaaatgttttcattaggaacaaaggtcaattgtgcgagaaggagtcaccatttatgacctgacaggttgaggtaatgcaggcagggtaagacaatacatgagtaagcaagcccccctcccaacagtagtcatcattaataggaactcactgcatttagggttaacagatatatgatgggtttgaaaattaccaaagtggaacccagatggatatgtagatttcagtatcattatatacttggaaattgaggaaatagtgtagaaaaatacataaactggaaaaaatcttatcagtcaagaattaagttctagggacttgctttgacctctcattcattcctttatggcctcttaatttctctactttttctaagcttctctctgcatatatcttcactcttatctccctaagactagctttctctacttattcataggttcctccttatcactttagattacatgtggtcatcacaacttctttggccctaagtctaccttaagccttttgtttatactcagaaaggaggactctgattgggctagctcatcttttctaatgaaaccaagagataggttacttgcctgcataggacttggctgcccttggttaaggggccatcatagcaccaatcagtcatgtctggtctggccatggggatgcataaataaacaaatggtcttacctttccaacctcttcctcaatcactacctaccctaggaccacaaactctatgttctatccaaaccactcttttccacagatacctaatcatttcactattcacagtgttaacctgccttttctcacttcttgaaatttccatcacagaatgcatgattaatctcaaagcctcatcccttgcatgtccccatgaagtactcttttactttcctaggaaaagttaacactctgatagtgctttgtttatgattgaataaggtcacttctggtattgtatttccactatgagagtgatgtacatgaactattgaatataaaaacatacctttgataccattttgttgtatagtttataaaagaaagctatgacaccatagggttattaacattatattacttaaagtagtggtaaaaacaacacacatatacacacacaaacacatacacatacatagcacagccagacttggcattctaacatccccacacatgagaactatcaaagtatcatttctgagctgcgttgtttttctacttgtgccctatttctaatagtggaagaatttttttttaaagcaaagctgttatcttttaaacactggaataaaaaaaaaattccattttctgcatgagtcagttttttcagtgaatattttcagcaaatgaacaagctctgcattaaatccatgctttgttttagtagtttccttgggtggactagtttcaccgaatgccatgtgtaaattggtcacatagaacaagaatttatatttccacaattttatttggaactttgaaacttccattatctcacagaacccagaaattgaattgaggctttgttactaagccaggttgtagcaacagacttaggagtcagtagctcaattttctacttctttgcatcaaattttctcctgagaatgatgcatgcaatacagaggaatggcagggaggagcctctgtgaagtgttaaatgtttggttcactgggtcctatcagcaggtagggcctgtggggagcttgtttatccagcagaacaatctcattatgaggacagtgatgtacaatagtttgcttcataccccaaaaccattcaaggaaacgactgagtgaatgatatttttccgggccctgtattatgctattatgacttgcaataactggcagcatattaaaacagaagtcagggactacagttactctgttgaatgaagttctgaaatttcaaaggtgttgattattcagtattttccaatttacagaataaaagagtatgtgattgactatttcatggcgcagtaatggaaataaagaaagagaatgaacaggcttgattaatttcagagtaaatgcttatttttcataattgcataattctcaagtgggtctctgtgtagaccggggtggccttttctgtcaaatacaaagataagaacttggcattgaaaattaaggaacaataaaaaataaatatgtgtgcatgtgtatatatgtgtgcgtgcacatacccttgtcatcactaagggcaagccaccacacagccttggttagctttgaaaatatctatgaatactacattgaaaaaataaagtaagatttgggacaaacatccatcttcctcatgacaatatgctgggaacagctgtaagcttagaataaagtggggaaccctgcttaatgcgctatgcagtaagcttatcaaatctcagcccagctagaacagtgccctaggatacaacaggcaccttgtaaatatctgttgaaataaaggatgaatcagtgaacgaatcaatgaatgcttctgtccagaagtgacacagactaaatgctgtaaaatcattcatcctctaaaatttcaaatattgttggttgtctgaaacatattaaaggaaagggacatggtatgaccactaagtgtctgaagtcttaacttttgaaggatgcatcaagaaacccagctacatcttttcggtagaaagtagctaaagaaaggattctgaattggatgaaccatgaagtcctaagttcctctttaaagctatttattaaccatacaaaaacatactttcactcactgagaatttaaacttttatttaaatattagtgatttactgcattaagtgttatcatgagatagcatctgctaggccagaaaattcatctagttttgagtttaatcgttgttaatatgcagactgtaaagataatctcactggtaaaccagtgataaaccagcacttgatgatcttttaattgctaagtagcactgaggcagcttacatttggctttggatttagtagatatttatattaacaactggccagtacagcttttcacgtaagtacttcacctcaaatttatcaatcctttaaaatatacatgaatttaccccacacccataagctgcactctcaaagataggggaaaataaaaccaaaagcaacaaagattgaatcaatgtaattttctgctgtttaaacataggtttctacttaccttgattatttaaagaatgcctgaaatcatgccaatgaaaactctggaaagtagagtttaaggttcaaggcaaccttctttttttttttttttctgtgctgccatcatctctcacctgaactattgcagtgatcttctaataggtcttctttttgatgtctgtcacctacattctattgtcaaccaagcaggcagagagcctattcttaacagctttattgaggtataattgatatacaattaatcacatatatttaaagtgagcgatttggtatgttttgacatatatataaactcatgaaactatcatcaccacaatcaagactgtgaacatacccatcacactaaaagtttcctcatggccttttgtaatgctctctccctttcgtcactatcccagacaatcactgactcgctttctgccactatagtttgcattttctagagttttatataaatggaatcaaaacagtatgtactctgttttgtctgacttttttcacttggtgtaattattttgagattcatccatgacatgtataaataattcattcatttttaactagtatttaattatatgactacattcatcatttgcttattcacctgttggtaaaatttacattgtttacaatttggagctactctgaataaggcttctatgaacagttgtgtgcacgtgtatagacgtagagttttcttgtcttagtcaaatacctaggaatggagcagctagatgacgtgaagttagtccatttgttcttttatgagttatgcttttggtgtcttatctaagaaacctttgcctaatccaaagtcacaaagattctctcctgtcttttctaaaagttttatggttttatgctttacatttggatccatgatcctttttaggaaaatttttgtttacagtagaatgtatgaatcaaagtttagattttgtcatatgggtacccaaatactccagcaccatttgtctaaaagagtatcttgtctgcactgaattgcctttttgctttgttgaaaatcagtggcaaatatatgtgtggatctatttctggactctaattttgttacatttatctatttttctatcttgatgacaagactttgattatgtttgattagtttgattatggtaactgtgataaatcttgaaatcaggtagcataagacttcacgctttgttctttgaaaaagttattttgaatatagcaggtacttaacattttcatgtgaattttagaattagtatgcccatttgattgtcattgtattaaatctatataacattttggagataattgactaattttttttaaacttctgttttacattcagggttacatgtgcagctttgttatataggtaaattgcgtgtcatgggagtttgctatacaggttatttcatcaccaaagtaataagcatagtagctgataggtagtttttcaatgttcacactcctcccaccctccaccctcaagtagaccttgttatctgttgttctattctttgtatccatgtatacttcatgtttagctcccactttataagtgagaacaggcagtatttggttttctgttcctgcattagtttgcttaggatgatgacctccagcttcattgatgttgctgcaaaggacatgatctcactcttctttacggctgtgtagtattccatgatgtatatgtaccacattttctttatccagtctaccattggtgggcatgtaggttgattctatgtctttgttattgtgaatagtgctgcgatgaacatatgcatacatgtgtctttatgacagaacgatttatattcctttggatatatacccgataatgggattgctggatcaaatgatagttctgctttaaattctttgagaaatcaccacactgctttccacagtagctgaactaatttaccttcccaccagatgtgtataagcattcccttttctccacaactttgccagcatcttttgttttttaacttttaaataataaccattctgactggtgtgaaataatatctcattgtggttttgatttgtatttctctaaggattagtaatgttgagcattttttcatgtgcttgttggctgtgtgtatgtcttcttttgaagagtgtctgttcatgtcctttgcccagttttgaatgctgttgtttgttttttgcttgttaatttgtttaggttctatatagattctggatattacacctttgttggatgcacagtttgcaaatactttctcccattctgtgtgttgtatgtttactctcttgatagtttggtttttgctttttgttttttatttttatttatttatatatttttgccgtgcagaagctctttagtttaattaggtcccatttgtttacttttgcttttgttgcatttgcttttggtgtccttattatgtaatctttgctagggcctatttccagaatggaatgtcctagattatcttccagagtttttatacttttaggcgttacatttaagtctttaattcagcttgagttaatttttgtacatggtgtaaggaaggggtccggttcaatattctgcatattgaaaccagttatttcagtaccatttattgaatagggagtcttttccccattgcttggttttgtcaactttctcaaagatcggatggttgtaggtgtgtggcattatttctagactctattctgttccattggtctgtgtgtctgtttttgtaccagtgccatgctgttttggttactgtagccttgtagtcaggctttattactggttcaatttcagaactcactatggttctgttctgttattgttctgttcaaaaatatggtttctccctggttcaatcacttataaaggcttggtttggctggatatgagattctttgttagaattttttttttaacaattctgaatataggcccccaatctcttctggcttgtagggtttttgctgaaaggtctactgttagcctcacggggttcctttgtaggtgacctgccccttctctctagctgcctttaacattctttcttttatttcaaccttggagaatctgataactatgtgttttggggatggtcgttttgtacagtattgttgcagaggttctctgcatttcctgagcttgaatgctggcctattagcaaggttagggaaactttcatggatgatgtcctcaaatatgatttttctttctgtctttcggggatgccagtgagtcatagatttggtctctttacataattccatatttcttggaggttttgttcattcttctttattcttttttctttatttttgtctgattgacttaattcagataaccagtcttcaagctctttgctcagcttggtctattctgctgttaatacttgtgattgtattatgaaattcttgaagtgaattttttcagctctatctgatcagtttggttctttcttaacatgtctattttgccttccagctcctgtgtctttttattgtattccttagatcccttggtttgggtttcaactttctcctgaatctccataattttcattcctatttatattctgaattacatgtctgtcatttcagccatttcagcctagttaaaaaccattgctggggaactagcacagttgtttggaggtaagaaaacagtctggctctttcagttgccagagatcttgccctggttctttctcatctgtgtgggttgacgttccttcagtctttgaagttgcgtcctttgaatggcactttttgcttttatcttctgtgatgccagtgggggtttgtttgtggtataaggtgggtttcaactggcctcttttctggaagattttagggggccacggctcaacacagcactcctggactgtgtgttctaactctgagggacttttaccgggcccctgcctttgctctcgagccccttgaagttaagatcttgctgtactggagggacctaagtgttcttggtccactggccacaacacgctgttggagagtgccagccaaagcgctttgtccagtggtagcagtgggatctgtgctcactcgggtgtgccagcagccacagcatgtgtggtagggtgcacatttttcagctgaggaggggcaccagtgggggcagggttgctgtcatctgtgctagcatttgcacctgcagtggtgggagtagggcacttgcagaggcagggtttcctgtgcccatacacagattcacaccggtggtggcagaagcagggttggtagcatccatgcgtgtattcgcactggcaggagtgggggcatggtgggggtggggttgccagtgcccatcaaggcaatcttctatacttgaatttgttaatcatttcacaatacatatatatgtatcttaaaacaaaacatcacattgtatgccttaaacatatacaatttttatttgtaaattatgcctcaatacagctggaaaaaaaacacatgcaaagttacataaatatccccatgattttttcctcaagttatcaccccttttttcttacttgagtctgagagtgtttatgaaaatgctatgaaaatgaagaagtactaaaccgataacatggatggatattattatatgtatgacaaaaatgagaaggaaaggtcctgaaggaggtacacagatacatttttgtaataccctgaacaaaatgcagtatgtcaacagataccaatcataatagatatatgattacacatatgaatgtagattaatgcccaaaacagttgtatgtgaagctaatctgtttacaatatattatatatttcatgagacttctctgataaaaatagacttggcatcacttaaaaaatggttctaacctttttaaaagttctcacttagaaattcacttggcggagcagtacacaagctgtgtgtgtctaattttcctctacaatctctgtaagaagttaatcaaataggcaattaatctgtatgatattattcatgtgaaagcatatgcatattaaaatacacaacagacttcattcttattttccttaaatttttctctaatgccaggggcttgaatgtccagcagagctcacaatatgaaaaggatacatggcagtgcttttgttgcacataccagaaagtacaagcaataacgttctgctgtataaacacctgtaatgaaggcagaaaatgtgtagtaagctaacaaacaagactttgaccccaacaacacttatctctcgccttgaatctgcttttgctcctcatttccattaatagtgccacaatcttctctggaatcctgatttgaaatctcagagtcatcctagactccttctcctccttcatctcgcccttctgatcaatttcagcatcctgttgattctgactacaattcttcccacatttccttgtcatatcctttgctacttcttttttttttttgtaacctctattttaagaactttctgagttgtctccttactcctagctatccccttccaatccatccttgatattgtcctgaaagtgatatttctaaaatgtgaatcagataataacacttcgtttgcagacatttaccactgtcaacattggttttagcagtgggtttcaaagtgtcatccctggaccagcagcatcacctgctttgtagtaactactttgtagtaacgcagatccttaggtcccaatccagaccttctgaatctgaaactctgagaggggagcacaaaactctgtgttttaaaaagtcctccaggtgattctgatgcacacgaaaacttgaaaactacggggctacagaattaagttcaagttttttggcatggtgtcttgccaaacctgtcttttctgcacttattttcacctccttacactcttctgtactcctcaccactccactatttcagaaccttaccatatactgtcctattaactgggataaaccattggcttgcaattttctcttccaaattatcaggttttgaacgaagcacatttttaatttcatctctttcttaaatcctttttgatcttcctagacatatttcctgctccattatttcatctgtgaaatggaaaacagttctgggttgagaggtaaaacaaacttcttgctttgtgtttcctcagtaatgttatctttgctctcagaatttattcgtttttcttgtgctatacatggtttttgacaagtctgttcccacttatagatgatatcttcaagggtgatgcaagtctcagtaatctttgtcatagaagagtgagttgcacatcatatgcggtctataacatgttgtctcacaccaatatatgacttgaactttaatgcatgattattttatatgttcattgctgaaaacaatccattagtccatttgggattgttataaaatttaaagaccttttgtaacttactatcttgaaaagtgtaattctgttcttttgtctgctctaaaacaaaaacaaaataaaagtaaatctgtgccttgaaccctgttactttctctttaaaggatcaatttgctggctgggtgtcctgccatctaacaggccttccctgtgaggctcctctaaattgggaaaaggattaaattttatcagtgtttgtttggtctgttgctcatcatgttgatatttaatccagtgtccaacaagtgtcccaaaggaataaaatgcctgaagctggcaatactttttgacctatctgtctgaacatattcctatcagtttttacccaaatagagggttttccaggagacatacatgagctaaataaacaatataatagtaagcttaattcagtaaactatgtttaatatatcaacaaggatttattgagttctgaagtacactcaattttgtgaaatcaaattattctgagttagaaaattgtatcactttgcaatattataaaggaaaaatgcatactgctattttttaattatcagggttaaaaatatctacaaacaatagttataagcgattgtgttaacaccaaagatatacattttcaatactcatttaagtgaacagttatttagttaatcactaatttattcaacacacatttattgattgcctattgtgccccaaatatatatagatatggaaatagctctaaatttataattagagctaaatgaggtttttttttcttttttaaagatagggtcttgctatgttgcccagacgagactagaactcctgggcttaaagaatcctcccacatcagccttttgagtagctgggactacaggcacatgctgctgggtccagtttgagatttagatatgtagatgatagatacatagatagataaacagatagctaggcagatatagaaatagagataaagatagagaaagatagagatagatatagagatggcgatagagatacggtaaagtcccacttctcagagtacaccacacttcagtgatcaatgaaatacatgtaagcaaataatgatttaatatgatacatgctaatgaaagtatgtattaactaaagaacatagggtaactaaatagtcaaaagaatgaaaaaagtcttcaaagtcaaagatggaccatatgtaccaagattttacctatctgcatcagtttcttatgcgaaggctaataaaagaaaataagaatccagattttcttgtaggatgacgtgcatctgtttgtgtttgctgaaatagcagggctttttctgctcctgttcagtgtgggaatggaaagcagaacatcccctgtgttccatgtactgtgttaggtactttctcatgtcacttctaaacactaagagaagtaaaaaaagaagattcaaaaacaagtcttaagctgaatttacttaatgcaaggcaggaataacatgatcccacacagatgcatgggaccttcagattaacagttaaagaattgttcagagaaaattaacctaaaacattgaggatttgttcacatatagacacatacaaggaagagcaacccttatgaagactttttctcaggccgaagtcaagtgtagagctttaaaaaggcaaacttagaagtttgggtttgtttgtttgtttctccaacaacaagagttgctgctgcaaagtgagagtcgctctccctactttttagttattattccaagatatctatccaagtagacacaggttgagtatcctttttttctgaaatgcttgggaccagaagtgttttggatatcagatctttttcaaattttagaatacttgcatatacagtatataatgagatatcttggaaatgggacccaagtctgaacataaaattgatttatgtttcatatatagcttatacacatagcctgaaggtaattttatattttccttggggatgctaaataaattgtgttctgtgaatctacattttgactgtaacccatcacctgaggtcaggtgtagaattttccatttgtggcatcatgttggctggcactcaaaaagttttgaattttggagcattttgggtttcggattttctgattagggatgctcaactttactttaaagtaacataatttatccttctataaatatagtattttgttttcatattagtatgcaacatgtataaattatatcattagacttttttgaaagaattcaaacttcaagtttgttaccatgaacatatttttagcttttacataggtagtaacagtgacttaattaaaaatactttttctactcttatttgaatatattgataatagccaatatatgtagttttcttcatagtacatcagtagtgaaggaattacttctgaatcttaattccattactgtcttcatatatgctcccagaactttatgagaggtaacaaaaatgaatgaatatggtacttcttactcccactccccaatgtaacttcatggcttccttcataaactcccattggctgtgaaagaacgtgtactgcagagatatgttgaactggagtatttccatagaatcctcccatcagggaaggagagtaccaatagcaaattttctgagagagacttacagaagggtattttattccgaaagggagaaaaacagattaagtactaccagcatccacaattacctgatgataattttaaaaaacaataacaataaaagttatatgaattacatacaattaatgtgtactgaaatcaacagtgtctagaaatatgcttttggaatgattgttcccaagccaacaaagcttgtgtgctgaagtaagaaaaaactgaatggatcaacagcaattctgttcatcaagagttagattttaagttatcacatatccttttaagatttgaaaagtctcactacacaaggttaaaaaatatactttgtggctatatttttaaagtctttattcacaaggggatacatactgacgtatttggggatgaaatatcattatgtctctaatttcttttcagctggtttagaaacaataatacaatatagaaggtgtgagagagaacatgtgtgcagatgaggcaaaccgttaacaaaggaaaaaaatatatctccttcatcacttctttcatttagtaaaatgttttattgtaactattgaagagagacataggtccatcatttgtttaaatgattttatgcaggccgggcttggtggctcactcctgtaatcccagcactttgggagaccaaggtgggcagatccgagatcaggagtttgatgccagtctgaccaacatggtgaaaccacgtctctactaaaaatacaaaaattagctgggcatggtggcgtgcgcctgtagtcccagctagtcaggaggctgaggcaggagaatcgcttgaacctgggaggcggaggttgcagtgagccaagatcgtgcctctgcactccagcctgggcgacagagcaagactccatctcaaaaaaaaaaaaaagattttattcaaataatttgaatatgccttgaactgttctttatagtgtttaccatcttttcccaggaattattgaaccattttaagtttattttttaacaggatgcatttagtttaatggtagtaaaacctcctaagccatagatcctccctctgtttccatattgaaatgaacaccaagtgtctctaatgtcgtccaaagtgccatttcttcattttgcctctaacttttctttggcacatgacgttgaactgtatgaaacttttttcctgactgatatttaggtatggaataagagtaattttcaggaatatttgtgattttcttccaacattttctcagaaagcatattctgaaagtgtgtagtaatatctatatgcattcccaacacaactctctctctattctcttgatctaatttgttactaactttttaaaactttctagactaaatctttttgcttaccttcaagcattttgttttatactacaaatcttctgagactcgaataattttatcttactgtttatatactgctaacttgaaggtatttcagcctttttcactagcagcgataccctccatgacagatagtcagttatattaacttgattctattgtaatttacatagtggtaaaacaaaataattttacacttataatcaaaattataactgtttaaaaaattaccacctaggattcattttatgtaatgggaaaatatacaaaactgttttgataaatattatatgcaattatataacttggacatctctgtgtagttttttcctcctgtttaacgtggtatgccagctctacagtagtcatgacaggaattatgacaatgactcagacattgatggtgcccaccaagcttccagcatatttactctagatagtacctcaatacagcccttttgtaaaaattttaaacccaaatttggtaattgaaatgaactaaatcaaagaatgctgtgaaattgacacctttattaaaaaacaatatgtgacagtagggagaattaattctaggttcagataaagctgggtgagaaccccagcactcacccttattagctggcatggagtttcttcaactgtataatttggtaattcagttgtttattttgcttatttattcatgcattcattcatttattcatttagtaaatgtatgctgagctggttagcaggcacaattctaggcactgtggctaaaaagggaagtgagaaggacaaagtccctgctctcaaggggtttacattcaaccggggagacagaaagcaaagtggatgcataatataacatcaaatagcaataggtcttgtgaaaaaaataccaaggcatactctggatcaagtgaccaggatgggaaggcaaaaggcctctctgaggaggtgatatttggcaagaaagaaagagaaagccatgcagatggttggcgaaaaatgttccaggcagagggaagagcaagttcaaatgcctcagtttatatttctgtgaatagtaaatgaaagtttatagactcctggcacatcgttaagtgcttattagatgttagatataattttaagataataaatgtggataattaattccacgttattatgtgtcttctttgctgtaatgtacatcctccttttcatctagaccatttttcttctcttgaatattatattatttatcctgttctcagagctgttagattgccctcttattaatttgtagtgactttaaccctgcttgcaatattcaaatgttattactgtcagaggtcctgttttctcagtctttgcccttttgctcaacatttgtatactctgagtaatgccaaattgattttcttgctaagtgttgggcaactgccctctctaaacagtaaaattcacaacttctctgtgatgatgataatgttgatgtacctgccctatggggacctgttgttttgtatgcatgtgcagggagaggggtgatcaaaaaatggtgtcaagatgtcatttggaagatggtacctgcagaaaacacagaaaacccaatcataccccacccccatcctccgcatttcccaccatggtttcttgtttacacttctccgattctcccagaagtcagagcaaagtgactgtttacctctgtctctggctgggaaaaaaccactcccagagctcaactcacttttattgatttctatattgtttggctgtaaaacatttattctcagttgtatcagtttgggtccagttagagaaaaaaacacagtcatttgaacagtgaaagtttttacaaataattattaaatgtaacaggggattatagtaatgaagggattggctagcataaaagaaagatgtattagtttgctcaggctgccgtaacaaaatactatagactgagtggcttaaacaaaagatatttctttctcacagttctagtgactgggaagtccaagatcaaggtaccagccaatttggtttctggcttttggatggctaccttcttgctctgtgctcacatgatctcttttttgtaatcacgatggagagaaagagcaagctctctggtgtctcttcttataagggcactaatcccatcaagagcctcgttctcatgaccctcctcatctaaccctaattacctcccaaagaaaggcctcatctccacgtactgtcatattgagggttaaggcgtcaacatatggattttcaggggagggcacaaacattcagtctatagcaaaagagaaccataaataatagaggaatggctaccattagccctagggctgagatagcacacctgagaaaaagtccctatgttttcatccccaaagcagagatccgcactttattgggaaggtacaaccatagcttaccgaatggcagaaatcgctaagttgctataccagcagaacttgtcagaaatctgtcttcttcaagttaacagagaccctccctctaaggtacctgggaaacatcgccaagctgctggttgccaagcactgtaggagccaggtgctgaagaaggcttgcacgctgtaagagcctgccaagtgagcacattgaaaataggaagcaaatccctttcttcctgaaatgtctcaccagtgccctctccccacaaagcttcagtgccagctagttaagaaaaacatatctcaaaggcccagatctatttttaccgagcaggcagaaaggtacatttagaactaagaggcaataaatcaataaccagcacactgatataaacaaataataaataacagcagaagcagactcagtgaagaatatattgtttgttagcagagtccactactttgcagggccattctcagtttgattcattgctatgtgctctgtgcctagaataaaatctgacccaatatggatgctcagtaaatatttgttggatgaatgaataatctaattgcttattttttttgcctctaatgtttttcctctctttctctgtctctttttttacgatagccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcaggtatccctttaattctattactgctgaatcaaagaaagcacaggctgctttctcgtacttaaatgttgctgctatctcttttgcctaaagccgttgtctcaatatttgcatgtgttgctgctttctaaaatttagaatcaaaatcataaaaagatgggattggaatttatattagacattatttctagcttatggagaaaagcgataccatctgggtagctacttatgttaccaagaattactaaaaactatgaaataaaatttatacaggaagtaaaatggtgcaaataaaatgtaagcaaagacttgcagaaaggatgcatagtttcttgctaaatgagttgtaacattttgctattgcccttcgcagacagatagagcatggatacttctggttcacacacatttgcaaagatgatttaggtaatgtgtgtatgtgcacagggagaggaagagagaattaccatgttagagaatatgaaggttgtgttccagattgctttgctaaccaaaacttctgggtcaatacaaaaatcttcccaagtctttcagggccaataccaaagttaataacaaattcagttcctgtatccccaaggatacccaccatacatctacacatctttgtcagcttctggaagaggtatatgcagtttgtttaaagataatgcattgaagcaatgcccatgtaacacattcgcagttaaaaacctcagtttaagcatttagcccctcatagattgtgaatcacatccttcatgaatgatcatgtatgtcattggactattagaacattagcgaagctgggtatagtcatatagagggtgtgtttaaatctatttatttggctttctgtatttgggcttattcagagaaataaagaagaatctaaagtaatggattcccataactcagagaaagtctcagaatcacctagtgtctttttcaaataaaaatttaccgctcctgaaatcctgatcagcagctaacactcctctgtcataaatatcatgcctccctctcaccgtcatctctaataattacctgtaagctgagccatggctacgggtgtgctaggacattgaaataggtcaagttgcataaaagttaaacagaaaggtatctttctaacactagcaacatatattatgttagagttaatgttggaaaatataaatgaatataagtaaagagttgtgcttgggaaaaatgcctaagggattttcaaagaacaaatgcatctggccgggcatggtggctcacgcctgtaatcccagaactttgggaggccgaggcaggcagatcactttaggcgaggagttcgagaccggcctggccaacatggcaaaaccccatctctactaaaaatacaaaaaaattagccgaggatggtggcacgtgcctgtgatcccagctacttgggaggctgaggcaaaagaatcgcttgaacccaggaggcggaggttgcagtgagccaagatcacaccactgtactccagcctgggcaacagagcgagactctgtctcaaaaataaataaataagcaaacaaatgcatcattcctttggcaactcttcttctttctcttagggtttactaatccttttatgattaaacataactcttaataaaagtagaggttttgtaggggtacagatcaataactgtcacactagtacagttaaagaatactgtttggactagctgttcccatttgaccaatagtaattagattttaatttcatatctgctgtgtttctttttaaaaatcattatttctgattgttcatgcatgtcgtaaggtgattcttcaagataggcaaatgtgtgtcctcatttatctgacattagaattgagttggatgtccatagtataatactacatttcgtcacttattattgatggaaaaataatgatgtgttcacattagtaatctgaattttgaaaacactgaggttgcaattctctgatgtatttaaatatacactgtgatccaatactctgagaaactgcattaaaatgcctctggaagggctgggcaccgtggctcatgcctgtaatcccagcactttgggaggccgaggtgggcagatcacctgaggttgggagttcgagaccagcctgaccaacatggagacaccccatctctcctaaaaatacaaaattagccgggcatgatggtgcatgcctgtaatcccagctactcgggaggctgaggcaggagaatcacttgaacccatgaggcagaggttgcagtgagccgagatcgcgccattgcactggcaacaagagccaaactccgtctcaaaaaaaaaaaaaaaaaaaaaaaaaaaaaaaagcctctgaattaccagttgcaataatgaatgaaagattgaaaagtttccaaaatgatgacacttgccatatgttcatatgtctacattttaataaaaggtgaaactaaaagacaaatactttaaagtttatgtgtgtcaagtggcaatctagagaaagggataaactgcaggaagagatacttttgtcactgaaattcaaatatgccaatcaatttgaagggagtgttgttacagctttcttttccaatttggaaaggggtactcaaaagtctttacaaacagcatttgaaatagcacggcttggtgttgacgtgagaggagctcaagggctgtcagttgagtcactgacattttggcatattgttagctatcaggccactaaactgtcaccattagtttttaaataatccacttgcaaagaattttagaggcttgaaaatgttagcatccattctaaggttctagtctttctgataaatattctgagtattaacttgtcaatgaaattgtttatcaagcttttcatatacaactaatttccatttacacttaaatatatgcaattaaatggcatacataatggaaacacctaagactcctatcattataatgaacaagaactttcttatttccttctttaatatctattttggacagaataataccacacaattctttgctccatacttactggctctttactcagtttactcattcttaaatttatattttattttttacatgaaaaagtgaatgaaggaaagctatgtaacaatttcttttgtcttattttatggccatatataaaaacaagtttactcttaaaaaaataaaaatttggtggccaggtgtggtggctcacacctgtaatcccagcactttgggaggcagaggcaggtggattgcttgaggccaggagtccaagaccagcctgcgtaacacagtgagaccccgtgtctacaaaaatgaaactgtttaaaaattagcctggtgtggtggtgtgcacctatagtcctagctactcaggaggataaggtgggaggatttcttgaggccaggagtttgaggctgcagtgagctatgatcacaccactgcacttctgcctgggcaacagagcaagaccttgtctcttaaaaatgaaatgaaataaaataaaataatagttccgtattcttgacctccaactttttaattccccttttcatagttatgccctattagcagtttcatatgcaaagctagctggtatatgtggaagcattccagtgccccccaaatggtagcatgctaagttatttggcaccctatttttaattaaaattttatttttgagataattgcaggttcatattcagttgcaagacataacgtagagagatgccatacccagatttgctcggtggtagcattttgtaaaactgtggtacaatatcataatcgggatattgacattgatacagtcaagatacaaaacaatgccatcacgtctcaagggcccctcctattgttcttttatagctacatccatctctacccaaccccaatcccaaacccctgtcaaccactaatctattctttatatttatagttttgttaatttattaatgcaatattaatgaaatcatacagtatagaaccttatggaattggatttttcactcagcataattcctttgaaatccatccaagttgttgtacatatccatagttcattcctttttattgctgtgtagtattccatggtatggactaccaccatatttattcacttgttgaagggtgtctctattatttccagtttggggatattaaaaaggaaacttctatgaacattcatattcaatttttggtgaacataagtttatttttctggaataaatgcgcaagagtgaacatggattgaatggtagttgtgtgcttagttttatgagaaagaaccaaactatttttcaaagtagctatagcatctgatgttcccaccagcaatgtatgatttctccacatccttgcagcatttgcgattgtcactacttttaattgtagccattctggtaggcatattgtgataactcattatgattttcatttgcattttcctaatggctaatgattaaaattttcatgtgttgatttgccatctctcttcttgtcagtaaaatgtccatatttttgtacattttataattgaattatttatgtcctcctcattgaattttgagaattctttgtatgttctaaatattaattctttttggagatgtagtttgccaatattttctgactgcctgtaggttatctttttgtccttctaacagggtcttttgcaaagcagaagtttttaattatgataagtttcaatttgtgaatttttccagttatggaccatgcttttggtgtgaagtctaaaaattctgccaagtgctaagtcctgaagatttttccttgttttattttttatttttaagatttaaaaaattgttaaaaattcagttgctttacattttacatttaagtctgtaattaattttgaattaatctattttttgaagaaatgcttattttattttttattttttatttttatgtatttatttatttattttaagtcctggggcacatgtgcaggatgtgcagatttgttacataggtaaacgtgtgccatggtggtttgctgcacctatcaacccatcacctaggtattaagtccagcatgcatcagctatttttcctgatgctctccctcccccagcccacctgcccagccccagcaggccccagtgtgtgttgttcccctccctatgttcatgtgttctcatcgttcagttcctacttataagcgagaatatgtggagtttggtttcctgttcctgcattagtttactgaggatactggcttccagctccatccatgtccctgcaaaggacctaagctcattcttctttatggcagcatagtattccatggtgtatatgtaccacattttctttatcccgtctatcattgatgggcatttgggttgattgcatgtttttgctattgtgagtagtgctgcaatgaacatattcatgcatttatctttataatagaatgatttatattcatttgggaatatgcccagtaatgggattgctgcatcaaatggtatttctgtttctatatctttgaggaatcgccacactgtcttccacaatggttgaactaatttacgttcctacccacagtgtaaaagcattccttttttttctgtaacctcgccagcatctgttgtttcttgactttttaataatcgccattctgactggcgtgagatggtacctcattgtggttttgatttgcatttctctaatgataagtaatgttgaacgttttttcatatgtttgttggccgcttaaatgtcttcttttgagaagtatctgttcatatcctttgcccactttttaatggagttgtttgtttttttctcataagtttttttaagttccttgtagactctggatattagacctttgtcaagtggacagattgcaaaaattttctcctattccttaggttgtctgttcactctgatgatagtttcttttgctgtgcaaaactctttagtttaattagatcccatttgtcaatttttgcttttgtcgcaattacttttggcattttcatcatgaaatcttaattttgaattaatatttatttcaggactgatgtttgtttaggttaagtcttagttttatggggttggatgtccagttgtcccagcaccatttgttgaaaaggctatgcttcctccattgaattgcttttgcatctttattcagaatccattgagcatatttttgtaggttaatttctgtgttttttattccatacctttgtctatccctctgccaataccaaactgtattgattagtatagctatatggtggtgaaaatatcaactagagtgattcctcctactttatatgtctttttaaagattgtgtttagctattatagggcctattatttttcatgtaaattatagcataagtttgtctatgtctacaaaaatccttactagaattttgatagcagtttcattaagcctatggatcaatttgaggagaattgatatctttaccatattgagtctcactatctgtgagtacagtatgtgcctccacgtatttaggacttccttctttggtttctttcatcagcatacaaatcctataaacattttgttaaaattttaactaagtatttcattttctttggaatgtttgtaaatgatatcttctgtttaattttggtttcgacatgtacattgttactatgtgaaaatgtgattgatttttgtgttaacattttaaaaacatatttttttcaaatgacatatctataatgtgttatatctagcatgtagttcatttgctcaagtcttgatttttccttttgggactatgtaactcttttttctcattgaaagaacacagtaagtaagcatctatcaaaaagtacttaaagaacatccatttattcactcatgctatgctaatggtaggatttaaaagatttaaagagaagcttttactttcaagtagtttacctaagagaaaataagtgtgtaataaattgctgcagatactatgaaaatagtttagaattcagtggaattctgccgagatagagtagccccgttcctcttaagtcttccttcttacaactaaaaagtctgcatgtaacggcaaacaagcataagaagtctctgaaagatggaagaaatacctctgagaaagacctcagaacttgaagaatgacatggcaacatgtcatgttctcactatcctgtctgctcctcacagattaaggcatgaattcttatcattttttcactttgttccttcatttgaaattcaatattttcattgcctacctgaacaatacatatttatttctggatgaaaatccagtttatgtttactttctttctatctttcctataattacttcaaaaacaattgtttcttctacctattctggggagaaaacacactaaaacttagtgccttaaaacaataaccattttatttgcacgtgactctgcaatgtgggctggactcagctaggtggttcttccagtgatcttgcctgtggtcacctgtggctggagtccactgcaatacagggttggctgagcctgtttctctattatttctgagggcctctccatgtgctttttccatttatctatcaggtgagccagactttttatgtggcaactcagaaagtataactgcttatcaagcatctccttgagtcatgcttactgatgtctcatgagccgagttttgagataataaaggagaagactttacaagggctttgaggtgtggttcattggtaggaccaccaaagtaacagtctaagagtcaacctttgacccttaatactgtcattcatgtccttataaatgcaaagtatagtgaccccattcctaaaacctccaaagtcttatctttctgtggcatcaggattaggttagaagttgatgatcttattatccaagtcagctctgagtgtgaatgaggttcttcctgcttagttccctgaatacaactgctcaggagtggctgctcttcatccaaaactctgtgaactaaaaaggtatataatttggccctcacatagccaacataaatagtgagatagggataacatagctaaaccaaatatccccatttgaaatgggggctgcggataggagatacagagcagtcactggcccatggcaattctaaaattcagctggatacatggcaccagtttattttattcttttcccaaggagagtaaatatactttattttttattttttttattatactttaagttctgggatacacttgtagaacgtgcaggtttgttacataggtatacatgtgccatggtggtttgctgcacccaccaacctgtcatctacattaggtatttctcctaatgctatcactcccctagccccacaccccccgacagaccccggtatgtgatgttcccctccatgtgtccaggtgttcttattgttcaactcccacttcttaattagggctcagttctggttactggaagtggttctctgatattcttgggtccatgctcttcctttctatataaaattaatggcccaggcctctttgcaatttgaactttatcccttttggtataaggtagtatcgttccttaaaatgttgtgaagcttccatgtattaagttgtaatccacttcatgaagcagaagccacacccataaatatcttcaggaaagatgcccctctactttgctgttcaagtcaggatgctggaggacaatgtaccaaagattcttaaatgagttttgcctagctagtcttagggcatgcctcatagaccctcctagctaagaatcttagagtctgccccatagactttcttagctactttctctggatgatggagtatgcattgtataccaaacatattaccacagacatttttccccctcagaatcaatatgaggtgtttgtcaatgagaaagcactcaatacatatttattgaacaaaataatgagtgattgaggttagtgttccttagaataccttgtggaaaacactgctatagacaaaattaaacaattttctgattcctatcattttccataagaaaataaaataattctttttcttatgacatctcttgtctgaaaccaacacaaattatgaatggcttgtcctaaatcatgatttttggtatttcagatgacaattttctgtcttttgacagaatatacctttactgtcacctggtggaaataaaaactaataaagtgttagatctgatagacccaaacaagtaactgctataactgtagtataaacaatttaagtaatttttaaaaatctgtatgatacagtatacttttaatatttatgaatttttatgtaagttatttaaaaaatcaagtcattcttgaatcaaaggatatataatgtcagcattattttagaaagccttaaacatttatgccataaggagtcttcataatttgttcagggcaatcaaagtccgtataaatgttttatatcctacccagtaattttaatgattgtgtgcatatgtgttccaaggatctagtgtagtttcacaatcttggtttcctaatttttaaactatctctcttaattgaaaccatagtatacccttgagaatatcagctataatttataggttataaaaatgcaattaaacctacataagccagtccctttaaaaaaaaaaagtcatatacaagtgaaagtctttaaaataagatttcaagtttggatgtagagtctcttatagataatatatttattttgtaaaactgcacatcaggcactttctgtagttttttggtagagacatctttcttgccatagtaggtttcaatgagatttttcagctggataactctgatgattcttggagatggtgttgaagtttaagccatatttccatgtctgagacacgaagacattttctaatggatcaaactacttttaacagagcaataattagccaaattgctatatttctgggttgtgctcttttcaaaaacaacaaattcaattgatggaagtaaaagccaagagctgtgtgaaatgtctatttgatttactgattttttttaaccatctaggaaatacatgtcttcaacaaaacagcctattttttttttttttttactaagaagatgaaataaattctgctggagtgatcatggggtagtttcttagatcactggattaagaaaagctttgtctaatcttaccaagtcctataggagagacagctttgagaactctttgaaatcaattgtgtcatgttcaaggcagagacttataaattttcttcaaaaagtatcaaattaatatggagtagatagagtactggaaaagatacatttgtaaaataattaggtgcataaagtccaatttgagattttatgtagtcttttttgttttccattttaggtcaaatgaatcaccataggcccttttcaaccatggatataacatgtgtatttatcgtatttcacaaacattactgaaaatctaggacatgacataattggtaattataatgagggaattttaaaaattacaaacaacatatgccaggcaaacaaatcacttacaacccaacaggactttattggtggctatacagggttatactgtgattattactatttgttctttatttgtaaaaaactattctccaaaaaaaataaaatgttaactgctaatattgatgcactaagtgaagagaaattgattaggcttaataaagtagtagctgctgatcagcaaaatttgggataagtgataaggtaatcacttatttgagatcagtgaaaaagaataggaagttaagattattccaggctctttctaaatctaattttgtgtgtggtcctaaagtaaaaaaaaaaaaataaatgaataaaaatctcatggaatgtagagaagacaaaaaggggctgattaaagagcgtatgaaggacttgtgatttgagcagtagtttcaagactaaactcatggctagggaaagtgtaactgggaaagatttctgttaaaaggtttcaggaagactactacaagaaaaattaaataatgaatgaaaacaggggttggcaaactttttctataaagagtaaaattgtgcactttgggaggctgaggtgggcagatcacgaggtcgggagatcgagaccatcctggctaacacggtgaaaccccgtttctactagaaatacaaaaaatgagccgggcgtggtggtgggtgcctgtagtcccagctactcgggaggctgaggcagaagaatggcgtgaacccgggaggcagagcttgcactaagccactgcactccagcctgggtgacagagcgagactccatctcagaaaaaaaaaaaaaaagtaaaattgtaaaaaattttagatttttcaagccatatagtctctattacaactactcaactatgttgtaatagctagacaatatccatacacaagatataaatgagtggacatggctgtgtttcaataaaactttacttacacagacaggtggtgggacggatttgggctgtgggtcacagtttgctgacccctgatctagaaaatgccttgcagctgtcaaatagcaaagccaacagtagcaactgttgttattaacaaagaaaaagctacaatatattcctgataaagcaagtagatcagtgttgttagaaaatgggctttctgtaggtgatagttagaaggatgactgtaaataatggtaaaaaaatgctaagacttcaatgccaagaaatatcaagcagggaatggaaaacagaaagcagttttcctggaagtaccttacaggaattctatgaaaccagagaaattagaaaatggaaaacagacaaggagtgtttacaataaatgaggcataaggcaatggggggcctatgtttagagtattaatggtagaagtgccaaagaaaataaaacagattcaaggtcatttttggaagaaaaaaatccatgagagatgatacttgattggatatattctgagcttcattggatgttgctatgggaaataagtaaaagagacagcaagaggcctatcttaatgcttttcaatacaaacctaaacatttttaccaaaacaactcaagctctgagaaataaaatcgcctacactttaagctattagacagggaaacatgtaaataaagttcccccatcgctggtttgccatagagcatttgaataaataaaggaaggagtttgggggtactttctaggttctctgatggtctgcttattagtctttcccttagatcatcttaaaggcaaaggtgtaactttgcatctttgcatctttgcatctcttattacacatatatgatcactgagatctgaacagagtaaaatcttttgattagttgtcacagtttgggggtggctttgtgtataacaagaatcttagaaataacggtggcttaaacaggagagaactttgtcagggaaaagtccaatatatccaaatttcagagcggatgtattggctgcctaattgtctaggcctcaggattctgccctctatagggtatggtcttcatccttattttcccaagatgaaactctgtccatcatatctacgctattacaagctcgaaggtgtagactgaaaggaacaaaggacatgatccttcccacctttaagaacaagtcccagaggttacttatatcacttttacttacattcataggccagaacttgttcacataactacaccaagctgtagtgatggcttgggtatgtagtttttgttagtaaaacccatgtgcctgataaaaatactactaatttaaggatttcaaattgatttccctaagagaaaagcctaagatagggattcctgtgcaagtgagctatgaagagagtgctctcagaaaaaaacctgcagggaagaagtcaggcagagatgtgttttcaagtctagcttcagcctgatcccacagggagctgtggtgcataaattgcatcacagagtttaatctcacattgaagcaagcctggacatcgcaagtatctctatctgagtggttcttgtcataccaaggtgattatcaagaaaagggtacagctatgggccttgaccagctagtacccacagcagctagagaatgagtacaacagctggtgaagaaattctgggtgggatgtcaaaagcatctgctacactgaagaaggaggacagattttgagggaaaattagtagccatttttgtaagagccaaaagtatcccttcacacatactgagatgactcaatatcctatttctgttttgtacatggttagtactctatcagtatttgtagaatgagtaatgcatattcttggacaaccttctttttttttttttaatttccacagccatcctttaccatttttgaaagtattaagaaatgttaatactttcagtaccaccatacctacccccagtacatacacaagcatcctgccctcaatagctatttcctctactcagattctaagtcacactcacaaccaattgtagaattacctcactggcattctgaagaattagctggcaaatttcctgcattttcaaatattttaagttccggtttccagaaaaattctccttgccctggaaataatagccagacaactatgattagaatatatataacctgcttatattcaccttctttaaatctttggtgaagaataggtatggcttttctcatcggtttgctctggcctagatttatgttggttttacagtgacatttctgactttcaggcaagtatccattgagtaactgttttattatacaaaatctgaggttataaaataaagacttaaatgagcatttcactgatttcattatatctcacaattatagatctggatctatcaattttttctcatgaaggtcccaaaagactgttctataagagccgtgattatggagtgaatgagtcaaatttgaagtctggtccaatggtttcaggaaaatgttttatattgttctaaagccaaaaaataaagaaagaataaagcatcatttcaaagcactatcacaccaggttggattagttaggcttcatattacagaaaagcagcttaagtaagatagtttagtttctcacgtaaagtagttataaggtaggcattcctggacttttatgataatttcaacgttttgcatgacttaggctctaaagctttatgctttgccattctcagcatgtggcttccattcccaatgtcactacgtgctcctaatacaactgaagaactgaatttttaatgttatttaattttaaatagccacatgtggatcttagtctttgttttcaaatagtcattacaagctgtttgtggctactgttttagaatagaaactcttctggatagctcttatttagcctggaatcatgtaatgtaaacatggaaaagattttagatttcactgtaggggttgcttagttttacagataaacaatggaggaagtccaaagaagtattggctttctagaaattcaaaactaatgtttagaaatactgaaaatcgagctggatcttttgatttcttaatcagtgcactcataaaaaataatttattaaaaatattttgtaattgaatttgttgattattcaggtagatcttcctttatttacttaaaaaagtaagattttaatacaattatttttttcaatccattcatttccaatggctaatttatttgaagaatgattgcagcaatctgacaacaaagttttaccccatctactctagatattgaggcttaggctgtgtttctattcttgactctataagccaatccattaaatgataagctaacaattaatttacattaaaacaagactactatttctgttactgtagaagttttagaattagttgcatgtaagttaatgtgattaaattggctaggaatatttgatactgtatctatttaatttattcttttagattattaagtatctattctatgcaagccattaggccagctgttgggagcacagcagtgaattaaaccacagtagaattaagctagaatagaacatgtctcttctggaagtttattctagaaaagagcctttgaaacagtaattacttggatcctaacttttatgaagagaaagaacaaggtgccttaagatcaggcaacaggctggcttagcccacttggtaaatagtctctccctcaaaggctcaacctcttcaaactgaaatctgactacttctgaggttgcacaaaagttccacagactgttccgaaaaaaataatttgaaggaaattcatctccagaacctcaactttcacatgtactcttgtctaaaattgcctgaaatctcagaatagcatttcctccaccttacaaaagaaaggcacacctttcttccttcccaaattgtagcatgatgcattgccccagaacttagggtgccaaacaaagggatagtctaaaatattactttgaaaactcaaggccccttaaactcagagatcttctcctgcctgtgtttcaggaatttttgataacttcagtgcttaatcaaagttggtatattcctaattcagaacagccaaagccttatatagtagtgatactgaattgtgtcagtgtaattggaatgttttataggactatcattttttcaagatgcatttgataaaactcaggaacacactttacttgtgatggttaatactgagtgtcaacttgattggattgaaggatgcaaagtattgatcctgggtgtatctgtgagggtgttgccaaaggagattaacatttgagtcagtgagctaggaaaggcagacccacccttaatctgggtgggcaccatctattcagctgccagcacagctagaatataaagcaggcagaaaaaaaaaaacacgtgaaaggactagactggcctagcctcccagcctacatctttctcccatgctggacccttcctgccctcaaatattggactccaagctcttcagttttgggactcgggctggctctccttgctcctcagcttgcagacagcctattaagggaccttgtgatcatgtgaattaatacttaataaattcccatatatatgtcctattagttctgtccctctagagaaccctgaccaatacatttgttttctttcatatttgatgtgcattgtccaaaaataacacatggaaagcctatttcattaaatcatgtactatgtattccacttagttaattctcatcatattccatttatacaatatatagtattttctctctcctattaacaaataactaaaattatttaaacatacaaaaatagatgtcacctttaaataataggtttttataagtcatttaaggtaaatgtgacacaaaaaagcttggaaaccccttttcagggtttctcaaattataatcgtatgtctaattagattaaaaaaggtcaccaaggtgctagtgaataaaacaaacaaacagattcctagatcctaccacttactgttgaatcagaatttctggggaaacaaggatcagaaatctgatggatcagcatgcatacagatgattcttatccacattaagtttgtgaatttatattcaagtgataacggttactatggtttggatgtttgtttccccaaacctcatgttgaaatttgatcccagagttggaggtcaggtgttactaatgggagtttgagtaatgcgggtgtgtccttcatgaaaagattaatagcctacttcagcagtgaatgagttcttgcttagtttccaggagagctggtgctttaaaagagcctggcacatccaccttttttctcttatttctgctctcatcatgtgatctctgctctcttttgccttccactataagtggaagcagcctgagttcctcaacaaaagcagatactggtgccatgcttttcgtacagccttcaaaactgtaaactaaataagcatcgcttctttacaaactagctaacctcaagtagttctttatagcgacacaaaaaatggactaagacaatgatccttttaagagagttctatcccatactaattcaaagtcaacatggtgtttcatataatcttgttgtaatagtctcttggtggtggacatccggcacctaacacagtgcccagcacatgttggagtgtcaagaattaatgattgaaagtgaatggaaaaaaggtatatatctcctcccaaaacatcaggagattgaatataaaggacacatcttccttctataatgtgacagatgcactctatagttactgtttgagagtttttttagtgcaaactatttacctcttaggctaaatttaatttacaaatggaatcattagtagtgaagatatagcagggtgccttccagattcctctgctgtgatcttcaaatgaataagcactgcagattagtcaaccttctgaaaagttcttaattaaggaaaccaatactgtgcagaataacagcctgtgtgttaaccttgttgacacagtgtagaaatctcatgtagatagctagtacaaaagaataaaaatgttgttctagtttctaaagtggcgtttccaaggaattatacttctaatgaaaattgctgctgtggatgtctgttcaaaggctttggcttacaaagtaaagatttgaaaatatcaaacttgcttaatctctgaatgttgttttcattcattaggtgaatatgacagctctctctttaccctaatcgccccccctggaggaaataacatttttgtttgtctaaacagtacttaatgactactctaaaattagagtttaagatctttaactctagagtgcaaagctctacgtccttgactctgacgtttatcatgaatattaatttctgatcttaaagtcaagccatgaaatttttatatattatcatacatttcccttgacagtttttgtaattgccgtaatttcctcatcagcaagagttgtttgtggctctcctggtctgaggaggctataaatttggcagctttgaattccctcttttgtttgaatgtggaaccatcgacttgtttactctgaacattaactagatctcagatcttaaaagaactatagtttttattggtgcctttacatgacaaaagactcaatatatttgttgccattacatgttttcattgttacctttggattgactttcttgttaggggagatttatgtccatcttcagatacttttcctgctactcacataaaaatgttattttctgccacatagctaccattttctttaaaattgatttattagtagtgtttgattatcgaataccagactgtatatattcacattgtgtataagtatccaacatgaaaattatttagacaatattcatggacatgtatacataaacacacatactttttaatatatgtaattcaactgaaatgttatcttccgtttgtactttcaacaaagatttatcgaacatctactacacatcaggcctggatttttttctgcacacaggaataaaaatagacaagacacaaattggcctgaagatgccacagtcaaccaggcaaacagacagactcataaaaaattatctgtatcactgtacggcaaatgctgttaaaaatatggtgacaaagagctgttgcaaccagagagactcagggatggatacacagaagacaggtctctgaggctacacgagatagatctttcttcccagagaaattgaaagggcatgttattttacacagtaggagtggccagacatggtgatttagtaaaagagcttcagaagggaaaagcaacagatacacgtggctggagtgaaaagtgcaaagtggtgcgtgggaaagaaacagaagctagaaagttaacttttggatagatttgggaagtacccaagaatagaatctcaggttcaggtgtttgactttttttttcttaggacctgaagacagtgatccaggatggcctaaatgtcgcagagaaaattattctatatattcagtcattcagacaattatctaatgaattctttatgagagttgtttttggccaggtgatgaacaagagtcaaagtctctgttcttaggaatcttatagtctttcaagagagaaagttaagtcactcaacgtttaatgtctgatatgacagaggttacaacagagaaaagaacagagtgtaatgggcacatagatgtgatgtgtaattcagaataaaaatcaggtaaggcttcttggagatttaaatattgagttctgatacagaagtaaaacttacctggatgaaataaggagatgaaaaaggagatttggaggagatcctaggtggtaagatagtatatggctacagtcattatatattcttctaattgtccacgactatagtaaagttcccatgacttgggtcatttttagagaagttggaaaggatcagttcatggtcttggggtacaaaacgggagagctgaaactttacacaaaaaggttcagggagacaatgaaaaactttaatcagatggatgacaaaaattggatttgagttttggggcggtcatttagcagcagtgtgtggggatgttgaatggagggcttggagagtagcatctaactacagggttgtcttagattggactcctctagaaacaaaccgcaaggaaacatcactagaggaatggggaagtaagatgtagcagagaagggaagccagtaaagtatgcattataaagctgttttatcccttttggcaactggaaattaggtttactggaaaactctgtgagacaatgtagacatactctcagagttatacccgaagggagaggaaactgggttgtttttctaccagctccctacctgttcctgattgagggtttcttctactaggaatcttagttctctagcatttctggcttgcccttcatgaagaccaaggttggtctcagggccagacaaaagccatcagactgagggtgtcacgtatttgtaagaagcagccttcatacggtagacgtttgggtggggcactgacataatcagctaaagaactaacaagatgggaggtgttgagggtctggacttaggccatgatagtggtaatccggggaagtttgggagtgctactaggccattgttttaataagatttggccatgcattaaatgttaggggtaaattatgaatgatgactttccagagagtagacagatgttgatgatgtaaaatgtgtgtgtttaacaacgtaaaggttttagtataaatatgaaacctatattaaagtctctttataattgtatctattttagaaaagtattataatacagcagtataaaaactctctaaccagaagacctagagtacttcctagatccagatttctaacagcatgaatcttggatgatactcttaatctctcagagcgtctcatgaaaaaaatggaagtaaacatgaaagaagctttgcatatgttacgtaaaccaaagtgtcagtaagccttgtacaaaattttaacttttaaatagaaattacataaagtatttgggccctaggacctaccaagtcgattattattaatgaatgagtaaatctagtcaatcaaagacctttcatttttcccacacctatatttgaacagatgccagttagtgagcatctttgtttgttaatatctgtacttcatacttaatggactaattttttctctatcaaaaaagctgcctttgttaaaacatttcaatcaactaaattacttaactctaatgcctattttgagggaaaaatatacttagagggagaattaaatgtgtaattttatttctgcctcattaaacctcctctgtgtctaggccaacaagagtttcctcctcctccaccggcacacacttattggacgcttcattgtgagaaaatcctcaggtcgctggaacttggtagtgagttacatacctgcccgtcccctccagtatatgtactaattatcttatggaaaataactattttcttgcttttttttttcctcaagaaagccttgagtctcatccagaagtcagatgagtgttagatttcttccttctcttggcttcaatggcaactcttttttttctgattctaaataaatagattgttatacccacatgaatatccacaggaccaacactgcccctttattactcaggaagtatttatttttcagctttctctttcctttctggccctttgaaattcaagcttatttaataatgaattttagtgaaattattttaaaatatcttttaatcacattagcaaacttctagcagagcattgagtttcttcctcagataattcaagttgtcttttctaaaatatgtacttaaaatgactttgaaaaaagagatgtatgatgtcagaaatttctttcaaaagaatctgggtgtggttggggtgatgggtagggatatagatgaaattaaataagcgctatgttgataaatgttgaagttggatgatggtatatgggagttgtgtagtgttttctacttttgtatatgtttgaaattttttctacacttgaaaagataagagaaatttaaaaattaaattggttctcacaattttatttttgtagctgttttttatttgagacgaagtttcactcttcttgcccaggctggagtgcagtggcacgacctcggctcactgaaacctctgcctcctgggttcaggtgattctcctgcctcagggcatgcatgtgtacaagcaatgcccttaccatttatgcattcaactattcttccctctacccattatttaatataagaagtacttatgatgtctgtgctgctgactgtgctaatcattgaagaacctagggtgagcaaaaacacacacagccattgccttcataggactcatagagaaatgagcaagaaacccaatgagaaatcacacaaataaatgtaaaattgcaaaaataacagctgttaaagaggaaagatacatgattttatgtgaaattataaccgggtggtattgacttgatgatttgagaaatcaggggaggcttatctgagtttgtgctgatttaactgagatcaaactttgatcttggtgtgtggagacatagaacataaacctcaattcacccatggtagacatgtagcttgagtgagaaaatgtaactttgttattgaaaaagtcatgacaattttgtaatctggcctatcctgatgaacattcatagggttatgatgggttatccttatatatcttgagaacaccaaggacagtggcagagcttggagtgagaaggaaatccataaaccagatgccaaaccttcctggagtcagcatagacatgaaaatgcacaagagggcaaaagagttatagaaccaactggtatgcatttcaaaagagcaggattgtggagaagagagtggatgaattattatttaggagctggaataggaaggaaggatatcaagcccagtccctatctctgaaatgcaaaaagtatgaggaagtaaataagcaccacctgagatagctgtaggagaagtgataatcacagaggagagctaggtttgattgggtgaataccaagaagagaaggggatactaaggatttagagcggttatatgagtatggaaatattgcatcaaagggtacagtgaaacaatttgagccatgagatgtgtgtgtgggcacagaatatgaataaatgaatgaatgaatgaataatagcattatagaaatgctaatgcagtagaagtgtatgtatatgagtgtgttggagaggggatgcttacaattttggcattgatttgttaaactaaggatgacagacatcctgaattcaaccttaatatctctttgaggaagatgactcacttggttgggggtgatgggaaacccagaggcaatagaatccatatacttttgatggtgggttgatagtaaaccagatcttcagatccccagtgtccattactacctacgttgtagtctaatctctcattaattctcacatgtttaattccctccaatccagctgtcagacatttttattcctctctgcttagaaattgatatttatggggggccgggcgcggtggctcacgcctgtaatcccagcactttgggaggccgaggcaggcggatcacgaggtcaggagatcaagactatcctggccaacatggtgaaaccccatctctactaaaaatacaaacattagctgggcatggtggtgggtgcctgtaatcccagctactcgggaggctgaggcaggagaatggcttgaatctgggaggcagaggttgcagcaagccaagatcgtgccactgcactccagcctggtgacagagcaagactctgtcaaaagaaaaaaaaaaaaaaaaaaaaaaacgaaaaaaccagaaatagtttatttatggccaggcgcagtggctcatgcctataatcccagcattttgggaggccgaggtgggtggatcacaaggtcaggcgttcacgaccagcctggccaatatggtaaaaccccatctctactaaaaatacaaaaattagctgggcgttgtggtgcacgcctatagtcccagctacttgggaggctgaggcaggagaatggcatgaacccgggaggcagaggttgtagtgagctgagatcatgccactgcactccagcctgggtgacagagtgagactctgtctcaaaaaaaaaaaaaaaaaaaaaagaaattgatatttataaaatataaatgtgaacttgttatctcctgtttaaaaatccttcaatgatttttcaagctttccagataatatttaaactgtgttaaaacacaaaagccctttaccgtctctcctgtagctactactttagtgtcccttcaaagcactttcccctactcatctttcatgtcagcaacagaactattttaattttttaaagctttcttgtttcatgctgctgtactggtgtctgtgctattcaatctatctggaacctccatcctaacctctttgtctggttaactcctccccaaagggattaatgactgaattaatgatgccgcatatgtttttctaatgttcttttgaagtaactcaattgactctgaaagtttcagaaaccccttgtcaagtactgatcaagcagcttatttcactgcatattttttaaaattattttttcctgaagtttcagaagtcatgactttatttcctttggaagtgttcaatatttatgaataaaattatgaagataatcatgtaaaaacagcttaataaatttaaataaattttaataaaataaagagatgatgaaaaaaaggagttatgaaaagccataacagcagagaaaaaagaagctacaggaagtgtgaattggaactaagatagaactatacatagcataaatgggaaatgtaagaatgtaaaatttgtgcacttgaagaaactgaacacaattgcaaaagtttattttgataagtggaaaacattgtcatcatttgtacatttttttcccttaatagaaagcttcttaaattatatctaagcacttatcttattgcactgaatgtaagatgccaaatatagtaagagacacaatcaacaatgctttcttatagcaatcataaaagatatacccaattttggagatgataaaatacaagcaaaatgcacatcttagaactgatgaaatctggaaattgatgaaaaaagtcaagtaactaggttattgcatacatggtattagaaaactgccaaaggaaatttttaaaatctttagaaagaaaattatcaatactgcttgatcacatttgatatgaatttttaggaggacacaaatattcagtccataacactctctgagcttgtcttcttcaagattctttcagttgcaagtgacagaaaaccgagatcaaagactgattaagcatagaaagggatttttttgattcacgaactgaaaagtccaaggatagcctggctttttaggcatgtctggatttagattagaggctcacatgataacagctgaaacattctctctttttcccacttctttccttggtgttggctttattcttaggtaggcaaagatgacccctatctcctctagtcttagattctactgtcttagccaccagagccagagaaagacatcatgcattcctaaatctccaacaaaaatccaaagtgtggctctcattggcctcatatgtccatccctgaaccaatcacggtggccagtggaatagaatattcagattgaccagttctcaggcataagaaccagagagaatcagtccaacttgaactacatgctaataacaaaagaagggagaaaatgttggataaggaaaaacagtagaggagccccagtactcactaaataggattaatttcttaaatctgcaaactgggagaagataccaaacctttaggactgctgtgaaacagaattaaacaatatgtgttattatactgaattgcactcatgtgactaaattattacacaccacatacccgtatattgcaaaattctaatttcttaaggatctgtccttgacttcattgtggcgattatacatcccccttgtagcccacgatagaaatgatcaatagaaaacattgtccaagcgtcctggctttcctcaggcaagatgttagttaatgagacctcaacaaggatgagtaactctttccaagggacatcttcagggtctccctaaaggagaaatcaatgccccctaactgatttggatgaggaagccactagggtctcaggaagtcccccattgaaatgcaaattggtctagctagggctttatcttaaacaccagcaaatagctcagttattacttagcacagctgcagggattatcaaaacttgcagttttgttgtcctataggacataagtcaatattgtatctaactttgcaatcttattctatctcttttagtcaaagcgatactgcaccaggcatttgttaaaaaaatggcaaggaaaactttattcaaagctattgtaatatcagttaagactattgcaataggggcaagaaagtatactcaactttattgaaatgaaaggcaggagaggttttaagccttagggtgagctagaggaaaagcactggaagacactagggggaaggtcggtcagggtgattgggcttatcaaaattaggctcctaccctcccacagagactgagaaatgaggatgttatctttcttgatgattggatttcaaaagaatggcttccaggtgcttgagaaagacattccagggatgtagaagatttacatctcaaagggacagagaatacatttacaatggaaagttttctaaaataactgctccaaaaaaagggcggggctgggctcagtggctcacgcctgtaatcccagcactttgggaggccaagtcgactagatcacctgaggtcaggagtttgagaccagcctggccaatatggtgaaaacccatctctattaaaaatacaaaaattagccggacgtggtgacgggcgcctgtaaccccggccactcgggaggcttaggcaggagaatcacttgaacacaggggcggaggttgcaatgagctgagatcacaccactgcactccagcctggggagacactgtctaaaaaaaaaactggccaggcgcggtggctcacgcctgtaatcccagcactttgggtggccgaggtgggtggatcacgaggtcaggagatggagaccatcctggctaacacggtgaaaccctgtctctactaaaaatacaaaaattagccgagcatggtggcgggcgcctgtagtcccagctactcgggaggctgaggcaggagaatggcgtgaaaccgggaggcagagcttgcagtgagccgagattgcaccactgcactccagcttgggcgacagagcgagactccgtctcaaaaaaaaaaaaaaaaaaaaaaaaaaaaaaaaaaaagaaaggaaaaaaaaaaaaacaaaaaaagggtaagtcgggagcttattaaggaaagaatcctagtctctggcattctatttgggccaactttgtcatccttgtaattccctctaaagctttggcatgtgctcacactatatccgtatgaagttcatggctttatatttataaaaattatattttgacttcttttctcttatattagttggtagaataagcagaaatcaaagaagctgaaactagaaaacagaacatagcaaaatagcaacaaaaagacattaaaacacaaattttgaaagggcaaaaaatcatttttggaatctgactaatgagacagcatggggaaggctaatggggtaaggagaagaacaaatagaaataattgtctttggaatgtgaacattaacataatggagagcaatgaataagaagtatgacaatgttaagtattttatgtcattgtcccaagaggtgctcaattgagaaatcacacacacacacacaactttaattataagaaaaatatgtggtaacaaaataacaggaaaactcagaagtcagagaataaattgcttattaccacctcctaagtagcttttaatgctctttctaaattttctttgtaaattcaaaagttaaattgaattttgattcagacataaaatgaaactgggagcatttatttctgtattgccaggagaaatatttaccttgatttatttaaattcttctaggcattcctatttattcaattttataaacatcctcttctttgatgttactctaagtttattgtttcattgtctgagaaaaatcttattgccatttcctaaattggtgtttttttccccatgaaatttccagaagcatccaaatgactggattaaaatgaagtatggcaaattgccttttagaatgactcttcccaattagaaattgccaaaagtagagatcaaagcagtatacagtggttttaaactagctcatataacatcttccatgagctagttatataaagatttttgttttgattacttttatcttataattattcttaccaaattccaaccataaaagatattttgtacataataggtactcaataaatgaacattacatttgaaaagcaatgacctgctttatatttcagtctaaatgtaatcgatatgaatcaagcagtaaagaatatggcagagttgcattacaatttgcagtccaaaaattcttgagtaatctcaggaaaaatgtactctaccagggctttccaaagatcgttttcaggaatactagcctgtctatgtgctgccaaagcgagcacaggaatactagcctgtctagatcaatgcagttaacacaacccagtagatctctgtgcttgatgatgaaaatattctatgtctctgctgttcaatacaatagtcaatagctatctgtggctgttaagcacctaagatgtgactaatgcaactgaataacaatttttttcatagaaattaatgtaaatagccatatgttgctagtggctacggtactggacaacatagctccaaagttctcaagaacaaagaaaaaaatttatttatttttctttaaagaacaaaattttgtctaacctagcatttcccaaatttagttcatcacgaaattcctctttctactttgagaagaacattagggtacacttttcaaaaattttatattattaataaaaaggaataagatgtttaaggccatttacacatgattccttattttatttgctgattcatttatgtatccactcaactaacatctaatgagctaggggcttggcaatattgagatacagttttgttcattattgagttatatctaatgggacaggcagattaatcaagagataattacacacagtctggtaagttctaagaaacacagaggactgtgggaatacacaggtgggtgcagaatcaaaatttgtcatggggaaagtttccagagggagaatggaggacaagtaggacattgtctggttaaaaagaggtccccggccaggcgtggtggctcacgcctgtaatccctgtgctttgggaggccgaggagggtggatcgcctgaggtcaggagttggagaccagcctggccaacatgatgaaaccccatctgtactaaaagtacaaaaaaagaaaaaaattagctgggcgtggtggtgtgggctgaggcaggagaatcacttgaacctgggaggcagagattgcagtcagccgagatcgtaccactgcactccagcctgggcaacaagagcaaaactccatctaaaaaaacaaaaagggtgcctttgcatttttatttctcttattcccctccccagggtttgacacttagtctgtcttattcaagctaagtccttgaatcacaactatgcctagatccttatgggttgcttatttatacctttaaacaaagagaaattcatctgatttttacagattgatttgagaattagaggctgttaatactatttcctttttgccaccccaaccactttttcctgttctaacttcttcatactccagtatacaccacagaaacagaggctgatatggtttggctctgtgtcccacctagatctcatcttgaactgtactcccataattcccatgtgttgtgggagggagcggtggaagataattgaatcatgggggtggtttctcccatactgttctggtggtagtgaataagtctcacgagatctcatggtttcataaggggtttcggctttcgctcctgtcttattctctcttgccaccatgtaagaaatgcctttcaccttctgccataattgtgaggcctccccagccaggtggaactgtgagtccattaaacctatttttcttcccagtctcaggtatgtatttatcagcagcatgaagaaggactaatacagaggccattcgtactttaaatgtattacggctaattatagtcaagagattagaagtcataatacaaatattaaccacagagaggtttaaatttctctatataatctacagtcttctcaaaatagccttcaaaattttgacctgagagcaggaacaggcctttcatgttttaatcctcaataaaacacagacatacaagcctgtgtgtgtgtgtgtgtgtgtgtgtgtgtgtgtgcgcgcgcacatgcattctcacgctcatagtctgtcttttcccaacttcgacaattgtcccactgatttctctgtaccttcctttctattttaatcaaatctccgcaaaataaataagggatattctaaaatgtaaatctcattaagccctcccccagataatactcttcaagagtttcctcagtttccttcaaaatatgttctatggccattagagtagtttaaaattccctgtataatctagtccaagtttatttctccaacctcagagcaaacaattctagaacagtgtctagcatataataaacacccaataagtgttggctattgttttaggaaatggttgtctgtccaggaagcctaaaaaggtgtcaaaccacaatattagggaggcaatgcatagtgcagccaattcacaaaagagaaacaagtcctagaaatgttactaagagctcaccattcatgacaacactaatctcctcccgcaactctgccctcacccttcattctttgaggcttcaaaggatgaagtttatccattcatatcaaaaccttcctttttcacatatcaatgcacatttaaaataatcttgtagacactgttttctccttaagagtctgagagttaggaaacaattctgtaaatattaaaaacacaggtattgtaagactgattggaatcttacaaactaattttgttttactaaccaagacagtgtaggatagttacacgaacccaggtctagtaaataattcattcgcgattgtgggattgagtgcaaataattagtgtaaattgtcactttctcaaaacaaccgccataatagcctgttgattaagcaacgctgagtttattacttagtgcagtaataaagatcaacacttgacacagggtcttagttctctgaagacagtggttgaaggtagatattttttatagagttttgagggggtctaggttcaagtggtttaaagaagttctttgaatgcagagatttgattgaaattgggcaaaatccaagatataatagacaagaattggtggacccagtgagtccaggttcttagaataagtcttgatgagtaaatagctgttgaataagtaagggagttcatcatgttaacaatccattgtcccatgaaagggagctttttctccaaataaacaacttattgtcttaagacagagctacttgatcactgtgtagttcagataaatgcagtttcaggaatttcctgacgctgtatattagtttacaacattatttcctgggaaaatgttttgtggaacaaaatgcaaagttatattgacgtaggggccttgataattaagttgagcgacaacctctctgagtttcctcaattgtaaaatggggataccagtggcacctttttcttttggttgttttgaggatttagtgaaataatgtgcataaagtcctcagcaggatacctggcacttagtaaaagtacaatggctgttaaatatatttttcaactactttcacagtagttactcttaaagtatcaactcattttttcatccactcttctaaaacattcaccaaaatattatatgccatgttctttgctgtgtgttaggagcacagggatgaaagaaccatgtactcaataacttgtacttatagacatgttaccctattactggagactgttttggtaaaaataggaataacatgccaaggcagctcaggggatgtaggaaagtctaaaaacctgtcctagtgaaactgatgcttgacctgggccttaaaggatgagtaataatccattagtcagccaagggtccgatcattccaagctaaaggaaaactatgtacaaaggctaggaactattaatttccatgctgggttccagatataaaggagaaatccatgtgatttcacctaaagggtcagatggatcagcagaagatgagttcggataacaaaaataatagttaatagaattcaatatatgataagaatattcggtgtttataacaaacgggataattccaaccagaggatggaaggatcaaaggttttttttctatcaaggtgtggagctggggtcctatcttacacagtttagtcattctcaaatatttttatacaccagaaaaacatggaaagacttaaaattgcctccgtcttgctcaaaccttccgaagattccaatttaattgatctgggatggagcctgggaatctatattttttatttttgtgtgtgttttatttgtttagtgctctcctagtaatactaatatataagtaggacagaaagctgcctgcagtaagcagtcacaacccaataccagtagttagaagcccaaaatgagtcatttaaacaatattcttaaggtccacgtgcaaaattctggaaacaaggagtcagtagaggttacagaaggtaattttagcagcagtgagaggttgaattaggacagtgagttttcagtcatttctgcttatctggcacttgctttctatgaagaaaaggaaagagcatattcagatactcccagtgatactggagtcatagtctcaggctaagatagtgggcatgagatgagatggactcaaaagacagaagtagatgttgggataaattagagtattgggataaagaagaaagagagagctcaaagaacaatccaaaggttgtaactataggggcaggagcagtaggtctaggatgtagataaagaactaatttgaaagtgttgactataggcagcttcccaataaaccatggctaatacctgagccattatttctttcacagccccaggcacaactgtgtggtgcctcactttctgaaacattttaacagtctcctcctttgtatatgaccccagtgccctcaggccattcccggactgctttcttggtttcaaaatatttcctctacttaagtattggttttagaggagactgaattgagaattgtgctatagggagcatcccagaaccacgaaaatgacagtggttatgaactatcactgatgaacattttaggcaaaagtggccgattttgaagatgacctcgaggtcatccaaacttccctctttcctcattgccaaaggtcctgaggaacattatgaaaaataaaaattaaaggcaggtggaaagcccaaacatacgtctttttatttgtgatattgaattataaagtgagaattactaggctttgttgatggcaaaaccagactctgtaaaatattttaggcagtcagattacagtttggttttatacattttatgaaggcaggagttttaggcaaagacataaatcaatatatggaaggtacacattggtgaggcctaaaagggtgagatatcttgaagcaggggcttacaggtcataggtggattcggagattctttaatttgtgattggttaaaggagtaaaggtttgtctaaaaatttggagtaagcaggaaggaatgttttaagttaagataaggaagtctgttaatcaatacactgggtcagagtgacctgtaggggtgtgcgatttaacccttgtctgacatggccttaggtcctgtttataatttggtatcttaatgttgcagagtccattttgttagtctttgctctctattttacaataacattaatgctagtcagttgtgcctaaactccaaaagggagggggtataaaaaagcgtgtctgacctcctttcttgtcattgccaggaattcagtttttaaggtttctctggggtctcagtggctaagagagggtctggtccatttgtgacgggctaaggattttatttttagtttacagcaggatcaatgattatgtttcctaagggacctaattctagaagtccttcagttctccccaaatattttgggcccttgtgtcacaattgctgaaaccctgactccaaatttgggaggataacattgctgccagctttttactggtatcaagaaaaatgccagaaaatatgcaacatatgttgccattttgtcaaaagcagcaatgttaacatgacaatgaaagcaagttccttttggatttctttttaatccctggaaggtcagagggccaaagttttctagtaattcatctaggaaattaaccacctttggcttttcttactattttaatttacaattatgatttatagatgaacgttggttggaaaatatttttacacataatggcttttttagaatagcatctacagatacatgacagaaggataaaaattgtaactgtgacagcaatttcaatcagaaataaaaaccttaaggagcatcatgaaatttaccaaaatttatgcttctgatttcatggtatgtatttgttgatttgtttcttccccaagggattagtagtgaatatgtaagtaaaaaaggacatgattacacatgaaatacaatatgtcttctgggaaggtggagaaatctttcagccttagtggcattcacgtttgtgtggctgtgtatgtggatgtgtgaatttattcaacaaaaatgataccacttccatttgcatgatattgtaaagatttttttctttcccatatattctctctttttggtctcctgataatcctgcgaggtaacattaatatatgtgatacatttaatgaaagtctttgacaggcagcaacatatttgagaaaacaagcttgggaagtaagcaatattatcttcatttaaataatgagaaaaatgagtctcaaatagggtaagtgatctaccaaccagcacccagctctccaagatagaactgatactcaaaactaagtcttgttaacccagtactgtgcttgattcatagaaaatgttccacaaatatctgaaatttaattcatagtttgtgtaggtacagcatgcaaccaccacaaggaattttggctttctctttaaaatgtggacttttatgtgccaagataaattttctttgtggctgaatgtttttcaggaagagattactcaactaatttgaaccacattgacctatctgtaatttatggaaaagtgcaacataatacaggattatagaggctagagtcacgcttgctgaatacatatgctgtacattattttgaaagaaagaaaacattttaatacaaactatgtgaatttgatgacgcattttccctttatttctgttagtataaacctgcctatatctgataattgttggtgggcatgaagtaaaaggaaattatccccctttctgtaggttgtctgtaaagaaataaagcaaaagggaattagtacaaaataataacggtaatctaagcagacatagagttcagtgtttgttttatttcacagaaagatgcctatgcaacttgtgtaacaaattggtaggctgaaagaataacctcatgtaaatgaagaatgtaattaccatcttcacagttttggtacatgttggaaatgtcatttcaatcagggctaatcataatatgacaggaataactgtgataccataagtgataatgttatgctgctcactttttctaaatttggtggcaaaatatgcaaagataaaactttcaaagagccagtaaaacatgttcaagaattttctcactttaaaaaatattttcagggaagtactcatcattatagatcaacaattattttgataactccattgtttttaaattaaccctgttttagtattttggtcatcttttatggtcaattataaaagaaaaggatccattttaagtgacaataagtatttgatattttactttttccacatatatattcctatattccatatggcacatatgtatattttgtatatattccacatataatccatatatatatattagacacacagatacacacatacgtatgatatctgtctatctgtctgtctatctatctatctatctatctatctatctatctatctatctatagttgagacaaggtcttactctaacagccaggctggagcgcagtggggtgatcacggctcacagcagactccatctcccaggctcaaatgatcctctcacctcagcctcccgagtagctagaactacaagtgcaccccactgcatgtagataaatttaattttttttttttttttttttgtagagacagggtctcactgtgttgcccaagctgtcccctaactcctgggcttaagcaatcctcctacctcagcctcccaaagtgctgggattatagacataagtcaccatgcctggacacatgtgatattttgtatgtatgtatgtatgtatgtatgtatgtatgtatgtatgtatctatctatctatctatccatccatcgatctaaaaatttaaatatagttttcgaaatgttgtctctcattttttttttccgtacatgggcttcttattaacaataaataaagtagctaaaaacaacgaactaagaacttcagcataaagctcaatgggtgttcccattcattgcattgtgaagttgatatgaatgccattttgatgctacctcattttctggctcctgatgaagaaacagattaatgacaaattcctttcattactaatttctgtggttctcatgaagtttatgacattttaatttaattttattttgttacttttctaatccactactttatggacaagtcaacaaatggtttcttaaaagtacctctctactaggaagttggcaataaatacaaataactaactgttgctgtgtggatacagcctcccaacgggagacaacaggggagtcaggggagtgaagaagaaaggaagaagtatgatttgtattttgtttttgttcataatttttggtgttgagtacaaagtttgacccaagacataaataaatgcgttgatttttgaaaactttaaataaaggtatcttattctgtggttcaagaaccactggaaatgtagaggtcatccaaatgtcctgaaattggatgcaaatttttatttctatgtgcatatgtacatttttatggggaaaggatacacgacattattcagattttcctcaacatataagactagcaaataggttcaggaccactgccttatctattaattatattcaggtccaaatgggaaaaagacgtttctaagaaacaagaatataaatgccttaatccatgaatttacttttatttatacaagatattacataaaataatctgaaacaaagcatcttccaaaatagtgttataagaatgaatattatgccgggcacggtggctcatgcctgtaatcccagcgatttgggaggctgaggcaggtagatcacctgaggtcaggagttcgagaccagcctggccaacatggcaaaaccccgtttttactgaaaatacaaaaaaattacccgggcgtggtggcgtgtgcctcaaaaaaattactgaggcaggagagtagcttgaaaccgggaggctgaggttgcagtgagtcgagatcatgccgctgcactccagcctggacaacagagtgagactccatctcaaaaaaaaaaggaatgaatattataatactatgttatttacttaattataagaattaaaaatatatttgagcatatttagggcctcataatcatgcatagaggaaattgatatgatccattttatgttgagtaactcattatcattattattattaataatattgcttactacaaaaaattaggcaaattccttttcttataaaaattaagagttgaatatgttgttatgcctaaactacataacgtctgcaaaggttatggtcttatggatgatgatttttctcaaatattagtgtgaaaataacaagtttctaagttttccaaataacttaatgtgaaggcaaaggatttttaagaggttttgattatactcagagagtggaggactaagtgatgaaagaccaagatgagtggtgatctgtgttcctttaactattatgtgcagttgctgacacaaaatggttttgttctttctaaaaggtagagagagaattttgcccacagacagaaagaaaatgtctttcaagaagtggtttgagaggctggagagaagcagattggttacttgattactgagagggccattaataggagctcatttctagctaaagtgctgacatcactttgaagccatttacaattgttaaaaggaagcaaccctttagtataaataatgagcctgttacagtgaagtgcattggcagatattcataaacacagatacaggaggagctgttattcattacaattactgtttttcgtatgtttgaaaaatgcaaatatatgtgtgtgtgtatgtgtgtagtcgcacagtgatattttgttttagtacgtataatttagaattatcaaaaggaggtttgctccttatatgtaggttatattatgtcatgtgtctacttttggagagagtgataaattgagacaaatattccctaagtttggatttaacaacccaaaatcctctaggatgtcactctacactttatttggcaacttttctatgtgcatattttagggacgcttgcagaaaaggtatgtatggacaagacaagatccttgcctagaaacagaaagaacaaatatgagcagaggcataaatcaaaacataagcaatacaaatcagtgctaatttttttaattaaataaggctttctgattcatgatctaacctttaaaagtagtttctgaagtatattctctgttatgaaacttcgttcttataataaaaatcatattttgcaaaaaaaaaaccctaattttcaattacactatgaaaaaataaactaatgagttttcactattaaaaaaataacagaagccaagttcatggagttgctttttctatgtatgtttattgcttgtagtctttcacaaggatacatatattccaagttcaacatctttctttctcttttctttctctttttttctttctttttctttctttctttctgtctttctttctgtctttctgtctttctctttctctctctctctctttctttcttttttttttgatggagtttctttcttgtcgcccaggctggagtgcaatggcaccagctcggcccactgcaacctctgcctcctgggttcaagtgattctcctgcctcagcctcctgtgtagctgggattacaggcatgcaccaccatgccggctaattttgtatttttagtagagatgaggtttctccatattggtcaggctggtcttgaactcccgagctcaggtgttctgtctgcctcagcctcccaaagtgctgggattacaggcatgagccaccacgcccggctaagttcaacatatttcatattcaaaatatctgtgtcagttagctttggctacataataaactactctaaaactgaatggcttaagacaatttagttcactgttctggtaggtgtttcttctggtctgggcttggctctctcatgcatctttggctcaagtatggctttccacagtgtcttaacccttcaaagactcaggttttacatctaaaaccagagttcgagaacaggaacctcataactgacaaaaaaataaaagttactcctcagtgttgtctgaactcatctctcctgctaaactcccaaaggagaattcaaaactggcctattttcctcaagctccctattcaacccttctcaaccttcccctctccttagccaatatcctacctgatatgtttttaaatattttagaccctcagatatgaatgctcttgccttccctatatcctaatgataaatgtattcatgatcacagccaacctcacgttcttttcctggctttctcagaggagagtctcatcgtccacttaagagatacctatttcacttgcatccttgattttatcaattcttattctctttcaactgtatggtcatcttcatcttttcctctctactgtagaactgccattttatttttcttcttttctgagccaatcttctcgagggagtaatctcaattctctatctccatggcttaatttcccacttcatgctaatctactgtaattcagtctttatttgtcatggtgcaaaaactattatttttataatcaatggtgacttttatattggtaaatctagtgaacatgtgctagttttttttttaactaggtctctcttctgcacttgacactgttcattactctgtcttagtctctacacacttgcctcttattatagtattctctgttttctttcctttgtgaacactgtcaacatccttcacaagtttctcttcctgcagtcaccttttggatagaggtgccaccatgcttccgtcccagttcctttactcttcttatcctgcacatcctcttgctgtcttcattccatctccaacccttgcatttccatcagatacttctctggagtggttccatagggatgccagatgcactacctaccaactcatactgaattttttatatatatatatatatatatatatatatatatatatatatatatatatatatatatatatatatatatatccccttcttctttagcacaatatcctggagaatcacgtagattagaaacaaacgggtcactcttgttcccctacttcctcactttcctattcaattagtcatcaagacttgcacattttgacaactaagatttttcttttgttccatcccctttcagcccatcacagtcccctaagaccacctcttagttcaaatattttgtacctcttgtttactaccacagcacacaacagtttcacataacttcacattacatatacactttcactcaaaaaaggatagcatttttggattttgaagcacggcataccttttaacgtgtgtataagatgtgttttctcatgacttcttatacaatcacatgtactattctgcattgctgctttatacgcttgtgacttatctcatgtaggaatggaaagagggtgatccctttccttcccatcataagggtcacagttgacacctctataaaaagagagaagccatacaaatttattttatcatagtttcttgtggcttgggagggagccttcagaatgaagaccccaagatacagggaagactacctttttatgcttaggttccatgaaggatggacagctgtgtagaactgtgattggacaaaaagggtatgatctaatactaatagactgagtgggaaaaatcagcaaggcctgtctgtccagattcttcttgacctctctgtgcagcgttccttcctcccaggtgtggtgcaggaactctctctggtatgggggatctttgacctatagtcaacaggtaagttagagaatttctttatggccagttcttacacataaaggtagggggtaagttatgatgatatttttaggttttatggctggccttgaggagaaacatttctgatttctatgaccagttttagggaagagggattttaatttcgatggctatcctcagggaagaacaaggggtgagagacaaaagggcaggagggcagaattttgtttctgaaattgcctctgaggacttcactttggggtactgcttcctgtgcctcaatataatcaatgtgatcaattttacattgttggtattattcaatgatactttagatttgtgaaattcactagttagaaccaagctatttattctacattaaaacatttcaatagatagaatatcttacaatagctattgtcaaaaaatcattattattgggtttaacatttttatatttagctctgtgtggaatatcttaattattttttgacttctctctcatgtagcatcagaaattattcacttgaacagattttagattaatttattgatattatgattaccatgcatatccattaaatattttgatattgacaattaaaaagaatgaagtatgcatatatgtctcaatcatccagctgatcctaggaaagggatgtgcatttattaatcatgtttttaacccacagcacttactgtgacatttgtcacatagtaagcactatatatgtttttaaattaatgaagctatcaaagttcaccaaccaatataatttcagaggacagatgaaggctttcacgtcttcatttgttcacaccctatattcttccttatgcagctatttaaaattaattggcaagaattaccactctccttttctcatacttgttttggattctaaactttgttattttatttttgccatctctattctttctacttacttgacaattttaaaatcacacattatctaaaatcaggcagtgttttaattggttgatatattttacaagaaaccattccaccattatgttcttggtgatttaaatgcctatttggctacttacttgcacattatttgcaagaatactgatatctctttgaaatccttatctgtgagtgtgttagtccatttgtgttgctctaaaggaacacctgaggctggataatttataagaaaaaaagtttgttttggctcacagttctgcaggctgtgcaagaagcacggtgctggcatctgctactagtgagggcctcaggaagtttctgatcatggcagaaggtgaagggggagccagtgcatcacgtggttaagagaggaagaatgagggagaaagagtggggaggtgccacagttttaaacaaccagatctcacatgaactgagagtgaggactcattcattattctgagtacagcaccaagccattcatgagggatctgtttccatgacacaaacacctaccactaggccccatctccaacattgaagactatatttcaccataagatttggaggggacaaacatccgaactatcagcaattatgtagctacatagaaacaccaaagctgttctttctattttatttggtagaggttaagataagagaatatgacagtttatttcactcaaggcattttattaattcattgacatttgtctttgaacaaagagggtcatgtacgttcctgccttattcatggtgaattggtttggatgtaatggtacttgtacaacctgaggtcttaccaaggatactatctctccagttcatttgtatgtctttccaaggactctgaaacattttgtccaaggaaaaagtttcttattgaatttgaacttacatcaaatgaggcaaagtacttagcagccactccactttcagcataggaaaattctataatttgtcttgtgcattgtatgcattgttctatttagaatctgtgtttaccttgtaaatgtacttttaataatacctgaaaaagtaatattgagaatgcattgttctatgtcatagccctcattatttcattaaatgaagagctgaaaaagagataatcatttaatttatgttttaaatatctatactgacttgtttgaagaataatatagccaccatttattaaaccttggaagtagtgattttacaaacatttttttctcattcgcacaatgactctgcacataagtggcctattattattttcattgtccagttgacgattcaagggttatacaatttatgtgacttcccattgtcatattggggctggaatctataccaattttgcagaacttgagaatttatgtcctttcctgtataaccgtggttttccatgttttccttctgcttccatatttccacatgggcaacacattcccactcttttacataatatttcttcagaaaaaggcaagaagaaggttgtatgtaatctgaattggctgtcttttacattcccctctcaaaccctagaggttgcaatacccatgatcctcttgagaattgccacactatatagcagtggttggatgctggctccaaattagaatctctaatagtctgatttaattattctgggtactaagatgctggtattttaagagctctctaggtgatttaatatgcagccagagttgaaaaccaaggtttcccttctattgtatttcatgaaatgaaaaagacaaaataaaaaaagaaattcaatttatattgtttgctgtcaatgaaacatatcacataacctcccaattcttaaattacaccagtacttcatatttgaaatatatattcttaataaatcttttaactttcagggctctttccccctaattcttttcagttactttattagctctttgaccttgggcaactttctcttagagtcgattttcttttcttcattctaatttataaattaaactcttagctaggtaatattatttattacttttttgaataggtgactcttataaaatttcatttattttgtttctggtatttacatattggcctagtgaccatactagatacttaatatgctgtatatattttatacacataaataaaaatgtaaatacacactatatatatactatatttatttttagagtaaataaactttttaaacttcaggttatttagcactaacatactctctgatggtcccagtattaacatggtttttaggagtgcacaaacccttttctgcaagagaccagagagtaaatattttaggctttgtaaaacttatggtctcttttgcaacaattcagtatctgtcacaactattcgactccaccattggaatgctaaagcatctgtagacaatatgtaaacaaataggtatgattatgttgcaataaaactatatttatgaatgctagctgtaggctaggtttgacctgcagtctgtcgtttgttgaaccctgctttttatgatgattgtgaccttgattttgttttcctttttcatagcaggtgcttcataagtattgatttatattagtatgtttcctactttcttcctgccacaacacagcagttgttcacaggaattttgttgcttctcctagccttttccataattttttggtattaaccaaagtaatctactatatatggagaaatttgctatggtattacttttgtataggttatgtggtcagctgctctaggttgattattttagctctattgaaatcactttggtagatctaggctgcagcaacaaggtgaaataaagttagaacaatggaaagagtggtaaataaaaggatcaaggccaatgaaaaggcttatataagaagatatcccaaaatattagagttttttagtggctctccctattatacacactgtaccaattaaaataaatttaagagacttcagaagaataacacagttttcagatgggtggatatggacatattctccaatcctcaggtgactacaagtaagaaatccactaattggaaagaaaagaaagtagactgtaatataacaggtaacaacttcatgaaatgagtaatctcaatgagtagtttagactaaaaatacaaataaattatatatgtatatatatatagagagagagagagagagagagagacagagagagagagggagagagagagttcataaatgaataattgtagaaagttggtttgagatttcagtaataacgtcatggagggcagctctgttcatttttcagaatgctctattcaaagtagttatgtctgtgattttatttatactgtgattttttcttaaatgttttgatttctcttaaagtcgtatgcttttcctctcattatttaaatttagatcacggtagtatgatttactattaaaaggttaataaaatgggctgatatttctcattatatatgagatagcttcaaattatgatatagaaaagccattacattgatatagagcattttctgttttatctaacacagaaatttcccaatcacttaatctgcttaatatttatagatcttacattatccatgattactgtttcagcttatttttactttattcatgttgtgaatagatagtacatgctcatggtacaagattctaaacacacacacatacacacactcaaacacacacacacacacaaatgatacagagaaacagtagtctcttttttcttctgtccgtctatatcctgaattcaattactactatgagtctcatctagaaatagttcatatacttacaaacatatttaaattcttatgtaatcccatttgacccagcaattccactcttaggtatatacccaagagaaatgaaaatacatgttcacataaaatcttgtgcacaaacgttcatagcattattcataatagtcaaaagtggaaacaacccaaatattcatcagctgatgaatggataaaacaaaacgtggcctatctttacaatggagtataattaggcaataaaaaatgaactactggcttggcgcagtggctcactcctgtaatcccagcacttcgggaggctgaggcgggcagattatttgaggtcaggagtttgagaccagcctggccaacagggagaaactccatctctactaaaaatacaaaaattagccggtcgtggtggcacacgcctgtagacccagatactcgggaggctgaggcaggagaatcgcttgaacccaggaggcgaaggttgcagtgagccaagattgcaccattgcactccagcctgggcaacaagtatgaaactccgtcttaaaaaaaaaaaaaaaaacaactactgatacatgttacaacattgctgacccttgaaaacattatgctgagctaaagaaggcagctattattaaaagaccacatattattcaatttatgtgaaatgttcagaacaagcaactctatatagagaaaaattactgttacagggctgctgctggtggtggtggagggtgatgcaggaaaggggaaaatgggagtgactggtaataggtaagaggtttcttttggggagggtgaaatgctctgcaattacatggtagtggtggttggacaaccctgtaaatatactaaaaacactgaattatacactttaaatggatgaatgatatggtatatgaattatatctcattaaagctgttttaaaaaatgtatatttgttcaagattttgaaccagcaacatctgtaacatattcaaatgcaatttcattttagcttccaagcatggtcactctacctcataggtgttaattcagtattagaatgactagtccaaggtagcatctaaaactctgaacttaatttagtgttaaattgtgccccttccccggtttagggctactgcagacaggagtattacaacagaaaagacaggcgtggcaggcggcgtctttaaatctgttccttggacttctctcctgcttacaccttgctattctgactgttccaaggtcagagcagaataaagacagaatgaggtgatataaagtgttttctaggcctaatggctggttaagtgttctttctctttgtctctcccctcccagccctacctacctctcctacagtttccttgacccagacaggctcaatctctatctgtgtggagacttgttactctttccttctcttctgaagatctaggcttcacctcaggttcttgttgctgaggttcttatactcccataggtggctactggtcagaacccaagtcaacccagtgttgactctattttctgtgtactttgctgttagggtgcccgtgtaagttatcatccaaactgaaatacatttgtgagtgaaagggggtattactaataattttgatgaggccgggagtggtggctcacgtctgtaatcccagcactttgggaggccaaggcgggcagatcacctgaggtcaggagtttgagaccagcctggccaacatggtgaaaccccatctctactaaaaatgcaaaaattagctgggtgtggtggcacacgcttgtaatcccagctactcgggaggttgaggcgggagaatcgcttcaacccaggaggcggaggttgcagtgagctgagattgcaccattgcactccagcctgggtgtgacagagcgaaactccgtctaaaaaataaaaaaataataattttgatgagacaggcataaaatgggactgttctgagcaaatgggtcttatagatacccactgtatagaaaatactcacatatcctttgcccccaaaggtttggaacactgcctcatctattctgcttgtggccattgctctgcctctctcaggtgtgaggtgagctccattcctccacatcacccaactgcaaagaacacattcagtagatttcaaaggaatctcatagaagacccctttacttggctggagataatagatgagaattctcagctctttcccaaggagatagacaaaatatcttgtcagagaaatatctgcacaaaatccttcctctgcactttcctaaaccatttaaaatctgaaagtcaccaaggagttcaagagtaaggaacagatgcttacccatttcctttaaaaatctctatttagtgatttgtaactcacactagtatttcgcatctgttgtaacatggtgcctagttccaacttcaattttaacatcttattctgtatatattctttttttgtccacacaaatgtgagagttatttttgaaatataatgtcaaaagagatgatttgtcttagtggttcagtgtggcacaggctttgaaatcagaaaaccagtgttattagatttttgactttaggaaagtaacttgacttcttgcagccttaacttcatccccagtaaaatgaggataataatagtacctacctcatgggactattatcataattataagaaatcacatatgtaaagaaattaacataatactcaacttgtggtttgatgtgcaataagttaactattattattactatgattgttatttttaatatctataggaaaccaaataatatgaaatgtcacaaattatttttgaaaatactattctaaggtcttttttttttttttttttttttttttagattctatatcaatttttattccttcattgttacgaaacagatgaataatccttggcagatatacttgagagaagactcttctctcttcctgactggggtccaagtagtcctaatcccatttatccgcatctgtatattccacattggatttgtctcacacatgtccttcttgagatgttacttctgtgtttgagccagattctctgtctagaaaattgtccttggttatacctgctcaatgtttgctattaataatgatatacatcataatcatttaaaaagcccaaaactataacaaccctttagattaaagatacatgctccattggcagccctcaagccatttattttcacaatgtgctgagtttaactcactcattcatttataaattgacttggttgccaatatttggaatcagaagatgtttatcccaaatccagctttccatgggaaatcaggtaacatgggagaacttggcccatattttatttatttatttatttatttatttatttatttatttattttatttttttttttttattgatcattcttgggtgtttctcgcagagggggatttggcagggtcataggacaatagtggagggaaggtcagcagataaacaagtgagcaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctatccacacagacccggcaaccatccgatttctcaatttttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcagctggccgggcggggggctgaccccccccaccatcctcccggacggggcggttggccaggcagaggggctcctcacttcccagtaggggcggccgggcagaggcgcccctcacctcctggatagggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctccaggatggggcggctggccaggcggggggctgacccccccacctccctcccagacggggcggctggccgggcagaggggctcctcacttcccagtaggggcggccgggcagaggcgcccctcacctcccggactgggtggctggccgggcggggggctgacccccccacctccctcccggacggggcggctggccgggtgggggctgaccccccccacctccctcccggacagggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgacccccccacctccctcccggacggggcggctggccgggcggggggctgatccccccacctccctcccggactgggcggctggccgggcggggggctgaccgccccacctccctcccggacggggcggctggccgggcagaggggtcctcacttcctagtaggggcggccgggcagaggcgcccctcacctcccggacggggcggccggccgggcggggggctgacccccccacctccctcccggacggggcggctggccgggcagaggggctcctcacttcccagtaggggaggccgggcagaggcgcccctcacctcccggactgggtggctggccgggcggggggctgacccccccacctccctcctggacggggcgactggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggccgggcagagacgctcctcactttccagactgtgcagccaggcagagaggctcctcatatcccagacgatggggggccaggcagagacgctcctcacttcccagacgggttggcggctgggcagaggctgcaatctcggcactttggggggccaatgcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcgtcgcaggcactcggcaggctgaggcaggagaatcaggcagggaggttgcagtgagccgagatggcagcagtaccgtccagctttggctcggcatcagagggagaccgtggagggagacggagacggagacggagaggggagaggggagaggggagaggggagaggggagaggggagaggggagaggggagaggggagagggagagctattctaaggtctttagaagcaaacagtgccattgagaattcctcaaagcactaaattacaaaaatattcacatagatttaaaggttaaacctggcttatagcaggtactcaactaatattgaatgaattaaatgaaacaactctttatctatcaggtacctttacaaagtgtacactaccattatgttataatgtattagtctcctgagtctgttgtaaaaagttaccacaaacttggtgacttaaaacaacagaaatgtattctgtcatggatctggaggccacaattccaatatatgttagaaccgcagcttattagaggaaataagcaagtcagaatgcttgactgtacatatcattctaaactgatagacttgacctgaggcctttgacctcttacggaacaaaggacaagtactttgtgacagctatttttctattttattatttgcctatatttgaaagcacatttaaatgatagatgttgaatttgttagaaaagtgtcagtctttaacttttgaaaaaatgccagttaataaaaaggatatataggtatcaagtatccttgattgtgttgtatttaaaaacagtcgtgcgtatgtaaatagttccaaaaatatgtgatagctacagactttttggttgtttatggaaatatatctcaattatagctgttttttataagcctgaccatcatagccaatcactggtattaaaaaaatatatatgtatattatacgtatatattttatatacataaatatacatatatacatatatatctataccttatatacctatattattattctgctttttggtagaaaaggtgtgtgtgtatatatatatatatgtacacacatacacctttaatatatcatatgtatatatacctttaatatattacatatatatgccatatatatatatatatatatatgcaccgttttggggtgtgtgtgtgtgtgtgtgtgtgtgtgtgtgtgtgtgtgtgtgtatatctatgtatatatatacctgatatacctgtatcattctgctttttgaccttatctttgaaaaactttgtcttcttttgtttttaaggatattcacaagaatatgaatagttcgaaatgtaaaatacaaactgctgtagggtagaaaaaactgtagtgccttttcctcagggattccaagcgttgtggccaacactcctatgccaaaagacgttaataagataaaagcataacagaattaatcaaggtattttgtgacatggaaggcttcagaaatgaagacccgaagacccagggaaaactgtatttctgtgcttaagttcgatgaagcatagacaggtgtggagaaatgtgattagacaaaagggtatgatctagtgttaccagattgaggggggaaatccagtgaggcatgtttgttcagattcttctggcctctttgtgcagcattctttcctccaggtacagggcaagacacctgtcacatgtgggttttcaggggagaacagagaaggtcagagagtgacatttcttggttttatggcttgctttgggggagaggagttctagtttctatgacttacctgagagtgtgggtggagaggaattctggtttctatgtcacactttggaggagaaaggggagccggagactggagggtgggagaaggtctgatagacctgcttctaaggtccccccagtctcctccaagtcaaagtactcagcatacaaaggtgccatactttggggtattgtgttctgagttccaacatggcaaacatgcccttttattataaaatggctttggacattttactgcattgccttaaaaaataaccaaggaaatgtgccaacatttataaaatatatgtgtaaataattatatgcattttaatgtttctatcaaaatatagactagtatagataggttttgagtttatcagttgaacactgtcaatcttaaattttaagctgactgtggactattttatcttaaagcattgtctaagagataaaagagtatacatttacaagattactttctaatttaaagggaaaaaagattagtattctcaactttaaatgaaaatcagtagcagtgaggaaatatagtactagctaaaataggcgtcttgcagctcatgacccttgagtttatgcttattatatatgtgaccttagagaagtacctttacctcagttaacttcaatgtccccatctgaaaaataggagttgtgataatgatatatgaattacaagattttttttctgtattaaataagatactatacacaaagggcttaaaacaatatctgacaaatttatttatttattttttttgagatggagtctcactctgtcacccaggctggagtgcagtggcttgatcttggctcactgaaacctctgcctcctgggtttaagtgattctcctgcttcagcttcctgagtagcttggattacaggtgcccgtcaccacgcccggctaatttttgtatttttaggagagacagagtttcaccatgttggccaggctggtctcgaactcctgacctcaagtgatctgcccgccttggcctcccaaagtgatggtattacaggcgtgagccactgcacctggccgacaaatttattcttattattatgcatcatattaaaaattaggctttttaaattttttggtatgcgtcattctctggactgagcatcttaaggacatagaaaccatatcttaatcattttttattgtggcttcatcaattaacactattttatccttaaatgcttgaataaatgattcactgattgagtgaattgtcggctgagttaactataaagtgtgtgagaggcatataaatttaatcactttaggaaatttttagtttcagtattatatgggaaatggcacacacacacatacacacacacacacgcacattgctgagccaaatacatttgaacatagaatgctctatttataatgaatctaaaagtgttaaattatacgtttgattcttttcatttctaagaaggttttgtagatattattaaatctttgtttacgtagttgttaaatatttgcttttaattttagacaacaattggctgaaagaaaagctcatgttatttttaaaaatgttgctttttaacacacatttcctatattacaactctctgagggacaagtgacagaaatctaactgaaaatagttcaaagaaaaatactgactcagtcagtgagcactccagtggtaggactgtcattgtcctcagataaagttgaatccgggagctcagttgatattattagtactttgtttctctctctctgtgtcactctccctcatccccttcttctcttcctgtctctgtctgtctctccatttcttaactgttcatttctctgagtccctgtggtaactttattatctgtgaggccctatctttctggtgattaaaatggcctctggctacctcagacttacatgattcttggtgccccccattttagaaagctccacatttttgtttggtctgattttgatgacatgctttgatcacacgcccacgctggaatcaaccctagtggctaaggggatatgttaccctgattggccagtcttgggtcatatgcccagcactaagataaataatatgttcggcccacccgagccgcaggtactgagaactgtgatctgttctccaagcttatgctgggtaaatacacacacacacacacacacacacacacacacacacacgcacacactcaaatatcacatgttactatgttgatgacactgtgataaaaattggacaagtcttttataagaaaggcaacttgacatattggaaaaatgtaggaggcagatcattttcactcctgtacattttggctatttgctgtcatcagccaagttatataacctttctgagcatcaattacttcactgtaaacataggatagattgtgatgaaaattaaatgatacattatgtaaagaacctaacctagtacttagcacatagtagataatcaatgtatattaaatgtgtaatcactctttgataaaaataccttaggattcagaaaagggaattgaaaagtggggaaggggtatgaaatttaaagaaatactatctgttccctttataaaaaataaactttttaaagaactattctagatatgcagtattattatagttagttctttttaaagaactattctagatatgcagtattatacagttagtttctgtataccctacgcttagttttccctgttactaataacttgcaaaagtatggtacagttgtcataattaatgagccaatatatgttactaactaaagtccacattttattcagctttcctcagttttccttaacattcttcttctgttccaggatctcatccagataatcacattacatttaatcatcatatatcaataggctaaccttggctgtgacagtttttcagattttccttgtttttgaggaccctgacagttttgaagagtactcactaggtattttgtaggatgtccctcaactgggatttgtctttatatgtatattttttcatcagatgtttctgggcaaaatataaggtcagagacttgtcagtcaccttcatccctatagcttagctcattatctgttgcatagtaggtgctgaatacatgtttttctgccaactgaaagaatagatacagtggtagagattactgtttatctagtcaatattctttgtttccttctgccttactgacaagaacatactttaaaaatatatactcaattgtttgttgattgaggtgaaatttgtataacataaaatcagtcattttaaagtgaaacattcagtggcatttagaacattcacagcgctgggcaactaccatctctatctagttccagaatattttcatctacccaggagaagttgctgtacccattaagcaggtgtgttccccatctctcccacttcccctacccccagctcttggcaattaccaatctacattctgtttctacagatttacctattctttatatttaatataaatgaattcacacaatatgtgactttttgtgtctggcttctttcacttagcataatctttttgatgttcatccgcattctgtcgtgtatcaacatttcatttctttttataataaaagcctaattttttttggaatagcaatgaccaagtttaaaactacattccctttcctttggtcgtgtggcactgatgccaccaatgatgtctaggaatcccgataaggcctctaggcaattttcttacagacagctggttcagcctgcaagtaccctgtttgctcttttcccttttccttcttcctttctgaaatacaggtattatggtgagagctatagatctaagcaacataacacaaggatgatggagtgaaaaggtgaaggagctggagtctccgaggacaccatgtagctgccataccagccctgtaatgactactttagccttcattcatgtgaaagagaaatgaacatctagtgcccttaaaaatattagtatagcaattcagattttactatgcattagaaatccagtgaaagctagagacatttcctggccaatgggtttatcataattctgaattaacctatgtaagagaatattcaaatgtccactgaaatcaatgttctaattattattgcccttgtcacccttagcttactattcctgtgttcctagtatggcagaatgaaaaaggctaaaacgttatatctgaaattggaggttgctgacctgtaaaatgagttagttagacaacaatataccattataactccatcttaacacatgttaccacccccttctggaaaataaatccaagatgtctgtagcacctttgtagccctgacggaagagtcaggccctttgtgttgcctgcacattcacttaggagagaatgaagcgtgctaatttgtggagcatataatctattcttttattaaaagtgtatgacaaatggatacagagatacctacctggcatactcatttgcatactaaaaatataatctttatagaagacaaaatagaatacgtccttgagcaaaacagagggaacaatttagtgttggaatggctaagaggttggaataatgatgactaaacttgaaagtgaagatgaaaaagttgagtctgaagggcaatgaaaagccagtgaggatttttaaaaataatagtgtagttggagcaaaggaggaaaaagttattttggtagaaggaacattttctattacgtgaggaaggtaaactaatgaggagactggagcatggagtatgctaatatgtgaatgaaaatagtgagtacattgagagcaaccttaggattgaaaataagcttaaaaatgaaaaaatgaattaatatactgatgtaccgtgattgctttgctttgattctttttttaatttttgagacagagtctcactctctcacccaggctggagtgcagtgggatgatctcggctcacggcaacctctgcctcccgggttcaagagattctcctacctcagcctcctgattagctgggactacaggtgcacctgctaccacgtacggctaatttttatatttttactagagacggggtttcaccatgttggccaggctggtcttgaactcctgacctcgtgatccacccacctcggcctcccaaagtgctgggattacaggcgtgagccactgcacacggccttgttttgtgtgtgtgtgtgtgtgtgtgtgtgtgtgtgtgtgtgtgtgtttgttttgttttgtttgtttgtttttgtaattttagcttcaggaaaaactttctgaggcaaaaaagttaattgggacttaaaaccaaagaccagaataagtcattcatttgaatacatttattgagaatttactatattccaggactctgctaggcattggagattaaattgtgaattaaaaaataaggcttttacccccattgatcttaggttttagtgaaggaaagacagtaaacagataacaagtaaatacttaaagagacagttaatagtgtcacagtttttccaattttagttccatttagcagtaaaaacagaataaaatgaagccacatgtaattggaagagagaggtcaagcatgtaacttttcttgaagatgaatcattcaacaagcatgtttgcatctggtcattagtgatgcgtttgggcagctttgccctcactgtcctcagtcacaagaaaggatggacatgagcagaggaccctgtagaaaaaggcagacatacatgacaatatgaagtatcacttggttgcttttctaattatttatcagtttttaaattgtaaatatgacttagactgcaggctagtatcacctgaattgtctaattatgctaacacgctactaaaaattacgatgttgataatgtgtttctctttaagttcaagtaaacatcattaaaagaagcacaaagcaagtgaaatatgcatggcagagaagcagtataataagggaccattgctaggtcacaggttccaatgttaacagcgaatgaagccgttttcttttttttctggaatagaatttcaagtagatgatgactgaaaagtcgttcttggacagttcagcctcattacttctggaggtctctctcatcagtgcctagtggagatgacaattcctaaactgtctgcaacaagtattaattacttgggtaatcaaaacaatataattgttgatttcttccctgtatttattttataaaatgaaaacagctttaactgtttttctggctgttaaaatacaagctccttggaaaaacctgtaaatgaatagtcaaattatcaataatggttttctcccatggtgagattgtaggtacttttgctttcttgtatttattttccatatttttgttcccagtgagtcccacagggagaagctgagatgccataaaggaaaaattggggctcatgagcaaatagggtaaggacccagaagtggtacaggcctaatggttccctgctttttgttttagcccaggtatccccctttccttgggctaatgtagatgagtcttttcctttgcccccaaagaaccctgctaaaaccgggtggggctacattctacacttgtatttattggtcatcattccacagaaccaagcacacagtagaaactcaagaaataaaatacttgattttattaagtgtcttatttcctgaaagtatgaaataacattacgtggtggagatatggttaaaaacaatatgatcaatttcaggagaaggaaacactccataaagtgcgagtcaacttgatgatattctatgagaaaagattgatttgtagtttttttttacattagaaatctcatatatgtgtctttgtgtgcaatatttatttaaataaaggctaaagattcccaaaaacattagtgagaaactcttcttaattagctttcacttcttggcccacattagtctttctctctctcactttctcacacacatacacacacaccacacacaaatgtaggtaggagagcaagggaggaattccgcattaggacatatcgaaagtagattaatgcaaatgaacaagatgccaagtacagtatgaaaattgacatttatcagcacactctgtatgaagatattttcaaagctttgccatacatatgaaaatattccatttttatgcttatgttttcgttattcaatagcatgcattactttctgttgtttccaaatgcaagttgtaaatctcctcagaaaatttcaccgatgtgagatttcacttagtcttttatggttgggtggatcatttcctttcaaccagaacagtaattccatgtaaaagagtaagaataaattgaaatagaaagccatgttgctttgaaattgaaaaagaaataaattattaattttagtggctttttggccatacttaagttcctattttcatctatggaattatattttaacatcataaacatgaactatgttttatgttcacagaaaagggaaattttcatctagctattcattttacatagctatttgccttgattcactttccttttttaaagtatttataaatttcatacatttttaattagacaaatgatacacacatccattcctattatttaagaaaagtaaaaaaataaaacacacacagggaacatcttaatctcccttggccattactcactctactctccaacttctccagaggtaaccatgttttttttgtttttgtttttgtttttttgaaacagagtctcgctctgtcacccaggctgaagtgcaatggtgcgatcttggctcactgcaacctccacctccctggttcaagcgattctcctgtctcagcctccccagtagctgggactacaggcacatgccaccacgcccagctaatttttgtatttttaatagaggcagggtttcaccatatcggccaggatggtctcgaactcctgacctcgtgatctgcccgccttggcctcccaaagtgttgggattacaggcgtgagccaccacgcctggccaaccatgttttaagaccaggacacgaccaatcagacatttttaatggaaacttgatggattgtttcgtagatcatctttttaactgacagagtatttcacgcttaaactacacaaaagttacatttaatcgtttccttattggtagatatttagaattatccaaatgtttcaccattacaaataatgcttcagttataatccatgaatatgcctcattgtacacataagcaagtatttctctgggataggcactaagaagagaaactgagagtcaaagggtacaggcatcatgaattttaatagatactgccaaattgccctccaaatgtcagtatcgatttattttctcaccagtaggatatgagaattcacagcccctctatcttttggaagcactgagaagagaaaatgctattgacatgttgttgtaatatgcatttctctgatttctcacaagctctggttttcatattcttagtgtctattttgtcttccttctctctgaaatgcccattgataacatttctccatttttgtattggtttgttttatttttcattgatttatagataatattttgtaaattgttcattttaattttgttggattttatatcttgcagatatagtatcttatttatcttctttttactttgcttaggttgttgaaaattcttaaatgtttacaggttaaatgtatcaatctttgtctcatgttttttccccttgctgtgttatttaagaaagccagtatcagactctaaactctggtacatttataggtttttaataaaagcaacttgatttataatccatctagcatttattttgtgaatagtctatgatagaaattgatatatatatatatgtttgtacaaacatgaataatatatgacagtttttcttttaattattaaatcaccttacaaatcaaacaactatggaatattattagcttaactacctgggtgattagcaaaagttttatatttcctttccctatactttttaatatctactctaaaataggaaagttactttctctggctttgagttgtcactaaaatatattcctttttgtttgttaaggccagtcagttcttcgatttgaagcccaaaaggctccaatgaggaaaagattcatttcttctctctttggtgctgttgttaatatcctcactcagatgcagtcaggaatatagtaatgcctgtctcccttataaggaccattatgattacattgggctgatctggctaaacctggataatcttctcatctaaagatccctaatgtaatcacatcaacaatctcccatttgccatgtaaggtaaaacactcacaaatactggggtttagcatgtggacatctttgggaggccattattcttccctccacattgtcaacctctggtccaactcacttgtcatcagtgtaggagtgcctgtggaggcaggtagagtggtaggagttgggaggattcttgattgccttcagctgagcttgaacctgtgctcttagtggagcagtttcatttaaaaggggatgtggctaagcaggcaccataaaatgtacttctagtagcatccctgaattgaaagagtttacatataagactgcatgataaaattaaatgagttacattttgtaaagcaggtagaacaatgcctgagcagagtaggcatcatatacgtatttgtgcttgttaaataaaacccaaaaataatttccacgaggaaaggagtttcaagcagataattaatttgcgaatgtgatatatcctcttgatccagggagctaattgattttgtgaattacatttctcagggtacactaaatcctcactgttggctatcaagaggaaatacaccttgacaggtttctccagtggtggtgaagattgtgtatggattatacacttaattgtcacatttttaatgagaataacagcttaaaatcaagagtgaaacatatacgctgaaaaatggcagtattaattagctcattccatatttattgaacaactacactgtaccagattttacagagcatcagtgataaataacagtccttgtgctcaagccttttgaagtataatagggtgaattcttttgggtttgcaaatacagtctcccccaccccttatttgtaggagataggttctaagacctaccttacccgaccctgtggatgcctgaaaccatggatagtactgaacctgattttgtcaaatggaacatgttttttatcatgtcttccacccacaaatttaatgccttttccatcttaactaagaacttatatactgtggctgtaacttttgcagttagaggtgcaactgcaaaactagcatgcatttctttttctttcttcacaatttctcagatagaaaatttcttcttactgtagatcttagcaaacagtatatggtgattttttttctttcttttcttttctttttttttttttggagagagagggtctctctctatcacccaggctggagtgcagtagcatgatgatggctcactacagcctcaacctccccagctcaagcaatcctcccacatcagcctcccaagtagctgggaccacaggcacatgtcaccacacccagctatttttaaaatttttttgtagttacggggtttccctgtgttgtcctggctggtctcaaactcctgggctcaaccagtcctcccaccttagcttcccaaagtgttgggattacagatgtgagctaccatgtccagccgtttacttattaagttgagaatttttactttttcacttaaaggaagcactttatggcttctctttggcatatccaaattgccagcataactattcttgcattttgggaccctgattaagtaaaatagaggttacttgagcactagcactgtaataccaagacagttaatctgatcaccatgagggctactaagtggctaatgggcaggtagcatgtacagtgaggacacactggacaaaggcatggttcatgttttgggcagaccagagctggacagcatgagatttcatcacaatactcagagcagtgtgcaattgaaaacttaagaattgcttatttcttgaatttcccatttaatattgttggacctctgttgactgtgggcaactaaaaccacagaaagcaaaactgcacgtaagggggactactatacttataatacaaaatgaattacactgtggcccgaagaaaatattaaaacaaagtggtataaagtattataaattagagtaatcactcttgtaaagatgtcttagagtaacaaggtagtatttgaaatgagctttgaccataaaggtgaaaatgagatgggacaccccaggtaaggggttaatattacctaagatagagagagagaaaatccaaacctttaaaataaaacagcttggcagaaatagaggatgttgcacctataattgtagtgagaaagaaaatggaagagttcaatgtaacttttggatcatatctgggtgtaaggagttaacaactcattaacaagtggcctaagtgacaaatagtgaaagctttgactaagatagtaagaatgaactagaaaggaggggctgggtatgagagacattgtgttaaagcagaatccacatgatttagcaactgatttaggaggggagagaggggcccataatgactgctttcctgcttggatgactagaataatgtagtttcagaatagaaacaggaaattggacagatgatgtattcttgtctttaaatgaatggatttaagatgctggaagaattttgagggtgactctttcaaacaagtatttgaaaatgaggttggacattcctgagggagatagagaaagatatttgggagctttagtctaaaataatctcaaaatgggagaggggagactttgtagctcattttgtcctatggactcatcttacttgagttccagccctttccttgtaactgccaaatgtttttctatcctgatttgaactttgagtctatggaggccaaacccgtggccccctggaggttacctcaaaatcactgacatgaggcaaattgatgagtgggataaatggcatacaaatttatttaacttgtatatacgggagccttcagaatgaagacccaaagacacaggggaaattgtccatttttctgcttagattcaacaaagtatagacagccacgcagaaatatgactggacaaaaatgatatgatctaatgctgatagattgagtggggaaacccagcaaggcccatctgtctagattcttcttggcctctctgttcatgtatttcttccttgtgggtatggatcaggaccctctctggaatggaggtcttctgacctatagtcaaacaaggtaagtgagatcatttctttatggccagtttgtacacagataggacagagagaaagttagagtaatatctttaagtttatgagtggctttgggacaaaaggagttctggcttctatgacctgccttggggaagagggattctagtttctatggccagcctccgtggagaatgggatagagagacaggagggtgggaagaggtcaaagaaaaacttttgcttctgaagctgtttttgaggctttcattttggggcattgttttctgagccccaacgagtctatgacatcctgaggcaggcaattctgtttgtaccattcagtttgaaatttcttctttattctgagttgtctaaagttctttccctttgaacctagttctacatcttgggaccctaccctagagcatttgcggttctgtctcacaaaagctcctctgatgttttaagaaagctataaagtccctctttagcctcctcttccagtaacgcagggagtgtaaatggtgctcagcggcagtataatatcttcatgccctcttttgcttgctccctgctagagttttcccagatataaataaattaatagaaaactaaaaacaacttgcataggttctaggctcaattaatctaacatgtgaaattgaaataaaaatccttcacagaaattaatagggtttcaccatagataaatgcctgagggcatatgtccacctctgtcacctctcccgcttccaatgctcctttattcttttataggctaaacatctctacttggcacaatggttcatgtgacagtttccagtcatatcactgtctttggtctaagtagcatggagaagaacaagaccagcccctcccttggtctacatactgttattttatatatatatatatatatatatatatatatatgctaaaatcagttgtgtgtttggatacacccccccccccacctggctcatagacacactgccaccaatgcctgttaatcatctgcagctcgctatgtaaccaagtggaggttcacccttcactgctattatatttcaccttactatccatcaggtcctcagataacatcgttttgttcaatgttgtttcattataacactgatgagaaaaaaaatcaatccccagccaggaccactgtctatgtggaatttgcatttctctgaatgtccgaatgagttttctctgggtactctgttttcctcccacatccaagatctgtgcatgttcaattcattggtgtgtctgagtggttccagtctgagtgagtgtgtgtgtgtgcgtgtgcatgcgtgcacaccacacacacacccagcgatgggctggcatcctggccacagtagatttctacatggcgccctgagctgctgggataggctcccaccacttgtgactcggaactggaataagcaggtaaatcgtgatttacttattttatgaatctttcttaaatgatgtatagctcatatgtatttcaatgtttaatattagaagtacgttggtctttagaagttttgtgatattttatgacaagaaatatgttacaagaacttaaatcttgtttatatcaattagcctatgagaaaattggttgtgtatgaggttgttgcacctaaagtcgcagtttccaagaacctatagatgacattaagtgaggacttactgtagttgaaccttactctaatctgcacgatcatttagatctcaaattgatcatgtttatcagcttgccttttttctctcttgctaagacattgttgatgatgtagaattttaagaaacttacatttaggatagtgtgcttgacaaaacagtatttttccagtttgacattaagttgtcaaaggtctgataaggaattttgggggaactttattgaagtggtatagatgttaaaagtgctttttaaaatgagatgacacttggtttattctgaatttatttatataaaataacactgtcttacgtgttgagaacttagacttttgattcaaaacacccagcatcaagtcctggtctaccatttatagtttatttatgctccctgaatctatttccttaagtgttatatgaggctattaatgccttcttcctaggctattgtgagggtttgaggagacgatgtgaataaaacacttagtaccttgtttggtatataataagtggctgttatttttctatgaaagtctgattacagtataaaatataactttattccctttgcgttcattttcatgccgaaaggttttctttcaatatgaaattggtatttaattgtataatgaatacttaggaagaaatatcgaatgtacatggtaagccttctaatgttttttgtaagaatggattttgatttgccgtacattcttttcattctttgcgtaagcagcaatacttactgattttgaaggtgataaaggccaaggatgtagtctagaaatccatgggcttggtgttcttaacttttgtgcttttatccaagctgccctaccatcatgatctgtaaccttcaaaatccatccctttttataaacagtattccattacccatttgtcatagcttgcctggagtaaagaaggatactgggaagatagtgggcactcttacttcaatgactgaccccttccccaccatttgttctcatcagctgtttttaatgttccattaaatctctcccttgaagttttgatattatttattatatttttcatttctggaagttcaaataattttgttcaaatcaggtaatctttgtagacagacatagaaatatctgcataagctttatgcttatcttttatttctttaacctacttgttttaaaattgctggctgataactccaatattcatagtttcaccacagagagcaatagctgctctctgctctttcatatgattcttgctgtaggtactgtatttctttttgtgtttagttgttttgttttgtttctatttcaatgagctgatcagtttccctggaatgttatttgtggggattctctgaggcctaggttgaagggaattcttgtagagaggatttccattagccttggcaggtgcctaaggtataaccactctgggatcactataaattaaatgaaattcatagcttgaggttttgggggaccatccaagtaataagaatttgtgctgtaaatctatcttaaggatatataaggggtggagatggtcaagtttagttatgtttcattatttttcctgaggatgtagcccttagctttactgggtagaggttctctccaatttgagatttaaccaagcccccaccccccatccccatctctttagcctcctgctaccattaaacctaggctcagactactggaatgtccaggatcagtgtcctcaggaaaaatgtcttcagtgggccacttaaccctttgagctctgattttacttagattttgggcataggaattcctatcttgtgaactatttgataactttagaaaaaaaaaataacccagtgttgttccttattttcagtggaaaggttgctccaattaaccttgcttgccatattaatagaaatagaacttccctgttatttctcacttaggagttttctcaaccagattttatatttaacatttcaaatttcttggcacaattctcattctctgaccctacttacttgctactggcagctttatttttaaactctgctttagcttttcttttctcctttgtataacttatccttcaacaccttgaaatagttaactcctgtgagtgtaataggaaatttacaaaaaataatctttaaaaaccaccagattatttgattgtgtgatccaggaatgaatgcatgtcttagaagaaagagggcaaattgggtgaaataaaagatgttaagcaagaaactcatgggtggaaagagagtattattgagatgattggcaagaccacttaggctgtcagataattaaatgaagccaagaaggggttatgggaaataagctgattacggcaggtaagacaggaaggaatgatggaagaactggaggaaaaggagcacctattaatcttggggaattttatcatgtattcagatttttaaaaaatcaattaatgaacatttgactatagaccatataaatcagggctgattcatagttttcccttttcttaaaactaattagcagatattagctataacaaaggatcttttgacctcaaaagaatacccttggtacattttctcatcaaactaatacttagaaacaatagggaaacaggaaattaatgagacatctgaaactttatgatttcttttcatctggaaatattagggggaaatcaaataaaatatacattttatcatgctgtttttacatcagacttttcccctagtattctttctcatttggaacatgttaatgtactacaaatgaaagaggatgaaacacttgaaaaatttctggattgtaatatgtttaaaaatatatatagttctccatctctcattttctacatttttccagtgttttttttttttttttaaatttgcttagccacgattcattactcattgaggtcctcctctgtccctggcactatggtaagtgttttgtgttttgcatatagtttctcattgaatcctcagaaaacctatgaggttctaattattattgccattttactggcaaaattgagactcataaaaaataagcaaacaaataaccttattgtttataaagtttacctatatttattttgatgtgcgttttaattgttatcttcatatcaagcctatgattttgtcagatactgttattattttttttaatacatgaggacaaagaagctcagagaagtgaagtgacttgtcaaagcttccagtataccgatacagatggtgctttatctcaaagcttctaagtcacactactaattttctacaatgctacacttatttggaagataaacataggatgatgatgatgttgatgacaatgactacttttaaagtggtacaaagcttgagatttagaaaaccattagtatccaacactagttgtatttggtaatacagattctcctctgctcctcatagtttagtgtagcctaccttaaacatgttcagcacacttatgttagcctacagttgggcaaaatcgcttgacacaaaacctattttatgatctcatgtaatttattgaatatgctacactgtagagtacattatccattgtttatccttgtgatcgtgatggtgtggctgactgggaactatgtctcacttctgctgttcagcattctgacagaagatcacacaaatatcactagcccaggaaaagatcaaaatccaaagttcagaatagtatttctactgaatgtgtattgttttacccatcctaaagttgaagaatcacaagtcaaaccatcataagtccaggattatttgtttatatatcttgtagggaagggaaaagtgaaaggaaataatgttctttctacccttctacattattggctggagcccctgtaacaaaagacaaattaacaagagaaaacaaacaggagtttactaacatgtatatctcatatatacatgggtgatacccaaggaaatgagtaaatctcaaagaggtggcttaagaatcagtcttaaatacgatcttcacctaaaaacaaagaaagaagggtatgggggaaaccacttatgggggtgaccaggaaaagtacagtaaacaagagtaaggttttttatgcagatttaagccatttccttcttcattaataagactccagtcttcttggtacagacagaaagagacacccttacaaatgaaaatttacgttataagtgtgaatttgccttacaaaagggtaacttctactttgtttgcagagcttcacatgtgtctgctatttctcaaaataactagttcaaaataatccttatactgaagaggcatattttggggtatcatattctggtctcctacaatcttaatatcaaatgccatagaaataacccaaaggatgggcacagtgtgtgaaaagttctaggaagaatataacaagtagactatataactactaatggcaatctgtgtcccaaccatttatttagctttatcagatatatttttctgaagatacttttctttctcatgtgctccactggttaaaacccagaaatacttgtagcataaagatataacccacaaacagcaatcatttcttttttcttgggtgtcagaaatagctcctttgtaaattcaggtgtgatgattaaagtaaaaacgagcgtgagataaactgttacgctaattatctggaattctttttgagatttttatgttagattgatttaggtgaggaagtatggcatagggccataaaatcagaggaaaaagaccgtatctgtgagttataaataatttttgtattaaaagggaatattcagtatagtacatctcttcaatttctaaaatgtctatagtaatattttaaaatattcacagaagaagttgaagtattattgataaggcttttgaagactattttgttcattaagtaaacagtaaaaaaaaacattttttgttaggtaaattttcaggattactcagaataagaatacttacagatataagggaaaactacctcaaaaggagtttaaagagattatattaaaatatatagtttgtacctaacgattaaaattttgtcctgagctcatcttaaattatctttgaaatcattaactatgtgttctgaaattttattttgggtacaaattgtttgagatggttgtttattttatgtatatatgtattcatgcattaattcatttgttcattcatattttttgtaatcttcagttccttatcatcattggcccaggctagtgctgtttcttcattatatgtgcatatatatgtgtgtacacgtgtgtatccatatatgcccttatacctacgacactaatccctttattctcctacagtgaggcaatcgttttaatgtactcaacgtgtatctttttatttgcacgtgtttttgtaaaatttgtgttgttggtttgtgtgtgtatctttttatgtaaattatgttatatatcatatactgttttctacatctttactaagcactatgttttaaagatccatttatactatatacatacatatatgtatatagacatgcatatatacacacacatatgtatattttgtgcatatatacacacacgtgcgtatgtatgtgtgacacatacacacacacacacacgcacacactcacattctaatttctaaatgcttcgtggttctccatagtgggcatctactacatttgaccctattccctctcccaatatggataaccagttgcctctacatctatacgaccgcaaataatgctacagtgaacatcctctcatgtgtccccttatagatccctgtgagaatttctctgagatatacatgtgggagtggaatggccgtgttataggtaaatatctatttctgtgctttccagaattttgcaccagtctgcactcccactagaagtgcttgaagattcccacgattgctcatttccatcagtatttggcaatgagtagtgttctagttttcgcctcagagaaatgtttaaactattttaaacacaaggttttcaagagtattctagtcactattactctgctgataaacctttattattattcatccaccaaaccaatctcaagaaaacctgtactacatgataatttgctagttatggtgtatgtattgtaaaataataaacttatttccttagaaaaattctttcagatattttattaatactgctaggatttagaattggtgatagtttatcttacattttatttctaatttgctcatagcaaattatattcatgatcaaagaatattttctgtcataattattgtccaaacagtgtttaggttgcacatggaatttaaaagtactcttcagtgagtaaatgacaaaatcctgtttttttacttagaacacttttaatactgtggttcacttttctataagttatactagtgggataggtcacatgcagactaaatgtagaaatataactaggctgtggaattaattagctttgattttgcatttatttgaaaaacaaaaaagaatatgaagaccactgacatatatttccactatttttctttttcaaatcatacaattgagataaagattcagtacttcctccaaataaacagccccgtaatagcagaaatgtaaattacaacacttctaaatctgtttttatcaactattgacctaactttattaaatgtacctaaaaatgtagggctactaagcagctggaaaataatgtattcagtttgtagaggggaaagacacgatacctttcctccgtgtcataaggttcttggctgacactcctataacaaaagacagattaacaagtgaaaagcataacacatttgtttaatcaaaattgtatgtgacacaggggacttcagaaatgaaaactcccaaacccggggaaaacgatgtcattttgtgcttatggttgttgaagagtgaatagctgtgaagaaatgtgactgaacaaaagggtatgatctagtgataatagaccgtggagggaaaccgagcaaggcctgtctgttcagattcttgtgacctctttgtgtagcattccttcttctcaggtaagggcaggaaccccctctgaaatgagggtattcaaggtataaaggaggagagggtgacttttctgggttttatccttgctttgggcaagaggggttctagtttctatgacttaccttggagaaggattctgtttttttataaattgcttcagagacagaaggagggataggagacaagagggcaggaggtcagaaagagaatttgcctctgaggctgcttctgcagccttccaatctcctttggttcaaagtaatcagcatgccaaagcactgttctctggggtgtcattttttgagccccagtaagtaaaagaagaagaaatcatgggcaagaaaatttcattgtctgtgtctctatctctgtctctgtctctctctacgcacccaccccccgccacacacacagagtaacaaattcacataaagaattgtaaagttattgtcaagatattttacttcagtacttaaatattaattgggtacttaccaaaaagcatgaacataaatacatatgtgttattttatatatatattatttataattgacaaataattgtatatagatatggggcacaatatgatgttttaatatatgtatacattatgacatgattaaatcaagctaattaacatatccatcaactctgctacttatcattttgtcacggtgagaacatttaagatttactttttaagcaattttgtaatatacatcaggccgggcacggtggctcacgcctgtaatctcagcactttgggaggccgaggcaggtggatcatttgaggtcaggagttcgagaccagcctggccaacatattgaaaccatccccctgtactaaaaatacaaaaattagccaggcatggtggcacatgcctgtaatcccagccactcgggaggctgaggtgggaggatcgtttgaggctgggaggcagaggttgcagtgagccgagatcacgcatcactgcactccagcttgggcaacagagtgagactccatctcaaaaaaaaaaacaacaatgtaatatacatcgaagaccttcagtctaattaggcaaacatactccaaaagtttattttagcaaaacgtggtttatatactacaataggctagtataaagaaaatatgttcattcagattttttcctcttaaacttatcaatatatctgatgtttttagaacaaattccttactttcattattttagccactactgagaagtcaatcatcaagtcactcatagtttgtctacttagggcctttcaccaatactcagtccctttaactggctacaccaaccaccatcacccttcccaaaaatacaacagaaaataaaataaaacaataattatagctcagtgacttcagagtactatcagtctatcactgtcagtgatttcttaccacttgtgaaatttcaaaagcctgccatgtactatttgtcctgtcaactcataccaggatcgtctgccaaatatctcaacatgaaggctctgtacaattacagacatctccatttgattcctcctctgaaatgtgttatttacatggttttttgtgtgtattttgcccatcattcactaatagtggcttactccaatgatatatagctatcctcccttctttacctagttaaatttcccagatgctcttcataggatccctctcaactattcaaggtctctttctatggtttaagggcttctcataaatgcagcctatcctcattgggtaaactatgggactagttagaggatagcagtaaggtgcatactccagcttttccccccacacggattcagactcatacttgggtaccttctgcctgaaggtgatggtggcagatactttgtaacccctgggttactaaatccttctcaatatttctaggtagccatgttattaccattccatttccacaaagatccctcaagtaccagagccaatattcaaacccagatctgtgggaactccaaatgctattctcatctctatatatgagggggtggggagctcaccaattctcttgacatgccaggagccatcttaccctttattttggtcaattttgttttgttcttcttttctcttgagctaatatttatacgctgattatgtgctaggcattgtgctaaatagtttaattattgcatttcattcccataattttactgaggtgtggctttatgaatgagcaaactgggacttaatgagtttaaataactgacccaaagtcaggcagctaataaatggtggagcttggatttaaacccagtctgctttaccttagcagccatacactaaacctgtaagcattcccaacaggacacatgggtttccatgattcagggtttcgtaaattggttaactgtgtttcttaggatcatgaaaaacctgcaggctttcagatttatttgaattatttttgaccattgagtcacacatggagtggattagttaggaaataattataggagtcagagttaaaataaaattaaatccagattggttataactcacacatttcactcttttatattttagcttccttttttttacataaataccacacatttaatagttttaacttgttattttggtcaaaataaattttgtaacgctgattcttctgttgtgtttagactatttggttgaatcaaggattttaaaatttgagtttaccaagttaagcactaaatcgaagtccaaaaccatatctgctttttatcccagtactttagacaataactagcacatagcagttgctcaataaatatttatttagtgaatatgtggaattactatacatttattattaatttgtacatcaaatgatctttcatcttttccttgaaaagtatttcctcattgaagaaatgctcaaattctgatacatctttcttcctaaaagagtatctttctaaagtccctaagcttttaagggtgctattaaatatatgtaaataatgattaatgaaaaatcaatctaattttaagatagtgatgcataccatctcacacaatgtgttttttcccagcttatgataataaaaaaatgtctctgagatgagaaagcatactgtatctgaaacctagccaaccacagctgacatcctcactgaaggttagctggtgttgactgatgcagggagggtacagatggaacaactgtagagtatagaatctagctctatgcgattttcatcttcctcagactaccttagatatgttagcaggtcaattggagacgggcaccaaaaaatggaagaaatgtgtaagtattaattgaagcctctgctttatgacttcgcattggctcaaacaggtcatttagtgggctcataaccagagtaaagtttccttaggcaaaaggtgcggatacagtcacagatggagtcattaacacaatcaacctatcatataagctaaactaattgtatttatttccataaattacatctggccttcctactacagtcttttgattttctactgagaagtgcatgctaaaaactaccttaaacacacacacacacacacacacacacacacaactttaactttctgcttactttcatttctgctaatattgtactttgtgctaatataattcattagctaaaatattcatttttgtagagactgagcaaaaggatagcagtcttttaaatagaaatatcatacagtatggcctttgtggtcagtatacaagacaaatatccacatggcatttatcaaataaaatttatgtatgtggacattttatttacatgcatatgttggaagaaagccatgtattttaaaaataaaaatgagctgatcattctacaaacgttgcagttgcctattataatgaaattgtgtgttaagtgtcactcttaaatcaatggagatgacatttgcatatcagtttaattgctttggattaaacattgaaagatgagagccaagagagcttattaagctgaaatgagggcaagtgataaaaaagtgatattatgtcaacactacatctggaggtctgttgttgtttccattttaaattctaaattgcagtgtttctaaaaaaattatcatcaaatgccatagttttgaaatatagtacaaaaattaaaacagttaatgcatcaattgtgcttgataaatacaatttgatttgaaagccaagctagggttttctctactttgttgaaatgtatttcttcttaatgtactagattgtaagattttgaaagcttttgaaaaacattatgtcttatttactgctgtatcttcaggactttgacatagtgtgtcctgtaataggtgctcaataaatatttgtgaataaatgagtcaatgcaaagtatggcaacaccttcatagttactgtaaaacactctaagtgagttcctgggtaccgctgattttggttgatgccagaaactgtatccacagctccctaccattcagaagcactgtgtgctcattggccttcttctttgcttgggggaatcatcagtcattattaaatatataaattcctgcaatgatctactttgaagtaggctatgtggactgtggcatgtgtgaagcaatttgattcccaattctgagggtctcctgtaggggtgtttgatttgagactccgcttagaaaccaccatttgtttgctgtgaccacagcatcagaaaactgatgacccatcattatccaacgataatgcagacctctttcatttgcattagagaatttgcatcacttccaggtattccctattgctcatcggagtgatttcatgtttgccagatagactatattgtgttagatcatctaaaacatagccttcaaatttgtttaaattaatccctccattgcagttatattgggggatttattttatggaatatctaagcatcttacaagcattatcttctcaatccttataacaagtgtgtggaaaaagttctatgaaatatcttcattttacagacgagaaaactgaggcacgggaaggttaagtggcatacctacagtatgtggaagagccaggttttgaaattagacagtctggttccagagggtgtgttcttaaccaccgtgctgtgagtaaataggtgcctgaggttcccctaaggtccctgaaaatgaagtattttgtatgccacatctatttcattgttgtttttagcttttaatcatagtacaaaaaaggtaacataaaatttaccatcttaactttttaagtatagagtttcagtagtgttaagtacattcacattattttgcaacagatctttagaactttgagttttaaaaattctatacccattgtacaactcctcatatcccctgtcatatctatttttaagtactatcatcccaaacatagcacctcaatctgatgagaagctatcatactattatcacttcaaatattaataaacagagaaaggagaatttttgtatttgcatagattagtatatgcccagaattcaaaatttagaaaaaatacgaatgcagaagaaatggagttgtattaatccgttctcacatcgctataaggaaatgcctgagactgagtcatttataaagaaagggggtttaattggctcacgattttgcaggctggacaggaagcatagtagcttctgcatctcgggaggcctcaggaaacttataatcatggcagaaggtgaagagaaagcagtcaagtctcacatgcagagcaggagctagcaggggagtgccgcacacttttaaatgaccagatctcgtgagaactctatcactagaacagcaccaaggggatggtgctaaccattcatgatggaccaagcccatgatccaatcacctctcaccaggctccacctccaacactggggattataatgtgacataagatttgggtggggacaaagatccaaaccataccaggagtgatttgaaataaaaagaaatgtcttagtgatttgtcttcctcttgtttctcagtttgaccttggatatttgcagaagaaaacttttctgatgtagtttatctgaatgacctgttcctaaatcatgacttcagaaatatatttttagttaaaagccaagaaaacaaaaagttatatttaatttacttgtttcttaaacacataagtattatgttaacttctgcataaaaataaattctattcaaacattgataaaaacaaaaagtacagttggccctctgcctttatgggttttgcatccatggattcagtcaaccacggattgaaaatatttgggaccaggcatggtggctcacacctgtaatcccagcactttgggaggtcgagatgagcagatcacttgaggccaggatttcgagaccagcctgtccaagatggtgaaaccccatctctactaaaaatacaaaagacaattagccaggcatggtggtgggcacctgtaatcccagctactcgggaggcttaggcaggagagttgcttgaacccgggaggtggaggttgcagtgagccaagattgtgccactgtactccatcctgggctaccgagtgggactctatctcaaaaaaaaaaaaaaaaaaaaagaaaaaatatttggaaaaaaattgtatatgtactgaacatgtacagatatttttcttgtcattattccctaaacaaaacagtgtaacaactatttacacagttggattaggtattgtaagtacatacattggattaggtattgtaagtaatccagaaattacttaaagtatacaggaggatgtgcataagttatatgcaaatactacaccattttataacagggacttgaacatctgtgggtttcagtgtccacaggaggtcctagaaccaattccccacagataacagggatgactgtatagacttttatatatgtatacatatttaaaattctatgtaaactgtagatagaattttaatcagtaaggtaaaaaacacgaatttcatataaatgcatgcaaaattatacaatctacgttgaagaaaataaaaaggactgaaaaagatatttatattaatacatattttcaattcttaattttctttatgtttgccatcatatttaattctcaaaaataaccctatataatagtttgaaatgtgatgtagtaaaggatgctaggaaaatagacttagatgggtggtgctcaggcagagaaggtgaaaggagttcctgggtgagggtcttcatcaacacatagaagtgagggagagcatggcacgtagatagcaccaatcgttacaaatggtcagagccctagatttgtgaatatggaagtggtaggagacagggaggagagataggccaaatccggatcaagaaagatttcctatagccaaataaattaattttaacgtgatttcacatattatagaaatgaaaggaaggggccaggcacattggctcacgcctgtaatcctagcactttgggaagccaaggcgggtggatcacttgaggccaggagtttgagaccagcctggccaacatggtgaaaccccgtctctactaaaaacacaaaaaaattagctgggcatggtgatacatgctattcggggggctgaagtaagaggatcgcttgagcccgggaggtcgaggctgcagtgagccaagatcgtgccactgctgtccagcctgggtgaccaagtgagaccctgtctcaaaaaacaaagaaagaaagaaaataaaggaagaaactaacaggaaaaatacttttttaaaaaagaaagaaatggtccggcgcagtttctcacgcctgtaatcccggcactttgggaggccgaggcgggtggatcacttgaggtcaggagttcaagaccagcctggccagcatggtgaaaccccccatctctactaaaaatacaaaaattagctgggtgtggtggtgcacacctgtaatcccagctactcgggaggctgaggcaggagaattgcttaaacccgggaggtggaggctgcagtgagccaagactgagccactgcactacacactccagcctggatgatagagtgagactgtgtctcaaaaaaaaaaaaaaatagaaatgcaaggaaggatattaattaatcaaaggattgtgtcgtagttagaaatgacacagataaaaatattttatcataaatccctttgctagtgtcaggacccattctgcttccaacttcataatattatattaccttaagttgggggttgatcaaatattaagaagaaagtctgagaatttttctaaggaccccttctaggtccacaagtcagagtagaagtagtttgggataactgtatgctgatagattttgtgtttttaaaaactacttggtaattattttgtcagttattctagcatcaaatattaaaggttctgacagtcgcaaggaagtgatcaatgatatttgcaaatgctaaagagaagatgattaccagccatccacagggatgattcaaatagcaaatatcattatggtaaaaacaaaattttcaacaaaaataactgtttaagaagcacagttttctgatatttttgataggtcaatttttttttttttttttttttttttttttttttgagacagagtctcgctctgtcgcccaggctggagtgcagtggcgcgatctcggctcactgcaagctctgcctcccgggttcatgccattctcctgcctcagcctcctgagtagctgggactacaggtacccggcaccacgcccggctaattttcatatttttagtagagacggggtttcaccatgttagtcaggatggtctcgatttcctggcctcgtgatccgcccgcctcggcctcccaaagtgctgggattgcaggcgtgagccactgcgcccggcctgataggtcattttttaaagtcaccttcaattcgagaaaatcaggaagataacatttttgagtaattttatctttacacttacatataaaatatttttaaagcatatatgcacatatatgaatttattcaagttttttttagggggaaaagagcttgatctagtgatatagtttattaactcactctgttatcttaacatatattgtttagaagctgtggaaatcatgtgtaattagcaaatataatcaaagttattttatatcataattatttattcttcccctgcaattccctgttgtaatttgtttgtttaatcagttcatctaaacttatcatttttcattcatttgtccattataagccatgaaacttttaccttttctctctcttaattataatcttgtctgatgaggacaaaataactgagacagaacagaggagcaagatgaatggcagacagcaggtgcatttgtatattatgaagtgtttgcaaaataataagcaccacatgaataatgcatttgaagaatattgtctggcaaatattattaagagtcatatatccaaatcatcccacaattactgaagaatgaaaaacaaagtgtctaatgcctctggttttgtcagacacagagagaatcaccatatagagcttctaggtagagcaaaagggcttctatttatttttatttatttatttatttatttatttatttatttatttatttattgagatgaagtttcgctctgtcacccatgctggagtgcagtggtgcaatattggctcagtgcaacctctgcctcccgggtttaagcaattctcctgcctcagcctcccaagtagctgggactacaggcgcacgccaccacgccaggcaaatttttgtatttttaggagacaggttttcaccttgttggccaggctggtctcgaactcctgatctcaggtaatccgcccaccttggccacccaaagtgctgggattacaggcgtgaaccaccatgcccagcaccacttattaatagaggactaaaaatttatatatatatctttatacaaatgtatatatctatattttatcatatttatatgtattatttatatatttgtatttactacatatatatgtgtatatataatacagttggccctccatatctgtgggttctgcaattgcagattcaaccaactacatatggcaaatattaataaaaaggatgattatgtttgcactgaacatgtacagtctttattcttgttatacttcatgaaacaatacagtgtaacaactatttacataggatttatattgtgttaggtattgtaagtaatctagagatgatttaaagtacactagaggatgtgtataggttatatgcaaagactgtgctatttttttatatattttatgtatgtatacctagcaaggtaaaatactgacacaattcaaaaaatgaaggaaaacctcagaaacgctttgattcaatgcttgtgtgtatgtgtttctgtttttgtttgtttttgtttgttttgagacaaggtcttgctttgcccaccaggctggagtgcagtggcgcaaccatggctccctgcagcctccacctcgcgggctcaagcaatcctcccacctaaggctgtggagtagctgggatcacaggtatgtgccaccatgctcagctaagtttttttgtttggggtgtttgtttgtttttctttttctttctttttttttttttttttttgtagagacagggtctccctaggttgcccaggctggttttgaactcctgggctcaagttatcctcccacattggtcttccaacatgctggaattacatgtgtgagccaacatgcccagcctctgtgtatgtgtgtgtgtgtgtgtgtgtgttgaaagagagaaaacataaagtaggactcaggattttagagtggttgatatgccactcctcattttgcctcttgactgtcttgctctatgaccactccttggaggtagctgagctgtttgtgttgctagtgttgctgcagccactggctgctgcaagaatctcaactgttctatcttctgttgctgctgctgctgctgctgctgctattgaaaagcagaagacagctgggacctctgctgagggaggctttaccaaatcttttctgggcaaaaccaacctgagatatcatagctgcctgaagctacagaaaacttctgactctggtgagattaatgagaacagctttatgagtccttcaggcctgttcttgattgcttgaaccttgtgcagaaccctgtggccttggctgtggagcatgagaagttgtgtgttgctgaaagtattgttgcagaatcaactgatggagcggcagaagcagcagcagctgctgctggatgttcaaaatgagggaaccaagtggaagctggagtagagttaatggcctgagacctgaggtacttaaaaaaaaatgctaaacacacctgattgaaaaggtgcctgcattctattggactgggccatgcatttggtagcatacctcctgaggaccgagggccactccctttgattctcgaaggaaatggggcattaacagtacagcccagcatggggtttgaaccactccccaaagcccaggctccgcagactgggcccactacattgatgactatttggacagttgagtttgccattacctaggaggctgggattgtttttgaggagttggaggagaccaggcagtgtgggggaaactgaccccatgattcaagtatctccacctggccccacccttgacacttggggattattacaactcaaggggattattacaattcaagatttgggtggggatacggcaaaatcatatcacttagctcaggagaaggtggacaatgagacagctccagatcctaattcagagaagatgtagaatatctcttgcagcattatttcactgagcctgtattcaccttttgctttttataggctgatcatttcagaaattctccctacctcggactccttgtcatgtggtccttatttattcgctgtctctcctgagtttggctagctcatgtcgtatatgttgttgtttgtccttttttatttagagttttaaaaatttatgattcatggtgtctttccaactttgcaatggcttatttaagtataaaatttatttaaaaacaaaacattaaaagttatgagtgaataagaaccagaaaaaattttttcgtaaatttccttttagagtgtcaaaatacaatttttctctgttttaccttgtgtgtggatgtttatctgtgtattgtttttgcaatgtttttatctgcttaattaatattcggctattggctttttttttctcagaacagtaatagaagatacgtttttgaagtggtaggatatgaagatgacatagcttacttaatttcatagttcaagaccagcttcttttgttgccattatgacatgaagtattttttttattgttaactgttgttattggtggtggtggtattttaaataaatagtacacttttccacaagccttgcgtctcctgattctttgacactcttgggtcattaggatccttcaactttagtctgttcttttttttttcccttagccataagtcttcaaagaatacatttcttctcaaaagtgcttccctgttcctaaaaggagatgtttacttctggtcctaaattctttttatgctcctttcttttgattgcccacaaccagtgctctaatctacctagtttcaaatattatctcagtatttcccaatccagcattgggcctcaatcacctcctacaaattattaagaataagaaaaatacctccggaggaaaattaggtcaaaataaatattcattaaaatatataaataatatttacatatatgaaaagatgctcaacctcacaataatagagttgcaagttaagactaaaataaaaggctatatttttgtattttctttttctctttttccttgtattattatttttatttgacacatattaattttacatatttttggggtagagtgtgatatttcaagacatgtatataatgtgcaatgatcaaatcatggtaattagcatatccatcacctcaaacatttatcatttcctgtgttgggaacattcaaaatctgctcttctagctatttgaaaatatacaataaattatttttaattatagtcaccctatagtgcaatagatcactagaacttatttctcctatctaaatgtactttttttttttttttttttttttgagacagagtcttactctgtcgcccaggctggagtgcagtggcacgatcttggctcactgcaacctcctcctaccaggttcaagcgattctcctgtctcagcctcccaagtagctggaattacaggcacctgacactatgcccggctaatttttgtgtctttagtagagacgggatttcacaatgatggccaggctgttctcaaactcctgatttcaggtgatccacctgcctcggcctcccagagtgctgggattacaggcatgagccaccgtgcctggccctaaatgtactttttaaaaaactaaacttagatacagggggtacgtgtgcatatttattacatgggtatattgtgtgatgataagattggggtatggatcccatcacccaggtaagtgagcatagtacccgataggtagtttttcaaagcacactctgtccttccctttccctctagtaatccacagtgtctattgttcccatgtttatgtccatgagtgctcaatatttagctcccacttataaatgagaacatttggtatttgattttctgtttcttcattagttcgctgaggatattggcctctagctgcatccatgttgctacaaaagacatgatttcattctttttaatggctgcatagtattctgtggtgcatatgtacccattttctttatccaatccaccattgatgggcacctaagttgattccatgtctttgctattgtgaatagcatggtgatgaacatataagtgcatgtgtctttttggtagaatgatttattttcctctgggtatataccaaataatgggattgctggattgaatgttctttgagaagtctccaagctgttttccacagcagctgaactaatttacattcccaccaaaagtgcacaagagttctcttttctccagagcctcatcaacatctgttattttttggcattttaataacaaccattctgactggtatgaggtggtatttcattgtggctttgatttgcatttctctgataattagtgatgatgagcatttgttcatatgtttgttggttgcttgtatgtcttcctttgagaagtgtctgttcatatcctttgcccatgtttaattgagttatttgttttttgcctgttgatttaagtttcttatagattctgaatattagactttcgccaaatgcatagttgtgaatattttctcattctgtaggttgcctgttcactctgttgatagtttatgttgctgtgcagaagctctttaattaggtcccacttgtcaatttttggtttcgttgcaattgcttttcaagactttgccagaaattatttgtcagtgcccatgttgagaaggctgtttcctaggttttcttctagaattttcatagtttgaggccttacatttaagtctttaatccatctggggttaatttttgcatatggtgaaaggtaggggtccagtttcattattctgcatatggctagccagttatcccagcaccatttattgaataggaagtccgttccccattgcttttgttagccccatcaaagatcagattgttgtaggtgtgcagctttatttctgagttttctgttctattccattggtctatgtgtctttttttttttttttttttttttgtaccaatacatgctgctttggttactgtagccttatggtatagttcaaagtcaggtagtgtgatgactctggctttgttctttttgcttaggattgctttagctattcaggctctgttttggctccacatggattttagaatcgtttttctaattctgtgaaaaatgacacttgtagtttgatagaaatagcattgagtatgtaaattgctttgggcagtatggctactttaacaatattgattcttccaatccattagcatggaatgttttgcatttatttgtgtaatctcttagttctttcagcaatgttttttagttctccttgtagagatctttcactactctggttaaatatattcctaggtatttttttgttactactgtaaatgggattatgttgtgatctgattcccagcttggatgttattgatgtatagaaatgctactgatttttgtaaattgattttgtatcctgaaactttactgaagttgtttatcagttccaggaggcttttggctgagtctttcggattttctaggtatagaattatatcatcagaaaagagagagagtttgaattcttattttcctgtttggatgccttttgtgtctttctcttgcctgattactctggctaggacttctagtactacattgaataggagtggtcagaatgggtatccttgtcttgttacagtttcgtgggggatggtcccagcttttgtccattcattgtgatgttggctatgggtttgtcatagatggttctcagtactttgaggtatgttccttcaatgcttagttctttgatgttgttgttgttgttttaatcaggaatagattttggattttatcaaaagctttttccagttcaatgaggtgatcatatggtttttgtttttaattatctttatgtggtaaattgcatttattgatttttgtattttgaaccaccttgcatcccaggaacaaagccaacttgattatggtgagttaagtttttaatttttcatttgtttttattttttttaatttttaatgttttgttgtgatgacctctctttttaattttttttttttttttttttttttttgtgacgaggtctctttgttgctgaggctggtctcaaactcctggcctcaggcagtcctccctcctcagcttcccaaagtcccgtgataaaggtttgagccacaatgcctggctgtttttaacgtgctgctggatacagtttggtagtattttgttgagaatttttgtatctattttcatcagtgatataggcctgaagttttctttttttgtcgtgcctctgcttggttttggtagcaggctgatgctaccttcgtataatgagttagggaggggaccttcctccttgattttttgaaatagttccagtaagattggtaccagttcttctttctacatctggtaaaatttgactgtgaatccatctgatccagggctttttctggttggttgctttttttttttttttttttttttttttaacattgaggaggttattttattttattatttattttttgagacaggttctctctgctgctcaggctggagtgcagtggcacaatgggctcaagcaattgaggagttcattttaaatgtatagtgtaatccacatctaagctctgtttgcagaatgagaggttgatgaaagaaagctcaatgaagctgcagagtcttaatcttgcttttggccgcaccagccctggcaggacctcgttcacaaagacagagaattaacatttgtcgaatgaatgaaggagatgccgtacaaagattgtatggttcctttcagagcctaaatatttaataggtgggtcactgagggtctgaactagaatatttgataagcagacatccagggttgagtgttagatgttctgcagggagatggatggaggggtacctacagggttctgcaagctcagtaatagatgttgttgaagaagaaatataagttagagacaggacaggacacacagagaatgcacctctttggggtcaataaaaaaagggaatgagcccagaggaagcactcaagatcagttgcaaattgatatcccaaatgttttggaatacttctaggaaaaaactctcctacatttcaaagtccagataatactgactccaccctctggcacagaggacttctatggcaacatagcacaggagtggtacatgaaggcaaagtccatttgtcttagctcatatcaaatggtaaagcagagcttcttttattttaatttagctattcaagctgctgaagctatacccaaaatccctagccctttctctgatatgagtctctgtgtttccatattgggagcaatttttttttttttttttttgagatggagtctcactcttgttgtccagactggagtgcagtggcatgatcttggctaactgcaacctccgcctcccaggttcaagccattctcgtgccttagcctcctgagtagctgggattacaggcacccgccgccatgcctggctaggttttttttgtatttttagtagagacggggtttcaccatgttggccaggctggtctcaaactcctgacctcaggtgatctgcctgccttggcctcccaaattgctgggattacaggcatgtcccactaggcccagcgcaattgttttttataactagaaatgtgtttggctttcctccaacaaaccaggaaggtcaagagatatgttctagatacctctttgtggttgcttaatgcagagctcatgcagacacatctgcaaacctaaggaaacgaccctctaaggactggttagccacttaaaatgtgggccaagataggctattaaattcgaatcctcactgcttcattacagcttcctcacattgttagcctacaaactaagttaaggacacacttaaattccagaagttgatattagtctattcagagttttaatctcttcttgattcagtcttgggagattgtgtgttttcaggaatttatccatttcccctagattttctaatttgtttgcatagagttgttcatagtagtctctgaggatcttttatatttctgtggaattagttgtaatgtcatctttgtcatttctgattgtacttatttggatcttctgtttttttctttgttaattaagctagtggtctatcgatcttgtttattctttcaaagaaccaactctcagttttattgatctgttgaatggatttttccatcttagtttcatacagttttctctagttttagttatttattttcttttcttctcctagttttagggtttgtttgttcttttatttcctagttcatttaggtacaaagttagatgattgttaatttgagatctttctaacttcttgatgaaggtgtttatcactataaactttcctctaaacaccactttagctgcattccagagattttgataagatatatcccgattttcattaatttcaaagtatattttggtttctgccttcatttcagtgttcacccaggagttattcaggggtaagttgtctaatttttgtgtatttgtatagttttatttttttttttagaaagtgtctcactctgttaaccaggctggagtgcagtggcatgatcatgggtcactgcagcctcaatctccccaggctcaggtgatcctcactagccacccagatagctggagaactataggtgcacatcaccattcctggctactttttttgcatttttttgtagagatggggtttcaccatgtcacccaggctgttcttgaactcctgggctcaaacaatccacccactttggcctcccaaaatgctaggattataagtgtcagccactgtgccctgcttatttgtgtcgttttgagagaccttcttgatagtgatttctatttttattgtactgtggtctgagagtgtgcttgacatgattttgattgttttgaatttactgagacttgctttatgactaagcatgtggtttatcttagaatatgcttcatgtatagatgagaagaatgtatagtctatggttgttggatggagtgttctgtagatgtctgttaggttcaattggttgagtgtcaagtataagccttgatgatctgtttatcaccctgctgtcagtgggtattgacatctcccattattgttgtgtagctgtctcagtctttttgtaggtcaagaagaacttgttttatgaatctgggtgctccaatgttgggtgcatatatattaaggatagttaaggcttcttgttggagtgtaactgttatcattatgtaatgcccttctttgtccttctttattgttattggtttaaaatctgttttatctaatacaagaatgatgactcccactgtcttttgttttctgtttgcatggtaactctttctgcatccctttactttgagtctgtgggggtgtcattagatgtaaagatgggtctcttaaaaacagaagatgattgagtcttttatttgtatccagcttgccactctatgtcttttaagtgggacatgtagcctatttacattcggggttagtattgatagatgagattttgatcctttcatcatgtagttagctggttgttatgtagacttgattgcatagttgctttttagtgtctgtgggctatgtgcttaagtgtgtttttgtggtagcaagtgttgttctttcaatttcatgtttagcattcccttaaggacctcttatgaggctggtctagttaaaactaattccctcagcatttgctcatctaagaaagatcttttttctccttcacttatgaagcttaatttggtaagatataaaattattggttgaaatttattttctctaagagtgctgaaaataggctgccaattttttctggcttgtgagtttctgcatcaaggtctgctgctatcctaatggagttccctctgtacatgacctgagccctctctctagctgcctttacatttttttcttttggattgacctttgtgaatctgatgactatgtgccttggggatggtcatcttgtgtagtatctagctggagttccttgtatttcctgaatttgtacgtcaacttctctagtgagattaagaaaatttttgtgaactatatcctcaaacatattttttaagttgcttattctctcttcttctctctcaggaatgccatattggtcatagatttggccactgcacataattccctatttctttgaggttttttttttttttcattttaaaaattattattttttctttatttttgtctgattgagttgattcaaagaacaagtctttgagctatgagattcttttctcagtttggtctattctgctattaatacttttgattttattataaaattcttctagtaatttttcagctctagaaattcagtttgattctttcttgaaatggttatttatctttcagttcttgcatgattttacttgattcattggattccttggattgggtttcaactgtctcctgaatctcaatgagcttccttgccagccaggttctgaattttatgtctgtcattttagtcgtgtcaggctgtttaagaagcattgctggggagctggtttgcttatttggaagtaagaggatactctggctttttaagttgctacagttattgcactgattctttctcctctgggaggactagtgttcttctatctgtggtgtaagttgggtatagttggttgtctttgtttctgcgtgttttctgagggtcaaggttctgtataatgtctttatttatggcttaattcttgcccatggtttcacaggaggatatattagcaaaatgtttttggtgctgtagtttgggctgcaatcctgtagatggtacataggaataacggtcagtagataggctcttactcagctgtgcagctcctgtgtatttccttgcatttgcagccatgctctgtggtataggggggagaagagatgacctcctcaccaggcctgctcctgggtcttaggaaacccctctgattacttccaccatgcccacatttattttgttaggtattctgggccatgggcctcccttgggcagaggctataacatggagatagactactccctttctggactggccttgcagagggaggcatgcctcactcccatgccagtccatgaacccatgtgtttcacccatttcagtgctgtgagagtgggctcctcccccactagagtgttgcatacagatctcagcttagcattcccgaactgtgcaccacagccttggggcaccaggactggctcgcagctctatcctctagacgttcagggttggtttctgggtgcactgggaaatccaaagtgctcccaggctgctgtgaatgtactcaggtgaagcaaagcatccaggctgggcagcataggctgtgccatgtatacattcctgtgtgggggaatggggggtatccaggtagaggctctgggaagggcttttgggcaggagagcctgcgaagtagacataccctagtcctgcaggaaagccagccccactttctcctggcctggcagtcagttgggcctagagattctcagaggaaaatggggatccctgtgggatgggcacctacctaaggccatgccctactggagctctcccacacagaaaggctcctggctttgcaccagctgaagcgttgtctctacctactctctgggtagattcccctgccagctcaaatgtctgtgggggacatggaatcccctgtagctaggatcccagaggttcacagtgagagtgggcagtcccacagcttctttactcacccctttcccaggagccatttggagccgaaaactagccataacgttcaggtaccttatacacggttcccagattcctctctcttcagcctcagtgcctgcgtcacatttccatccactcttggcatttttctctccaaagatgtattcaaattatgttgctttacttaacattttggtccctcttggcgggaacagtgctttctagctgtgtctagtaagccatcttgtcccacttcctagctgtatttttttttatctgttaaccatcctttggctatccctctcccttccctacccttccctgcctctgataaccactattctactctttacttcatgagatgtattttttagcttccacatacatgtgagacaaatataagcggtatttgtctttctgtacctgacctatttcacttaatgtactccaggctcattcatgttaccatgaaagacagaattttgttctaaaagaccattcttttttttttttttcctactagattactgaagatcggaacatttcatagcttatcatgttagctaatggtgtggggaaacagacacactcaaatgttgttgagggtttattttgtgtttttttgtttgtttttgagatggagttttactcttgttgcccaggctggagtgcaatggcacgatctcagatcactgcaacctccgcctctcgggttcaagtgattctcctgcctcagcctcccaagtagctgggattacaggcatgcgtcaccacgccctgctaattttgtatttttaatagagatggggtttctccatgttggtcaggctggtctcgaactcctgacctcaggtgatccacccgccttggcctcccaaagtgctgggattacaggtgtgagccactgtacctggccattgttgaaggcttgtattggtccaattcctatggataacaaagaaactaggaataggatttaccttcaaggtttttgggaatttctcaccactggcctatagtctcattaaaaatctactactttttaaaccttttaaaaataaatgcaatatttaccttgttgctttgtataccacctgcacaccagtgttactggtcagtggggcagcactactacattccgagtatcacttggtaacatgagagaattcaagaggaaatgtatagcaaggacaaaatcctaggaaaagtctagcatttatgaagaaagaagagaatgaatagaggcatattacaatcaggaatagacttactaataaaatttcaagaagaatgggagtaaatagtattaaatgccatggagtgctcaagccagttaagtattgagccagtgaaactattgaaaccatgtaattgttgaaaagtaggtttttgatagccttagtaacaacattttctgagaaatagtggagaaaaatcagaacatagtagaaaaacagatgagtctgtgttgagaaagtaaagagagtagcttagactgtcctgaaaagtttttgttagtgttgagaaagaagtgagttacaggttaaaatagaggacacacacatgcatacaaaaaaattaatagctttgtgtaaaatctctcaataatgcaataatagaccaggtaaatacaacataaataatgatgttaccaataatgtaattttggaatttttggaattgacataagctttcatggagatttttatatgataaatgaaaaagtaacatacgcaaaagcctctattcaaattaatgacttggctgggtgaggtagcacatccctataaccccagcactttgggaggccgaggtgggaggattgctggatccctggaattagagaccagcctgagtaacatagggagacctcatctctacaaaaaaaaaaaaaaaaaaaaaaaaaaaaaaaaaaaaaacttagctggacatgctggcatgcacctgtagtcccagctactcaggacactgaggcaggaggatctcttgagcccaggagttcaagaacagtctgggcgacatggagagataccgcctctacagaaagtaaaaaaacttatccagatgtggtggcacattcctgcagtctcagctactcaggaggctgagatagaaggatcgcttgaacccagaaggttgaggctgcagcgagccatgattgtgccactgcactctggcctgggtgacagagcaagactgttgccaaaaaaaaaaaaaaaaaaaatatatatatatatatatatatatatatatacatatacttatgtgctttgtacattatagacataataaatggtagataatgacatcagtaaccacaaagtcaaattatacagcaatacttcatgtaattttgattccaaataaatccatattagtaaaagaaagccaggagcattgtaatagcttttgtaaattagccaccaaggtagtcaatttacagttgtatttaatagactagtgaacagaagggttttgagagtgggaatgattacaatgctgttgcataaattggagctttaggaaagcactgaaggaaatggtgtccagttaatcattaagatattcttcacgtgcatatgaagaataatttgggaaaacttgacattcagataagactgaatataattgggttaaactgcaataatacatacatgttctctattttcttgctattatcataatgtacttttaaggaagaggcagatattgtaactgaaaatcatggatacagtaaagccatttcagttctttgttacagttgtttcctatgagaagaacatgagaaatgatcttatagtattgacagaaaaggagtgttgacagctgactgttgcaaagcctccagtgtaattattccacctcccctacggccagggatcagtgtttttcatatgacccatacttctgaaaataatgaatttcaaaatgtctgttccatgtacacagttgttgacatacacaaatatttagctatctagttctagaatccccttggtgtttcatccatctgaaactgagaaaagagagcagagtcagtaacagataagccctcgttgctgttttatttatgtatttgtttatttatttatttatttatttctgtactgctgcatctagggatgccttccactggatgcctctgtgtcaactgcagctctttcaggcaatactatgagacaagattaactgaatttcaaatgtatgagactccactcacagaaagggtgttctattcatactgaatctttctataaaaatgcaaaagttggatctggagaacagaaaaaggaagagagctgcattcacagtaggataaggagattaaataggaagagttatgtgatttatctcttttatgaggtgctgctggaaagcagattaagctttttaaaaagtggtgaccttgatataaatttcatatttagccagtgctgatggattttgaataatgaagggtatgtgcaacaacactgagcctgagaagatgcaagaaatgtagtgaagttgaccataatctgagtgctaatacatcactgcaaacaacagtaacaggaataatacctattgtgtagcagtttgcccattacaaaatacattcacaccaggatgctatttacttctcacaataactctatgagattaagtatccttagaatttgatgatctggtgctgaagttcaagaaagatgttacttgttcatagtcacacaacttgcaaataaattcctctccctgtgaaaatattctcttcttatattcattgtcacattcggataaagattggacccacttgtattttatttctaacacttttaatcatacctctaacataactctatggtattacattctgacaactgaaatgtaaagtgttttatttctgcattgtctctgttgacatgaatccttaatataatgtcatattctgagcatgtttatgtttataaaaaaatacaaatcattaggccattttctttttccaaaaatgaccggttattgccgagtaaagttactaggttgctggtattcaagccattcgttattttaatgaataataggtaattcagattaatggatttccattctagcaagaaatctctaaaaattacatggacttgaactgatattaaaattgtatataaaggaatggaaaggaaaccaactgtgaaatgtgtccaaatcatatagaataaaaaagttcccttccccaaaaacctaactctgcttttaaattctactaattcacagtgtaattctgctctttccttttttcctgtttttggctttagatacataaataagaggctttaatcatagaaaggaagctggaaaagtaccttaacttattacatttaccatgtttgaacactgttatttgtaatatttgcaaatgtacaactatataatttgtttatctttttcttttacctcatgggagacttctaggaatttatatataatgtggattaaacacttagactatttgttccctaagctactgtattggccaggacctagtcagttaaagcaaattcattccagatagttcagtagaagaaacttaacatgggaaacaggatatcaatatgctagaagagctgaaatgacccagaggttagcaacattaggaaaccactaccacccctatatatgaagggacaaagagaagaaggaagtcatgttaccagaacccagaaactgaaaggatagatcccctcttgtaaaaattcatcaccaatgccatttgtgaggagaaactgggaaattgagaaactacgtatgggataaagtggtaaacaaggcagataagactccctcatgcatgactcttacaatgttatggaggagaaaatatataccaatataaagaaagaagacaaagaaaagatcagttagtgataactgagaggataactataaatataaaactgagtgtatgaaaaaattatgagatttattcttgtggattatttttgcattaatttaatttttgaatattgcattgaaatattatctatcttaactagtgagtttatggcaccccctcattcaactcatgctagttccattggggtaagcccatgatgtttcaaaggactttcagctattttgcttgagcaattcggtggatggtgtagtatatgtcacaaataaatgaagcaactttttaagatttcaaaaaggcataataaatagacatttgaatatataaatctagaattcagagctggagatacaaataaaggagacacaacatagaaatggaatttagagtgagagggttaaatgagattacatagagggcaatgaaatgagataatgcattaagtctttttgaaatgatggcttaaatgaaatataattcatatatcatataattcacccatttaaagtgtaccattctaattttttttaactgtggtaaaataccacacaattgaccctttgaatcatttttaagtataaaactagtggcagtaattacattcagagtgttgtgcaaccatcaccactatctatttccgaaattttccatcatccaaaatagaaattatttacccatgggcgcagtggctcaagcctgtaatcccagcacattgggaggccgcagtgggtggatcacctgaggtcgggagttcaagaccagcctgaccaacatggagaaagcccgtctctactaaaaatacaaaattagccgggcatggtggcacatgcctgtaatcccagctgctcagaaggctgaggcaggagaatcgcttgaacctgggaggcggaggttgcggtgagccgagattgtgccattgcactccagcctgggcaacagagcgagactccgtctcaataaaaaaaaaagaaaaagaaattctttacccatgaaacactaactttccattccttcctcccaccagctcctggtaacctctactctactttctgtgtctatgaatttacttatcctagggacctcgaataagtttaatcatacaatatttatccttttgtgactgactgatttcacttagcctaatgttctcaggtttcatccatgttgtatcgtgtatcagaatgtcattgctttttaagtctgaataacattcctattgtatgcatataccacactttttaatcttttcatttgttgatggacatttgaattgtttccaccttttgggtgttgctgctatgaatattggtgtacaaatatctgtttgagtcccttttttcaattattttgtgtgaatacctaggagaggtgttgttggatattctatatttaacattttgaggaactgcgaaactgttttctacagtgactgcaccaatttacattctaccagtaatacacaagggttctaatttctccactccttgccaatacttgttgtccaacccccaacacactttttaaaaattttttttaattattgtcttttgagacggagtctcactctgtttctcaggctggagtacagtagcacgatctcagctcactgcaacctccgcctcctgggttcaagcaattctctgcctcagcctcctgagtagctgggattacaggcgcccaccaccaaacctggttaatttttgtatttttagtagagacggggatttcaccgtcttggccaggctggtcttgaactcctgacctcgtgatccacctgccttggcctcccaaagtgctgggattacagatgtgagccaccgttcctggcctacactttttattttttgataatacccatcccagtgtttgaggtggtattgaaaggtaaagctttctatacaatatttcttccttccccagtttgcctctcaataggatataaactccataaaatcaagtactctgtttattcactgctttatccccagccaggccacgcatatagccattgctcaatacatgtgttgtattgactgagtgaatgattttttttttttttttttgagacagggtctcattctttcaccaggctggagggcagtggtgtgatcttgtctcactgcaacctctgcttccaaggctcaggtgatcctcccacctcagcctccccagtatctgggactacaggcacacaccaccacgtctggctaatttttctattttttgtagaagtggagttttgccatgttgcccaggctggtcttgaactcctgggctcaagtgatctgccaacctgagcctcccaaagtgctgggattagaggcatgagccaccctgcccagccgtgaatgaattttaaatgctcagtaagtgagagttgtattcaattctttaataaataatatcatatatttagtcttatattacattgcatcgccattgctgggcttagtgttttctttttgttttattttgttcttatgaaacaacatcctttttgaattggaaatttaaggaaagatatgctgcatatacatagaatgaaattatttcaaaccatgacaggggaagaggagatgaacacgggatgaaagagttgaaaaatatgaaattaggaagtggtgaagaaagtcaagtaaaatctcatgtcctgccttcaaattagagcatcaagcaggtgctatgaacatgtaatttgagggaagtgcctgtgattctcttcttcagggagcacttctggtttgcgttttcattttctctagaccttttatagatgaagaatatcttgtttttccagatgcagatagtctgttatgttctgtctgtgtctgcagagtatggacccatttctaaatgtgctgagttcaaagatgtcactttttatacgaaactctgatcatgagttttggtaaatattatgaccaccttagaaaaagctgcctttgtaaagcttggagaacaaaaagtgatgtgcaacttacccaaatgtgactcacacatttatcttccctatcccttgtctttcacatcgagaatgtcaactatggttagaagaaggcctgttgtgtgtaggatgaaataagaagatcatcaggtgattgtgtgtagcttttcagtgcagagtatctttacaactctatgtcaattttttgccgggcatggaagacacatctgtttgccgtatatgctatcaaggaatatgtgttatttatagctgggcgcagtggctcatgcctgtaattccagcactttgggaggccaaggtgggtggatcatttgaggtcaggagtttgagaccagcctggccaacagggtgaaaccccgcctctactaaatatacaaaaaccagccaggcgtggtggcaggtgcctgtagtcccagctacttgggaggctgaggcacgataattccttgaacgtaggaggtgaagtttgcagtgagccgaaatcatgccgctgcactccaggctgggcgaaagagcaagactctgtctgaaaaaaaaaaaagaaaaaaagaaatatgcgttatttcaaaaccccagaaaatgaaagatggcaaaaaagtagtatggttgagtttaggtgggagttgtttagaaaggttaagccaaaaaaaaaaaaaaaaaaaaaagcaatcagaactttgtagctattagctaatagttcattcatttattcatgtaatatattgagagtacctcctaaatgcctggtactgtactaggcacttaaggagatcattaggcctttgaagtctttagcctcaacaggtcatcagtgaacaaattcctgtaatgaattaccatccatgtgtcaacagaaactgaaatgttcagaaaaggagaaagagtttaagagattaaaaaaaatatatatatattcctggtccctcaaaaagttaaaccatatgacccagcaattcaaattctagatatataccgaaaagaattaaaagcagggacttaaatatttgttcatgcatgttcatagcagcattattcacaatagctaaaatgtgaaaacaaacccaaatgtccaataagcttatgattggatacatggaatgtgatatatcatacaatgggctaatgttcagccaaaagaaaggaatgaagtactgatgcatactacagcgtggatgaaccttgaaaacattatgctaagtaaaagaagccagatacaaaaggctacatttatatgatgacatttatatgaaatatccagaataagcagatccatagagacagaaagcagatgggtggtttccagttattgtagggagagaggaaagaagaataattgctaatgggtactagcttttctagtcttagaactagatagaggtgatcattccaaatcattatcaatgtattaaatgccacttaattataaactttaaaatagttaatggttcattttatgttgtgtgaattttacctcagttaaaaaaatgtgtgtctaagaattcaaacagcatacagcttacttctttattttacatattatgagaagcatacatattaatagtggatgtagcaaaatgaggataaatactgtaattaaaaattgtgattgttggccaggtgcggtggctcacatctgtaattccagcactttgggaggccgaggcaggtggatcacgaggtcaggagatcaagaccagcctggctaacacggtgaaaccccatctctactaaaaatacaaaaaattagccgggcgtggtggcgggcgcctatagtcccagctacttgggaggctgaggcaggagaatctcctgaacctgggaggtggaggtagcagtgagccgagattgcgccactgcactccagcctgggcaatagagcgagactccatctcaaaaaaaaaaaaaaaaaaaggttaaaacggataaagatcaaagaaatcagccataggccctgaagaaattatatgtaatgtatgtaatcttgaacccatgtcctgggcctcagtttccctcagtgacatggtttttacttcttctccctcttatcttttcccttactcttggaatctacagaggtgaagtttgaaagtgttcatgtccaagaataactcagacagagaaatactggactagaattgtatatgcctaggccttctcaattctagtattccaggaataataggttagaaaaataaaaataggaaaattatattgatcactttctactaaaaaagagaagacaattatcttgaatttacagttagcaaaagactgtaggtggagttcaattcaccagttcaacaaaatgtttaaaaaagaatttcaaatgagaaggcagtaaactggcatttttaggttttaagcatctgctcaatggtctcattctaatcttttcaccaagggctgatttcaaccagggttaaatcaataggccctccagagctcttctgaaaagaaaaactaatccaaacaaatctctcatttagtattagtagctacaaacatactgtgtttaagaaagataagatataagagagggacacatgcatagcttcaggcattaccataaagactgacagaacaataaaaaaggaagaaaatggaaggctttaagattagaaataaactttcaaagtatatttaaggtttaacaaactctaagatgctctttccacaatctaaccttgacactttttgattcctaacactttatgtttacaactaatgattagacacgatggtcaaatttctggttgagaagctgccttccagacagttcacttctgcttgagtctgtagtaactgaaccttcagatctgctgccactctgtgctggttttcagtgccaaaggcttatgacacttgaaaaatattatgtgccttcattcttacaaaaaggaaagctcatgacttgaaaaatgaccagtgaatgttagagtagaccatataaaacacagaggcatagaacaacttaatccttttaaaaagttaatcaaatccctggctttcttacacactacttcatgaagtaggaaaagattgccaaacattatgaaaatggtatttcccttagggacttgaggattagcagaatatacaggtcatgtgtttagtgatcctattagaggatacattttacaatcatgtcactggtaattctgctagagtaagagagagataccaaacactacacattatcgtacatagggcatgtgattacagaataattaaaactgtgctacattaaggtatcacataaatggtttttaatatcctttgtcagtgaatcagtgatatacaaaatttccctttccacacatattttccttttttaccttctgcctgcactacccaaatttctgcactttgatctatagttatgcaatgtagtcatccttttaaaaatgaattttaaaatctctgatagcggccaggcacagtggctcatgcctgtaatcccagcactttgggaggctgaggcaggtagatcaactgagatcaggagtttgagaccagcctgaccaacatggtgaaaccctgtctctacaaaaaatacaaaaattagcctggcgtggtagcatgtgcctgtaatctcagctattccggaggctgaggctggagaatcgcttgaacccgggaggtggaggtttcagtgagctgagattgcaccattgcactccagcctgggcaacaagagcgaaattccatctcaaaaaaaaaaaaaaatctctgatagctcccatgcatatcaactctgaattgtcttctatttcaaagtacaacagtactgagaaacctgtggaggagttcagggtgctgctgtactgacttctggaaactgtatggaagtaattattttgaatttatttttgtgtcatatatcgattacttgtgttcaaaaatatttgggaattcccaatattttcactgaatcagattttttttttcttctttgtaaggcgggactcaaagccagtgcttcagaagtaaatgcttttatatagtagaaaaatatgaagaaaacatagtatttcaggtcatttgctcccttatatcacttatcagattttggggactttaaggacctaaattttcaaaaaaatcaagttagatcatggatttttttgaaaacttgggtcattaaagtcctgaagaaaatttgaaaatttaagtccttaacgtccagaagacgtttattttagactgtaaagtaaagtaaaaccaagggttaagggtaggtaactttcttttgttttaaacaatggtatgtctatatctatatctattatcatctataggtatatagcgtctatgtgtgctaacccagcaccaattgcctcccctagcttatagaagagaccagtgaattagaagtaggagatgtgagttctaaccccatttctaccactaattagataatagaattcgaaaaactcattgacttctttcagcattgggtccctttgctgtaacatgaagacattgaaagaagtaactttatgttagttgtttctccaatatgttgtgtgtgtacctggtgtggacctcacggtcacccttgccagagacaactagattttttttttaagtctatactaatattctttcctcactagaaaggatagtggggtgtttactctcagttgtaaataactctgttttctctgcctgtatgcatgtcctgtctctctagccattttataaatactgaaaccagtaatcatgatttaagtttttgtgtagactgcagctcatctgttataaacaataaaagctgagtaaatatgtgctaatggttttaccataagtcctgtaggagcattctctttaccccatttaccccattccacgttatttccctgacagcagagaaccatagcagttatgtcgcgagtttgatgatggtggaatgtactctttgctttgagagtgtgtaaattcccctcaggggtgtcatatgtttattaatgtgtcacaagttgcttgcttcctgttagctcttctcagtaaataggactatagcattcgttggatactactttatttttagctttttaaatcacctcctgatgaacagaaacagtaaacaagtattaaacatcgaaagtaatttgaaaatagtgccatcctggagagtctggagttccagacattaccagacactcatctcacagagctgaaggagaagttaggaaaataagaatacctaagtgatgctcctctggagccactttctgaagattaggggacatttgtatttaaagaagagaaagaggtgatggctgtggtagggagtccatatttaattcaactttagtcattcttattcaacccactcatatatttcaaatgaaaagtataaggacttatctggatttttaagcttcacactaattagacaccaaagaactgaaggcctcatcatggtagtattttctaatttgttaaacaaacactgtgcgactgtactgcaaaatggaagtataaagaaactgggaatgaaggaggcggtgccgataataagatctaacgcttactgagtgttctaagctctttatgagttttattgtattcgtttcccacagcagcctatggagtctttggtattactttcaccttatcctaataaggaaatgaaagccaaaggagccaagtaactttccctagttttctgttttttgagatggagtctcgctctgtcgcccaggcttgcagtctcgcgatctcggctcactgcaagctccgcctcccgggttcacgccattctcgtgcctcagcctctcgagtagctgggactacaggcgcccgccaccacgcccggctaatttcttgtattttcagtggagacggggtttccccatgttagccaggatggtctcgatctcctgacctcgtgatccgcccgcctcggcctcccaaagtgctgggattacaggcttgagccaccgcgccctgccaactttccctagttctcaaaaataatgagtgattgagcttgaatgagtgattgagattgaacccatgaggttgggctttggagtcttgctcttcacttgaccctgcctctctctctctctctctgtatatgaatgtctcgtattccatacaaagagatatagtacaacagacaaacaaaagtaatcaatagtttgaggagaaaggaaacctaagactcttgtgtctaaacgatttatgtggaagtttcaaaattatgatgcacagatttactttccttaaaaggcctttctgtttttgtttttgtttttttttttaattctgtgttctacaaatctgtatccttccaaaacctaagcattttctgaaagcatatttgaatgtgccctaaaatagttaataggttaatgtagataatttttttctgaaaaaataatcttataatgagcctagaaagagcatgctccagtcagccctggagtaaaattaataaataatgcatgagcagtattgctggcaaacccaaagagggatatctttttcacttgggtgtgaagctcaagctaaaacttaacacactcttttctctcaaagctgtttctttttcagtgttttttatgctgaaagattgactctacctttcatatactcaactgagaaaaattcttgatcatcttggatgcctctctctttcctttgcttcctcactgttacattgattcagtgtcttaagtatattttgaacatgatccctcttttctgtcccaatgtgtattgctttcattggggctgccatttgtttctgagtgaatgcagttgctttctaatttgcctcattgcatttattcttccttacagtcaaatccatttttctcattataatcagaaaaacctttctaagatccaaatttcatcattccttaacataaagtttaaactctttgaagtggcttatgtgactttcagtcttgcttctgtgcatttgtccagtctcaagtcctttatactccagtcactccacattatttgcaattacttaaacacagtaagttgttttatgccttccaggctttgtgcaaaccgttacctcagataacccttcttaaaattgccaaattcttattcagtctctaagatagttcaggtatcatcatttatggagccttcttgtttctttctttgataccactgtggtagttcatatctctttgtagtaattatcatattgaatttcagctgtttatttgcctatctctttccctggattgtgagggcctgaggacagggaatatgccttattctagcaaaattcctgaacacacacgctcaggacttttttcaagcttctgattacctttgtttaatggctaattatttcacctattaagtatctttcatctaattgtaggctaggtattataggaagctagagatgtctacattcaataaagaaccatctaattttgtggaaatattctttgttaccagatataaagcctaataacctacctatctattttctggacattctcactgtgtcatattagcattcaacaaaagcaagaatctaaataagggagctgcttaaatgtcaaagcattagctgaataaggaggaggacttaagagatgttgtgcatgtgtacagacacaaagaggaaccagcagtatcacggagcacctatgacaggccaagcagatttctatccagtatcctttttaatgctcagacaagtgctggctctcccatgagtcccacctgagactcaaaggagttaaataaattgcccagttttgtagagatggtaagcagtgagactcaaatacaggaatttgatggccatgtacatgaataagcagttgggcacttatttaccaaatgggaagttctaaagcaaactttgaattcaatattttattcctctctttcttctcattagccagcaccatgcctgacacatgatcagtgttcattgaatgtcctgagacttaaaaagcaagtagaagtagtgcaatttacccaaaaaacttcatttggtctcaacccttccaaaagatctctgcacaggatttatagcctcacttattccaagttataaacttgatttatgtaccaggaagaaaaaagagatgcttatttaatgacccaattctgtagaatctgtctatcaggatggggttgttcttatgtaacacagtagaatgcttagctctgacaacctggactctaggttccaacccaagtagatatgggtcgataaagatagtaactttgcaatacttttatccaagaatgtgttctgcccagactcagtaactactcgtcttagcaagacaaccaatagtgtaacttttatccaagaatgtgttctgcccagactcagtaactactcgtcttagcaagacaaccaatagtgtaagagtatgcagcattattcctgaacctcactgtgattaataggccagttacacttttctacttctattgaatttgccaattttagcataagcccaggcttgactttattctggacctaaatcttcctttattttttttctaggtacaaaatatctattaaacattttaaaacttaacctgaatgtaaaacaaaactttttctctggcaaataaaaacaaataaatatacatttagcttcacaagagcaagtattgtttagctgggtagcaagagagaaccctgtggaataagtcaagataccataaaattagttaaacagtgaagtttttgcttttcttttaagtgaattaaatacactgccttggcagcacttgctttttgttcacaccaggtcactgtatttattctgctttgttacagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggtatggactgcgggtggttctatttcctattaacaaattaattgtgccttatattctgggacaaattggatagaaaacttagatgggtgtgatatagtttagctttgcctttctagaataatatagcaagttgtactggtcattatatgttttttaaccaatggctttagtaaattctagtcaatgtttgtattggtaatccactgtaataagctgttgtgtttatgtttatattttatttccatggacaattctttcaagtctactatggtctgggttgataatttcaggaactaaattaccttgaaccttcttttcagggttcttcacattagcatttcaaagtgtccccaaacaaaaggaaaaaggactgatttttttccaggataaaatcgtatactagtttttcatggaatgttctgtttaatggacataattttgtccatattctaatctttttcatgtataaacataaacattttaaagaaataacatctgaggaaattgtatgacaccagaaatataatattgaagtaactttcttccaaaaccagttgaaactttaaacttaaacagaataatccaacctctgactttcctatcaccatcattgatgtttatttactgatattccagatttgaacataattttaagcttgtttatacaataaaagaaatttttgttattgaatgtactcaaaaaataaagtatagatgctgtgaacattcttccagaatattttatacatagtttaaagaatccttatgtaacatttgctttgtctaactcactggaagtgggactttagaaactgggcctctttgtaactagatccacaaatgtcagtatacagaatgtgagccctcatgacagactgaagatgaattcaaaaactgttagaaataaaacaagaaacaaacctttaacaattttaaaaaagatttttccaaaacagcaatgctctttcctaagtaagacttacttttgattcttgataatgtgaaattgtgggttcagaacatcaagggaactgttggaagatttttatacttgtcccttgcttgattttcaatcctagaccatgttaaatggagctcaaatattagtcctgctggtttctgttactgtgggaatgaattttctttttctctttttttaattgttggagtatttcttatccttaaccaccctcacatctcaaaccaccctgtggtttgtctgacttccacaggcagattctgaggcaagccctgatgattgcttcaagggggagtggtattaggggaatttgacccaaagtctccaaataaacccttttttttcttagtactcatgtgtgacatcagcttctaaatatgcagtgtctttgttgttcactaataagtttattttaagagttgtgtttcttttctcaccttttgcaaagagcatcttaaaatttgctgaaagatgagagactacacacacacagtgtaaaaagtggctggtcctttagtcctatttccaacattgccacaataattttgaccttaagctatgcagactagtgaagtggtgggtggggatgcagtatatgtggtatttaaaagtcataacatttcagattatttttccatagtcaaagattagcccctgtagtctaaatagcagagatttaagggctacttctatagtggaatactataaaataatcaatctggctaaatgtagatgtcacacattcagtggaaaatttatgcaattaccacaagtcatgcaactaatatggcatatacagtgtatattttggtcagaaataacacgaaaattgcccccaattacacaaaggcattgagccacataaaataatgttctgcaaaaatttgatttggcaatacaattttttagaaacaatattacccctgaagaatgtcaaatgttttaaagctattttatcctcgttccattgatttcaaatctggctagaggaaattgacttctgttttggcaaaaacagaaatctcctgagccaacatcattattattcaaagcttaattcagagaccataatttgctaagtctattaacaatgaaaacagatatttatggaactctaaagaccttgcatataaatgttgattgtttcatggattatagcatgcatacactatgaagagatttaatttttactaaatgcaaaactaaaatgtttcaaatattgaaatagaatttaggtgcaatcattgaacggtgcaatcttttgtacagcaaattttctgctttccagtaaaataatatggtttgtattttatgttatcaatttcaatatggttgatttcacaataatgaaatgtgaaatatctgtttccaaaatgatgtcacggatagtcttagcatacatctctattcttatatctaataaatcagtacatatctggtttagatatactaatcttagaagttaattgacttttccaaaaaaataatcttcagattgaagtattcattggttcaaaaatgtataatgaccagtgcaacttgccatattattctaggaagcaaattgattccccagagattttgagaagaaatgaaattatttagcattagtttcaaactttttagtccctttaaaatgcaattttagaagcttttgttttagttatttaaaactgttctatatttttccattactatatgtactaccaaaattgtatgttcttcatataggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacaggtaatcacagtcttcaatatttcacttgcaagtgatgaaactactattttaagttagtttttatgctacacattgatatttttactctctaaagaattacataatcaaatgctaagtggattcctataggtgaaatttattcctccttgcttttgaatcatcttccactgaagtccattcaaaaggctagagacaatatgtttagggagttatagaaatgttaacttttgggccgggcaccgtggctcatgcctgtaatcccagcactttgggaggccaaggtgggcgaatcacgaggtcaggggttcaggaccagcctggccaacatggtgaaaccctgtgtctactaaaaatacaaaaattagccaggcgtggtggtgggcgcctgtaatcccagctactcgggaggctgaggcaggagaatcactcgaacccacgaggcagaggttgcagtgagctgagatcgtgccattgcactccagcctgggggacaagagcaagacgaagtctcagaaaaaaaaaaaaaaagaaatgttagcttttgaaagtacttgaaataaaaatgagtttatggtttccaaaaattatgcttatattttataatggtatcgtttttggaaacatttcctagagtggctaaatagaatatatgaaatctacctctgtcttcctgtcttgctccaaattagaaaagtcgcttttctcttttatttatttatcactctatcaatctgacatacatgtcctcatgaacttgaaaatagcataacttcaggtgcagtcattgaataattatgtgagatgtgatgcatagagtcattttcatagctggttgctaaggtggaaggacatgaggacaagattcagaacactacctgtaatcatgaatctacaactcactagtcacataggttggtggagttaccacagccttcagcatattagtttcttcatgtataaaatggtgttgataaaatttgctgttcttatttcatagggtttttgcaaggatcaaatgaagtaaggtaatatgtatgacataaatttgcaaaatgcagaattatatccaaatgtgcataatttttgtccatgaaaattgcattcatacattttttttctttatagtgcatttcttacaaggtggtttcatgagaaaagtggggataataagaacaacattcagaaattaaaaatattattctcatattcttattgagagattcttcttggtgacttttgtgtatgatcatacttgtaaaacttatatagaaaagcataaaaaggacattagctgttttaaattaaacagagttttatttgttcactggtccacttaaaattagttttccctgtatatgaaaagtgttttgtggtagtcacctacatcttataataatttatttcttttaaggtatctggctatacttgagtttctatacaatcaattttgaaatttgtttttcatctgttacttaattttttcctttaatctctactgaagtggtttttcaaccagtagtattgaggcaaaggaatttaaaaatataaagtaaagcaatctatcctgaatagaaaatagaatgcacttctagtctttattcttcagagtggagaactcatctttagtaagcacctctttcccctttctagaaatgctaggattctaaaccagtacctagtatgagacagttggagcacagtatcatggatactgaacactgggctctgaatggtaaaacagcttgtgtaagactattttatagaaccaaaaatagaactctttatatcctaaatgctttccagggcaaccgtactttcctaaacttcatttgtcccaaaatatcttgttttctttatataaaaacaaagagtaattgagtcttgatattcaagaggaagataaagttttaatgaaagttttcattccacttattatcataaatacttatatgtagccttacctgagacaatgatttgggcaaataaattatgaaacagtttgactggatgtgaaattttgggttaatgtagagctacatgccctagaattaagaacagtatatactaaaatgcattttaggtattaacaacaagtctactgggaagatatatttatgtataacattgttttaaatggtgtgacactatagcgcatttactgtggggccaaattaaagagcagttcttaaaacccaaattatattcctcagttaaagcaacaaacatgggcagtatctgaatgataaggaatcactgttttttatcttggttttctgcacatcattatcatattttacttaatgaaaatattatggaaaacataatattatttggttttagtggaatttgaagtttgttataatgtcactttaaaaaaaaaaaaaagaggaatcctatacgtaaaaaggaaatttctggccgaaggaagtggctaaatgtgcaggcagcatcgtgagcttttatgggtgatcgatccttcccttattgaaaatgtatatccttagctaagtgaagtactggttcaacaaaacagatcacagtgaaaggaattataaacctgtccagcacttttggtattttaaacatctttttttttttctttgggaaacagtttctctcttgttgcccaggctagagtgcagtggtgcaatcttggctcactgcaacctctgcctcccaggttcaagagattctcctgcctcagcctcccgagtagctgggattataggcccgtgccaccatgcccagctaatttttgtatttttagtagagaccgggtttaaccatgttggccaggctggtgtcaaactcctgaaacattctcaatttttttcttttaaattaaagatgttacggcaccatctctagcctctatcttttattagccttacccacattgaagttcttactccaaatgtcctccctctgaactcttattcatggttttctccctctggaaggttttttatcttctcctttgtcacatccctgattctcaccctttcttcaaggcacagctaaaatgttatccccttgttgaggcacgtactccatgcatccacagcacttttagcatctctattgcagcacttacctcattgcatcaaactatttaatgacactcctgtattttcataagaatgtgagcaacttagagtcaagggcaatgtcttttattttttaaataagcatttgattttagaacggttttagatttacagaaaaaacatagtagaaatcccatctagcctgcattcagttccccctgttattcacatctaatattaatatggtatattcgttatagttaatgaactgattttggcacattattattaaataaagtccgtagtttatttagatttctgtgctttttacctgatgtccttgtttctgttccaggatcccatctagaatagcacataacatttagttgttatgtctccttaagatactcttggttgtgactgttttacatttttttttatttttgatgacctttacaattttgaggagtattttgtcgaatgtcctatatttgggatttttctgagattttttcatgattaggtgagggttataggtccttggaagaaaaaacacagaggtaaaatcacaacatgtcatatcagcctgacttatcactgttgatgttgatcttgatcacctgaggtagtgttaggtaggtttttccactgtaaagttactctcttccccatttttatactgtagtttttgtcatccatgctatatgtcatccatgctaaaggagtgagaggttatgttccacctctctgagagcagaatgtccacatattttgtgtggtattctgctacatgagatatatgtctgttctcccacatttatctacttattcaattgttgctctataccagtttggacttaacagttattttatactttgctttataatccaaattaccttatttattttgttgctcaaattattacagttttggtcattaagagctcttttagttggctcctttgtccctgtgacatacttatattggggtgtgtgtgtgtgtgtgtgtatgtatgtttgagtactttcctactttctggccctttaagatgctctaagctcatcttgtatatttcctgccccagtccctacatcagatatattttttcaaagatgccatgttgcttttattggagaattataccaaaaatgaataccttcatgttgagagtactcattgctactgggatatagttgttttgaagcttttctaatcgacaaaaaaagaaaaatgtgtatagtaacacataaacatatacacatatctatagatatttatatgtgtaaccacctgtgtttatattaagttaaacatgagttcatactgatgtttccaactctaatttattaccatatggatcattttagcctcttcccctaccttatgtgtaacctcccaatccagtagttagaaaactggttctcaccatctgccattcttttactgaattgttcacttccagtataaatgtatagtgagatcagaatttgttaacctgtgcccatgtgggaaacaactttatcaattagaatatggtgtttacgtacaattgttttagcatttagccttacagacttcactcatttccaaagttgctaaggtcagcacctttcccctcacctgcttcagtgaggttatctcacatatttgtaatatagttagattgttttatcatattctgtatttcccaggatcctctgacctcctgaattatatttaaaatttgcatacattaaggttttctctttgtgctgtgaagttctatgagtttaaacaaatgcatagtgtcatgtattcataattaaaaagtaacagaatagtttcactgccctaaaaaagactctacacttcatatgttcagcccttctttctgccttccgaatccctggaaacaactgatctttttaccataactatagttttgctttttccagaatgtcatataattgaaatcatacagtttttggccttttcagactggcttctttcacttagcaatatgcatttccttcactcctttctgccttccttccttttaattgagcattttatctcttccatttttacatcaattttccttctttttagatatatattttagtgatagccctggatattccaattttaaactaatctcagtccaccttcaaaaaacgctgtgtagtacagataccttattacagagtactcccagttcctctctcctatcctttatgacattgttctcattcatttcacttacccatattgtataatcacccaatatattgttactgttattttaaacaaagttatcttttacatcaatttagaataagagaaataaaatattttattttaccttcatttattccttctctggcactcttctttatgtagatccaagtttctattccatacacttttcttctgcctgaaaaacttcctttggcatttcttgcaatgaaggtccagtggtgatgatgtcccttagttttcatttatcagagaatgcctttatttatttttcccctttgaaaaagaattttgctggatatagaatttttttgtttgtttgtttgttttgttttgttttgagacggagtcttgctctgtcgcccagggtggagtgcagtggcatgatctcggctcactgcaacctctgcttcctgggttcaagtaattctcctgcctcaccctcccgagtagctggaattacagacacgtgccaccatgcccagctaatttttgtattcttagtagagacggggtttcaccatgttggccaggatggtcttgatatcctgaccttgtgatccgcccacctcagcctcccaaagtgctgggattacaggcgtgagctaccgcgcccagtctggatgtagaatttttgattggtacttttttcgttttgtcactttcaatatgccactccactcttttattgcttgcatggtttttgatgagatgttcactctgatacttatctctgtgcctgtatagatatgatattttctctgtgttctttatttatttatttattttttttgagacagagtctcgctctgtcgcccaggctggagtgcagtggcgggatctcggctcactgcaagctccgcctcccgggttcacgccattctcctgcctcagcctcccaagtagctgggactacaggtgcccgccactaggcccagctaattttttgtatttttagtagagacggggtttcaccgttttagccgggatggtctcgatctcctgacctcgtgatccacccgcctcggcctcccaaagtgctggaattacaggcgtgagccaccacgcccaggctctgtgttctttcaagattgtctgtgttttttttttctctgtagattgaatatggtatgcctaggtatagtgattttgttatttatcctactcagtgttttatcagcttcctggatttctggtttgatgtctctcaattttgaaaattccatgaccattattatttcagatatttactctgctccattctttttttttctacttttgatattccgattatacatatattatgccttttgaaattatctctcagttcttggatgttcttttctgtttttatcattcatttttctctttgcatgtcagttgataaagttctactgatctattttcaagctcacacattgtttcctgaactggtgtccagtgtactgatgagaccatcaaagggcttcttcatttctgttacaatgtttgttttttaaaaactctagcatttcctggctgggcacagtggctcacgcctataatcccagcactttgggaggccgaggtgggcggatcacaaggtcaggagatcaagaccatcctggctaacatggtggaaccctgtctctactaaaaatacaaaaaattagccgggcgtggtggtgggcgcctgtagtcccagctactcgggaggctgaggcaggagaatggcgtgaacctgggaggcagagcttgtagtgagccgaaatcgcgacactgcactccagactgggcgacagagcgagactctgtctcaaaaaaaaaaaagcaaatctagcatttcctttcgattctttttaacattgcaatctctcttcttatattacccatctgtgggtatcgtggaggaataataccctccatacagatctcacactctacttttattaatatttaggttggtgcaaacataattgcggtttttgccataactttgcgggtttttgccctggaaagtaaaggcaaaagccgcaattacatttgcacgagtctaatactaccgagttttacataaaccttttcatttcctacattatattgctgatttgtattgagatttaagtcaaataacatcagttttcttatattgttaagtcaaatgcctgcctgtggttgaacttttaggtatgaatacagtgctgagtattcctatagagatgattatgttcatttttaatacgtcatcccagtgtatgaagataggttttatacttgattctgtcttacactataataacttctcttccttgacaaaagtcattacgttttttgttggaagatatgtctgttttgaatggaaacattgtttaaaatgttatatttaaaaggctctgtataaagctgtgtaatatgcttttatattttttctggaatgtattatttcacctctctttagtgagagatttttatcctaataagaaatacagaatccagtacatatttttacttatttcttttaataataacatatataaccaaaaagtgtataaaatgtaaacaagtagctgcttagcatgctatcaaaagaactcaactaggcaaagaaatagaatactgtaggccccatagaagcccccatatgcccttctgattataaaccccttcctctccactactggataggtacctcagtatgtgagttttggggtatttattttcttgcgtgtttaaaagttgtattagctgatagtgtatgacaaagcgatatagctacattttgcctggttttgaaacgtataaattaggacccacatgttgtgtattctgtctggcttcttcaactccaaattttgtttcaaatatgcatgtatgttattccattcatctgtactttattcattattcttatgctatgatattccattatatgaaaatctcagtttgttgatagacattagggcttgttgtaattttttgcttatgtaagtaatattgccattaaccgtcttatgtacacacatatatacacacaaacacttacatatttccttgaacatataagcaagcaattctgtaggatttttacctaggaaaggatttgctcattaaaagtatgtatattttcaaatttactaactattgtttgggctaatttgggtcatgggcgtatcctaaccgaattgactgtagggaggagagaagtactccaaagaaagttggaggtgccaaaataagtggaaattattctaaggaacataaaaagccattttctactacttctacacattatgatttcttaaagattataaaatataatttgatatgcataaaattctgttttgcattgtgtaacaattttctatacttccatattgttaaataaaaatgtgaaaacattcaactttgtattgatatacattgccatatcctaggattccttgcactaaactctaactcacatccagactacactataaccctagtcttctgccagatatatgtgggaatgtgggtatggggaaaacgtcatatccagaggtggtccataagcaatctagtgattccaaaataaattaaatcaccttggctcatcataaataccaactatgtagacaaaaaatacaaatattagtaatgatacatatttttggatttgttaggtctaaggaaaaaaatatacactatataggatttttttagatgtattgattacattacatgattttcatttttgcccatttaatgcttatttccccttctggccaaaacatttttctattattttaaaaagaaagatttaaaacaaagtaacaactgtattgccatcataaagtttggaaatgagtcagaccagttgcaacaccatttaatttctagggtcagatcatagaattaagtaatggtaagggaataccttgttaaaatgttatgtcagaaaaaattttcccaagtaaatttgagagtcagcaagcagagtgaggaagtgaagaaaggaaaactgattcgaaaagaagcaaaaagaatgaggtgattgttacaaggatgtgatagttttagtagcatttttatcctttatataactttttaacagttaatacagcagaatattcaaactacttcccaatcgaccacagactgaatttacgctctcaaaaggtacatcttcctcctcttttaatggatgaggaagctgaggcaaagaaaggttaagtggctttatcaaggtcacaaaacgtcacagtgacaaatttagaaataaaatttaattccctgaacctcagtctatgatttactccactggataattaatagcaaggcattgtagtgttcatattagctctgctgatcgctatgagagatttatattttaagtgcaacggaaacacatttaactgagacctctaattcttctgccatggatgtaattaagcagtgtatttgtggtctagcctggggatggagtattgcttctttttcttcctatttctttcaaaaaattgcgtattttatttctcctttaaaaaaactgtttttgttaaattacttcatggattaaagtgtgctttcactgactacagcctaacaataattgatgaaattgataaaaggggcagatctttccagactttactttgtatgtttgctaacattccaggatccatacccacaaaaaccatcatgtatattatttttgatgaattgacatatactacatttctagctgttttataagtaaatatctgccatatttttgtaactcaaatatcatttagattaattcacacttttgaattaaaagagaaaaatgctcataaatatggtgaaactgaatttaatcaacttggctatctaatgttgatttggagttgaattcctaaaacaaaagagctctttcatgagtggtttccaataactgtcctgaaaccactgacactcattacctttatttattatttaatcttaatatactaaatgggttgttcaaaaatgtatgaatcaaattaacatttattgttaaggtgtagtaagtttgaataaaaacaagatgtttttactcttgagcagaaaacgtatacattttagaacatattcatagcaaggttggaatgtgccatctctggccatggggaaaacaagacatcataaacttgaatgatttccattaatacaagaaaaattaaatattaataattagaatagttaacacctactgagtgttcaccgtgtgccaggatctgttctaaattctttttttttttttttttttgagatggagtttcactcttgttgcccaggctggagtacaatggcacgatatcggctcaccacaacctccgcctcccaggttcaagcgattctcctgcctcagcctccccagtagctgggattataggcatgtgccaccacgcccggctaattttttatttttagtagagacgggttttctccatgttgatcaggctggtctcgaactcccaacctcaggtgatccacccgcctcggcctcccaaagtgctgggattacaggcgtgagccactgtgcccggcctgttctaaattcttccacataacctcaacttactcacccttaaaaatttttccagtgctcgccaggtgcagtggctcacgtctgtaatcccaggactttgggaggctgaggtgggcagatcacaagatcaagagatcgagaccatcctggccaatgtggtgaaaccccgtctctaccaaaaatacaaaaattagctgggtgtggtggtgcgtgcctgtagtcccagctgctcaggaggctgaggcaggagaatcgcttgaaactgggagatggaggttgcagtgagccgagatcacaccactgcactctagcctgggcaacagagcaagactctgtgtcaaaaaaaaaaaaaaattccagtgcttgccaagtacctaatattcttctaggtttcataaattgcacttgaaaataattcactattttatttcccacttcatatggatttttgaatttaataaaagatgaacatccatttctggaaaatgcagtcaattagacctccatttgctgctctgaaacactgagaaaaattagatgaaataaaatagaaataccattttaaatgattagttgagcttgcaagaatgttcttttttaaaaaaagaaaaatctctgggtctaatttttatttagcagtattgaagtacaaaaaagttacataattcaaatcataattttatgaatatcaaatcacattttataatctttaagaaatcatgaagtttagaagtaatagacatctgctgtttatatttcctagaatatgtttcacttcttttgacacctcccattttctttggagtaccactcctctctttccttcagtccttttggttggtagactcttggtcaaaaaaatctccaatttgctgctcaagaagaattgaccagtctccaggaagggccttaacagggtcctcctggttcaagacagcatttaaaaaataaaaagagaccaggctcagtggttcacacctgtaatactggtgctttgggaggctgaagcaggaggattacttgaggccaagagtttgagaccagcctgtgctatatagtcagacattgaatctatccatacatacatacatacctatctgtattatatctctaaaaatgtcaggtactagaatccataaatacagactagaaattagctatgcctaaaatgatgggtcacatttttaaaaatctaaaacaataccagtatttttgatgcctgtgtgagagcataaatattaagaaaggcaattggtcagcaggactttctgccccagtcatatatgcattttgatttcattcaattttctggctgccctattgctgttgttgcctgacatagttcatcagccagaagtagttcttaattttttcactgattttctttgacagcattgaatttcaagtgtactgagagtgttttcattataataaccctgccagtgtaatccaacggattgcttgcctcttagaaatgatacagtcatcctttctgtccgtcccaggtgttagagctgtattacttctagattttcagaccactagctaaacttattcttacctcattgttaaagaaacaactacttttttttttttttttactgctaaccatatggcaggtactgtacacaattatttataggcattactatctatatttatcaaggagaaaagtcaaagtacattttggacacatatttaaacttttaaatacaaatcattatcattatttctaatgaaattcccttctttatttgcactctactgcttcaaattttcaaattctcttatattaattctaacaaactcaattttgagagtcaaaaagctgttcaataaatatcccttgatagaattattggtttatggctgggcatggtggctcacacctgtaatcccagaactttgggaggccgaagtgggtgaatcatctgagatcaggagttcaagaccagcctggccaacatggcaaaaccctgtctctactaaaaatacaaaagttagccaggcgtggtggtccgcgcctgtagtcccagctactcaggaggctgaggcaggagaattgcttgaactcaggaggcagaagttgcagtgagccgagatcaaaccactgtgcttcagcctgggcaacagaacaagactccatcaaaaaaaaagaaaaaaaaaattcttgttttagttagttagagaaaaaaaatatcaacaactgggctgtccaatataatagccacaagcaccatgtgtccactgagcaactgaaatttggctagactggattgagatattttaaatgtaaaatatgtgctaaatatttcaaatgtaaaatatgtgctggattttaaagacttagtttgacaaaaataatgcaaaatatctctttagtaatttttttatattgatatcatgttgaagtgataatatttagttaaataagatatactacaaaattgattttacctcttttcacttttttaaatgtagctgctagaaaatttttaattgtatatgtagttcggcttatatttctgttgcacagagctactcttgaaagtgaagtgtggtatcagcctggagaagtgtaagggaaacacacaagaccaagcatctaagggttgtcttagttccattggtggagctgccatgcctgggctcagtgaccttaactaagttatctgtcttcattaaatgttgtcttagtgttgagactgtgaatagtcatcactcacagtgctttggtgaggggtaaattagcgcagatgcatcaaaccggactgtgaaggaatatacaaatggaagtggctactgccatgatttggtttgatttttgaatctttaccttggtgatatggtttggctatgtcctcacccaaatttcatcttaaattgtagctcccataattcccacatcttgtgggagggaccccgttagaggtaattgagtcatgggggcgggtctttgccatgctgttctggtgatagtgagtaagtctcacgagatctgataggtttagaaaaagggagttcccctgcacacgctctcttgcctgctgccatgtaaggcaccgctttgctcttccttcatcttctgccatgatttcccagccatgtggaactgtgagtccattaaaccgctttcctttataaattacccagtctcaggtatttattagcagcgtgagaacagactaatacacgtggtttgtttcagttaatgtaattttaatatttataatcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccctacccccaccccacaacaggccccggtgtgtgatgttccccttcctgtgtccatgtgttctcgttgttcagttcccacctatgagtgagaacatgcggtgtttggttttttgtccttgtgatagtttgctgagaatgatggtttccagcttcatccatgtccctataatatttataatattaatctattccgtcaaatgtcactgattatcatcaatacaattattgactaacattcattgaccattaagtaatggtttatatgtgtggagaaaattcagaatatcttatttgtgtgcaagctactaacaaatgaatttcaatgtctttaactggggtaaataatgaatatgtgcatttctacctttgatatgattatatatatttatatgtatacaaatgcatacatacgtatgtatgtgtatatatatgtgtgtgtgtgcccctatattaatatatgtcttattgactattacagtcacttatttgcatctaagaaatcaggggaacatttttctatacttttttttgcaataatattattttctattttacaaaactgatttattttttgtggttaacattccaaagacccatttgatcatgattcctctcatatgaggtacctagaataggcaaattcatagagacagaaaatagagtagagattattaaaggttggggaacaggggaatgggaagttattgttcagtagttagcagagattcagtttgggatgataaaaaaaagttcaagagatggataaaggtgatggtagcacaacattttgaatgtatttaatgccatttaattgtacacttaaaattagttaaaatggtaacttttatcttatatatcttaccacacaaaaaaagattcatttgaaaataaatggctgttcttaatagtttggagcatatttttaaaattatttgccaagtgtggtggcttgcccctgtaaacccatcactttgggaggctgagacgagaggaccacttgagcccaggagtttaagaccagcctgggcaacatggggaaaccctatctctacaaaaaaatacaaagaattagctgggcatggtggtgcatgtctgtagttcctgctactcaggaggctgaggtgggagaatcgcctgagcccaagaggtccaggctatggtaatgagactctcactcaaaaaagaaaaatatcatatcaaagatttttttttaaagatcatcttttctctacttcatgttggctctctactttgacaggtattgatttttctgtaaaacttttgaagctcaaaccattatgtcggcactttatattaactgcttttagttttgacatcagcaaaattgactgaaaactcaatattgcacctgtttcaatacagagtctctggtgtggaaagattagcaagataagctaaagaaacttctattgttcaactttatcttctcagtctcatcaaatcaaagattgaaaatgtactctaggaggatgtatttctggtgaggttagatgactacacatctaaaagtaaaagttttaagagtaaaatataacataataaggatctagaatcttgaagaaagattccaacatattttatgacaattaagtctctaggtaccattaataaagatgactgtaacctcagagctaaaagcatttagttcattattccatgcaaactcgttaaaatatgaagactaaacttagcatctagtgtcaccactaaaaactgtttaaaacttatgtgatattgagtgagatacatttctttatggtttaataagtgaattagatgtctcagtgtgatgatgcctatatctacatgcacgtgaatgtgtgtatacatagatctatataatatatatctataaatatgtattttcattggatagagaattattaaccattttgtttttttttttcttttttgagacagagtctcgctctgttgcccaggctggagtgcagtggtgcaatctcggctcactgcaacctctgcctcccgggttcaagtgattctcctgcctcagcctcccaagtagctgggattacaggcgcgtgccaccacgcccggctaattttttgtatttttagtagaggtggggtttcaccgttttagtcaggacggtcttgaactcctgacgttgtgatccacccactttggcctcccaaagtgctgggattacaggcgtgaaccaccgcgcccagccattaaaccaattttatatatacagctcttatagttttaattttatttttgccacttagtggcaagaaatttgttacttggtataaataaaaccaagttgatttgtttaagcagtaggttcccattagacttaatgatgttgtatcatcccattattaatttgaataaatttctattatgttatttttcaaaatgaacaacagtgcatagaatcaacaattgagtcactgcaatagcagtataaccatgctactccttcaatatgggagtttttgttaacaaactaaactctgacagcttaatgtatgcaagattaagaaaaaaaataaaaccacaagctaatttcttattatactcactttgtgtattatacttaatggggtctcagatttgtttttcttctttcctagacaccagattaccaggaacagtgagaacttaggtagaaatgtggataatggtacactaataactagaggtttacaaaataggaaaggttaaaggaactgagaatattactattatttggattttaaaaaactctgggctgggcgcattggctcactcacgactgtaatcctagcactttgggaggccgaggcaggcagatcacctgagatcaggagttcgagacatggtgacaccttgtttctactaaaaatacaaaaattagctgggtgtggtggcacacacctgtagtcccagctactcgggaagccgaggcatgagaatcacttgaacttgggggggcagaggttgcagtgagccaaaatcgcgccactgcactccagcctgggcgacagagttagactccgtctcaaaacaaacaaacaaacaaacaacaacgaaaacctcaatgatgtgccataataagatgttaagtactggaagtgttcagaataatggaagagcagcaaagggtgactacattaaaaatccagcaggtaatgagtttcatgaggatttacaaattgttttttaaaaaatattgattaaatttattgctctgtgattttagcatttaaggatagttcctggaaaaaacaaacaaacaaaaaacactgctcaataatagggaagacttttggtgctgtattctttggaggttttaaaaatatgacagaaacccatttgaggcatgttcaggcatagacaaattggaggaaggtcactgagactctagtaatttttttattatgttaaaatttttatggttcatttttcctaatattttgtagtttaaaaaatagggagcaatttaaaaaatcaaaacattaggttttgatatgacagtttaataattacataaaggaatttaaaataatgaatgctatttttaaactgttcaaactattttaaagagcttctattactcttacactatgaaaaggtccactaattatatcccagggttagttttcccttgcctttatcacaatattgaaggctctttcttgatgataaaaccaagaggtaactcttaacttgcaattgatgtagatattttgtaacatatatttagaagaatttctaaaaactatttttgagaaaactgcatgaaaatggagttggtttttttcatgtcaaaatatataacttttgcatcataagagatttaatgttttcatttcttaaaatgcttgaccaagtcttttagtcattatattagcatctcttgttccatctggaggacctaaaaatccaatgaactgtaaatgggcagttcaatatgaatatgcaaattaaagacattatgaattctatgtaagatgtaaagaagtagcttactctgtgccttaattagaagaccttactgtatatttctttatcatttgttgggttgatcatcgggttccactccaacatatccaccaggaattctggtatataaatggcatcaaagattgtttacaaatatcgtggacaatgtctcaagtgataattgcaatatgtttctcagggaagaaaaaaatacaacttttgtgaatattatttttaaaacagaaatgctgtatatagtcactactgtcttctgatggtaatgatagaaattttggaacctttaatgagtacttattgttaaagttccattagataattatgttctgtttacatactgccatcatttgaagaacatatttgctttattcaccaaatcttgaagcatactctacacatgaatttaaatgctactatttctattacccaccctcagagtcttctaatttctaatatttacttaaatattttggttttcaaaattttacctatgattataaagcacacactgagcttttattttaaaattgaggcttgtgctgtcaatttaaggatgagagaagcacagagaaacgtgttctttttaaaaaagtaatatatatatatatatatatatatatatatatatatttttttttttttttttgagatggagtcttgctctgtcgcccaggctggagtgcagtggcatgatctcggctcactgcaacctctgcctcccaggtttcaagcgattcttctgcttcagcctcctgagtagctgggattacaggcccacgccaccacgccccactaatttttgtatttttttagtagagatggggtttcaccatgttggtcaggctggactcaaactcctgacctcctgatctgcccacctcagcctcccaaagtgctgggattacaggcgtgagccactgcgcccggccaaaaaaataaaatatattttaaacctttaaaagcaaacttggttatcaatgtatcatgtttctgtgtatcaacttttataagtccactactcaaaatgtaacctgaaaacagaatttttccaattagatattgttgctatggcgtaattgagctagttaatgatataactctttcagaataataagtcaataatagttatcagcaccaaacatgaaggaagtgaagtagaagatatatgaaaaataaccattaatattaaaacaatatattatgggggcagcaaataggtagtaagctatttactattcattagttggttatgacattgctaaaattaaattaaaacaaaaggtgaatacaaatacaatgaagtagtttggatgatgttttccatttggggtatataatcagatcattttatgttaatctaatttgtctttgagttaaataaacccaatagtgttgacctgccttttcatgtgtcattttttcaacattgtcgtttgataaacatttagtaagaaataaaattacactcagagcaataattttatactttcgcaagctatttataaaatctaattgtataaatgaatgtgttctttaaagatctgtatttgttgtttatgatgaagttaagaagttatagctacttctggtgctgttcaaaatgaagattggaaataatacagtgaagtagatctttaacccagatagtttgagatgcactcttctggatggcggatgaaggactgaaacaaaggccaggcagttagtttgcagaaaagaaatatgtaggaagtaagacaaaataattaattacatatacgtaatgacatatacttcttctcattcaaataatctctagtcattaattccaggaaaattactcagataatttttttttttttgagccagagtttcgctcttatcacccaggctggagtgcaatggcatgatctcggctcactgcaacctctgcctcccaggttcaagtgattctccagtctcagcctcccaagtagctgggattacaggtgcccaccaccaggcctggctgatttttgtatttttagtagagatggcgtttcaccatgttggccaagctggtcttgaactcctgacctcaggtgattcacctgcctcggcctcccaaaatgctgggattacaggcatgagccaccgtgcccggcctactcagataatttttaaaatgtgtgctttttttgtttgttcataacattcagagttctagagcataattacagagtatttcaacaatgctcagttagtagtggttaaatcttccacttcagtgcagctgttgctctgtcatgtaaacataccaaatgtaccttcaataggagtttaagattttttttatatgtatttctgtactttggaaatagtttctagtgggtgggtgtggcagaggagactcttgttggttagtatagagctgttgctgtggagcagctgctcagccagaaattcaatttcccagcccctcttgcttctaggtggaaccatgtgactagttcttatcaatgagtataagggaaggaatgtcatttctgagccaatgtaatgacgaagtagatatgctttttccctgtctttctttctccatcaattactggatgcagacaatggcaaggttttaacagatggaaggtgcccaggtctctaaatcacataatggggggaatttggtcactgaccagaaagactgtcattgaatgacttcaggagtgaaaaatgagtctcagttaaattaaatcactgaaatggtgaggtttacttgaatggcagaaagccttaccctaaatagcagtgttaggcaagttttaccaatgcaaagtcatttgaataaaagagaaatttattgtaaagtcacaaatggtctagaactgaaactgctaagctacacagctgccactttcctgtttgaatgcttctttctacacggtttctccatctgctatgcacttaccagatctctgaatgttcagtctatacatttttcaacagccaaatcaaaaacccatctcttctggtcaaccttcagtcctctctcctagatctggacagtcccattttccttagtggtcagtttgctttttgacacttttttctttcccctccacagtgatttggccaattggatatattcctactctttcacactagcctgtaaggccctcgagccacgactttgtcttcagcattatttagcatagagagaaaagatgattaataagtacttttgaaatgtttaataagcaaaagctgagttgggaatgtattttagaaatatatgctattgtagatagctaaatgtgattttagtctttatcacaaacttcttagtaattatttgagagctttcagcatatttataaaaataatttaaaatataactattttacttgaaagtctttgtatattcattgttcttgaattagtaggtaataatcctaatgagccataacaactgttctctcttcaaaataattctgatgatagggttttcttcttaagtcagcacaaaatttattctttatatagggtcaattgaagtgtttttaaaagcatgcacagctctggtaattcattcataaaacacaggaaaatgttttaaagtcaaaagcttcaaaaagattcacaatgtgaaaaacataaattagaacattaaggaaacttgtgttgtaggactttttccttagttcagctagaaaccaggttcttgtcacatgaccaggaaagattaggttcctagacacagtagaagggtgggaaaaatggaatttattgggcaaaaaggaaaaaggaaaaacaacacagcaaagtgagatggggtcctgctaaggggctctccacctcaccaaacgaatcccagggttaccaccccagaacaggagaggccaggctcctccccgctgcaaagggcatgaacttccctcatctccacactcccacacatacccccacccctgttctcccagtttgcaggccagttgtaggttctccaagaacccctttctcctttattacttggctgtctcacttagaagactgatgctagcaaaaaacatacacaggaaaaataagagagtaacagaaaaaaaaatctggcaaagaaggcagaagggaaagagactaagccataagagagagagagaaaaaaaaaatctctggtctgggaagggcatattttctaagcattagtgtgtaagatggagaagcaactcattaagctgtcctttaatgtagtattatccataatagtacaatatgagaaacaactcaaattccccaaaaatgatacagaatggattttataaatcacgtaagccagtgccatagaaaagagtctgaattcgagtggtgtgacttcagttatagtcctgtttgcagcctggtacaggacttaggcaaatattttaattcttacttgtatgtttgggaggcaaggtaaagacttcgccttcaccctctgaagataccctgaaaaatcaactcacagaaagcagattaattggaaaaaagacatatacatttattaacgtgtgcatgaggagaaccagggtggttacccatcttgccagtggagttcagaagcttatatgccatcctggtcaaacaggttatgggagtggagagaagaggaattttggtgagggacaataaaggatccttagggagaacagaacccatctgggagcagagattaattaagttgtaaatagttctctttggaatttgaatgagcctgagagacaggttagtcttccacagaggggaagaaacaacagttatcctttttggtgagtttggactttagacatataaaagaacttcaaagaacagcttcctcctggcttgagagagtcatttgcgggcggggagagggagggaatcagagaggctatgagactgctttttcagttcagcatgttaaagtgccatatttggggtatcggtttttgaaccccatcataggctacagaaccctacagttcctttcaaggctgaaagtttctaatacagtaaagtgtttaaaagtttacactattctgattttagcagatttcccaaatggtatatctcttcatagtgttaggtaaggcagaaagctattctttaaagagcaaatctctgaaagctaatgatgcctgggttgcaatctaaatgatatttttttctttttctaaaatgccaagggcaagttgacttttagagttaatttctttcatttatataaaatggtaatgagagttaaattatatttaggcacctggtacattacctagcctgtaataaactctctgtaaatgctagtttcctccctctgttgcattaaaacaactacaagatgaaaaacctatgtaaaccaaaaataaaagtctaagccccacaaccaacagaatggacccctcctttcggccaagagcattataaaggaaacctgaaatattagttcaggccttgatgaaatggatggttggatatgcctcattatactttcctccctttgatatttaggctaaccagcattagcattaaaacagagacctgaagactgacagaactagactctttaagcctgataagaaacatttacaactgattccctctaaagcctgctacctggaggcttcatctgcataataagaatttgggtctctataatcccttatcttaacccagacattccttctattgattccaagtcttagataaattctttccaccaattgctaatcacagaatctttgaatccacctactacctggaagcacccccacaacacacacacaatggcttcaagttgtcctgcctttctggaccaaaccaaagtacattttccatttatcgatttatgtcttttgtctccctaaaacgtataaagccaagctgtagcccaaccaccttgggcatgtattgtcaggatgtcctgaggttgtgtcatggacatgtcctcaaccttggcaaaagaaacttctaaattgattgagacttgtctcagatactttttggtttacaactgaaaacaatataggttagcgatacatctattctggtgtcaacgccagaatagtttgtcacagtcaaattttattactgtgattcaaaccatggtaaaattataacttaaattttataagatagataaaaacaattcaattaatattccctggttagtttcagtcataatgattatataagttgggtattctcaattacatgagcatctctttaaggcagatgagaatttgatgatgttaatcatgatgatgattactagcatttattgaatgtctactatatgcaccactctaagcaccttgcatatactatctaatttaaactggctcatagatgacatactagtttagagtgtactatttgttgactgcattttaccctgtacttcaatttgatagacagtgtagatgtactaaattcattcttcattccctttacaaaaattgactgagttcttattgatgtgctgtcctggacagtgtgaaaaatcaaaggatgaatcaggcagagacctcttcgagcagatattattgagcagaagaggtaaattatgcacacaatagggtgcaagatgaaaagtggtatgagatgaatgatcataaagggtggtgggaattctgagatgatcatgaaaagtttcctgcccaagtggaatttgaatttgtccttgaaagagagtgaaatctggactgggaatgtcaaattaaaaataaaaatccagactttgtaaggtggggagactattgcaattgggaagctactctaactataagatctacaagcctttcaaagttaggcaaaaggatttttctttcatagggaagagtaaacaaggctggaaagaaaaaaaaaaaaagcagatgtagggaagtgggatgaaaaggagtggcaagatgtgacagtggaccccagaatatttaatcctaaagccagtatagtctctggaagggggctattaagagggattgtatgttgcctcaggctaaggtggtgcaaagctcagggatctagaggaaggacagaatgttaaccgtctttctttaagaagcattatattctgattgatcacttggggcaaaacagttcataattatctatgaggcaaagagtgggaattttgagtctttttgtatggccctgtcataggcaagccaggggaacaactgtgaagcagggtggttctgtgcagtaagccatttcccaaaacacaaaaggatgtggggatttattaaacttcactgttttccaagatcattggtcttgggtaaagttcaacattgtcttgggtatgggaggaaaactcagttaggacttcttaaagaaagagatattcatgggaaggtttcgtttagctgggatgttgacattatgaaggaacgcactaataaatggtgatggttaccctttttgaactgccagttccttttctaaagttaaaaactatcagttcatttaatcttcacagtcatctgatgatacagttacaattatcctccccattttacagacaaagaatctgaatccctcagagtttaagtcacttgatgatactcctagtaagaagtacaacagggactccaacttatgaagccactgtaagcctgacagagccattttagcctcttttcatgacttcagactttccctttataccaaagggaatggaataaaactgcttggacaagagcaagaagacatgcatccatttttcacattccaaaataatggactccaacacatacacataagagaagcagctggacatagaagaacttagaaaaacagaaagtccaagtttggatatggtgcacaagaaacaacagcagccaatggagcttgacaaagcagagtggcgataacaggaaaggttctgagggcagggaacaaaacaatggagctagtcaagacagaagggcccactgtttgtctgctttctgttttttttgagaatgaggatggggtggagattagggttaaatttaacactgttatctttgtaggcccaggtttctctggttcatatctctgtcaatgagactatcacaggtctgtgaagtttttgggggatttggaaaatgcctgctggattagcttttttaaaaaaaagtattattattattttgagacagggtctggttctgtcgcccaggctggagtgcagtggcatgattacggctcactgctacctccgcctcctgggctcaagcaatccgcccacctcagcatcccaagtagctgggactacagttgcacaccaccacaatcagctattttttttttgtagagacagggttttaccatgttgcccaggctaatctcgaactcctgggctcaagtgatccactcgcctcagcctcccaaagtactgggattataggcatgaaccaccgtgcctggcctggattagcttttaagagcaaccctgagctaccctgaagacatctcaactagtacagtttagccctccagagttgaggacagttgctgaatccaacacacattcaactctccttcccttttccctttgccagatacatttgcatttacttctataaatcacagctatcattgtttttcctaataattatcttatgattcaatacactcagtccagtgagcccaggaatacatagtacatggttctaaattttattgaaaatatttataactttgaaatgtaaataattgaactaaattcatcttctataaatcatattttgggaagaaaccctgattgctctaaccaacagagatgttattagaaatgtaatataataataaaagcaattaacctttactgaggccatcctgtgtccctgaactgatggtaggcactttcacatcctttttcatcctcccaggaacctattagtagaagatatggtttctattttacaaacgaaccaattacagttctgagaagttaatctctttgaccaagcagttgtactttaggccttgagccaagttttgaactcagacctctctgactttaaaagtcctctaagccattctacttggaatcaattactcacattttcaagactactcaagggcagctgtgctacctaatacgtgtaatgttgggaacaatatttaactacccgttgacttagtttcttcatctgaaatgtaaaggcaatcagaacttccttagaggattattgtgaagattaaataaattaatacatgtaaactattttaaaggtatacagagctactattttataagtgttagctatgacgattgatgattatgatgacaatgaaatcatactctctttctcaagtgaatagccgtactcaaaatgtcattatgattttgtatgctaaacaaaaactacagaaaattaggagtattagtttgctcttaattaaatttacatgtaagtttcttttaatcataaatttggaaatctcttttgtgcctcccattatacttcttagtctctaaaataaaatttgcattttatttgagaccacagaatggcagttttgataattggattttaaaaacctttttaaaaaaaaaaaaaaaagatttgcatattatttccctggtataaggaatctggatcaccaaaatattaagaacattttctattatttctcatttgtgtggaacatgggggtgttaacattgtcttgacttatttgccccgtatggttgttaggttccagggagcttcagctgagcttaagtgttcctgtctgaaatatctgagtcaaggtgtatgaaccagagatcaaacaaatcagtaaagaagtaacaggcataagactgaagtaaaaaaacaaagatggttccctatcactactaagtatggacagcccagaggtgtgacaaaccctattggttcttcttgcctactgcacagtaaagccaatacactgagacagcagtgttgcagtagaggatgagtttaattctcacaaagcagctgagctgaaggatagtatgcatttctcaaatcgacctccacaagaactcagaaactagggtttttaatgataatttgatggacagggagctagggagtaggtgctactgattggctgggaatcaaaccatagggatgttgaaactgtctttgtgcactgagtcagtttctggtttgaggtcatcacaggaccagtcaagtcagttccttggtatgggtcccaggttcaggtggcatcagtttgtctgccaggatgcaaaaatgtctgaaaattatatccaagaccagtcttgggaagcaactggagaagttataaatcttgtgacctctggccacttgactcctgagcagtaagtaattatagaaaacaagcttgggaccaagggtaggttattgtttaactatgcttgcatcttagcagaattcatgctcctcccataagtctaagcttgtggcctttcattagctttacaaaggtggtttcagtctgaacaaggaggggaagggactgttatcatccttgctttaaatttaaactgtaaactaaattcctcccgtagttatctgggcctacatccaggaatgagcaagggcagttagcttgtgagtttagaagcacaatggagtcacctatgttagatttatttcactgtaataatttcacaaaggcagtttcagtcacaagtatttaagagcagagacaaccacccaggaattcaaatctagattgaagtacaagctgttttaaagcctgcaaggttggtgtgtgtctggatgacaatggcagtgctcatttacctcaacaaaggctttcaacagccatagaagttggtgacaaatttatactctagtaagtatgtggtttacagataaggcaggctgagtttaaaggtttgcagtagggattgcaccggatagtgtgaaaattgtattgaaactgatattaaatatcttaaatataaagcattaaatgacattaatctagatgttccgctatgacttttatactgttatggctttcatctgttgctgccttgaagttgaggagaaaagagcaagcagtggcctctttgtgaggtccatgccgactggaactatcatcacacaaattactactaatatttgctttgttaaaaaaaaactttaggaacaaaaaaaaaatgagtaaaaactttctaagactatgtaaagactatactgacttttttgtattcctgaaacaagaagaactaagatacaaattattcaatcctagacctgaagaaattgtgtcccatggacaaagatgaaggcatttttctgctgccacctgcttcacaccattctctgccctctgaaaccagatgcttaaaagcaatcagtgactcactccacattacccaaaggataaattcccaaatccttagttggtttaccaaaccgtcaatcagtagcccccactcataccccttaccatcatctgtctccatttaccttattacactttaacttcccaaaattgaactttctttagtgtatattgaggaatattctctctgccaagaccactatccaaccacaccatatacattcacttgattaactccaatgtattctttgattctaatttataactccaaggcgaactcttcccttaaccctcaaattaagtgactccccctttgtcctttcataatgtcagggcacatttgtttcaaacacttttatagtgatacctttaaagaaatgtttccaaaacttcagtacacacaggaattatctggagatcttgttaaaatgcagattctgattcagagtgatgccagtgctgctccctgtccccatactacagagtaagtagcagtctgtctgttccactagacctgagagtaggatcctcaaagccccacttatattaggccccgaattaacagctactggaggaatttaagaaaacaatacacaattggcaacacaatttagttttggaatacaagtggtacttacaaatagccatttgagaaaaaccttgttaacttccttccctccttctgtagcttggtatttccaccttttctttccttctctttgcctcagtcttcactcctaaatggaagtggtctctcagttccctccttaatcacggattcttttcatgcccagtagtcaacccttgagatattttcagtggtagcacttcagaaaatgaaaagcaaagggagccaggatagagacatgaagaaaaataaactcctattctcttcctcagtaatcagtgagttactttttctttctccagatctcacctctctggccccatcagactatttattaaagaatcacaagtacatctctagactcctcttcagtgttgcattgctcagaaattcgttgtgtaggtggtgctcagaaatagaaatgaacctcatatcagtcattcatttacataaagacttgtcatatatataattatagtgtatatatatgtgtgtgtgtgtggtgtgtgtgtgtgtgtgtgtgtgtgtgtgtgtatttttttttttaaatagtgatgtggtcttgctctgttgcccaggctgctctgctcttggacttctggcctcaagcagtcctccctcctcagcctcccaaagtgctgggattatagacatgagccactgcatacagtcaagaattgtcttttaacatctaagtagagacttaatcttgttttatgtctctctctgtctgtctctctctctctcccccaacgtgtagtcattttattccaaaggtttgtagttgcatggactataaaaatggaaaaataaaaataacacaaacttcctggggtccccttactacccatatccccataccttgtctcacctacgacaggtaaacagaatcttggagagcaagtgctgtggagtagtcactgcatccaaggtagagagtggtaaaaatgtttcatcgaaaaataatttttctatgaaatggacaggcctcttctccattaggtttaactgtgtttctgactgtgtataggagaaaatgggtcctcagatttccaccacagggtggttctactattagtacatacaaatctttgttaggctttctgtttctttattgttcaaaggcacaatataaggaatagggctagtctgtatttcagtgtaaaatatatgacactttatatatgtgtatatatatatatgtgtgtgtgtgtgtgtgtgtgtatgtgtatgttatgtatataaggttgatttggtctgtatctacataaattacatgatagatatataaatgtgtgtgtgtatatatgtaaataagtctaatgtatacttataatctatatatttgtatttcgtgtgtgtatatgtatatataaacctatattttcatttcttgtaataaaataattaaaataattaacatgaaaaagagatcagaagagaaactcttggtaaatgtataggtttgtctattaataagatgttagatgtgctatagatgtcatagtaaagataacatcccccaaataccaaggagaatagaatgattatactagggtgcgaattctagcaaattaaaataaatatctgcgtgatccatgtttgtaactatctgacagactgtttgctgttaataacttttctggaagccacaaacacagcagtagcactcaattatgatgcggtctacaatataacacaatgcagtttttctgctgccttcaagattacataggcagcagagcctaccataatgaactgtcccgaaaactcaaagtgctgtttgcagcaattttgcatgtgagtattcagattttacagtgtatgaagtctgacttgaatgtgctctacctcagtaattctcatttcaaaatattcacattaaaaacattcacatcttccttttttgattgaagaccatgctaataaaaaagcacatagaatattgcaaataaatagtcatagtgagctaagaactacatggaacactgagattcttcaaggtatgctaatgactttttgtttagtagatttcttgtgctgcagtacgcatgttaataagtatttcatcctcacacaaggtgcttggtgatgaacacactagcccagaattatcagcatacatttattcgattatccgcttgtaatcaagaaaatatattattccttttctcttgatattttggttcatattatctaagtatatgtctaaagcgttaataatattataattcacaaatgtaatgcttaaataggagaaaatattttaaagattctcaaaacctctgtaattttttttcccattaccaacatcattccctttttgctactacatttatcctaattagaaaaagtagcagagggtttgaaagaagaaaaaagaaaaggaaaagtgaagtcttcctaataagaaatattatgttaagtactaccacagcaaattatcattagtgggaattagaaggagcccccttaaatgtgtatataatgctatttttaaaggcttaaaatattttatttcaagttttaacagtatcctatgttactctttaaacattttagaaacttttacaactcagtttgtttcatattaaataagaacttagctgatctcttttggactcactgtggaacattgcattaattgttagccataggacaacaataaaaaaataattttagtaaaccacataacttaggtgactcatgaatgaaagcggtttacagatgtgcttattgaccagaaagccttaatgttcccctcagcttgactaactttagatagatcctttcatgattattggcctccgacctccctttgcttagagcattcactttagaaaatatggaatggtcaattctttctctgcccctttaaggtgtaaatcttctttcagtctcttgccagttttacaccccagaaatgtctttcccaaagatctgggagctagccctttgaaatgtaatcatcaagcaagatagtacccctacctctcaggctctttgggacagtaggagcctaactttgatagataagtgacaatctgcacatatggcctcatctctttgagcaactctccctacacaaagtcctctagtacttttccactagctcaccccaatacttaaaaattatcccaccttttgtactagtggaattgagttctgtctgtgtcacctattgcaagtctttaataaaatctttcttgcctgtttaactctgccttgtgcaatttttctatgacattatttagactccaagtttactgtgcagagtaaaggaatagataagtggagagattttttaaaagggtttaaatgaatgttctaagatatagcaatgactcatttacctgccatcacttgccttacccttttaaaccataatacttctccttctacttttatcattcatgatggaaatattcctaaaatgtagtagcaagccttctgtttctttctcaaaatgaagatttgtttctcaaattgaaagtagttttttgtgtgtgtttaaacaaaaatgtacatgtggaaaataagacactgcaaatcacagattaaagcagtgtttctcaaccttttaaaaatcattactgccccgctaaggagcttttttagttattttttcctgcctcatctccccatgagattttaataccatgaatacatggtatgtctgtttatgtactgctgccttttggggtgccataaacccttacagtatctaagatttgtttgctcccacccaagaaccagtttttgcaccattaggataatattgcctctttgaaaatgcatggtttaaagcacaaagtaaaaatcacttaaaatcccgtaccacagaggtgaccactgtttgcctttagacaaacatccttccagagatctttctaaccatattttatgtgcttttaaaatttgtttttgtgctttaataacaatatggaaatgtttccatattaatatagacatcatccctttcaagtatatataatttatttaaccaatttcctgtgacatacattcttccttcgatttttatattttaagtaatactttgatgaatatcatgtcgtatcacatttgtgcatttgatgtgctgtctttagaaataatttttcaaaatgcaatttctggatagagaggcacatacatttaatttgtttttataaaaatttccaaactatcttcccaaaagattttaccaatatacattctttcatatactgcatgagaatgcctgtttacaacatagggtattatcaatttgtttaatctttgccaaacttatagacacaaagtaagtcttcactattgttttaattctttattcttttatccttaatttgataactaattcattgagtttttaagtaagcatattggctatttgcatatttaaagatttccctcatcttgtaactttttgtcatttttttttactttttttctttgtagtccttattaattacattgcctaaaagataataatcatgtacagtaatgaatgcattttacagttgtgcctttgggaactgtatagggctctgtgcctattcatttcacaaattatttttgctttcttctgaactgacttcatataaaaataaagatgatgataactatggatacattaatgcatgtaagctttatagaaaatatttgtatataaaatagatattttatattaattttatgtgtaggtatttttttaaaaaattaaataatttccagtttttatttatcataaataattctcttttatttaaaaagagctctaacattctaatgtattcttttcatactgaaatttataaaccttctcagttcccttctcaatcacttctgctctatagactttgaactgacatatttatttgatttctttcatctttatctcttttgtaaaatgtcattaggctgagaaaaatataatgagtccatgaagagatattttttaaaaaaacagattttatggaaaggtaaaaatcaaggagaaaactcaggagagtgtgaacacatcagattaatatgatcattgctctcgttccagttaggctcattccaaatattttaacgtgctggtcatgtgaagtaatacttcttttcatagttgtcacactgttttttgccatctaatctgctgtccacttctccaaagttatttatgagatttgttattgatacatcttaatactttgcaaatgccaacattttcctaatattttgagtggaataatatatatttgtaaaacaaatgaaggccaataattatgctttagatttggggactttttgttgagaatcatcgatatagtttgatagtatttcattataccttacagagtatacttaaaaatactcatcaattattgttttaatttatagtttaggttcacaaaagcattatttaatccaaatagatttcacataatataaaatacactattttagccattttaaagtgtacaattcagtggattttagtatattcacagtgttgtgcaaccattaccactgtctaattctagaacatttccattactccaaaaataaaccccacacctttgaattctgcctcttctacctcctgccctatttcctggcaatttctgtctgtggatttgcctattctgaatatttcatgtaaacagaattatacaataggtgatcttttgttactagcttatgcaatagcgtatttttaaggttcatacgtactgtagcatttatcagcgctctattccttttcatggttaaataatattccattgtaaggatgtaccacattttgtttagacattcatcacattgatgaacatttctgttatttccactttttggctattatgaataatgctcccatgaacatttgtgtacaagttgataatgtgaacatgttttaaatttacttgggtatatacataggtgtgaaattgctaaatcataaggtaactgtttaacttcctgaggaactgccaaattgtttcccccaacagttggacattttatattcaaatactacaatccgtatgtttgtagtgtttgaagtttccaatttctccacattcttatcagcacttcctgttttctgggttttttgtttgttttattattgttgtagccatcctagtgaatgcgaagtggtacctcattgtggttttgtgccgttgtttttaaactgcttgatttatgaatgcatttgtggttttattaatagaattgctaaggtcaaaattatttaaaccattttcaaacatggtatgtgtcttgtgacatactacaaaaagttggcaatggttctctattacatttacgaaagaaaaaacctgctgatgaagttgaggctctgactgtatgtattaaactttaacctaagtcactattgacagcagagtatttcaacctctgaagacccagcctcactaaatttgcaaaaatagttttttaaaaattgtactaatacatttctatgttaatggaatggtcactttttcttttcaagtctagtatctaaagtactctgaaatggggaaaagatcatgcttttatagaaattttcttgacctgagcttccattaggggaaaaaacataacttccgattgaaaaatatatttacataataccaatatataaaccattctttcagggtaagccaaacacatctaaaaattccattaagtccattggactggcagttattatgttaaatatattttcatgaaacattttgcttccctggaagcaaggcaacaaaaaagataaaactaattaaaatgatatggggaagaaggagaaggaaagtcacagtcatagtatgttttagatttttcttactgatgaataaaaataactcctttgatttggattatattatagtaattttcatcacttttcaaaaatcttgttcaaaattgtttagttttagtaacaaaatgagcctctttctaccattttcttaggaattctgctactgggacattttgcaaaagctgcaaatgcagctttgattttactaagtaccgtgattttgcctgcattttcaagtacctagatagaagttagggcttaaattgtatttgctaaagttttgaggacttctgagaaaaaaatacaaaagaatataaacatcttataataattcccatactcccccgccctttttttttgttcccacttgtgtaggagacataacccaggaggtgatggagaggagcaaaaacctttccttttctttaatcacttgagaaagagagtcaatctaggaatagctaaaattactgggttctgagtgatgaagacttaagctatttgagaatgaaataaaaattttatgaagtgactgaaggcaaagtcaaaaataaagagttcacaaaggagaatatacagagtactctaataggtcctaaaggagattttagaaaagatattactttatcatactgtgttatttaaaattgccttcatgtttgtctatttttataaagtacatgtgtgtgtgttacaattttttggagatttttgctctcaattctttatatcttacgtgacagcaattagtaccatgtaatttgggcagaaattcctccaagcgacaagcagaatatttcacagtgacattttaatacatgtataaatatattaaaatttgtctctacaaatgcaaaattttaaagtaagatcaaataagaaaattatttaatttttattacttcctacataaacagagaatattttatttgtgggactttttataaatgctgagatgcctctccacctccaaatcagagtgttttaaattttataattctattatagattcaatcatttgggtaagtttacaatacatagctgttaataattattactgagactgaggtacatacaaatagtggaaagctaagatagtccaatatatgtgagcctctgttagcacaggacagtcattttatctgcagataaggacagttttatttcttcctttcctagctacgtatattttatttcgttttcttgccttattacacagactagatctttcagtactatgttgaataagagtagtgagaacagacatttttttgtcttattcctgattttagggggaaaacattcagacaatttgctctttcaccattaaatagcatcttagctgtaggttttttatagatgctcattatcacattgaagatgtgtcccctaatccctttatatttattcttctaagaattcttatcatgaatgggtgttacattttatcaaattcttttctgtattaattgataataatcatgtgatttttctttagtctgttaatatggtggattacactaattttcaattattgaaccagccttccatcctaagaataaactccactttgctctggtgtatacttctttcatatatcactcaatatgacttgttaatcttttgttaaagatttttgtgtttctgtcaatgaggggtgtttgacgtcagattaatactagcttcataaaattaattggaaggcattccatcttctcttttggagagaagaggtagtataagattgatgctaattcttctttaaatgtttcatagaattttccagcaaaatcatctggacatggagatttctttttttggagtagtgttttaattatgaattcagttttcttgatggttatagggctattcaaataattaaattcatattgagtgagttgtcacagttcatgattttggagaatagatccattttatctaagttgccaaattacaaagtgtagaattgttcacgttagtccgttattgtgcttttggtgtctacagggtctatagcaatagtgcctgtttcattcttcgtattggtaacttgtgtcttttctctttttgtctttgtcagttttgctagaggtttatcagtgttattgatcttttcaaagaaccagttcattgcttcgttaactttctctattgcttttctattttgaatttcattgatttctgctcttgtctttgttgtttcctctgtgcagtgtgctttgggttcatcgtgctttttcttttttcaggtttttgaggtgggagattagaatagtgactagagatttttcttcttctctaagtaagcatttagtactgtaaaattttctcttagcactgctttggctacatcccataaatgttgatatactgtgttttcattttcattcatttcaatgcattttttacattccttgaaacattttttggcttatagattatttactagtcgtttggtgtccaaatgtttggagattttcctgttatcttttttgttactgatttgtagctttactccattgtggccaaagaaaacactttgtatgatttcaattattttaaatcaattgtggtttgttttatcccctatctaggtatatgatccatgggaacttaaaaagaatgggttttctgatgtctttgagtggatttttctataaataatgaccagatgctgttgatttatgatgttgtacccagtcagtagatttggatctctagatcctgaagaatcttgccatgtacacagttggtgcttatgaagggtttgttaaactgtttggacctgccatagtattaccctttttcctgttaccacatatacctctcctgtggtctgttaaaatttccagaagaaaggcaagcagcttaggcagactacagtgatagtgtggcatcactaacaacccaaagttaaaaagtttgcaatagcagtcatttatttcatggtcaagggtctggagtttggcttggttttaattgatcttgtctgtgcttacctgtgctctactggactatcctggattctaggttttgggttagattcaaatctgttccatatatctaaattttaggattcatactgaaggagcaatagctgtctagatcatgttcttttcatgggaaaggatgtaagcctcaggagagctggcagaaacttggaatatctcttaaaggcacaatgtcacttctacctgtattccattgtccaaagccagtcacagtaaagtccaaagctaatgcgttaaaggtatatactctgcctattccagtaggaaacacttcaaaattgcgtggcaaaaggcatggatgtataagtctattacaatgagggagtgaagaactggaagctattattcaattttcctttgactttcaatctttaggactttctactctacacagggatcaggaaaatgaaaattaactctccacaggaaaactaatgctccacatgaaaatccctatttggattgaaaactataaagaatgtttcccttgacatatagttaagtcttatatattatattttggataatttgaagaaatggttttagtaaattaatgagaaaatgcttcagaatatactttatagtacatcaaaggcaatgtattttcaaatccaggctgtattatttgtttgtttggttttttttttttttttttttggttttgaactatatgtaggcattttgttgacaggactttttgagaatccattgcaagcctgcacagctacgttaaatatatgaatataaaataggactcaaccttatcaatttgacacgtgtgtgtgtgtgtgtgtgtgtgtgtgtgtgtgtgaatgtggtaaaacatctgcatttgtcatcaatttttggaaatattcgaaagacttttgtgaatcaaaaacctataaattatttggtatttcagatagagatcatggaatcctattaaatgatatatgtccagggttttgcaggtcacaacttgaattttattcgaagagatataatagtcattaaaaaataagagaaaaaaagaaccctggggacagaaattttaatttaaattcagggcaggcatgtagtacctgatattccatgtattcacagaatgacagaaaaccatccttacctgcatggaatgatggcagtgattgtttagtgtccattcaaaacagtaactggttgcagttgaagtagtacttttaatcatatggacacttgttccccaagaattgacctggagccaccaaaacataaacacagactattgagcacagaaggagccagtaattactttcaatcactccttgtcaaaatggtttgaattcaaaccaatcattcataagagaggagctacctcattaatagttttcttagttcaagatcaagaaaaatgataagccatattaaaaattgtttgtgtttgcaagcattcaggagaatgacatttgaaacacaattaccaaaacaaaataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctcattgtgtcattttactgttccacatgaatgtaaccattgttgatgtatactgggatgtggaaatgtttgggaagcactgatgaatgaattaacatgattacttcttcacaactatgtccctgtactcactggtgctagtctgctagtcttgaagatctggtgggaagaatagctctttcctatactgcacacttcttttcctgttgcggtggatattttctcaaaactttatcctcaggcaaatgattccacgtgcttacttatatccgtaaaatcctcaaatttcatagttagctgatggcaccttattattttattttggtgtgagaatggaaagactcattctcttatacagtttctgccatttcagtatgatttcatttgggaaataaagtaagataaatgttcttatttcagcattttatatatttttaacatctttattttgaaataattttcaacttagaagagttcacaaaataatacatagagttcctgtgtaccctttgtataacttctccaaattttaacttacataatcatagtacaattattgaaataagaaaatgaacattgattttatactattaactaatttacagattagttctggtttgtacagtgtaatgttcaactattagtatattcactacatttatccaaagttttgtttttagagcctgcatagccaaagcaaggctaagcaaaaagaacaaatctggaggcatcacactgcctgatttcaaactatactataatgccatagtcaccaaaacagcatggtgctggtacaaaaataggtacatagaccaatggaacagaatagagaacccagaagtaaacccaaatacttacagccaactgatcttcaacaaagcaaacaaaaacataaagtggggaaaggactcccttttcaacaaatggtgctgggataattgggggaaagagtgggaggggggtgagggatagaaggctacaaatatggtgcagtgtatactgctcaggtgatgggtgcaccaaaatctcacaaatcaccactaaagaatttactcctgtaaccaaatgccacctgtaccccaataacttatggaaaaataaaatgaaaacaaaacaaaaacacacaaagttttgcttttacttaatttaaaacaaagaaattttgtaggctgcatgtggtggctcatgcttgtaatcccagcactttgagaggcttaggcaggaagattgcttaaacccaggagtttgaaaccagcttgtgcgatacagggagactcttgtctctgtagaaaatttaaaaaactagctgggtgtgctggtccatgtctgtggtcccagcttctcaggaggctgaggtaggagggtcacttgggcacaggaggtcaaggctgcagtgagccatgatcacaccactgcagtccaacctgggcatcacggcaagaccctaactatctcaaaaaaaaagaaaaaagaaggaaaagaaattttgcacttgaaaatagttactgatctttagatggataagtaaaataataaaatacctaaaatattttttcattttattctcattttcaaaaattttatcttttacttatctaattattattcatcctagttgactattttcattgtacagagcaatccccaccattatacgatgaaaccttagcaagtttttgttctttgcaacctaaagactaagaatccttagtagaatcatatatatggaaactcttgcacaggaaccaaatgtgtaatgtgtctcattcagagtggaagtgggaccaagaaatttattaggaactgaagtgtgtgctctcgcttgctctctctctctctctctctctctctctgtctcaatcttagtgctcacaaattatttaatattaacctactgaatactgaatatgttaataatttattcagtactcagtagttttttcttcttgtctctatataactcttttacaaaacttttttctccccttacaaatggcaacattatgaccatcataatcaaagtaagtcatcttccagctctattattcgccatagcctagaaacttccctttgtgactctgttcataatgcaaaagaggaatttctgaacatcactggttttgggagggcagaccactgatgtgtcactggcttgtatatcgatgcctttcatcccttatgtcaggttcttacctctgactaaaccaaactagctatatcatttagtctttgctacattgcaaccatctaccccaaatatagtaacttatataataatcattcatttgcttacagtatggtggggtcgtcaatttgggctggactcagaatggcttatctctgctctacatgaggtcaacttatgtgtctgcaagttcaagtatcatggctgagcttctctttttatgtgttctcttatcctcaaggagcttagtctaggctcattcttatgttgatgaaaggggtcccagaaacagcaagagagagcaatccacaatacagaagtaccttttatgtctctccttgtgttacttttgccgatgtcccattgaccaaagcaagttacatgggcaagctcagattcaaggtatagagaaatagattttaccttatgttagaagaagttgcaacaacacattgaaaagagacatgtggctgggcgccgtggctcacgcctgtaatcccagcactttgggaggccaaggcgggcggatcacttgagatcaggagttcaagaccaccctggccaatatggtgaaactccatctctactaaaaatacaaaaattagccggatatggtggtgcacacctgtagtcccagctacttgggagtcagaggtgagagaatcgctttaacccaggacgcagaggttgcagtaagcctagatcatgccattgcactctagcctgggcgacagagtaagactctgtctaaaaaaaaaaaaaaaaagaaaagaaagaaaagaaaagagatatgcatacagaaatggaagaatttgtggccttttgaaaaatctgtcattctaggccaggtatggtggctgtaatcccagcactttgggagggtaaagcgggagaatcacttgagccctggaatcagaccatcctggacaacagaaaacagaaaaaacctatcacactaatatagggaacctgggtgttacaacgtagaacataactatttaggacaaaaggggatgtggacaagcatttccccagccagacttgtgaattagtagctccagaatgtggctgatacaatgagatcagcagggtgttatacttcatttatattgatgcagtttattttattaataattataatgatctcaacgagagtcacgaaacaggttgaggaaagtatataaataaaaggcacacctaccatccacagtcagtcctttgattgtagtctaattaagactagataatgattgaatatcattgtccctgatggtggttttgtagtacagacaaattaaaaaggtggtatacttcctgatgtgaaagaacccactttgggagaaaagacaaaaacatcatcaccatgaacattaattggggtcagtgttggaaaaatgggaatttattctagctttcctttcttcacgttagccctgtgggctgaagttgtacattttttaatttctcttgaaaattgcacagttactgcccactttgtgcttttagattgggtaaacagaagcagtaaattcccagtagctaatgctttgctgtgtaaaggtggaaaatccgtttaaaagtagtcatataaacctctattttctggaatgtttctaagatattagaattggacacatccataaaacagatttctctatgaggtcagcaggatgccatacttctttccatgcactaaaaggcacaccttggttctgaaaggcttaatagtctcaaaaagtgaacactccagtcttcactctgtatagattcactcccagggagagaagggattctactagtgagcagaaaatcaattgctgagtttctgtagctgctttaacttttacttaccagtaggacgccattttctctttgggaaccccactggcctaaacattagctcccttttcaccagcagggtcaggcccttgctgtttctgagttaggagttttatacaatatacagaaatgtccttatttttaaacatataattgcatataaaaatgtgttggtattccttagagatagttgttacaagagaaaacctacaaggaagtaaactgtaattgaccactgcctgacccgttatatggctgtatttaagttttatcctccataaaataattatgatggctttgtgtgttaaaaatagctatttatattcatttgagtgcaatacttgttattctctgccctggttcagtcataggagccctgaaaagcttatggcctgaaggttttgagttctgagttgaacaggataaacactcctttgacttaaaggggaagatgacctttaccattgtagaattcctgtaacaaagttgctgttcattaagtatcatttatgaattccaaaatcaatttgaaaaccacatgatatatttttaataattctagtacacgacatactgtagaaaactgctcaaattgagagaaaattaaactagaaataactaccagttgactgagtacaacttttagttgaaaacagtacagttgtccaagatgtatgatacagtaccaaacggttctcaagactttttgtcctatatattttttttaattagaaaactcactttgaaatttttgacctgtcaaagtgaaagcatatcttgaaaaacaataaagagcaagctggttaaacattgaaaaactgtgaaatgttgaaagcctccccggtgagtaggaacctcattttattacatctgcgacaaaaaacaaatgaaaccaaagatctttgacagtcatttttttataatttatttttagtaagtcatgctgtatattgcgtcttttaaattagggtgtatcagacaatacttagactgttctgtttagaaacttagaaaaccattttttaagggggaaaaagaccaatatgtgctacattaaataatcatctaaaaataaaaagcaattttggttctgctatttcctaaggcttaattaaaccatatatggccaatacagtctagtgactaaggaacaacacataccatgatgtcaggtagcagttttctttctgtgagatgctacttggagggaatatgtttttaggactaacaaagcacctgacaatttattgcaatgaacatattaataatcatttagcaacatacaagtggttacatatagtatgctcttggagaaaccagttatactttgtgtagccgtttcctcaagaaataatgcccagtataatttagaatggccttagaacatttaaaccagtggtgtgctgaagacaacttgtatcagctcgcaagagactggtaaatggtacaaatcactgacctacctccctctcagaaaaaaaagtgattaaatattcatcagtgtattactgaatttttaattatatatagtttaaaaacgattggattctacatgatcttattttgaatgaatatccatctttttattcttactgtggactctcagtgtaagttcctgaaatcaactaaatacatttataaaaataatttatcttaaaaaacatgatccatctatccttgtgcatatttgctattatgtcaaattgtacctcctagttagagtgcccattagtatacatgcatttttattatgccagtgtatgtggaaacccttttgctccccccaaaagacatgctttatcttgcctttgaaaatagaatttccagttgattagtttttattgcaaagctgcctttcacactttcacattgaggtaattatatgcgcctcatattgttttttaaaaaagatgtttcattcattgctttccaaaaaaaaaaaagcaaaataatttatttcctctgaagagggacatgaatttcagtgtttattcatgaagtttacaattgatatatgtattataattgtcctagaaacactttttacaataagatatctttgtaattacgcacctaggataatttggtataaaaagcagtgatattaaagagtgaatagtgtttgcaggtcatagagctttgctctagtattatttgctttactgcaggattcaacataaggcaggtgtcttgtctcatgaagtttattatagaaagagtccttataccatattttcacttatgatgtcgaaacttagaataattttattcaaagaatatcctttgagctccaataacacaaatcaggttataggaagtatcaccctggtacagaattgttcacatactcatttgtcattatttgaagaataaatgaatgaatactaagagcaaaaattagtggcataaatcagaaatccattcattaataaaggagaatacctagcatgtacttgaacagttagggtagacttcattgctttggtaagactttcatgaacatggagtttataagtggaaagacaagaaatgtttttggtagaagaaattgcataagcaagcatgctgaggtataacttcaagtacatttaaagttcagtaaggggccaggatggttgaagccaagattccctgaagttaattctggagagttggaataacattacgtcataggagagactgaaagttaatcctgttggtcatggggaaccactgagattttaccaaaacacttgatttagaaagattcttatattgtgtcaggagtgaaattagagtgggaaaaggaagcgaaagcctggactggttgacttagttccatgagattctctgctatttaaatgtgtcctcagtctccctgctgaaatctaaagaataatctgaaggcaaaattattcccaagtacgaaaatgttttagaccttcttcctaggcaaacatatttctcaattccatgtccatattacagagattgagtatagtagagactcagttttatcacttgtcaacattaatctgttgattgaaatagtaaaaatgtgaagaatttgattcaaaataattttaaacatatacatatactaatatttactaagactctttgacatgcataatacagaatcagagtcatgaaagtaaatgcgtaaaagaaagaaaatacgcaatgggtggttgaggaatacaaagacttttaatagaagtttcaggtatttcagttctcagagggaaatgggaatagctagcatttatccagcagtcctatatagtagtatagaacttgtcatttacagatgtcctagctagggctgctccacaacaataccatagactgggtgacataagcaatagggatttatttctcacagttctggaagctggaaagtccaagatcaaggtgctgatagatttggttccttgtgagggctggcttcctggcttgtagatagactccttctctcttcattctcacatggcggagaaggaggactctggtatcttttcttcttataatggcaccaatcccaccatgaagtcctgcccgcccttatgacatcatgtaaatctaattatctcccaaaggccccacctccaaataccatcacattgggggttagtgcttcaatatatgaattttgagggaacatattcagtccataacaacaggtgttaccatatttaatatttacaacgatccaatgaaaggtactattcttcccatttatacataaggaaaccgcgatagagatagctttaaaactttcccaagattagtggctgcagggtgagggtgttgagaagcagccagggtttgaagccaaacagattcctaggaaaaatattcttaactcattctctgagtttaagtagggtattagcagtttaatgatgatggggtaacagttatatgtaagtatgagtgtgtgaatgtgtttatctgtctatctgagtgaatgagagagtgaagaggcagggagagagagcataagcaataataacagaaggtaggatagtaatttaccactcttactatgaggtgtgggtgtactgttctagatgtgtaactaaaaggaataattttaacctgattattttcatcatacccacttggtggtcattttgtaaactcccacagctcttgtaacagtatatctcaatagtaaaaaagtctttgaaatctatattgggcacgctgagtaaagtgcatcttttttcttccaggaatctctttctaacagtggagaaaccaactggtgaagatcaataaagaatgcttgttttaaacaagagtaacttatgcatacatatgcatacacacacacacacacacacacacacacacacacacacacacagagagagagagagagagaatataaggaagaataaaatcatcttattttacaaaacaccagctgtgttccagtgttctatctattgaaaatgagaaagtatttgactaaaataaaaaaagaggaaggaaataatttaaaaatggaccaaaaaaaaaaacagtcaggagaagaaagctatattgaggaaatcctcttgacagctaatattatttttagcattactaatttgacttccttgataatatcagcacttttactattacaatcttaatgacttgggaaatgcaagctggatagaaaatgtcaaactggaaaggaaaatttcaaatgttttgctttgtaattaaggcctgacaaatataagtcaattttagcataatagatagattatcaagtagggacatttagctaatgttagaggtaaaaaaaattataatttatatttgaatacattctgagatggcttcagtgtgctgacatgttttaaaaagtgtaacaagtcttaacaagattccaggaggggatacacacatgtggacacacacatacattcccaactatctgtaaagggccagagagttcatattttaggattttatgggccacacactcttgatcacaactacttatctctgctgttgtagcatgaaagcagtcttagacaatatataatcaaatgagcatggctgtgttccaataaaattttctttacaaaaccaagcaaagagccagattttgcccccaagccatagtttgataagcacttatctaatacatattcatatgtttcatatagagggatagcttttactagcaagcagtagtaataggtgtgtgcatcattttaagcccttaaagagctaaatcatatccaatcattcaacctttaaaaaaatttgaaaattcatatattttatattttatctgatgcaaccgttcctattaatatttaattcaaatgaaagttgttaaaatgaagtggcattttcatattcaaatctactttaaatgtattcatgcttgtcagtgcctcaaatagaatctgtgaaaaattctcataaaatagatcctaaattttgtcaaataaacttggaaaataattgcagaatacttatttaccacttcccatacatgatttagcttaactaaggtgccgatatctgtgtatgatagcaagttaggtagtaggggggttggcatttatcttaaggagccacagtgacactaataattgatcagaaatagtcaagttcaaaggaagcacgttcaaaaaagatagtgaagtttctttaggtacaagacggaaaatggttgactctctctatacctaatattaaaaaaaaaaaagaatctatggtaattttcttttcttctattcttttttattatttttatttttttattttttattttattttttttttgagaaggagtcttactctgttgcccagactggagtgcagagtgcagtggtgcgatcttggctcactgcaacctccacttcccaggttcaagcgattcttctgattcagccacacaagtagctgggactacaggcgcctgccaccatgcctggctaatttttttatttttaatagagacggggtttcgccatgttggacaggctggtctcgaacttctggcctcaagagatctgcgtgacttggcctcccaaagtgctgggattacaggcatgagccatcacaccaggcctacagtaaatttttaaaaagcattttaattggtaattttacagtaacctgggatgcagaattgaattgttttatgaattaatctccaaggagttacttgaatttgttctctctctctgtctctctctctgtgtgtatatatgtacacatacatgtatatgcatatatatatgtatattctatgtagctctatatgttttgttccattagacaacctggaatacataaatgttaaaaaattttttgtgaaacagtggcccacattaaaaacggttctcatttttgtttgtcattcctcagaacaaaacagtatttggtggttcaacaaaatagaaaattaattttaaaaatagagaggaaaataaatttaaatatgatttttcccagtagtcctataatttatcttaataagaaaggagtacaggtttcaatgcagcattgttctaagactttttgtgcatatcagaatttggattcatgtttttttaaaaaggaaaagaaacacttgtcgtggaaaaagttattcagttagtcaaagtcaaaataacaaaataagaaacgtcaagtaagtaaatataacctgggagttctgaaataaagataacaaaatgattttatcaagtatctaaagtctatcatttctaaagtgggtaaagctatcataaataaagcagaattatatttacttttctaaatactaaattatatgcagtatatgcatacaatttgctttatttaagaagatggctaacttatctgattctttctttatatgttttagattaattttctagagttgactctcactcaggtctaggcagaaaattattggtgtggaaaatatgcccattccagtgaggtcatctattacatgtgcatgtaatatatggcagcaggtaattgagacaatgtctctttgagatggcagtccccttgaagtcattgccagggaatatatttctctttaattttttatgagacaatttagggaggggattttgtgacttatcagttccagaaattatacctagcaatacagaaaatgatatgttttttcttgtggatggtacagctttgttaatttttgattttgagatgctttagggtagagaccaggcttatcagctcaatgagaacatgtgtttttgtatgtttcattcttggccatatcacaagtgcctataacagtgcctggacaagagtacatgctcaataaatacttttgaatcacaggattaacctttacattgccgattgccagcagaaacttaggagaaagccatggtggataatcaaaaagtacgattaaattaagtggaaagagcaattataaataaataactaccttaccattccccacagtgggtctgggaattcatccttgtaaaaccacggagagtgttcctctgagagtgactacagattttttttttttttttttttttttttgagacggagtcttgctctttcacccatgctggagtacactggcgcaatctcggctcactgcaacctctgcctcctgggttcaagcaattctcctgcctcaacctctcaagtagctgggattacaggcgcccgccaccatgcctggctaatttttgtatttttagtagagacagggtttcaccatgttggccagagctggtctcgaactcctgacctcaagtgatccgccacctcggcctcccaaagtgcagattttgtttctcacataatgagaagctgagtgcaatctatatgctgtaagaatatcccattcctactcaatagtgtctttatgactattactttaaagaaatgaagtaaaaggtagttttacttcacatacaatatgtgaagtaaaatgtagttttggtttacatgtatatatgactatatgataatacttcaggaagtcattaatgaggaaaacgattccaagacacatacataatcggattttttagctattgtgtttgtagcttactttcaacattagtaagcagttgtaagagaacagccattaccaattactgtaaccgcagcattacacagggagaaatatgactgttgaccttgaaatgagtataagatcatccccagtagaagatcacagtccaacaactctcaactctggctgcacattgacatcatctgggggagcttttagaaaattttttttattagatctaggccctaccttcggagactcttcactgtttggacgtctgtacatttttaaagcaacccaagtgattctattgtgcaattatggttgagacgatcgaatgctcttcaaattgttttactcagataaatttaaaggaattttgaaaaaacgtgcactatctcccatatttcaactataaaacatttcagcatatgtttaaacagtttcaaagaatatacattcctctgcatcatctatgtgttctaaatatattttggttgaatctttgaattgggtatttaactcattttgtttgtgggaaaagataacattaagacagaggcttgccctgaatttttttccttagacaaaataaagatctgtacctttcaatattttctttaagatatcttcaatggactatcccaaatgctcagcgcattatttaatggtccttttgtttgatgccctggagggttttactccctggagcaatatgctttgataagatttgccatagtgaggtacgtctttcttcttcaaagtaagaaaagtgtggttagataagagaataggcacattatcagatcaattttagatgtgtctgaaagctgaagatctggaaatagattcccttaaatatgttcatgtctgtgtactccttgaaaagtcctcatattttagtgtatgtacctcagttggaaggtagctggattaaacttggagctggtagttttggggaagacagagacaaggggacaggcatgagaattggccaatccctggtgggatctccaaactgaccagcaggttgataggttggttgggaataaggtgagaactttttaatgagggccatgtgtgcaccacatatcatagcaaaataggagttcaaaactaagcagacaagcaacaatctaagcacaaatttataacagcagaagaaccagagttggagagaaacgagggaggtagccaggaatcaagaggaaaaaattctgaagggcaaataaagatgggagaatgaagtagaaaaattgttcaaaaatcagcaaagctatatggggaataaaataatacaataaacatgactacaccaccaatgagagatgccatcaccaaagaggtgagaatacatgaagctcgcctgtcttccgtttgatttttttttttttctgtgtctgccctttggagtaggaacaacttctcatgcatagtagaggcaaaaaccagcatctgatagttccatgtcttcagtgtggagtagaaagcaggaaagagtgggtagatcccgagtgcacaggaaatgcacttatgttcactgaaaagccatacagcatccaactatagatgacattggctggaaatatagaatcacaaaaattattcacagatcttttttttgctgaaatcattttaaataaagtctgacggggagggagagcatcagcataaatagctaatgcatgcagggcttaatacctaggtgatcagttgatagataaaggaaaccaccatggcacacgtttacctatgtaacaaacctgcacgtcctgcacatgtatcctggaacttaaaattttttaaaaaaagaaagtatgtgggaaaaaaaatatcttacagagaccagagatttttttcttttcaatacatttctttagtttttgttttaaccaaaacagagttccaacagttatctcttcagtaaatgaaagcatctccttaagctttaagtggtacttgaaattttaaaagaggattattttttccaactcagtgaggttataatatacactccaacaactttataaaagcaagagaagtagagtgttaattgttaattatatgaaagtgttcaggcaaaggaacttttaccttgaaagcctttactctttagcatcaaaataagcttgaaagttctatggtatttagggaggatattttaaatttcccctacccaagaaaactggataaggattaatacaaaaccccctccagaatattaatttaattaagtagttatccaaagtgttatcacaaatacatgatgtgagttcacacttcaggcccttacatttttatattgcatggcatttgtctttttaattaaaaaaaccccacagttctattgtattgccatggggtttttcatttaattttccatttaaaagtagttttatttctccttttaatttaattaaaaacgttaaaattgttagggaaaaaaagaagaaaatcctgagtcatcactctttccttccttatttattcacattattgatgaaggtctgtctagaacaaaccactgatagcacattatcctttgaaaggcagtgaaacaccgaaaattggagtttgctcactttgaggatcatcgaaaacaaacagctgaaatatttttttccttttagaaaattaaaaaaaaaactgatatgaaatttcctctatttagaagcccatgtctacccaaaaatagaaaaaaatgttttctcaaaagcccggaattagaacatcttacgacatcttcaactctaagttgaatttcattaaaatattttgttgcacgtttttgaagtggcaaacatcttgctttttggaaatctcagttttaagaaatgaaagaggtaaagagtatttgaattataatcattgtctaagccaggatcagttttctggggtgggagtacagagagatgcatcgggtagggggctagtggtcatggctaactgttataaaacttctattgatgccacccatttggatgacatgagattggatatgggctaagacttttgttgaaaggaacgttgtttacttggaagtgttccagtaggcatttgccagtcacagaatacaagaaagaaaaagggagtcattcattttatttcattaaaacatgtgttgaacatctactaaatgctgtaatctgtgctaggtgcagaagatataataataaaaccagccaaaagcgtgattctcatggtcgccagattgaaaaggggcttatcagttacggaagactcaatgcttccaaagctttaataccacccactttttattgaccgtttattaacccattttggctaggaaagggagtgaaagaatgtttacatgcatatttatatcactatttacataagatattttttctaataacacttgaaattgcgtttttaaattgttttatggaagaattttgagcccaagctggtacggtagcttactcctgtaatcccaacactttgtgaggcccaggtgagaggatagcttgagcctggaagttcacgaccagcctgggcaacatagtgggagcttgtctctacaaaaagataaaaaatttagccatgcatggtggcatgcgcctgtggtcccagctactcaggaggccgaggaggaaagatcacttgagcccaggagatctagtttgcagtgagccgtgattgcaccactgtactccatcctgagcaagagagtgatgccctgtcataaaataaaataaaatgaaatagtaatgtataccagcttttatttacctctattcttttttttttttttggtccaaagcatgtgtttcctttaattttttttctttaacttttattttagatatgggagtacatacacaagtttgttacatgggtatattgtacccaggtagtgagcataatacccaataggatgttttttgacccttcttccccaccctaagtagtctgtagtgcctattgttatcatgtttatgttcatgtgtgctcaaagtttagctcccatttatacgtgagaacatgcggtctttggttttctgttcttgcattaattcacttaggatagtggcctccagctgcatccatgttgctacaaaggacacgattttgttcttttttgtgactgcatagtattccatggtgtaccacattttctttatttgatccaccactgatggacacctaatgttgattccatgtctttgctattgtgaatagcatgggtgaagaagatacaagtgcatgtgtctttttggtagaattatttgttttcttttggtagaattatttgttttcttttggatatatatttagtaatgggattactgggtctgttttacattctttgagaaatcttcaaactgctttccacaggggctgaactattttacattcccaccaacagtgtataaacattctcttttctccgcagcctcaccagcatctgttattttttgacttttcaaatagctgttctgacttgtgtggatcatatcttattgtggttttgatttgcatttatctgacaattagtgatgttgaacattttttcctatgtctgttggctgcttgtacatcctttgatctcgaactcctaaccccaagtgatccacctgcctcagcctccccaaagtactgggattacaggcgtgagccactgtgactggccttgtacatcctttgaaaagtgtctgttcatgccctttgtggtttttacttgttgatttgattaggaatcttaagttccttatacattctggatattagacctttgtcagagcatagtttgcaaatattttctgccattctgtagattgtttactctgctgatagtttcttctgctgtgcagaagctctttaattaggtcccagttttcaatgtttgcttttgttgaatttgcctctattctgaaaaattctgtcacgtaccataaatattttgttgtagtaagttaggtaacacatttaaataattagctcaacatcctgaaatatggactactgccaaatggatacaagaatatatacaaagagagttctactccttgactgcccagtcaagttgcacacacacactgttcagatgggtccttggactatgtcaaatcacattgaagtaaacagtagttggtgattagattaggatgaaatataaaatccataaaagtaatcgcataaaacttttaaatggcaaaactgcaattacttttgcaccaacctaataaatagtttctctttattaggacatgcagatataataattagcctttctctgatcggtatggtctagatcagagatcagagaacgtttttgttttttttttttgagacagggtgtcgctgtgttgcctaggctggtcttgaactcctgggctcaagtgatcctcctacctcagccttctaaagtgctgggattacaggtgtgaactaccattcccagcctcagaaaacttttttacgtaaagggctagattgtaaatgttttcagttttatgggtcatgtggtttctgtcacaactattcacattctgtcacaactattcacagtcatgctttgtagcttgaaagcagtcacaaatactaagtaaataaatgcatatggctgtgtttatataaaacatgaggggatagatttggcgtgtggtccatagtttgccaaacactatctagacaacataaaggttcaaaggaggaggatatgacatcaaattggggcaatgagaaagtatttcattgaagaggtagcacttgctattattcttgaagcctggtagatgaggtaagctgacattgtggggtgatttctggtggacagaatgtggatagtttaagaaattgaatttttatgaacactgagcatttcgttatggcagaaatatagactctgtgtagaggagtgactctagatgagttaggaatgtagatttgttcatgttttagagttttcagtaccaggatgaggaacttgtacctagcttgacaggcaattatagaccattaaatagtttatatcacaatgggatttggtagaaaccacactggaagacagtcattctaggagtggtgtgtggaataaattagagaagtaagggactgtaaacaagcgagcggattggaagagtgtcataatagcttaaaaaggagacaatgagggccccaacatagtcaggtaagaggatttctaaaaaagaggttgttgaggtaaactgtaacattctaaaaattatttctttaattgacaaaaatactgtatataattgtgtacaacatgttttgaaatatatatacattgtgaaatacctaaatctagataattaacataagcattacctcacctacttatcacttttgtggtgagaacacataaagtctactctaagcaattctaaagaatctaatgcattgctattaactctagttatcgtgttgtacagtatgtctcttgaacttatttctcttatctaagtaaaattttgtatcttttgaccaacatattgccccccacagccctggtcgctaccattctattctctgcttctaagaattcaacctttttagattccacatataagtgaggtcatgaggtatttgtctttctttggctgtaacatttaaggatgaacaactgggaacctaaattatttccaagctgtagtcccaccatatgcaccagtacttttaacggagcctgcctagttcctgtttctagaaaactattcagtaaaacagccgtcttctatgtattatgtatttttcctaagtcgttacctagggactagaaccctgcctagatccctgtgcccagtgcttcaagccgccttaactatcttgtaatattggcctctatgaatttttaagtagcagaatcagctcccctgagattagtttatatctccccacctggagtggactgcatcttgggtctttgctcaactatcactggagacattcacatttgctgggcggcattgtgccgacccatcatattgatctgtaacgtttagcctgtggttgggcaatttcttcctgcaactattgtatcccactatgtcaaacaaacatcaggtcccatttctacttactccagcctcttgtaagcaactacccatactacaggcctgaatactgagatttgccatacttcagctttttttaaaaactgaggagtaagaattatagacatttgagctactcctccttgtatgtgtactaataccactatgcaacttgtctattaatattattacatacaatttgaaattatattcaaaatagttaacagcctggtcattgacccatcaaaacacttgccagacataaataactgcttgcttaccagctagaaaaatcagccctgcctgtgacacagaaataaaccttcacaaaaacactaaagagaagagctaaaactatgaaatgtccaaaagaaaacataagagataatctctgtgaccttggagtggaccaatatttcttaaatatgacacaaaaagcatgaacaagataataaatattcatgttaaactttatcaaaattaaacactttttttttcttcaagagatattattaagacaacctaaaaccaagccacagacttgggaaaagtattttcaaaatataaatcagatgagggcttttatccagaacatagaaaatgtataactcttgataataataagaaaaacacatttaaaaaaatagcaaaatatttgaatagacacttctcgcaagaagatatacaaatggccaacaagcacataaaaagttattcaataccattagtcattagggaaatgcaaattaaaaccacatagaaataccacattgcacccactagaatggctagaatccaaaagactgacaatactaaatattggcaatgaggtagagaaactaaagttgtcacacattgctggtgtgaatgtaaattgatataaccactttggaaaacacttttgcaatatatttttaaaattaaatatactatggatatactatatacgtaactataaatacactatatacatatataactatacaaaaatgtactgtgtatatatgtggaaatatatgtatattgcataaaacccagcaactccacacctagatatcttcccaagaaacatgtttatacaaacacttgtaatttaatgtttagactagcagtattcagagtagcccaaaactgtaaactctccgaatgtccatcaactagtgaatagataaacaaaatatgatataggcatacaatggcatgctactctccccaaaaagaaataaattactgatatatgcaaagacatggattgatctcacaggcattatactgggtgaaagaatccagacacaaaagtgtaggtattttattatttccattatatgacatttctagaaaggataaaactatagagacagaggcaaaatcagtgggttcctgggaccaggggtagaatcacagattagctacaaattggcatgaagaaactttggggtgatggaagtgttttaaaactgggttattgtgatagttgcacaagtatataagtttactgaaactcattaaactgaacatgtaaaatgggtgaattttattattatatgtaacagaaaagctgttgaaagcatagaatactgttatatgaggagattatttctgtttaaaggtgatttttctagaaagattttataatgtctaaaatataaaactggcacatcatagaatgagtacatataagtaaaactttttttttgcaggcatgcatatgtgaaattgtatggttctatttatggcaaacagaaggaaactttttacagtgaaactatgttcatagttttcaagggaaaaacagctccatgaaataaaatattgcttggggagttctttcataccgcttgtcaccagcattctcactggcttataagttataattgctctgtgataaaggcgtatgctttccttctctcttataaaaattttaatgagaacttggagtgaactctcactgaacctattttcattccaaaaatcttatgattttaatcttatgatcctcctgagacctggcactatggtctgtgacagcatgaatacttcataattattcctcctgtttgtagaaaacaccatgggcatccatcattccctctctcccctgctgcctccagggagtcacagcctctagcaaggtcagtaattgcagttttggttgacagttccaggccagctgaagcaaatccagctggtgaagactagccacaatggatattgactgacttcccttccttctttcacctcatagtcagtttggccttaaaactcttccttagtgatgtgatagatggacttaaatcatcccacaagagattccccagtacagagaaaatgaatggtttctctagagccatgtgtatatgtgtctgtcggtatttgggggacaattgatctaaccgtcctggggtaactgaaaggtctttcccttggggataaggaaaagactgtattggagcttgacatttaatattgtttggcatctcacatctctgtagataacctgcatgaaataaaagattcagccatgtgaattaagatggtattttggaagtggatatgcttcatttggctaacatcgaaaattctaataacagatttgccctgtgcatagaaaaaatagatgctttagatgtcaagcaaataattaagcattaattttttactttattttatgacaaatgcatagagagattcacacaagaaataccaaaggaatgccagatgctttatcaaaaaaaaaaaaacccacattatgaatccaaagaaagatagacaaatagccttcatagtatgtaatattggatggtatagctttacgaaaaagaagataaactttcatgtgaattgctggtgaattccagaaaagaaatgactttcgaaagtggtataatacctttaactctctaacttctcaccatgtggtttactcatagtgtagaccatgactaaagtaccggcagaaacaaacccaattaggcatggcctattgtatagatactgaactagtctagtgtctttaggtttgtaataagtcagggtttatttttttcttgcttttttaccctggtcccttgtttctggacttacttggggtttaaaagatgtatttgcttaagaataacttaattacccattctggataaaaatttaatggaatgtgttagaaggcttaagtgagatattaaaattaattgaaatcacgacccccacactctttgacacacctcccattatgaggtagattgtgagcggccttatagttactccacttaatagaataaagttgatgtgatgttatgtaacttccagactaagttagaaaaggtcatttagcttctacttggttctgtctagagacatactctgggggaaaccaacaccatgtaaaaagctgtcccgtgaccaccatgttgtggaggccccgtgtaggaatttcagccgacactaccgaccaacagttagcctccacttccagccctgtgagtgagtcatcttggatatccagcccagtccagtctttatgtaactacaaacctacctgatatttaactccagtcccctgagaggtgccaagtgagaactcctcagccaattccttctcaaatatttgtctcacaaaatttttagaatatctttaatatatgtgtaatagtaaaactactgtcactcagtaattttgatattaactgtatgtttattttggatattcagtttgttatgtgtctatttaaataattattgaatttctattaggaacacttgttcagcctatctaccatgagacttaaaaagcctaaatcacagtccttgccttagaagaatacaattgtcagtggagtagatgcaggatcatcaagtatcaaaactctggagcacaccattcatattatagtctatgtaaatggtctcccttgagttgtgcaatgggatgtcactggaaagataagacataaagtgttattttagtaataaccattcttatactggtaagcttctcaggattggtatatatgagtggtaaggaatactactaaattttatacttttccaaacttctttacagtactctgttgttgacaaaagtgaaaacaatttagttagaatgtaaaagtaacaaagaagttttaaaggaatatataatgttctgtcataaagacacaggcacatgtatgttcatcatggcactattcacaatagcaaagacatggaatcaaactaaatgcccatcaacagtagaatgaataaagaaatgtgctacatatatacaatggaatactatgcagccataaaaaagaatgagatattgtcctttgtagcagcattcatgtagctgtaggccattatcctaagcaaactaacacagcaacagaaaaccaagtacctaatgttctcacttataagtgggagctaaaccttgaggacatatggataaaaagaagggaacaagggcctactttaagatgaagggtggcaggagggtgaggatggaaaaactacctattgggtactatggttattacctgggtgacaaaataatctgtacaccaaacacctgtgacacagaatttacctgtataacaaacctgcaacatgtaccccttatcctaaaataaaagttgaattcaatttaatttaatgcaaaatataatcaaaattttagtctgggagtagtggcttatacctgtaatcccagcactttgggaggtcaaggcaagaggatagattgagctcaagagtttaaggccagcctgggcaacatagtgagtccctgtctctacaaaaaaatacaaaaatcagccaggcatggtgacatgtgcctatggtcctaagtactttggaggctgagatgggcggatcgcttgagcccatgaggttgaggcagcagtgagccatgattgtgccgctgcactccagcctgggtaacagggtgaggccctgtctcaaaaaaattatattgcactgtatgcaatactttgtaaatgcatatgctattcttctaatgcttttagacacttcagtgcgtgtcatgagaatatgccaagttgactaactataaactgatggttcccaaatttggctatacattgaaatcacctggggagttttaacaaccaactgatgtctggttcccactcccagggattcagatttaatggatcgggggtacagaatgggcattgggattttttaaagatctgaaattgttttaatggacagccacaaccgagaacaactgatatgtatttcttcttttaattaggtagttctcaaactcaactgcccattggaatcatctgtggaacttggcaaactattagtgatttggttccatttctagagactctgatttaattgctctggggtaggtcctcttggtacttttaaaaatgctcactagttaattgtgatttgagatccaccaataggatgctcatactgggtttacagattaatgtttttctgcatatatgtgtcactcagcctcagttaccacatcattactattgggacacagctcaggttgccaaattcagcaaataaaaataacttttcctggataagtttgaatttcagataaacaacaaatacttttttagtgtaagtatgtctcatgcaatatttgggacatacactaaaaagtaagtttttttaatttaaaattcaaatttaaccagataccttgtattttatctggcaactctaaacacagtataatttaggcaagagacagagcaaggcccaaataatgcattatatgaagtgtgaccacaatggtgttcaatccatattccaggacagaactaagatattcttattgtcccccagctgccacagagtaaccattctatcccataatactacttttaggcggtctcatctgtagcatccctcttatttattgagcaaaagcaatggacagatgtaggagacagacagaaaaaacctgaaacctcctgtcccatcagtgttaaatcttttggcaacagagagtgttaaatctattggcagcataagctgaaatcatgggactgaaacttatgacttaaaaaaagacaaacaaacaaaaatcctgtgggtttctattgtttttacttatgcaatttctcaaatattttcatgtaattatagaagagaaaaaaaaacagattagtgctgaagttctgatcactggctgaacttcatagccttagcagccactgttaaacttcgaggttctgtcgcatttatagtgacagccaattccctcagagttacacagcagttgctggcaagtataatctcacatttggcaaatgcttgcatttctgaagctcactttttcattggttcttctcaacaatgctgtgaagtaggcagggaagttatgatatccattatataactaaggaaaattagaatcaggaaagtgttgccttgacctagagtagtatttcttaacgtgtggtcctggacaaactgcctcagcattacctgggaacctgttagagacaaaaattctgaaaccctaccccaaacctactgacttagaaactgcaggataggcccagtaatttgtgtttttataagccttctagtgattctgttgcatggtcaagcttgaaaacccctgccttcaggggtatgtggtcccagctcaaacattactaatactaatgtttatttatttaatttatagtttatttgtccccctggagtttaaaggctgtgaggtcagggatggtgtcacactgcctaggtatataatagatatgcagcaaatattgcaaaataaattaatgaagactagaacgagtgaatgcatgaatcccacatatgggggcttccattgccatgccttgccttaaaagaagtgtcctgtgcttagaaaattccattgcttcgctcattctctcttttgaagaatctcagctaatgggaagaaaaatggttgactgcatgaatttatccacaggcatattgagactagatatttcccttgaccccttagtgggacttgcgaaggggtcgctcacttactcagcctgcagcactcaaaccccttgagggagggggagcacacaggtgagcggatgtgggagagccagggccaagtgcctttgggcaccggcaggaatgaaccttgtactggcctgtggcagagtaccacgtagtacctggaaggcaccttagtttatctagttcagtcctctcattgtatacataaagaaggtaaatttgtgagtggtaaagtctgtatctacgcaataaaatacttcaatagctggggctagaactctgatgcctttattccctttaatatgcaaaggttttgagtacagtgtcctgtgaagaatgcttgaaatctcaccatggggaatgtcaccagtgcaattctgctgtcttttatttttatttttatttattttatttttttagatgcagttttgctcttgtcggcccaggctggagtgcagtggcacaacctccgctcactgcaacctctgcctcctgggttcaagcaattctactgcctcagcctcctgagtagctgggattacaggtgcctgccaccacgcctggctaatttttgtgtttttgttagagacagggtttcactatgttgcccaggctggtctcgaactcctgacctcaagtgatccagcgcctcggcctcccaaagtgctgggattacaggcgagagccactacgtctggccaattctgctgtctttatttctgcttaattattacttttaatttcattattttattacaaaactttaactttttatattgaatggtattattaatatggaattttgtatttataaagtaaagattgaaggaagcgtatttactgctaatggaaagtatcgcttactttttccttcaaagcaggaaaagcaatgtgcaaacatgtaagtgaaggaaaaatccaaccaaatctcttacccgagtatctacattaatattgtttggtgggtgagatatttctgcaattctgcagtattaatccatccttctttattatgtccaccgaaggtgtaacactgattacagtatgttttagggaaaacaatcctcctaggcatagtggcgataattcttcgacttttttactttgctgtcttggctcatcacggtgacctttaattcattttctcttgtctggtcttctttgcagacactacgaagccactctgtggtgtctattgagctaaagtcaattaatcacagggtgacttttaaaaaatcaagattaataataggttatttcatagccagaatgcttgattaagatgggcacatttgtggttcccctcatggctagaaataatttagccaagttacaatatcttgggcaaatttttctctcttataattttcccaatgagaactgctcagtttaaatggacttccctaagcttccatcaggggttctcagaagggttatacaaaatcactttcgttagctactgggtactcctaaatggaagcatctttgtaaagccatgtagcattggcacctcttcacaaaaacttggggggagtccgtgaaaaaaataacgggaagtctgtctttaaagataataacgtctgcctccaacattttacacatctcagtcatgccctgtggtgggagcaaaagaattctcttttctctttagtcttgtgccaaattttcttttcctgttggcctgaatccactaatgtccttggtaggtggatcctggtgtattaaaagattcatagcatttcatatttatattctgcttaacaatatgatggtacaccttagcagtttagcaaaatggcaaatctgtttgcataataaaccatataatgtgctgcatcatcaatttgactttgctggatgaacgaagagaaccagttggctctgatgaagttgagttttacaggtcaatgcaccatccatattaaggaaatccaggacaactatgtacatatatattgtagctagaggctgaatacattttgtacaatatttcatttgctgttataaaagaaaaaaatataagcttgggtacagctaccatagaaatcaatttttaggttttatattattactgcctttctattccccaggtgtgctttttcatagcatctccatcctaaacacaattgcctttgaagtaccaatatatctcttagtggatgacaatttccaaactctactcagaaaatacagtgcaaatcctggtataatataatggaactaccaagagttgttatggggctacatattttctgttctctactctcttgagatcttagcaaaatcccttcttggtaaccttggcttattgaaaagggctaatttatttggcattaatcagaagacatataccatctctcaactagactctctccacaacgttcctttaaaatttttaatctagtgaaaacagggggtagctttattctgtaatagtaatatggttcatgatatggagactgcagaaagaagactgtaaagctgaatttcactgcaagaaaatcgtgacttcaatacttcaggagaaaatcttgttgttcagtttgctggaattaatagttattttacctgtcaaactgtagtaccatcgaagtttcaccagactgtctagaacagactaatttgaagaagtacaatttcccaagtaatgttttattctgcagtccctctcttcagggcaacacacccatgtaggacctctcccactgctagtttagtcatgtgaaagagaatacctcttgttgttgcaagttatttcatcatcatcttgctaaagaaatgtctcactctcctaagtctccaagatcttttattggccagattccatataaggctttgtgttctacatttgtgatctagggaatttaaagcttttcacttctagcttaccagaggcttctgtatgtggtaaatcatacattgatataaaaagtaaataataataatcataataatagttatggcttatgtaacctatctttctcaatagttattggaccatgataagtgatacctcaataccacataccccttcacccaccatccactatctctcatacccttcataaccaagcatctttttttcttatacaattttattaatggagatacaattcacataccataaatctaccattttatttatttttaaaatactttaagtttaaagtttattttatttaatttattttagagatagggtctcactctgtcatggagactagagtgcactggcatgatcatagctcattgcagcctcaaactcctgggcccaagagatcctcctgccccagcctccagaatagatgggactacaagtatgcatcgtgtctggttaatttttttatttcttggcatagacagggtcttctctatgttgcccactctggttttgaactcctggcctcaagcaatccttttgctttggtctcccaaagtgcctggtttattgacatgagccactgtgcctggcctaccattttaaattgtacaatttattgtttttgatatatttacaaagttatgcaactatcactactgtctaattccagaacattttatcacccccaaaacaaaccatgcacctgttcaccaaaaagtgactgaagcaggtatcaatcaatagaagtttatttacccaaagtcgagaaagtaccttggaaaatatacaaatcacaggagcatctgtgatctgggctttttccaaaggagggggtgggggaacttcagtatttgaaggggaaagagcaaataggagggaaaagaaagggagagagggtagcccctgaggtaaatggctaaattctagtgaggctctgtttagcttcagtaaatctacattttacatgtgaaaagaagaactagaggaaaaagtcaattaggcatttgtctcagggtaggcagagggttgataagctggcaattgacattgtcagggttagatttcatagaactgggttttagggctagtatatataggaagggtatgtatcctggaagatttaggtgctcacgaggcaattccttgtgagggaggccatctggggagacatgtgcccttctatagttatgggaaactggcttagagatgaggctatgacacggtgttgctgaattacagctatctgggaacaaaaaggaaggcagcattgtgattccgttcccaagcttaactttgcctttggcatagtaagtttggagtcccaagattctattttctttcacatatccattagcagtcactcctctttccccctccccctaggccctggcaagcacgaatctactttctgtctctatgaatttgcccattttgaatatttcatataaatggaatcatccaatatgtgactttttgcgtctggtttctttcacttatcatcaggatttcatggctcatccatgaaatgtctcagtactttattaccttttatagatgaataatattccattgggtataccaaattttgttatgcacacatcagttgatggaaatttacaattgctttcattttgaggctactatgaataatggtgcatagccagtcatcttgatagagttgtctatactcactttctttttctcctcatttcctatttactcttcagcctactccagtttgatttctgctccagtcacttccctaaaatggctttctctggtgtcaccagtgatggctatacaactaaatcctacccatttttcagtgtatgttgctacctatatctcacagctctaatttgacactgtagtgtagaccatgtcctgtcttcccttgatatgtatgaaagtacactcttctggttttcctcctgtcaccatggctgttgcttctctgtctcttttgcagactcactttttctccttggctagtaaatgtgggatttactcaagactgagtccttgggcaccttttcttttcactcacaagacccattctaggtaatttgacctccacctatgccttcaacaatcatgtatgtgcttttaactacaaatttatgtttataagttagattttggaactgtatacctgtcaaggccagactaatttatttaccctgaatatataaccatcttacatttttttattttcttagaggatgatttccattactcactcagcttgacaaggcacaacatttttaaaaaatctttctgatggataataatcaaatagttaacagctctggacactggctgcctgggttcagatccaaagtctacacatactccccgtgtgaacttggagaagtcacttaacctttctgtgtctgttacctcgtcagtaagatgggtacttttcagggttgatgagatgataacatgaaatgtaaatacgctgaagattttagaatcatgcctggcgtgaactaaatactttaaatgttcaccattttccctctgcctcatctcccatctctaattcttttctttatgtctaaagccagccagacacacagcttcccggtgctttagatataaaggctaaaatgtgtagcctggcctgttgtattagcttcgtagggctgctataccaaaataccacagactgggtggcttcaacaatatcagttaattttctcacagttttggagactagaagtgtgagatcaaggtgttggtggggttggttctttttgagggccatgagggaaggatatgttctaggcttctgtctttggcttgtagaaagccattgttatcttcttgttgtgtcttttcacatcttcttccctctatgtgtgtctctttgtgcaaatttttgttttataataaggacatgagtcagattagattagaggcccaccgtactccagcatgacctcatcttaactaattacatctgtaatgacgttatttccaaataagatcacattctgaggtactaggggttaaagctgcaatatataaatttgagagggatgggacacaattcagcctgtcacgtttggttagtcttctgccagcctctccaggtacatttttactctatgctttctcagcctctcagctagccatccacacagtagccttcttttaaatgggccacaatcttccagcctttccagacctctttctaaaagatatttcttcagctagaacactcttaattccatctcactgccccgccccccaccccccacgacccctcagaacacaggccattttgcatggcttatttctgttcatcattcagatttcaggtcaagatcacttagtgaggaattctctcatcttctaggctggatcaattggattatgaatctatcaaagaatgtaacccctaaagcatttatcttgcttcgtaattgtacatccattacatgtctttttttcaccctgcctatttcaccctgaatgatttgtcttaccctttgatctacagatccttttgagtatataacaggaactcaatcagtatttcttaaatccaaacattacttaagtattgctattttgacaaatcaagatctttactattcactgtaaacagctacttttttcccctcatttttaacacctcatttcctctaataatattgcatgtactttgacatcctttcacttgactgcatccttttgcttgagggaaggtttaagaaaggacgcatttttcatcaggtgttctattcccaacacagaaaagttgactgaatagttcttctttgtttgatatttataatgtcaactgattattatgttcaaggtgatttccaagaataacagacaattagagtcaagccatgtttctgtcccctgaaatcctgaacctatgtgtgttggctaatgtgtgtctttgtatgtacatttttacttactctccaaaaatgtaattgaatgtgaaatttttaactagagccagaattccgtagtaggaatcccaacttctacacttactagctatgcaacctggagtaaactgcctcaggaagtaatagtatttgccctgtagggtgatagtaaaaattaaaggagctaatatttgtgtctggcacggggtatgttaggccattcttgtgttgctataaagaaatacctgaggctgggtaatttataaacaaaagaggtttaattggctcacagttctgcatgctgtacaagcatggcatcaacatcgaagctcaaaatcatggcaagaaggtgaaggaggaagcctgtttatcgcatggtcagagagggaataagagagaaagaagggagaggtcccagactcttttaaacaaccagatctcatgtgaaactaactgaatgagaaagaactcatcaccaagaggatgttgctaaactattcatgagacatctgcccccatgatccaatcatctttcagcaggccccacctccaacactgggaattacatttcaacatgaggtttggagggaatacacatccaaaccatatcgggtagtaagcaccaggtgagtgttatctagtagaaggaggaggagaatacatagaattaacaggactagaagtagtaatatatgtaaagaaatatttcagcacttagaatgacatggtttatccttttatatgcctcacaagaaagaagtctcttttgctcacctttgcatcctcaggacatggcaccatgcctgttagatgctccagaaatatttgttacgtgaatattcattaatttattctttcatttcttaattcatttacaaagagttgctttcattgttttagatttagttgtttatgcttattgtaccagtgcctatttatactacactgcaggtctggaaaaatattacattttaaatttaatttgggtgttgatttggactcactgagcctctgaatacaagcctacttgagacaagtatgtaggatgttcattagttctcaaatacagttgatttatattttataacttgaagtactcctgctttttagcatctatgtgtgaattagcatataaagatatgagtaattgttttaatgaaaatttcacctctgcaccactctactgtgactttattgtgaatgcaattaggtttaccatagcgttctccctgtgagcctgtagataaggcatggaaaaattatttcttttactataatcctcctgcttaaatatgataggaaggcaccaatgaatctaataccattaatgttctctctgaactgaaactccttaaatcataaaatatcacataatgtctttttattaaaatattgacattgtttcaaaatgtgcatttcagagcaagttttatatgcgttcctacaacatatgggcatgttcttcatttggtctttcaattaacatgatgattaagacgaagcgcttatttctgtttctgatgtgttatgtccctaccactagtcacgtttcctataataattcatcacacgttatgaagttttttttttttatgtagtttcttttaagctttcctttaatatatatctgatgatggagacttacatataacagagaagttttcttttggaaacttagcatgactatattttagtttcattagaaagaaagagaattaaaggatggatttttaagaataattcattgtagagttgctatactcaagtactgaagcactttaggactcataagggcatccgtgtcttgcataataaagcagccaagatggagtaaaacgtaaaagcagacatcgaggtcattacctaatctggatggattagccatccagatgcctgaaggtcaaggactgaacaagatatctcaaggtacctacaaattctatgatttcatgttattaggctactgagtataaccagagacaagatggccatgtggttggaaatcatgtagaattacaggttagctcataataaaggcaaaaacaatatgtcggttagaaatttcaagtataagtgaggctaaaagtattttgtgaatggcatcactccatcttttataagataaccctatacatttttctctgtgtacttctattgtaaatgtatagttctattatcacacttgccattttacattattgtcgtgtatttatgtgatgtaaatagttataggtaagtcttatttatctgttctctgtaggacctagcagggtatctggtacagtatgtatcaataatcattagattaatgaactaataaattaaaagtgttataccccattagtaacaaatgacaagtcccaaaatattattttattcaaagtatttgatgccttaatattaactgatttgtacagcccattatacattccaagagggcaagggcagtattaaactgcatccctgaacttaacacgttacctgaaacatagcaggcactcaaaaatactcgaaaaaacaaaccaataatagctttcatttatatagcacttcctatgtgccacacattgttctaggcactttaaatacagtgactcatttactttttacccatattctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcccatattcttaactaatacaaaatatgggctctctacatggtatagatcagctgtactttcagtaaatctgtgacttgatttgaaaatggaaaaaataggattcatctcctaagatgttctgtgaatattatataaggcagtgtttgaagcatgcttggcctagcgtctggcatagcagaagttttcaagatatttttactattaagactattattattgctgctattattaaccatctcctccaatagttggcataagagaggttatacaattcagaagacaagaatagagaaagcgaatgctatttgtgtcatcagctatttgttgtgtttacatttctgcccctcatctctatatcctcgtaagcacactccatcttccaagtattcctaggttaggtggcatttaatggtatgtgtagaccctgaagatttgattacattgaaaacagcaatagctaacacttctttagtgcatctctatgtcagtcactcttttaagtactttatatatattaacataaaaacccaaagaggtaaatgcactattattatccccattttatagaagagaaacttgagatactgagtagttatgagaagttacgtgacctgtccagggtcaataagctggtaagcagagcagctggtaggtgaacccaggcagtctggctacaaagttcctatgccatgttgctcagtacatttaaaacttctgtaccaaaaaaatcataaacaaaattttaaaaacagatggcagagtaggaagttgaatttaatagaaaaatatctatgcaaaatacataaagacttgcagcaaaccaaaagaacaaaccacaagtaattcacagaagaaatacaaatagttaaaaataaccaaacaacctcactagcctttaaagatatgcaaattaaaacaagataattttaccctcacaagcaaaaataaaacagaaagaaaagagagcaaaacaaaaaaggaaagtaaaaataggactttgttagtattacctactcaatgtctgcttggtatctccacagggatatgcaatagttatcataagtttaacacacccagaattgagcatctgattccccttcacacctgctccttttacagacttctctatttcagaaaacgtcagctccattcaactagttgcttaggcaaaaatatttagagccctctttgactcctgtcttcctcacaactcacgtgaacccatgagcaaatcctctcagctccattttcaaaatttatccaaaattctgccgtgtagttcagcacctccactcttgcctctgtcatcctgtggctggatggctgtgtccccctgttacatctccccctgcttcagcccttgccctcctatagtcttccgttcaacagccaatcggccagtcgttcctttatgtctcaagacagatcatcactagtccctggtcagaacacccccagggtctttccatctcactaaaagtaaatatagagtccttattaccgtggtcttggagactctgcagacttaaccccatccccttctttcagccccaactcctgcctctctcatcacattttccagccctcttctcccaggtccttctctccactgcgatgactgccttgatctttcttatagttggtttctcatctgctttttctctctgccgggagtgttctttctcttagagctccatgcagttcacatcactgcctccccgtctcaggtcaccgcctgagtagagctccccctactgactgttcctgaagatagcatcctgtcctcacacccttcactgtccgccattccctgcattattttgcttcatcctacttaatattttatatattaaattgttaatttgtttattctcttcttaccccttaaactccttcattgactataatatctgaaagcagaagtttttttttttctttttctctgtctctcactaatgcattcctagcattagcccttagcatgtagtatcttttaaatgaacaaaagaatattcagcatcagctgggctctgtggctcacgtctgtaatcccagcacttggagaggccaaggtgggacaatcacttgagcccaggagtttgagactagcctaggcaacatagggagaccatgtctctacgaaatacaaataaaaataattagcaggtgtggtggcacgtgccttgtggtcccagctactcgggaggctgaagtgggaggatcgcttgagcctgggaggcagaggtagcagtgagtcatggttgcgtcactgcactccagcctgggtgacagagcgagaccctgtctcaaaaaaaaaaaaaaaaattagcattgtaagtgttgcaaaatgtataggaaagtaaattttcacaactttcttggaggattatttgacactacctatagcaatttatttatttatttttaagtttcaatagtttgagaggtacaggttttttttggttacaaggattagttccatagtggtgaattctgaaattttagtgcacccatcacctgcgcagtgtacgctataatgtagtcttttatccctcacccgcctcccaacgttcccccccagtccccagagtccattatatcactctgtgtgtctttgcatcctcatagcttagctcccacctataagtgagaacatatggtatttggttttccattcctgagttacatcacttagaataatggcctccagctccatccaagttgctgcaaaagacactatttcattcctttttatggctaagtagtattccatggtgtatatataccgcattttctttattcactcgctggcccatgggcacttaagttggttctatatctttgcaattgcgaattgtgctgctataaacatgcacatgcatgtgtctttttcatataatgacttttttttttcctttgggtagacacttttacccctctcttgtttggcttcaagccaacaacttcacagaaatcaatctttctttgtcctcgtatgttccctcaatccctaacaaatgttcgatgaccacttcttgtccaaattcaatggctttattgctgttctatatatttctgaccataaaactccatttagtactgtcaatatcaatatttacttttgggggcaataaattagacagtttattaattgaagcatgatatatgtatacacacacatatacatatatatatatatatatatatatatgcatacctttgaatggatctatttatgtacaaactaccaatggaatttggactcacaacatcggttataaccaaaagaatgtgccatcttggcctgatctacccctcctcttttgatatccttctatgcctattcttattaaaaagaataaaattgttttaaaagaaagacaattccactcattatatcacttaatgtaatccttgtgttggcacttttgcctttcattgatatagtttcaaccataataatatatgtaatgaaagtttcaaacttttcagaactgcctatttttggcggggagaggtaatgtgtactaaaggtaatccatattttatgtaaaaagtaaacacaaagaagtaaaaatcagttgcaatctcatcatctctacacatctcttattagtttgatgtttattatctccttttttccattttttcatctaatggagtctgttttacaagctgattttttatatagtacataatagttaatgttattaacataatagtttgctattatgtatactttcatgctatcattttatggctgaatgaaaatgccatttttaaccttgaaaaaaatcttttacttgttctagcagctttcttagttatgttttctttattgcaaaagtaaatattaatagcatccatccttaatacaaattatacttggtgactcagtcaatttaatatataatccaattttaaattttgttgttgttgaattattagatgtttaatgataaataacaaactaaaatattctaaaatcagccaataatttaagtttgtctttacattctctgcttcatttggctaaaatgaatacatctttaaaatgactagataaaatgatagtcatttgtcaattaatgataacctttgaggcttagtatagaagatatattgacaaatgggaggcatgtgccaaagctttttgcattaattgcatcagtatgataactttagtcactacggttccttcaaaatgtattcacataggccaacaaaccttcagtcattttaaaaaagcagtagcatctaatagtccaaggcaatagcaatccatgcacttctgtgacagagagggtgtttcaagaattttggcaaagactcacacttgaggaccaaggcactaaaggtattctaagctcagagagccaacggccattgcctgcttagctgaaatgaggtgctggtgtggagaatctgccctaggttgtataagccttgcacagcctgcttcaaaagagagaactggaggagatctagaggtgttctgagggatgtggtgttataaagagagtccattttaactctgcctcacccctttgtgggcagagctgttaaatggcctggttgctcctgtttttcctgcctcgtggaaactaaccaccacttaagaagtgcaactaccctgatgtgagaagtctacttgcatggtcatgacagaagataactaaatcacaacatctttgtaaattatcacatcatggcctctaactataggttggtgcaaatgtaattgaggtttttgccattggaagtaatggcaaagtaatatttgcaggcaaattgactcacaaaaggctgggcttctgggacacaggaacaattaaatgaagagggaggaaaaggaaaacatttatatgtatatgcttcacctttttaaaaaacaaccgagaatttgttaacattcatattatacttttaaagcattttaatttttcctattctataatacctgaaggatatggaacaattacacataaacatacagaaaattagtttaaaaaaccatccatgttccttctactcatcattaaccactatgaacttggaatataaccttcaaggcatctttctgttcaatttatgtaaatatgtctgattatacacaggtgattagcacagaggcagcataacatattaatgaagaccaaagctctcaagacctattgttcaggttcaagtctcagcatcctctcccccaccatcccttaccagctgtgtgaccttgattcattttcttaacctccctgtatcttatacatatgggtatgatactggtgtttactaatcatggggttgttatgaggatatttaatcacttagacttaagctttctaaagaacttaaaatgttcctggtacatagtatgcacaaagttagtgtttattaaatagaataattacatttcaaaagaaaaatcaaagaataggataaacagtattttaaaacatgctttcttaagaatgtggaataaacattcctcatcagtaaatacacatctatgctattgatttttaaaagctgcatagaatttcattttgtggataaagcatagttcctgattttcatacatttatgtcattccattttttgtttataatacatttcaacttttattacgggactttccaaacatacaaaggtagatcatacagtataatgaaccttcctgtacccatcacccaggtacaataattaccaacacatggtcattccttgtaatatattttaaatactcattttattccatcgattctgataagactaagataatggtcttaaagtgaagagcttccacatcttaagcaacaatattagggtatttgtgtttacgttagaaagacatgccttactctgtcctcaagataatggcttttatctgatgccaaagttaaaaagatcagttcctttattcaactccagtgaacatccttcattatatcttgtttccttctgatatatctgagaagaaaatggaataatttagaagatgccagtgggataaaacactatattcctaaatatagtgcagttttcagagctattttagccactgtaattgaaatcctcttgttctccactgacatattttggaagcccatatgtttagagtctgaaatttcattccaaaaatgatagaaagcctcttgatctcagaatggagagttactgaactgaattaaaatgggcaaaggcttcagtaaacttgaggaagtaatgtatggccttccacgtggattaatttcactctctatcctgggaagtatggtacccaggtagcccgtgtgaaaaatatcatgttggtgatgtccgtatgctaccatattagagacaaagtcatacgttctgcgatgctattttctaggcggtttgtttctttgcattacagtagtatattcggcaccacacagaagttaaaattataagagggaagtaaccttccttagtgagactacaactgtgaagctataactaatagacactaagatagaaataaattattcttatgatatataacataagcatgagcatgtaatattgttgggagctctagcagaaagtactacagtagtagtagttttttttttttttaagacagggcccggctctgtcactcagcaggctggagtgcagtggcacgatctcagctcactgcaacctctacctcctgggctcaagccatccttccacctcagcctcttgagtagctgggactacaggcacacgccaccatacgtggctgatttttgtattttttagtaaagactgtgttttgccatgttgcccaggctgctcttgaactcctggcctcgagcaatccacccgctttggcttcccaaagtgatagtactgcaggcgtgagccactgcacctggcccagtagtccattaaaaaaaaaaaaaaaaaaaaactcattgagcacctactttgtaacaggtactgttgtaggtgctagggataaaatatacttgtttctcctactggatcttgcttttcttggagaaagaaagaaacacaatgtcttagtccattttctgttactataacaaaataccacagacagggtaatttattttcaaaaaagtttattcagctcatagtctggaggatgggaattttaacagcatagtgctggcatctggtgagagccatcttgctatgtgataatatgtcgaagggtatcacatggtgacagggcaagatctttcttcttcctataaagccaccagtcccatcatgggggctcacccttttgactttatctaatcctaattacctcccaaaatccccgcctccaaatacgatcaacatatgaatttgggaattaagtttccaacacataaagtttggggaacacattcacaccatagcacacaataaacgagcaaaaaatactatattagatcataataagtgacatgaagactgatgcaacaaaataaaggaggtaggaggtaccagaggggaagaatggttattgttatttcagatacagtgttccaggaagaaactggtatctgagtagagagttaaaggaagtgagaaagtgcatgttgaaatcggtgacagaggtaaagacaggtgcaaatgtcctgaggcaggaacatatatcatgggcatattctagataaggctttggcttccttatgcttcctttttagtggggaagacagaacgcaaagcaaatgcaaaataaataatatgcagtcaggttgagattagtgttatggaataaaagaagagagagtaaacaatgggggaaggaacaacattaagtaggataatcaggagacttctctggagagatgacccttaccctcagacctaaatgatacactacaaaataaatgcctgtacaatcactaaaggattaacacaaactgaaggtaaaaaccattgtgtaagcgttttcctgaattcaagaattagattattattctgaagctattttaatattgggaaaatcttgttagcatttttttctgacaaagttcaaataatgatttctgaaatttaattctacctaatactaggtgtactttagaaaaataaccaaaatgagctgcagaagtattttactttattataataaatattacagtatgcatcatgaaatgaaagaaaaataatcctttgcctatagttttattatctccaaatgagtagaaactgaatgatgcatttggcaaagcacataaaacttcacttaagagatgtctgttaatacttgctgagtggaaaataatagctagcatttgtttgaacgcttgatgtgtgccaggtgggacactagggattttacaaacactaatccatttaagactcatacacctctgcaaggtatgtagtactattcttcctcctaggtagcctgagtcagtgtcaaagaggattctgtcttgggtctatgtgatttcaagtactgtgctcctttaaccccactcttaattgtgaaaatctttatcacaggactctgaaacttcctgtgattcactttctccatggtgtccacagtcctttcatgctatatgtaccacaaatagcatgaaaggacttccttttaacctaaagcctttttacaattaacccttgcaatttacgctttttgatttttgtggttagtgtctgttcttgtcaaaattgtgaattagagcaagtttctccttgatgtcatcacacttctttgaagtcatcaagcatttagttctcattaggcagaacaggccctggcgactcaaagtgtgagcaggagccagcagcatcagcagcatccccaaatctgctcaacaagagtattaacaagatccccatggaatctgtaggcacattaaagtttgagaagcgcagcgttaggccagcatcagcaacacttgggaccttgctaaaaatgcattatttgtacccgaagctccaggaatgtggcccaagaatctttgttttaacaagccctgcaggtgattctaatgcatgctcctagagagttactctttctcgggattgacatcagcaataccgacctgttgcaataaatcagtcattctcaagtctgtctgcatatgagaatgccctggaaagcttgtagatcccaggttccattccaatatagttggtctcaactatattccaatctgcaggatgggaccatggcattagtgtgttgttcgtttgtgtttgtttgttttcctgtgggctcctcagtgttaaaaatcattgccatagaattagaagatcagtattttaccactctcaagggatttactttttaggagaaattcgaatctccccaaaatagtgcccaaaggactaatctaaacacctgagttaccttcactgactatataactgccacttctgcccttcagcatgacactatgtctctttcctcattgaaaaatacataaaaggggaaattgtaacctctctattcccattggactattgttgagatgaacaaatgagtgtgagagtaggcacttgagaattctcaagtgctatacaaaaaaaaaaaaaaaaaaaaaaaaagctcgtggtctatctgagggtgggatgcagctctgctctgatgtgtaattatggataagtgatcagaagttcagaagttctcagacatcacagggactgcagctttttatttgtttgtggtgtcagctgaaaaagtgctaatgagatacactggggacagcctatggaaaataatctcatgaaatttttagaaaaagggagtatctatgatgatagttctgaaactccaaagctgtgctcctcagactttaatgtacacatgaaactcttggggatcttgttaaacaatactgaatcacaacaacaaattgtgattcagtaagtctagggtgagggctgacagtctgcctttccaacaagctcccaggtgatggcaacaatgctgattcgtagaccacacttttgagtagcgaggggctaaaacatacacaataattaggcctgttattttgcagatgccagtgtgattaatgaatcctgcctatgataacattcacgagtctgccctgaacatttttctgttcttttaaccctgattgcctttgccctgtagctcacatatgatctgtacctcctctttcttgcttacatataatagagcatattttatatatactcatatccagttataattctctaactatgagcaattgttttgttgagttttgttgtcagtgttcatatcataaattgcctcccccaaccttctttcatctctacaattcctttcactcttctttttgaactggcctgtgagtgtgctgttcttgccagattaaatgaatcagtcaatgggaatcttattcttaagtgtattggatcagatatgtacaagtgttgctcatgaggagagaaaagaagatgggcgtgcatgctattgattaatgtagtcacagaaatgcactggtcaatatgatacaagctgtttgcaaccgtaatagtcctgtgctgaggactattaaaaaactgaattggttaccactataaccactacagttatgcttttatttgggtaaaaataatctagcatgttgtggtttagcaacagaatgctgaagaacaccccgatgtgatgtttgaaggagaaaatccaatctattcagcctaatggtttgctacagtagttgaaaaaggcataaaaaatccaatctcctgggtagatgtagctcattgagtggggcatgggctggatttccatacccatcattccttggctagttctcttctgcaggacgtgaccttcacatctcatactgagtattgtgtaatcatcttctggtatctttcttctcttatgtccctttactcattattctttgttccccttttcatctttagtcttcctaagggcttctcagtttttttcacaggggtatatagatcagaaccaagtcctttcctaagcctgtgtctttatttcacaattcaacaaggaaggacactacagatcacatagctcacctccatacatcagagtataggccttactgatacatgcacacatagaaacaacagaagctggcggagcatggtggctcacgcctgtaatcccagcactttgggaggctgaggcgggcggatcatgaggtcaggagatcaagaccatcctggcgaacatggtgaaaccccgtctctactaaaaatacaaaaattagccgggtgtgggggcgtgcgcctgtagtcccagctactcgggaggctgaggcaggagaatcacttgaacccaggaggcagaggttgcagtgagctgagatcatgctactgcactccagtctggtgacagagcaagactccatctcaacaacaacaacaacaaaaaaacagaagccaataaataaattctgcagatctattgtgcagcatggtgactatagttaataataatgtgttgtgtattggaaaattgacaagacagatcttaaatgttctcaccacaaacataactatgagaggtggtgcatatgtaactatgagaggtggtgcatatataactatgagaggtggtgcacatataactatgagaggtggtgcatatataactatgagaggtggtgcatatataactatgagaggtggtgcacatataactatgagaggtggtgcatatataattggcttgattgtggtcattatttcacaatgcatactgttaacaaaagatcatgaaatttgcaggggcaaaaaggagagctttactttcctaaagaaatttgtaggtgggggagacgcccctttgggacagagcaaaagtgtgctccaaggagacactggagagttaaagattataatggcaaaaactgcaagactggggagagggatcagagtcttgattagatgacatttaagcctaaaaccacaaatctctctttgttttctgactctaggtggtcagtggttggtcacatgaggattttccagctgtagtctattttgagattgataacaggaactggtttagcttgattgcagaaaggggagtctcgtgacatttctgcaacattttttgagaacacagtgtatgtgactacctcctcatcttgctgtggcctcccagttctgctttaacttgagcatctcagccacagggggtttattttatctatatgttggggcataatttgacaatacatacttcaaaacattacattgtacactgtacattatacaatttttgtccattacattttggtaaagctggagataagaagaaaggcaagggggtaaaaggagaaacggaatacaagacaagtattaatgaatattttactacatgtaatgtttggttaattataagatgctaagctaaacaaaaaatgattttaaaaatgtcatacacaaaaattattaaaagttttattagatttccattaattcatctttaatgattttacagaatgacaaatgtgatgttttcttcattttaacccagtgtacaagtaatacattttttcttcaaagagtagtttcttataaaaatgtatagttttgttttaattagtaatccaccgaattacatcattataatgttctttataaggggatttattttctattatttaaatttcctctgataaatttttattgtgatatctgccaccaacatcttatagttaaaatagtatgcaaactaatggtcgtgcagatagttactagtataggcttaatactatgcaatacaaggagatgctttcattaggccaatggtttcttatataaaaattacttctttaaaggtctgtacagctagcagaatggcatttgaggggatttaggtctcagcctaattattacctttttagagctaacttctgtgaccaacacagttaaagaagttcaaagatcaccttatttaattttctacataggacttattaatctctgataccatgtggtggtttcatccttgtttaacagtttttctgactctcaatttcaagagggtaggacacttctcattttattattgtatctttaatgtctgtgacaattccaggcagcatggtacataggaactctataaaaattattgaataaatgcatgaatacatggtcaatatattaaaataaaattaaaatttaaaaaaaaagccataaaaaggtaatttgagactgggcacggggcagtggctcacacctgtaatcccagcactttgggaggccgaggtgggcggatcacttgaggccaggagttcaagaccagcccaggcaacatggcaaaaccccgtgtctacaaaaaaatacaaaaattagtcatgtgtggtgacacatgccagtaatcccagctacatgggtggctgatacaggagaatcccttgaactggggaggcagaggttacagtgagccgagattgtgccactgcactccaacctgggtgacagagggagaccgtctcaaaaacaaaaacaaaaaaagataatttgacaaaaatggaagtcgctcaccaaatactttgaataatgtacctactgtgattttgtatttcaagctacaaaataggaaagacattgttcttccttatttttgtttcttttctaacctttttcttttattattctataatatattggcatttcctttagcaaagggagttgtttggccttgcatccttcatacaaatagcaaatatttacacatacacacactcatcgctatgtaagtcccttgaagttcaagtacacagttactcatctgaggtatgtgtgtgtgtgtgtgtgtatatatatatattctgagtgtgtattttgcagctctagttttttataaatgtgtttctcacccctcgtagtcatttgtatgcacttaatgtaattgtcagaagttataaataaatatgtggttgttgtattttcatcattaggttgtaaattccttgtgggcaacaagcatcatataatgaagaaattaaagaaatcagaaccattacattgaaaacatgatgctttcaaatacacttttgaatgttcacctcagtgttctaattaaattctaatttcggtatacatatctccttatctgaatgcctttagcaatttgaagtgactgagtattctgattcatcccatattcaatggaagcatatcaaaattgtctgccatttaactgtgctatcacaagctataaataggacactactctctgccaaaggtgaattaattgtgataaagctatcttgataaaacttattcctcacttaagtgaaacatgcagtacctgattaatttctgcaacagctgtgttaaaagctctgcacttaatatcaaacttctacttcagtatatgtcaccatttttacagaaacagaaagtcccttgcatttgattagcctcaaattatggctcattgatgaatgcaaataatcaaacaaaaaaggactaattgtatagaacaagtaaatattatacatacagtgctcatttgcctacaattacacaggtaatgtctctatttagtttcttaatttctcattatgagacaattgcatctcatctagcagtatttaattgcattgtttctattgctagaataatagcatattcctttttttaagatgttgaatgacaaataaatttagattgtaatcacttattgttccttctctaagcaaaatcgcccaggcgtttcagttgcaatgaaaagttttattttctactaatgatggccaaaatgggagcattctagataagtctgtatcctgtctatcaccttcttcttcagttgtggtcataaccatgatcttaataagtctacttgactaataactttactattttctaaaggtgtcactataaaatcttacaatatttaacctcacataccaaacccctacaataatctttgtttctatttgtaactttacgtgtctgcattggtaaatgtcaggtacatttggaatgacaaacatgcagttacactgagtctagtttgtagtttcttatcctaattctcattctgaccttaacatcaaatcctctactatgagacagcagtattaaataaaactatcacctagcttctgagttatcttgtaagcataagtgaaatcttattcacaaccgtaagtgaagtcttgtaaccgtaagtgaagtcttatttacatgtttacatgtgttttttatgcttcgtgtattttctaaatgattcacttgctcttagccttttgcaaaaagtataattttttattgctgccgtaataaatacaacaaacagtggcttaaactacacaaatttattatcctatagttccataggtcagaaacctggcacaggtctcacttggctaaaatcaaggtatcagtagggcctcatttatttctggaggctctaggaaagaatctatttctttatctttgtcagcttccagaagtttctcacattccttggctcatggtcccttctgctatctttaaaggcagcagttatcagttgagtccttcttacgtggcatcactctgactcttctttcattgtcccttttctccctaactgcagctagaaaagattattcatctttaaagactcatgtgatcagtttgggaccatctgtataattcaggataacctccccactttaaagtctatagccttaatcacattttcaaagtccctttgccatgtacaaggaaatattcatatattttagtgatgaggatgtgggcatctacagggggccattattctgcctactacatatggtctcttattatttagcatgtctagtgcagttgtgtggggatgctggacttcttaacatgtgacattagttaggcttatgaagtcaagcattatagacattgcctgttaatgttgaagcaagcttgaacagagccacgcttcatctctagccttggtttgcttgtttttcctttcatttattattatttttcagtgaaaattgataatagagctgccttttctttttgcactggcattattgcattgcactactgaagaaatcactaaatctgtttattttacagaaaaagattgagggtccagttaaatttgtgtttattcaggacaatgagctctgtttttctcacttgggaattctccctcttgagacagatttcccaggtacgaccaagagttaagagatcaaagttttgtctggtgagaacagaacccaaatctctaggcaactcttgttaactaattttggggataccacagatacagattggagaacttttagaaattcatatcaagtttgatttatttaatattcatatttaatatgttacatgaatgtataatccaatgtaaatacgatttatttattatggaattgtttaatacatgacatgcttatagttataccgttaaggaatatctcttattttgcaacattttacttttttcctctcccaagtgctttgtgaatttcactaaataaatcagggtaaaatgcatgtagtttagtctaaaaatacttaataatccacccagagggaaaatatattttaatgcttgctgcataaccttaataaacagagaatactaatgtgcacttataggttaaagtaatatgtttaaaaatcatttcaacttttattttagagtcaggggatacatgtgcaggtttgttacatgggtatattgcataatgctgaggtttggggtgtgaatgatcccgtcacccaagtagcgagcatagtacccactaggtagtttttcagcccttgtccccttcccccactccccacactagaagtccctagtgtcttctttgtccatctttatgtccttgcgaattcaatgcttagtatcatttttttgaaacagagtctcgctctgttgcccaggctggagtgcagtggcacaatctcagctcacggcaacctctgcctcccaggttcaagtgactcctctgcctcagcctcccgagtagctgggactacaggcacgcaccatcaggcccggctactttttgtatttttttttttttagtggagacggggtttcaccatattggtcaggctcgtctcaaacccctgacctcatgatcttcccgctttggcctcccaaagtgctgggattacaggcgtaagccaccgcgtccggctgcttagtatcatttataagtgagaacatgcaacatttgatttttttgttcatgcattagtttgcctctagttgcatctatgttgctgtaaaggatatgatttaattcttttttatggatgtataatattccatgatgtatgtgtaccacattttctttatccagtccactgttgatgggcacctgggttgattctatgtctttgctattatgaatagcaagatgctggacatttccttaggttttagatggtttcttttgaaatgtatattgttaggtttaatcagtcctttgtatatagttgccttttgtgagaaatacagtaccaggtagcttgatataccattaaaattaagcatatagatttacctgctgtctctaatgccgttatgtgtgacaattcccatatgaggtaaatttaatgagttcgtttcttttaatatctagactaactaatgccttcaggaaagtatgaaagtatattgtgtctctttagtgaattccctttagataggcttaagatagccatatggctctaaacttactaaatgcagaaaatttaacttagctttacttctttcattcttaggaaaacagtcttcattttgttgattaacttccatttaaatgcttattttatactgtctttatttggactatgcttcattaagcctcaatttccatttaattttgcttgtgtcttattgttcgagttcctatgtctcagttcactaatgaaatgttttctaacctgtgaaaattcagaagagcacaaagatccatataaaagtacatttccagtttctaaaagaaaaattaaggtctactgggactctggtacactgcaaaacataaacactattcttactccaaattatagtcattgaggtctttcaattcccagctcccatatgttaaatctacctatctgataatgatattagttgcaaatgctttattgcttccctttgtatcctgtttcagtagctgttccttgtaaccttatcttgacattttcaaattcggtttgaaaatacaactagagtttaccattatttatggaaggtaaatgttaactgacattatatttacatttaggatgaaataggtgaatgctcaggtacaaataaaactaagtttatttatttctctgcttaattcaaaaggtgtataggttcaggtcatagcatagtttagggcaaagaaagtagaaatgagaacacagaacgcaggaatttgtcagttttgtgcatctatctcgtaatctaatctcagctaatgggactttacatttaatcacctttccagaccaagtctccagacccagctgaagttgctgttcatccatgcccaaatctcttttgctgacctcctaatcaagattctagtgtgttagcgataaggtgtggcaggcaataacccagtgatcactattgcttgtttcccccgacagttgtgccctgtttacacacttgagtttctctccttagttctgatttagagccctcggccaggttctcgaaatcactagtgatcttgaattcaaccacatggcttgcattctagcccttgtgcccaaacaacatgatcgaatcatttcaattgaaatacatactatcgctattgcactcagtctccatccctactgtctctgtctctgtccctgtctctgtcttcctctctctctctctctctgtctgtctgtctctccccttgaacaacctggtccttaattccaggcctattctctacaataagttcagacatttttctgcagtccctaagtaggcaaatctgaagacctcctagaacatccagcaagctttgcagttatatcatactgcagctatgaccatgcataacctttatttgacttttatttgaaaccatattttaatatactgtatttattatagagaagtttcttacattcaatgtttctaaatttacctttcacctatatatggtagctccctacatatagaatattaaaatttactgaagtaaaaatgtatttttttctcttttaaagccaccataatttgatacaattaaattatacggtgatatagtttgcatatttatccccatccaaatctcatgttgagttgtaatctccaatgctggaggtgggacctaatgggaggtgtttggatcgtggagacagatccctcatggcttggtgttgtctttgcatcagtgaatgagatctcacaagatccagtcacttaaaagtgtatggcatctccctccacactctttcttattccttttttttttttttttttttgccatgtgatgtacctgctcccccttcaccttctgccatgattgtaaacttccagaagcctccccagaaggtgagcagatgccagcaccacgctccctgtaaagtctgcagaaccatgagccaattaaatccgttttcagtataaattacccagtctccagtatttgtttattaaaatgcaagaatggcctcatacctgtggtttaactgagcacttaattcctttattattttagtgcagatgtctccatttttttcctttgttcatgaaacttttattgggaaaatgctaaatgagagttttactactatgaccacggagagtaggatgcacttgtgcaaagtctgggacctccagaagcttgcaatttaatcagtgaaacagactggacataaacaactctcttaacttctcagtgattggaaatgcaaacagtattctatttaaaaatgccatctggctttcataaggtttggaaaatacttactacttttaaacagcaaatcctccaatatttgaggtttgcaatgctaagcccatagggcatgaggcaacataaccctgatatgagtaattttgatgaattctccatatttagaagtaaattgtgtatcttgataataaattttataatttcattattgagtttcttcatacattttggaaaaaccccacggccctctgatttatttatagctgatttgtcagttagatgtaaaatttcctgcatgttgatcacataacttgcttttcctgtttgatttttttgtcctctataatttttttcagctcctaggtttatagatatttttaatgtagcccatattataataattcaacaattttcaacatctttaaactatgatttaagtatattttgctcattaagaattgctacctcctaaatttaataagaagattgaaagaagaatagctgttgacagtaattaataatattcttccatgtaggagctacatggcaattaattatttttcaggaaattcttttcacttttttgttaagaatatttcattatattatttttcagcactgtcagttttctaacattcatgtagctgttaatttattcataacttgaattcattttcagtgtcattcatgcagctttggctttttttcagcttgcttatattattttgtatatgaaaaatggataactttttgactaatttccttccacattaaaactgtgtagcattcttttctggttctggagaaaatataataatttaaggagatacattatgccatttatttcaatatattttaaaaccagtttattttcatgctatctaaactgctaactggttcatcttaaatttggtgatcctctatagtttaataattgtcagaataaagtgtttgagtaatcaagaatagagctaacaccaatccattagtttatatggtttgtactgattaacatcatcccattctgccatgggccttctcacaaaaatcttaatgagaaagagagacagagacactaaaacagtttagtgagaagtcaccaaaaaatttcttactagttacttggcacgcaataaggttgtccttgccaatgacgctaaccatgatgacatattaatcaatcaagaaatggtcatttatatcaataaatattcagttcttctattatttctcctttgacagtcgtgatttttctgtcagtctacatcaccattgcttccagatgagcctcttttagtccctctctatggtatgcccaagttctattcttcctcactctaggtggctgcaaacagttcttccccctcttggccatgtgtgaaggaggatggaaatgtgatttctgtaaaggctcctgccatttactttgcctgttacattgtctggcatttgcttcatttctatttcatttcttttcattgccctcttcattgtctcttactctcctttcttgtttttgcctcttaatctttattgatttttttctttatttgattccttacgcttagtcctcttcttctgtcattcttaatgaattcattcattttctattgtttcaattgttttctttttttttgttttttaaattgtggttttttcttttttaaaaaaaattttctctttagttttcatcatttaaaaattagcacagatagaatattccttagattaggtgcacacaaatattgaatatgtcattaaataacccgttattttatattatttgtactgattaacaccataccattctgtcccataaattcagaataaacatattgttttttgtatgttgtatgtcgtgtatgtataaagccatcttataagtttcactctgcatatgcctaggttacatattttggcattaagaatatcattaaaagccaactgtttttgagaaaacttttaatgttgggatgtaaaaaataaaccttattgaattcatcataattaaacagatgaatagcagcaataaattcagatcctgaataagaatcaaaccacaaaggttctttgttgactgaaacacaaaaatatgtgtgcattaattttattcttttgtaaagtgttactctaaataaaattactggagataatatcttgggtctcaacaatatcatgctttgcaaagtatttgtcactgctaattgaattttgtgtgtgaatataatgcatatctatacaaatagaacagcctctaattgaatctgggaggatttgaatattgtttgagtgttggccagtctactgacagatttaatcaagaaatggatatttatataaaagaattgtgcttaggagtaataacccatttagtcacagattcagtgttaacggattgaaaggtttgtggtatactctggctctatgagttttaatgaggcttcgtttcctcactttttttttcttttattcaggaagtgttaatgtagcatgcatttcagccttatgattttgtcaaatataatgtttatgttttattcattttggatcccctcctagaactgttattcacatatttgctactacacacatatcagatgagattcattgcagaacacacaactttaggctatatgtcaaatacgaatataaaatacaaatacataggtcagttcatttgtcattcacatttaaaagtggaaggtttaatataatcaattctctaatcccggtacaactgttcccccaaatctgttgaacccagccctctttctgtttgcttcctcaaagtaatgtaatggattttaaaacctatggtaaataaaccagtagaaattgaacttgtctattgaattataatctttgctgtttatttccttctaaacaagtttttattgatatataatatctgtacatattttgggggcatatgtgataatttaatatattcatataatttgtaaagatcaaatcagtgtaattgagatacagtcaccttaaatatttgatctttctttatgctagaaacattagaattcttcttttttctttttctttttcttttttttttgagatggagtctcactctcttgcccagacctggagtgcagtggcacgatcttggctcactgcaacctctgcctcctgggtccaagcaattctccctgcctcagcctcctgagtagctgggattacaggtgcatgccaccacacctggctaattttttttgtatttttagtagagacagggtttcaccatgttggccaggctggtctcaaacacctgatctcaggtgatcctcccatctcggcctcccaaagtgttgggattacaggcgtgagccatcgtgcccagccagaattattcttttgtagttattttgaaatatacaatagattattgttaactatagtcaccctactgatttatcaaacactaagtcttatttcttttatcaaactgtgtgtttgtacccattactcaacttatctttatcccctctttcccttacccctcctggcctcaggtaactgccaatctactctgtatctttatgagatctactttttcagctcccacatatgaatgagaatatgtgatatttatctttctgtgcctggttaatttcacttactaatgacctccatgttcatccatgctgctgaaaatgatttaattattttttatggcggaataatattatataatatgtacacacaatacatggctgaataatatttcattatattatgtatatgtatatatgtcacattttatttatccattcatctattgatgggtacctacactgattccatatttgggctgttttgaatagtgctgcaataaacatggaagtgtagatctctctttgatatatttgtcttttttcttttggatatatacccagtagtgggattgctagataatatggtagctctatttttagttttttttgagaaccctccatacagttttccataatggctatgctaacttacattcccaccttcctctacatccttgccagtgtttgttagtccctgtcattttttaaagaccattttaacatgggtgaaatgatatctcattgttgttttggtttgcatttatttgatgaataatgatattgaaaatttttcatatatctgttggccatttgtatgtcttcttgtgaggaatgtctattctgatcttttgctcatttcttaatcagattatttgtttttttgcggttgaattgtttaaactcctcatgtattctgactattaatcccttgtcagatgggtagtttgcacatattttctcccattctatgtgttgtctctttactttgttgattgttttctttgctgtgcagagctttttaggcggaggtaatcccatttgtctacttttgctacttttgctttggttgcctgggcttttgaggtctcacacaaaaaattctttgcccagagctatgtcctggagcatttccccaatgatttttttttctagtagttttatagctttaggtcttagatttaagtttttaatccattttgatttgatgtttgtgtatggtgagagttagaaatcttttttcattcttctggatgtgattggttatccggttttcccagcgctatttattgaagagactctcctttccccattggatgttcttgttgcgtttgtcaaaaatgagttgtctttaaatgtgtggattaatgcctgtgttctctattttgtaccattgatctgtgtctatctttatgtcagcaccatgctgatttggttactatgtctttgtagtatattttgaagtcaggtaatgtgatgcgtacacctttgttcattttgctcaggattgctttgcttatttgagtttttttttttttttttgtagttccatgtgaattttaagtttttttctatttctgtgaagaatgtgattgatattttgatagggattacattgaatctgtaaatagctttgagtagcattgtcattttaacaatattaacaatattaattcttccaatcaatgagcatgaaaaatctttcattttttatgctttttcaatttatttcgtcagggttttatagttctctttgtgtagaactttcactcctttggctaaattgattcctagatattttatattctttgtagctattataaatgagatttctttcttgatttctttttgagattgcttgctgttggtgtatataaatgctattcatatttatttggtttttttgtatcctgcaaatttactgaatttaccaattctaacagttttttggtgaactctagttttttctaagtataagatcatattgcttgcaaaaaggctaatttgatatcttcctttccaattttgatgcctcttatttctttctcttgcctagttgctctgtctaggacttccattattatatcgaataaaggtagtgaaagtgcgcatccttgtcttgttacagatcttagagaaaatttcaattttttctcacttagtacaatattagctgtgggtttagcatatatgcattttattattttgaggaatgttccttctatacccagtttgatgagaatcttttttatcataaagatatgttggattttatctaatactttttcagtatctattgaaatgatcatgtggtttttgttctcatgtccttgtatcgtatttattgatttgtatatgttgaatcatccttgcatcccaaggatgaatcacacttgatcatggtgaatgatcttttaaatatgttgttgaatttgatttgctagtgctttcttaatgatttttgcatctgttttcatcagcgatattggcctatagttttctttttttgttgtgtccttgtcttgtttttgtattcaggtcttacagaatgagtttggaagtattttctttttgtcaatttttttgaagaatgtaaatagaattagtattggttcttcttcaaatgtttggtagaattcagcagtaaagccattgggtcctgggctattccttggtgggagacatttgattatggctttgatctcattaccagtttcttcacattttctatttcttcatagttcaatattcataggttttatgtgtcccagaatttatccatttcttctaagttttccaatttcttggcatatggttgttcataatagtctctaatgattctttgtatttttgtggtctcaattgttatgttttctttttggttcctgattttatttatttgggccttctgtctttttttcttagtctagctaaaggtttgtcaattttgtttcttttcaaaaagccaactttttgttttgtcgatcttctgtacttttttgccttatgtcctaccattaccagagggtctcctatattccagggttttgtttgtttgtttgtttgtttcaatttcgtttgtttctgcttagatctttattatttctttccttctactaattttgtttttggtttgttattgcttttctagttccgtgaggtgcattgttaagttgtttatttgaagtctttctacttttttgatataggcacttattactatgaactttgctagtagtactgcttttgctgtgtcgcatagattttggtgttgtatttctattttcaatcatttcaagaaagttttcagttgcccttttaatttctttattcattcattgatcattccagagcatgttgctaaattatttttatttttatttttattttattatttgagacagggtttcactctgtcacccaagctggagtgcagtggcacaattacagctcactctagccctgacatcctgggctcaagcaatcctctcacctcagcctcccaagtagctgggactagtggcatgtgccagcatgcccaaccaatttttaaaaatttttgtagagacttatatttcccatcttgcccaggctgctcttgaactcctgggctcaagcagtcttcctgcctcagcctctcaaagtgctaggataataagcaggagccaccaagcccagcctgaatcctttttttttttttttggtatagagtcttgctctgtcaagtgcagacttgacagagtgcagtggcgtgatctcgactcactgcaacctctgcctcctgggttcaagtgattctcctgcctcagtctcctgagttgctgggattacaggcaccccgagcctgaatttttacgtgcttgtgtagtttccaaggttcttcttgttattgatttctagttttattccattgttgtcagaaaatatactgatgtgatttctacttttctgaatttgttgaggcttgttttgtggcctaagagatggtctaccctggctactgtttcatgcactgataataaagaatgtgtacttggtaacagttgggtgaaataatttttcaattctagatagccctatttggtttagtgtgtagtttaactgtgatatttctttgtcgattttctgtctggatgatctgtccattacttatattgaagtgttgaatcccatacttttgttttattgcagtccatctctccttttaaatctattaatgtttgttttatatacttgggagctctggtgttgggtaaataggtatttataattgttccattctcttgctgaacagaaccctttatcatgatgtagtgaccttcttagtctctttttacagtcttttattttcagtctactttatttgatgtaattatagctactgctactcttttttgtttaccagttgcatggaatatcttttcccaacacttcaatttcagtctatgtgtatctttataaatgaagtggaattcttgaaggcagcatatgggtaggacttgtttctttatccattcagcagctttatgccttttaattggataatttagtccatttacgttcaatgttattattgataagtaaggacttactactgccattttgttgcttgtgttctggttgttttagaactcctctctgttcctttcctattgtcttcctttatggttaagtgatttttctctggtagtatgttttaatttgttgctttttcttttcggtgaatgtattattggtttttgctttatagttactatgaggcttatgaaacataattataacattcttttgaagagacgacaacttatcttagataaaaaagaaaagaatagaaacaaataatgaaaatataaaaataaactctacattttagctacatccccccacagtttgactctgttttctcaatttacatagatttatattgcctatctcttaacagcttgctgtaggtattattattatgaaagatttgtcttttgggcttcatactacagttatgtatggtttacacaccaaaattacagtattagagtattctggatttgtttttgtacttaattttaccagtgggttttacaccttcaaatattttctttttgcatgttagttttttttcagatcgaagaactctcttttgcatttcttattaaacagatcgggtcatggttaattctctcaacttttgtttttctgggaaaaacattatttctcattcatacttgatggacagttttgccagataaagtgtttttgaatggcagttttttttttctttcagctctttgaaaaatgtcatcccaccccttcctgtccttattgagaagtctgttgcttatgaacttggaactcctttatgtgttatttgcttcttttctcttgctgcttttaggatctggtatttgtctttgacttttgagagtttgttgattatacaactttgagtaatcttatttgggtcgaatgtattttgtgttctctggccttctcatatgtggatatttgtctcttctcatattttagaaagttttctgttattatttctttgaataagctttctaccccttgaccgactccctcttgaacacaaatagtttttagatttggtctttttaagtaattttctatattttgtgggtgagctatgcttctttttattatgttttctcctctggttattttcaaatactctgtcttcaagctcactgattctttcctctacttgattcattctgctcttgagagcttctcatgaatttttcagtccagcagatatatttctcagtgccagtatttttgtttgatttttaaaattatttctctttgctcaatttttctaataagtttctgaattcactagaaatttttctgtgttatcttggaaatcagtgaatttccttacaactaccattgtgtattcttgttcagagagttcacatatcaccatctcattaaggtcggttactggttccttgcattgtccatttgaggaggtcatagttccctatttgttgtttcttgtggatgtatatctatgtttttggatttaaggatcagttatttattccagtgttccttgttttaatttttattggatgtgtttgcttaaagattcttttaatttacctgttgatttgattttctcttcttcttcttctccttctccttctcctcctcctcctcctcctcctcctccttctcattcttcttcttctttgtgcgtgcgtgcatgtatgctacttccttttcagcaccaggtggttccttaagcacaggtttgctttggttctagtaaaccatcagagtgcttcctgtcctgaatgagggaggtatccaaggggatattgcagtactatgggaaggctatcttgggtttcatgcccagggacctgtggaacaaacttcctacagtatagtactgctgaatggccacctaatttgttgtcttttttttttttgctgagttacagagtagtttccagggctgagaatggtagtctcacctcccctttgtatctctggctgtcctcggggatatttctgtcttcaggtactcctgatgtttccagtgggctgaggcagagacagttctgcccagaaacccaagatggtggggaaagtcattgctcacctcaatctcactttcactagtttggaaaccatgagttgtggggacatttttttttgcatacttggtgccaggtagattagaggagagggagtgtcatggatgtgaaagactgattctcttattctctgtcagagtttcttcacttctctatggccctaagaactgtctcatcctcatatttgagttctgggatattgctggtaataatctcagtgttgtgcatttgtttttggttttctgttgaggggaggaagtaaagccagcttagctctgcatcaccattatgaaaccagaagtctgtgcttatttattattattattttatattttattttttctttctttctttcttttttccttccttccttccttctttccttcctttctttctctctccttccttccttccttcctctctctctctccttccttcatttctcccttctcttccctccccttctctcccctcccttccctccccttcccttccctttccctcccctccccttcccttcccttcccttccttcatcttgctctgtttcccaggctggaatgcagtggctcaatcatggctcactgcacccttgacctcccgggctcaggcagtcctcccatctcagtctcccaagtatcagggactaaaatcgtctctacaattaaaaaaaatgtagagacatagccttgctatgttgcctaggctggatgtgcatctttattcttaaaaaaacaacttacggaaggactcaaaacatatgataccctcaaaagcttccattttagatagtacctatagtgtgttcaagaagctagctaacattctgttgttttctttactgacaaatttaagccaaagtttctaaatatggcattttacatgaggaataagtaggatttagctgtgcctattccagtattgataatacttataatctttaaaaaatagagaaaagtctattgaaaattgtaatagctgggattttcatttactttttttttggacttagcttttgtggtagaaaccacatgacaattagtctgcacaaaatcactgtaaactctatagtatgtacttggagagaacttgtttccttagaaatgctataagatttagggactttaagaaacattttcccacatgacagataacaattttggtggcaaatcttcattgtgaaatcaatctcctccttctactgttttttttaatacttaaaaacattatctggatttatatctctgtcctatagaaagtatgtcaagtgtacctgtggttgtcactcattaatgcacataagaaacacatgaaataagtggattcctgatcccagctcaaatacacttaataagagtatccgactttaggaagcaggatttttccagtttgtggatctgagtctcatgtgaactgttaggtaagaataattgtgatgtatgcaatttgtggacttaactgttcccaaaaagaagggtgtctgtctgaaaggctagcttaaattcaatggttactgaatgaaaataattatttttgtaagatattttctaaaatgtgattggtttatatttgacaactatataaaacaggatttctgaggctaaaattgaattgcatatttggttccaagcctcctaatacccaaagaaaaaaaacaatgaatattatgtgctttacattgtctatataaatttttgaagacatccaggatcatttacaatttctccaagaatattgagccttcataaacttgaaggattgaaacattagaggtgagtcagccctcactaatcccttaagatcaaccagtatgatatggaataagtctttatgtgagaaaaaataaaaataaaaatagaattgatggaggactagagattttgatgctgtaactccttggcagtgtcctacaggtttctaggtacagtcttgcctttctttgattgctaaatgatatttatgtgttattagtcttaccacttttttatatggagaagtcaaaaattagtactctacaaattctaagagtaacttataattctttaaattctttaacatttttgttctgttacaataacatttactaagtacttgcaataccactttatgccagtcacttggttcatatcctcataaaaatgttatagggcagaatatcagtcagagttctaccagggaaacagaacttgtagaagctatatattaagagatttattgcaaggaattgtaccacacagtgatggtggctgataagacaagttcaaaatctgtacggcaggctgtcagaaaatgtagtctggaattctcaggtacaaactgaagctgcagtctacagatggaatttcttcttcagaaaagcctcagctctgctcttaagcccttttactagattgaatcaggcccacccagattatccaggctaatcttccttacttaaactgattatggactttaatctggtctacaaatattttctcagcagcacctagattagtgtttggttgaattaatgggattgtagcctagccacattggcatgtaaaactgaccatcacaggtatgaacttttattgttctaattttacaaaatcaggaaactgactttgaaaaagttaaagtaaattgctacaattgagaaatgatggaacattgaacctaagtttgtccaaacccagaacccatattataaaacccagatggaaagttggcatttgactactaaactattaaagaaatgaatgctgtgtgtgctctggtgcacacacatgcacacacacgcatgcgcccacacgcacacacacacacaccactaccactgccatacagctattcaggaaaaaattataaagggatatttagtacatttgaatgcatgtattaatattgcggagattgaccagcgttttcattaattccgctaggttaattttccttttggaagccatgaaaaatgatctgttcgttataaattagagtaatcttggaagtaatttgacagtcaatcatcatttaataaaattgaaataaaatgtcaagagtaaactgtaaaagacaatgggatcactcatagtaattactgtcagtttaaactgaggaaaacagaatctgatttttaccgttatcagaatgaggtagttagtaatgaaccacaaatgtgaatctgtaaagtattgcatttaatttgttggatttctgcatattggcttaatggatgagtggcataaatttgtaaaaacagttactctcaaacacattatacaatagcacctaaggaaatatttattattctgagattactgattgaatttgtgatacattttattctgctgtgtatgttcagagatagctgtaaagtatgtatctactttgaaaaacaggaaagcctagatggaggacattggctgtcaacagagtgctagaataagcagaaagaaaaataaagcggaaacagaggtacaaacactaaaaaattctttgaaaggtggcatttgttctagagtttcacattttccaatgacacattattttaacttgtccatgaagttgaaatcatttgtgcaagccttgtttcataatttcactattttacttttgttcaaatatcaaaatatttcccaattagaccatacatatacttgcatagcctccctcctttcattatcttctttgtaaaaccaaccatttataatgagcaagacaatatcctcccttgaaaatgttcactttccttatactgtgtctctactcagcatgtgacattgcccatagactgcaaaaaccattctatctcttctagatcacaaactaccatgccatccttaggtcttactaccctccaatacaaacactttcttctagtcatacggggcctttcattcccaccatacttatcctacatatttccagaccaaccaacacctctgctcacattgtgggcctaacagtacactcctgacttcttgccatatatgtgaatactgtcgatctagaagcccagatcctgtaagatttctttattaagcctggtctctttctctactgaactcagataggagatcaaatctgaaagaagcttgaagacaacaggcatctgctgcttgaactccttctttatagtcgagtgagatgatctctacccatggatattatgtttgaaaacctctagtaaaggagaactcattacttttccatcaggttcagtctttggatagttttagaaagtagaaagttcttgtatgtaactattatcatttcttctttacttagctgttcctagatactagactataaacctctttatagcaagagtgtgttttttatttcccaatacttaacacaatactgggcatgcagtagatgttaaaaatactttaaaaaataaataaacctcatttggggttctttcactttcttaaccattcatctctgtataaaccctggtttgcgtatgtgcctcagagcaaatgcacaggtatagtctgacctttctaatccacaatggtctgcacagcctacttcttactcttttctagaaaagcagcctatgttcacattttccaattttccatagcttcataattgctgacaaaaatttctttatacacaattaaatccaaacccaagtattactacttataagacttatttttatttttaccccaagccatatatttcttaccaagtttttgtaacattggtgttttaggatccacatgtagaatacattttattcttattaaatgtatgctattaggcctatgagtctccccatcaagtcctttttgcattttgactctattcttccttattcagtaaacgagccagatttacattactgacaaattgtataataatttctggtgtgaccatattcattttattgacttaaaatattgaatagaagatgaaaacggctggagacctagcattacaagtcagtctctcaatcttggtctgtctttctctctccctctttctcttaaaattgagccattaacatattttagagtcccttagccagttcctatcacataaataaaaattggtgggatgagattcatgataggaatataatgaaatgacatgcactattaaaaataaatggattgatactagaaatgtagcatgtccaatgtaatcatacaacatttcgggggttacatagcacaggcatgttcaaattgttagttatctttattatatatatatataatctctctttctatttagcttcttaattatttaattacaaaatcgagtcttacataaatctgtatatccgtaacatgtaatggtgtaccttatgcataacaggtaaccaactgattgtggtttaatgtgaaaggactcaattgcaatgaaaaagaaagttatttagctacagttttcaagagtaactcccaggaaagaaaaataggtaggataagtactaagaaactctttccgaagctgagtgtaagatttcaagaaaaacgttcaaaaatattattacttcgttctaaaataaaatacattctgaaaaatattaggagccatataaaataatgtaatgatgaatcatactctcaacataaaacaaatgatcagtactttctaattttctataatttgtatgtcaaatctcgttaatatttttttaggtgtgttgtactgttgctgaggttgttttattatttgttttggagaaaaagactgtttagaaggttaaactgatgaattcacagacaattatacaagcttgtgctattaatattgttaaataattgcatacaacttagcacttgagcaagaacaagtgttatttgttactgagtctcttcctgtgatcaggtgattagcattacatattcccaagaataaatgattccacacctcagggatcaggaaaataaccacactttcacagtcagaatgtagataagcgctgtcttgtaaactgtagtaaagccaaacatttatagcatcttttaaagacagtcttatgatctctgaatggttttcatctattagaaattctgtactgtttgtctgacttaatgactcatgaaaatataacctaaaagtgaaaatactgagaacataaaataaataatggttttaaatcagtagtgatattgtcaatttgtgttagtggtctgtacttgcagacaagtaattgggctctcttgtcttaattttgtttcagttaccaatatcactatccaatttcagcagaaaatgtcagcattaaaatatgttatttattacaaagtaatagtttttattgaggaaaatttcaaaaacacagagaggtgtgaaaagaggaaaaaatatgctgtcattctatcaccttgaccactaagtagaatgaaaataaatggttgttattagcatctatagagtgtctttttgcaaaattttgattatcacctacataatgcttggtaacatcacttttaacaatgcattctgaacacttttatgccattagaaagtctcctatcatattatattatttttaagtaataaaattatatgctacagcagaatttatttaaccaatctccaattgatgggcatttaagttgcttttggtctcttgatgaagtaaaaagattgttttaaaaattcctttttaaaatgattgcatacagttctgagcctggtttcgtgtaaggagtgtatatttgttacataggcattcaaaagagcacacttctgttatctatttaaaattgtagaatcatgttaatgtaatgaaacaaatggctagctagaataagatggaaacttgtagatgcctgcattaaatcatagatttggactttgaaagaattgctattgcatatgactaatgtttcttagcatgaaagttgcttattttagaatagctggaactatttatcagtgcatttgtaaagcacaggtaccttaaaatggatccaatatctgttcatatcctcaattaatgtaatacatttttgactaaattttatttaaaaagaatcaacagaattgatacaaacaatgggtaaagatgacaaacttttttaggtcaaaggtagtcttttacaatttctggaagcttctttaaaatgttatctatcttgcctggtttgatttgacatatgaaatatatttctctatatattttctatgttttggggcataggtgatgtgcagggttacgttggttcataatattatcacaattttaatcaaacccaattacaaaagaaaaatgataatgatcaccttataatttatcgtaaaaattatacatatatatttgtgtgatgtttgatagatttgctcttatgtaagagaattatgaaagttagatagaaacagccttctgaaatataaaatatttgtcctaacttttcctgaatagcagaaactaagtatactaaaataaatgtcttcaagattttcttcacacgttcctcagactttgttttaaatcagacactttcagataacatatgtttaatgaaaacacaatgatgtgctgagttttcattttaaaatgtttttacttaaaaatagaaaagaatttggagaaagtcaagttgtattgttttgttttgtttgagacagagtttcaccctgtcgccaaggctggagtgcagtggcactatctcggctcactgcaacctctgcctcctgggttcaagcaattttcatgcctcagcatccccagtagctgggatcacaggtgcgcaccaccacgcccggctaatttttgtgtttttagtagagacagggttttgccatgttggccaggcttgtcttgaactcctgaccttgagtgatccgcctgccttggcctcccaaaagtgctgggattacaggcgtgagccaccgcacctggcaagttgaattgttatatgcagctatatttatccaagttgcacatatttaatataagcacaatctgattaaaaaaaatcaaagttcctgtctaaaacctaaagaattgtagtgaaatcaatcaagttgttgagcttaactgaacttctttaatgccataaccttgatattcactatttcctttgaaatataatattcccttttgcattatttatgcaaatgccatgccagtgtagtggaaggtgtcacctcagtgcagctatagccagtaacatttcctgttctagtcatagaaactttcatttattcatgttgatttgtaataattctcagtcaatttttcctgggtgaagacatgaatttgatgaaacagtagcagcagaattattgttttggatgtattcattaattttttagttaaactttctactttgagataattgtagatttacatgcaattgcaaaagacattacagagatctcatatatcctttaatcagtttccctcaatggaaacatcttccaaaaatttcttacagtggtaacatcttgatagtacaatatcaaacctggatattgaaattgacatagtcaagatagaaaacattttcatcaccacaaggattcctcctgttgccaattagtagccataccacttcccttctgctgtcactctctccttatctctggcaaccactaatctgttctccatttctattattgtgccaagtcaagaatgttccataaatggaatcatacagtttgtaacctttttcactcagcataattctctggagattcacctaggttgttgaatatatcaatagtttgttcctctttattgttggtagtattctctggtatggatatatcacaatttgtttaaccacttacctgatgaagtatatctggattgtttccaatttttgagtgttacaaataaatttgctaaaacagagcctcactctgtctcccaggctgtagaacagtgttgtcagtggtgtgatttggctcactgcaacctccaccccctggattcaagcgatcctcctacctcagcctcccatgaagctgggactacaggcatgtaccaccacgcctggatgagttttgtatttttgtagagatagggtttcgccatgttgcccaggctggtcttgaattcctgagctcaaacaatctgcccaccttggcctcgcaaagtgctgggattataggtgtgagccactgtgcctggccaaatcaattaattttaaattcaaaggtgatatgatgccctctttgtccttctgattttcagtgttttatgaattgattttagttgtttcagtggattaattctacagtatttgcaacagaaagtataacaaagatctctgacaaggtcatgcctatattgggctgtaggaaatacttacttagctacgtattttatacaaaatactggctactagaaaatgtagacatattaattggttgtgaaaaaattatcttgatttactgtaatggcttttatttacctatgtattcttaaaaatctatggaatgtgttctagatacaaaatagtatatatgccatatagagagaacttacagaattagagaaatgaactcctatgtatcagttatgagtttcaaaaatagagtagtacatcaccatattgaaacaccttggagcatggccttctggatgttatctcccattcttcttttggaggtcaccactattctcaatttgatatggtttggttttgcccaattttgttatataaatgtactaatctgattatattcactgttctatgacttattttttttacttatttcacagattatactatgatggtggcagtatcattatttattaatttccattgctatataatattttattgtatgaatatactccaatttaatgtatctcttgtattcttgatggacatttgggctgtttccattttttttctattattaacagtgttgctatgactatccttatacttgtttcctggtgtagatgtggaaaaatgtctccaggttccatatatatctagcagttgaacagctgagtctatatgcatattttaaagtatattaggtaatactaaattattcttcaaaagtggtgtaccaatttacatagccacaagcatgtgttctctcacatctgtaatcaggccctcagcatttgtttgctcacttttatattattggtcttaagcttattgattcaaaagagtacttcgcatattttggatactaggtgtttgacagtaatacatattgcaaatgttttctcccaacttatggcttatctttttactctctttatggtacctatgatcaaacgaagcccttaatttaatcacatttattatctttttcctttctagtttgtactttggaaagctttttgaattttactagggtttatagcttaagttttatatcagtaaaatgcttaccagaataatgttctttatcttgaatagtagcttgcatttatctaaaaattattaggatatatatttcataataatttctatttatagacatatatccttatgatttttatataaacacataccaaatgtatatatatatatatatgtaacaaagtttcttttaaggtttttaatttcagctatcgacctaaacatgcataaactaccttttcttttaaaatacattgctgtagttagctcctgaaaacacttctacttcactgaagcggtgatgatttttgtgaattttcagccatttgtctttgagttttctctttgaaagaccctgagactttattcagtgatatgagagaaactatggaattgttaatattttaagacatcatcatattcatgatttattgttctttgcacaattgattccaacccaaatgtcccatgaaataaaataacacactcagtgtgatttgttttactaattattatatgtagcaatcacttgactgtatagatcaaattttactttctaaaagctccttccattagtgctaatgtgtttgtccctttcaaaaaatacatctagtaatcattgggcaggtggtgaggaggaacagattagaaaatggttcctctctattttttaaatgatgaagtagaaattctgtcttttatgaacttctgctgtttggtttctaggaaagtatatgcttaattgttaaaatattgaagatcttactgttaactctaatttttccagagagaagaggaagaggaaccgtcattggttaaacgctcaatataggttaggcaatattctggccatatgacctctaatattcttcattcatgcattaattcattcaacaaattttttttgagtatgttctatgtgccaagctgtgttctaggaatcgaggtaaagcagtgaataaaacagacaaagaggcaaaaatcatgattttggtagagcttaagcaataaatatgacagattactgccttagaggtatctagaaattgagaaatgctatacaaaatagcatatggctctgcttgtaaaattttaatgtgcatgtgagtcacctggggatctcgttacaatgcagattgtgattccataggtcttgggtggagtcctaagatgctgcatttctagcaagcttctgagtgatgccaatgttgctggtttgggagcacagtttgagtagcaaagagtatatggcaagtgaggtgggggtcgagcgtggagagtgggagagaaactggctgcactttaaaatatgatgattagggtgtgccttattgaaaaggttataagtgagcaaagatatgaagaaggtgggggaatttagctatacacttatctaggtcaatgaaaccagccagtgcagaagggtgttacatgggagtgtgcctgacaaggaggtcagtgtggatggaatggcatgaatgagaagagtagtagtagatcggatttgagagacagtgggaataaagtagatcttgcagggcttcggacaccattataagttctttggcatttacgctgagatgcggaaccactccagaattcggagcagggaggtgacatgctccaacgtacgtatttaaaaaatcactctaactgctgtatagaaaatagactattataaaacaggatagaagcagtgagaccagttaggagtctgcaaaatatatggtagctcagacttaagtttatagcaggtgagatggtgagaagtgctaatattcagaacacattttgaaggtagagcctagtgaacttattgatgtcttaaaatatgcatatacacagatgtaggctgtgaaagaaagaaaggagtcaaggatgactgcaaggtttgtttgttttttgacctgagtttctagaaggatgaagttggcatcacctgaaatggggaagggctaggttttcaggagcatgtcagaggttcattctctgtatgtgttgaatcccatgtagccattagatcttcaaatagagatgtggagtaggcaattgtatatgagagcctggaattcagcgaaaggaccgtgcgagaggtccaaattttctcttatatcattcttaaaacaatcccttgctgctcatcttttatccacattttataattggggaaacatgttcagaggatatagcaaacattcagtttgtaagaggtggagcagagccccaggacaatctgtagctccaaaggccacactgctgttctgcttcaatagtaaaaagaatcaacactggtcactgcagctggttatgtgtttacttagagcaagtcgaaaatatttttaggcagaaaaattgagttggcagttcatctttttaacttccctacttggctactatagacagattttgttaagtcaatgcttggcagctttccatatgttctagagatgcgtgttcatctgggtgtgacagttttttctaagtcacttctgccatagcttgttaaaggtaagaaaaccatgtcttcactgatcttggggtcctagcgaagaaatgtgtgctttctcagtgttggaagggtagagaatggtaaaatgaacattggtggcctccctgtcccccagtggaattccaaggcatagcctaaatgatttctcagaggtccccagcagggttgattcccggttgctcacagcagtaacctgttcattaataccatttattggcttttcatgcatccttgcctcacattcctcattgttcacttcttaggatcacctcccaagtgaattgtctgaacctaagtccatgtctctggctaatctaagaaaggtgataatgtgaaatgtgcttaactggtctatccatgatagttctttctaatttctacaacagtgcctggcaagcagtctcaataagtatttgccacaccagtgaaggactgttattttccttaatgtttattaagtaatagtagtagttgttactattattttaggcaaatatatttttaataggacacagataaattcccctttgtcactaacactgccaatcttagttctttccttacgttcccagaaacaagagttcttaaaactttggtatgtatgcttctgctattttgacttttacctaaatcacatcattttatacatgtgattatgtaatttgcttttttcactcaaatttatgattttgagttctatcgatgctacatattttctgccttctatctgattaaaaatttcccattctgttttcttcctttatggtatttagcgtttttaaattctatttctattttttagtggttccttgtaagtctttaacacaaatatttgaatttacattttaagaggtactaccagtaatgagctaagatttttatcattgcttaaattaatgagcctttctgttcttaatggccaaatgtaggccatagtttaccttgtctcctagctatccctgtttacttccgtgttttctaggattttagtttgttcttgctcccaaataacaaaaggcttattattattattattatctttattggatcttataattaagttttatttctttcatttgcttattgaactcctttctttaaatatacttttcatgttggggaagtgtctgctttagtcactaggctatgatacttaatctaggtcttaacaagtagggttttgccatgaagagggagaaaggatcagtatgcaagggagtagtgtctgaatttgctttgtatgtgccggaatgtctatgagttaccctttgaacacagctttgtgttgctctcatggtttgtaatgtaatccatggtatggtaaatatgtacatcaaaaataaactaataggaaaagatatgaatatcaaattagaaagtgacccaaaatgaagtgttatctaagacaatacatttaatatgtaaaaatacacatagattcatttgaaaatatttgtcgtatttctttcaaacctcatccaatgtcagcataaacaaatataacaaactagttttcaaattaaatttaaaaatataattcttcatacctggagcctcggtgagtaggcattatgcctgaaattttcaatgtcgatggaccatagatctgcctaattactcctagagtcattggagccaaattgctgggatgagccatcattcccccatccccctttcacaccaatgtgattgtatgccttaattggttctctagttattcatgttatatgatctcaccactaccagtgcttctctattagtacctcagtcttcttgttagcattcttaccaaaagattatcagaaaatccaagttactaaaaacatatctaaaacacaaagcccgtgaacagcacatgaaagctggaagcccttgcacttccagaatcctgcttgcatgcctttcagatcacttacagtagcagaaaaggtgtgcaccatcacgctcagctctaacttgctctcttttgtatatgatgcggtaatcctggctcttagtgctttgggattttggtgatagatgtcatcaccagtaattccacagtccccaaagagttcaactctctcaatcaaatcttaagccatattgttggctccctataatactttaaattctactgtacatttcttatagtgtaatcatgttaaagagggggaaataggcttttttcctcttctcaatgcataatctttttaaagttatctattctgatttctcttgaggtctctttccaattacctgcaagtttgcttttactgtggtgttccctgtattgtgtgtgtcttattccttctgcaagaaggaagtggccaagctgacagattgctaatattaccattgtctaattacagctctattatgtctgtacaacagaattgcatatcatttaagaggccactacagcatttatcagtcgttgtggattctagcctaacttgaccattcatttatttttaatttatttttatttttgccttttttgagacagtatctcactctctctctctcacccagggtggaatgcagtggtgtgatctctgctcactgcaacttctgcctcccaggctcaggcaatcctcccatctcagtgtcccgagtggctgggactacaggtgcataccaccacacttggaaaaaattttaaggtttttgtagctacgaggtcgcattatattgcccagactggtctcgaactcctgggctcaagtaatcctcccacctcagtctcccaaagtgctgagattacaggtttgagccactgtgcctggccttgatcattcatttagacttgcagtctgtgccatgggaaatccaaaagctccaccatgacaaattaactccctgttacagacgtagctgttgtctctccgtatctggagaccctcagagcatttttaaaagcatgacattttaaatgttaatttttattgcccagcaaagttaatcacacctatctatgaagagttaatttccaattaaacagttctctgttcactatctataattccctcaaaggaaccaatcatacttaaagggattcagagcctgttatatttcttatcgtctattttcatgagagtatgtacttattataccagatttctggcatttagtgttatagatatgcaaattccattttaactccccttaagatttccaacacccaaatgaacaattaagttttaacttttcatctgtgttctctctctctctcatctgtgttctctctctctctctctctctcagcacatgctgttaaaactttagtttatgctataggtccttgtagcgacaattttagaaacacccctttcttgtgtttatactattataactttggggtctctaaaccaattctaaatatgcattataattataactttatatgttacattcttatcctacttttgtcttaagataatttatgactgaatatttttgtggcatcataatttaagctttaattttactaaaatgtgctttttggttaacagtaaacagttaatatgctatagtctcctggaaacacacgttcacatagctttttatgagccaggtttttggtaattcagcatatactttactattgaacttgcattcttaatgtgcaatctgatcaagaaaaatatcctctaatatttcttttgggttccaagagcactgtcccctttcccaagtactacattttacctgaaaaatatatgagaaagtatgagaattcttgagcctaaagcatttaaatttgattattttcaaaatttgttaagtcatttcaaactgaaattgaaaataaaattaatttccaaatagtaaaaggataaatgaaactaaatactgttactgagaaaattagtccatctttagggcttcaaaaaacacactgaatgtagctttcactgattatatacacttttaaggttgcactttttctaggtgctaggcagaaaatggagcctgaaaaatatcaaattgcagcatagtaaatcacgtttgaatccaagttttaagttatttgaccagtactttattctttgatgagccctgaatatatttttctcagccataaggtaggcatcatgcattcctaaaattggagttgattttctatgatagtttaatttactagctgctcagttcttctaactgtgcatgttatatgggaagattatttttttatttctttgtaaattcatgtcagatctacccatgggaggaaaatgattcctaactcttctccatttcttttagtgtttattcatatgctgtttctgtcttttctttttgcctttcccctagctgaaacaaggatgaatctataaactaaaaaaaaatctttttctttgtaatattagatagacatattatcaataatattatataatctattgcaacaatcaagtcaccattaaaatgtgtagttttctgagtgtttccaagtatgtaatgtaggacaatgctttaagtctggtttattctcatttcacttggcttttttttttttttttgcatactttgagtatatgttcttaagaatattcttaaaatattttccaagacacatttatgtaagctaatcaaaccatgcaatagataagaactcaatgttttagaactctgtcataagaagagatatatttgtgtatgtgtagatacacacatacatttagcacattttcagagacatatacattatggatttttattattgatttaaattctttataatatgcaattacagatatattttatatcagcttaagcattttaattgcaagatttctgtttaatttgtctgcaaagtactcttttttttctggtcatggtaaatttcatattctttgacaatagcttttgtttattactagaaacacttctcttgggctaggttgttaattaactgtcatttttgtacagggtgtaaaagagatatggaaagaagggtacatgagcaaatggaatttcacacattattaactgttttagtgtcttcaaacttcaaaaacatatattaatatttttgtaccacgtaagttcatcagaagcctgactttaatctctgatttattatatttgaacactgtgaagaagcagtttaacactgaacgaaagtgtcgtaatgcagctttcaaagtggccattaaagacagatctctgcttttctattagtacattttctaagatgactatcattgccattgtagtcagctttgtgtacctttatagagattccagtataaacccagaaacatagagcactgagagaaataatatcagaagtgtttcacctttggctactattgtaaattgacaaatgacattattgcttttagatttttaaaacaaacacactaagtagaacatatgcatccaaatcagtagggtcatttcaaataagtcatactttttgttccagtgattcattagcccaagtacacttgaagttcccattttagaattgctttcacaggccagtttatgaagcagaaaataaagattcatttctttctggttaacacctcatttttggccaaaagtgatatagcccaatataccacgaataccttactgaatctgatgcccaatgaattttaactgtttttaaagttcaaagcaatctttaaaagaatgaagactttcagccattgaaactgtctagaagctgagctatgatatttgaaggttcagtatttacaaatggcatcattactttttctttctagagaaggcactagaaggggggctttcatcagaaatacctggaggttttagagaaggcagattctgtctggaaagtcatgggaactagaggcagggtgccatgctatgatcagtcaagtctctaatctctaaaatgtatttcgaagacacagtttgagcaggttgaataagctttttgtcttgtaggcccaggatatactgcgttaccaaagtccaagccccacaaggaggttattcacctgcccataggtccattagaagtcatctgctgatgtgactgtattggtgatgtggaatattaacgtggaacagaaaactccatgggaaggcttagtgctgggggagagatataggcaaaagagatggaggaaagggttgaaataaggatttgtttagacagttcactggtggtgatttattgggtgtgttttactgctaacccacacatgaagcccctgacatcttggctgaggctggtaatttttttctgacaaggatcagcagaaatgaaggtgccatagcttccagtgctagatatagtagctaaacattatcttcagcagagatgggagttcagagtgtcattgtaaaatacatggaaatacctaatgtaaaggagtctaatgaatgaaagaaataccaaatgaatcttcacagagggaggtaaaagaaaagaagataaaatcaaggctggtgacaaggaattattaaaatagaatatgttattgtatatatttgcctcagagtttataattaggagtccgttgaactctgtttcaggatgtcttcatcatttctttaaggatttaaaatatactgcatctagaaataatccaaattaaaattgatttaatacactccaacaccacattataaaaatcattcactatgaccacctgggtttgatattggaaaatctattaatatcaatcactatattaatagatctaagaaaaaaatatacccttactccagtaatgctaaagcctggaataagacaggaatgaaattagaaaagataaattagaggcataagaactagaaaagaagaagtaaaattccctctatttgcagataacatgatagtatacctggaaaaccctagagaataaatggcaaatgtagctcaaacaatgaaataattcaacaagctagcaatatgtaaatttgacagacaaaattcgacagctaccatatgcaaaattaataatgttaaaatagttggagattagttagaataaattacaaaaatctcacaaaataaacagaaaagataaaataggaataaaattaacagaaaatgtgtaaaacatataagaaattataaagcctttctgaaagacacacagaagtagacttgaacaaatagaaagacattccttgttcttcaataggacatcacaacatcattaagatgccacttctctctgaattaatttaaatttaatgtgatgccaataaaaataccaacatgctttgctatatggagctaggcaagttgaaactaaggttaaaatgaaaaaataatgaacaaaaatatctgggaaaaacactaaaaaggaaaagctatgactagccctaccagatattagcatgtactacaaagcctcaacaaataacagtgtcaatagcacatgaatggacagaccaatggaataaaatcaaaagtcctgaaatagaaccaaatacatatagaattgtaatatataatagaggtgacatctcaaataactggggcaaagttgaacttaataataaatggtttcgtataaaagaggaaattagatgtcttcctcaagccatacacgagaataaacttcaaatgaatcagaaaactaaatgtaccaaggaaaactatacaggtactagaagaaaatattggtgaattattttaggacttgcatgtagggaaggactcttttttttttttttttttttttttttttttgagacggagtcttgctttctcaccaggctagagtacagtggtgcgatctcagctcactgcaacctccgcatcccgggttcaagtgatttccctgcctcagcctctcaagtagctgggattacaggcacgtgccaccacgcccagctaattttttgtatttgggtttcaccgtgttggccaagatggtctcgatctcctgacctcgtgatctgcccgcctcatcctcccaaagtgctgggattacaggcgtgagccgctgtgcctggctgggaaggactttctaagtatgactaaaaattcaaatgccacaaataaaaagattaatacattttactatattaaaaacttcgcatgacaaaatcaaaagccaaaagaaaactggaaaaaatgcatatattgtaatgtatatcacagataaagagttaatgtccttaatatataaagaacttttaaaaattaagtgggaacacagatcctgtagaaagatggacaaaaatataaatagacaatttacaaaaaatatataaatgatccttaagcatatgagaagatgattgctttcactaacaataagtaaaagcaaattaaagctattttgaggtacagttctcacccatcagattggcaataatatgaacatttcacaatatactctgttgagaagctgtagagaaacaagcattctcatacagtgttggaatttcgaaatgttctgaaacaaatggagggggaaatagaaatatctaataaaattacatatgcaatcccactttgacctagcaatctcatttctagaaattagcctgaagatatatctcctacaatgcaaatatatgtacatataaagttattcattgcagcattatttgtaattgcaaaatattggaaactacgtaatagtcaaacctaagatatcagctggataaactatagtacatatacacaataaagtactaggcaactaaagcaataatgaggatctcttgatgaactaatattgagtaatttctaagtgaaagcgaagtaaaagaatgtttttctactatgctgcctttgtgtgtaaaagaaactgaaataagaaactgggcatcactttagccaagtgctcaaaattagtatgtttgttttctgtgctgtgtaaaaaattaccacaaatttagcaacttaacatagcatttattttttctttcagtttctgttggacagaagtctgggtatgacataactggaatctctctcagatccttaacacttgacctcctccataaactctctcacacttacaatgtctgatctctggaagggcttggcccctttgaagccagattgggtaaagttcacccaggatacgctccttttttattaacgcaaaggaaaccaatatgggactttatttatactgcaaaacctcttcacctttgttatataacataacttgatcaagggagtgaaatccaccatctacccgttattcctagagtagggattttacagggtttatgtacaaaggcatggggatcttggagcccctctttgaattgggcctatgacagttaatatcaccaaaaaggggcaaacagacatcttgtgtgtgcctccagatgcaatactcttggcaggatataacaccactgagaaggatatgacagcactgatacagtattcccacccaaactgtataacctgaatttagtcataagagagcatcaggcaacacaaatcgaggtacattttataatataattggtctgtagttttaaaaaaatttcatggtcataaatgatatagaaataatgagaagggattccagattaagagaaactaaagagacatgacacccaaatgtagtctataatactggattggataccaaactgaaaaaaagatattgttataaagaatattatttgatcaattaacaaaattagaatatgaactacagttgaaagtatttgggccgggtacaatggctcatgcctgtaatcccagcactttgggggtctgaggtgggcggatcacctgatgtcaggagtttgagaccagcctggccaacatggtgaaaccctgttgctactaaaaatacaaaaattagccgggtgtggtgatgcgcgcctgtaatcccagctacttgggagcttgggaggctgaggcaggagaatggcttgaacccgggaagcagaggttgcagtgagccgagatcgtgccactgcactccagcctgggagacagagtgcctctgtctcaaaaaaaaaaaaaaaacccaacaacaacaaagaaaatattctattagtgttattagtgttagatttcctgagtttgatcactgaactgtggttatataagagaatatcttttgttcttaggaaatacatactgaaatattaaggggtaaaggaatataatatgtacaacatactctcgtggttcagaaaaaaatactatatgtgattgtgtgtgaaagagagagaaagggaagagagaatgataaagcaaatgtggcagaattttgaagattggtgaatatttgtgaagtgttctttggattgttcttgtaacttttctgtaattttgaagttatttcaaaataaaaatcaaattaacaaaaaacaaaaaataaactacacctaaacatcttagcagagggcctgcctggcatataagttctcagtaaatggcagttaataataatatcactattattacctaattcttgcttacaacttgaatccaatcaaatgaacctatttattgccactaccttgggggtttttattgtatttttggtttaagaatacttagtatttttgtttaaagtctaaaataattttataatataaatgtgtagagtaactggtaaccagaattcctgcaaatttaatgccactgcattaattgattgttttagttttggttccccagaagctgacccctagaacccaagacaaggtttcaagttcacatagtttatgtgagaggaaataccaggagatgttagatgtggggagatgagaaagtgaggagaaggaattgaataaagggttcattattaaccaagttaccactgtaggcaaaagggacttaatcctggtggggaaatctaggagacagtgtaatacatgcttcagactttgcctgcccaaggagggatggaggtagggtatttgtacactgacccccatcggtcattgactgagggcttctggagcatgcaaattaaattctaagcacttccagactgctacagtatcatatcagattcctttaggcaatgggttgcaagagctgacatgtgggagacagggctggatgcatgcaaatgatgaattctgagggtatactggtaagtgtctcacagaatctgctgctttggtgaggcagaaatctgctgaatcagtctccctggtattccaggaagcatgtggagtgattgcagctataattatggtgaaatctacactggaactaggtttctaggaacaaacagatctgaactgaattattattttttccagttgctagctgagcgactttggatgagttatttgttcgaacctttggtttcctcatctgtaaaataggggcagtaacagtttgtcttcataaatttactttagaattaaagacattatgcatttgaaaggttgggcctagaaaatactcagtaagtgctagttttattatgtttgcatctcttatagttactattacttttcacttttaatcagtctgttagagatgattgttcttatcttgaactataagatgcactccaatctgctagattaatttgtaccttggctttaaaaaaatctgttttttttttaatagccattgaagactcagaacaatagggactccaatttgctacctgttcttgaaaatgacaatcagttacttaggaaagcaactttgaaaaatacaaaggaaagtcagagagattggaaccaaataatgaaggtcaagcatcatcaaaaacacaagttgtgagtgacacataaagggaagaaaaataagcatcgtaaggactggattagccatgtttagtatgcttttgaaatatttatgaaataatcacagtttaactgtttaattgcatgagctagatttggttgagtacaagcagaacactgcctattctttctcacttcctctttaaatcaagtcatggtcttgtcctttcctacccatgaatgaaaccgaacgcagagtccatagcttaccagtctcaaagtgtatttgtttcctagggttgtcataagaagataccatgaaccgagtggtttaaaacaacagaaatgtattctcacagttttggaagtccagaagtccaaaatcaaagtgttggcacagccatgctctctcttaaggctcttgagggatgattcttccttgcctcttcttaacttctggtggttgccagcagtccttcactttgttagcttatagctgctttactccagcctctgcctttatcttcacatagcattctccctgtatctctgtgtcttcacatggttattttgttaaaaggactccagtcttattggattaggggcttaccccactctagtatgacctcattttaacctaatggactatatttgcaatgaccttatatctgaagatcacattctgatgttcttggaattaggatttcaacatatcttcgcggggagagggggggcgcataattcaaccaataacacatagataattacagtctaagcccatcagtattcaaaccctaaatcttctccaaaataaacatcccccctttcttagctgaggaccactttgtgcctgaaaggctgcattggagtgagagtgacccgagtgtttatttccctgccccaccttgttctgtccctcctcctctctctctgacaaggatatgactgagtcttccaagattagagtaggtagaaagcgtgagctaaggttgggaggaaatgagaagggagaaaaggatgaagagttattttgattgatggaattattttggctttggtgtcctctgaggcagcagattccaaattctgattcttactctcattaggttgttcccttgcctcctcagaagcccacttactctctactctaaatatctctcacttgtagctaaattgatgcaggtagggcctctgacactaataaccaaatcttcagacccttggtgtctcattctgttgcttagttgggatctctgtatcctccaggcagtcatcttgagtggaacctttcttgaaatgaataaaaatttcttccccaggattgacactgatccaacaataaattcatgaatctgtcctgtgcagctgggtcgatctcataaagcatttattggtcaaagttcagccttaaacagttgtttcttgaattttcaagaggcagataccagtgcccatgatggcctttcaggtttactttttaaactcttcaagcatttcttatggaagttctcttacttaacttgcagtaaggtgaagcacctctcttccctaccccattgactcccaagaagcgatgggcaaatatggagaggagattgtaggtattacaggaatgcagagcactaacaactccctctaaagaaagccactctgttgaacatcttcatctgtccaaagatttcttaaactcctatgaacagcctagcctagagacataacagtctaataaaaacctggcagaacttgtcagaactcatcttttaatattttctaaatgcattgtttttaaagtgcttcactgagatataattcatacacttcaccactcacccatttaaagtacacagcacactgttttttagtatattcagagagttatgcaaacatcactacaacctaattttagaaggttttcatcattacaaaaagaaactccattcccattagctgtcactcctcatatctccctcttcctagccgtgggcaaacattactctactttctgttcctgaagatttacttattggggacattttatataaatggaatcatataccatgtggattttttgtgactgatattttagcataatatttgcagggtcatccattgattgtagcatatatcaacatttattttgatttctaaataatattccattgtatggatatatcacattttattcatccatcagttgatagacatatcaattgtttctgctttgagctagtagaaataatgctgctatgaatgtttttgcacactttttatgtggacatatgttatttctcttgggtatttatccaggagtggaattgttgggtcatatgttaactctatatttaactcttgaggaactgctagattgtattctaaagtgactgtaccactttacatccccatcagccatgtgtgaggtttcctaattttcaacattctcaccaacactcgttttcgttttttatttatcatatccactctattgggtgtaaattgattgtttcatactatcttagcttattttcatagataatccatttgctagagttggaatgtgttcccacaaagttcatgttttggaaacttggttgtcattctggtgatggtgggaagtggggcctttgggaggggattaggtcttggaggctccaccctcataaatagattaaggttgttattgcaaaagttgctttgctataaaagcaaactctcttgcatgtactctcttattctcctgcccttccaccatgagatgaccttcaccaaaagctggtctcatgttcttgtactttccagccttcagaaattgagccaaataaacttattttctctgtaaattacagagaaatttacagtgtgtgatattctgtaatagcaagagaaaatggactaagacaccattgcttctctttaggatgtgcaaatagtttgtgcttgctttatttttctgacttacgagccctctgttaaaactcaaaaatcataagaacagtgacatttaacattcagttaaaatgacaacaatttgaccaaaaggcattagaactctatgcctagagttatcgtaataccatgtgcacaataaaatatgtatatgtcataaggaataaaaagtggagtaaacatgagataatctgactatattctgagtgctagatgtctatgagggctttcaggttagttgcttgttttttagtaataaacacaacagtaataatgatgataatacatagcctatattgctccagccaggtgtggtgactcatgcctataatcccagcactttgggaggccaaggcaggaggatggcttgagttcaggagttcaagaccagcctgggcaacatggcaaaacctcatctcgacaaaaaagagaaattaggccgggcgcggtggctcatgcctgtaatcccagcactttgggaggccgaagcgggcagatcacaaggtcaggagatcgagaccatcctggctaacacggtgaaaccccatctctactaaaaatacaaaaaaattagccgggcgtggtggcgggcgcctgtagtcccagctgctcgggaggctgaggcaggagaatggcgtgaacccgggaggcggagcttgcagtgagccgagattgtgccactgcactccagcctgggcgacgagggagactccgtctcaaaaaaaaaaagagaaattaaccgagtgtggtggcccatgcctgtagtccctgctacatgggaagctgaagtgggaggatggcttgggcccaggaggtggaggttgcagtgagtcaagattatggcactgaactccagcctgggcaatggagtcagactctgtctccaaaaaaaaaaaaaaaaaaaaaaaaaaaattaactccctttattcctatgagaaccccactgaatagacactattatctttaccagttgtcagatgagcaaacttcccccagataataagattaatactacctttttacagattaagtaaaactagggggagattgagaggatactaaaaatatctaatgcataaaaatgtataaggttaaggacaattgttttgcctatctctgcccagatcttctcagatcccttttgaagatttttgttgtctaccctctctctggtttctgtgctctcacttttatcaactagcactaaaggctctttgtggggtaccatcctagggctactgaagctgtacccactcctccaggtgggagatcaaaagcctgggaatttcctgtaaattgttggaaattttcctactgataaatcctttcatgtttttactggctttccctggaagcattctttgtttggaatgagtcacttgtacacaaatcttgatctcagggttagcttaaggagaacacaagaaacagagaaaggaggatctcgataaaatattgaactagtacttagtatgtgaagaaaatgagtgatagtatcaaggtaaaaacaagaacagtagaaaattatcttaaaccagggggaattgacattagaaacaaatggattgtcatgatttgaaaatgttagaatgggctatttactcagaaaaagcttcaaacttgctttctgagaagactttataaatgtgcatagctattttcctgggttagtttaaatgtactgcagtccttctggaactgaataactaaatcagtggcttcccagagcctctacagctctaatagttgtataagagcacaacctatggttgtaaccaatggttaacaatcattaacctaaaaagtaaagcctttttgattatgcattgtgctaagggctttagaattattgttaaatggattcagtccctgctttttaggaacttaagagaaaaatttttaaaagtaaataaaagaaatctaccgtttatggtgtactactaagaagcattaaaacaagtatgagaatcacttcagagaaacattaatgaatttacaaatatcagtatttcagaaaagtaatatctactttgattttacaaatgagatatgtatggacaagaaaaatctattcatgacatgtctactccaaatagcttcattagtatttttcaggcgaaaagaagtaacaaaatgaaaaagaaaaagaaacattacactgcattgaggcaaaagattaagaaataagtttgtcagaaaaatgtgaaggtttgatgcttatctttgcagtaattttaagtaaaatgatgaagaaagaaaaatgtttgtggtgagaatattaaaaaaaattgtaggataaaatcccattatatcactggggaaacaaattaatatttcctggtaaagagcttgatgctaggatctagtgtcagaaacttttcttaaataaatactttttcttcttgaacctttaaacatattttgaactaagcaattttgaaacaaattttattcaagtttcttcaagtaataataaaaggaaatagttatcaagtatacaaataactgatctttaaatatatatatatatatggatattaggaaaatatttgagtaggtgggtaggtgttagaggaagcaggaaagataaaatacacacccttgataaaattgtattatataagcaactgcatatattgctttttattgcttcatacaattttattatataagcaatggctttattatataaacaatggcttatataataaaattatataaacaaaggcttagataataaaattatataaacaaattttataattttaaaattggcatgtagagtacacatataatttccttaaaactgtgttattactttccatcaatcacatggatcatgaagttgttttcagttcttctaaacatgctagaaatgtggtcagagactaaaaaacaggtacaaatatattgttttcaaactttacctgtgcgagtacagaataaagacatatttggatatgcagaaacactgaatattttctttcatggcaccctttcttagaatattatttaatgatattgtctatcagaactaaagagtaaaccaaaaaagaggagagcagtgaagagaagcttcacaattatagctatttgttgggtcccaatactgagcaatctgtcccagttaaaaaaggaaggaagacttcagaatagaaatatctgggtgattttattctaccctttattatttggaacaatataaggaaggaataaatgcagaaaataaaaggataatagaataacaagcatacaagatctcagcacccccttttattggagtaaaaggactacctgatgataaaatgcaaacaattaagatcaaatcaagagaaaacagatcaaaacaaaaagttggggaatgatgaatatttggtaaaaaaaaaaaaaacaacctggtgaagagctgtgaatacaaaaaatacaaaattgaaaataaagactatgagggttgtagttgtagaacagaatgtaaatattataaactttgaaaaagtgaatcaatataataaaaatgggaacatgttgaaggaggcaagaagcttattttctctcctttcacagcaggaaataaatcagtctgacttaaaattgaaatactcattttagaatatcataattgtagcaaaaccgatttcttaatgctgttccatattaatttttcctaaacttctaaaacatgtaaactgaccattaagaaactagtaattatttcacttcatattatttcttaatttatttgcagatacaattacattaactatatttcattcagaatatatgaccgtgtttactaaaatcatattttatctttatctctctgtatggattttagagatagctgggaaaatagttacctgatctttattgtttcttgtccatactttaatatcactttaatattgatttttatattaaaaatatattattttgtaaaataaaccattaaaaaaaaagccaattactaaaagtaacttgaaagtcagtacaactttgtataaagtccctagaaaaccacaaagtaaatttgatttatattatagcaaaatgtgtaatatatataatcttaaaggtttttcttttcttttctttttttttttttttttggagacggaatctcgctctttcacctcaggctggagtgaagtggtgatctcggctcactgcaacctccgcctcctgggttcaagcaattctcctgcctcagcctcccgagtagctgggattacaggcgcctgctaccactcccagctaatttttgtatttttagtagagacagggtttcaccattttggccaggctggttttgaactcctgacctcaggtgatacacccacctcggcctcccaaagtgctaggattatagggataagccactgctcctggccaaggttttttttttttttaaagcaatttagtaacctcccaaattaccactatttcttattttacaaatgtgtagtcttcacccctcttttcagctagaaaacaatttaccttaagtgtatgatcactgtcaaaaatgttagttaactaatagaacttcaacataaaagattataaattaaaagcacaaaatacaattttggcaagatataggtcactcggggatgaagttcagtctaaatagctgcctttcttttgcaagatgcttcagattttgtaaactccttttgctcttaaaagaatatctggtggattcatagccaaaaatctaccagacatgaaaagagagactggtaccaatttcaccgaaactattccaaaaaatcaaggaggaagcattcctccgtaactcattctatgaagcaagcatcatcctgataccaaaacctggcaaggacacaatgaataaaacacccaaaaaactacggaccaatatccctgactaatatagacgcagaaatcctcaacagaatactagcaaactgaattcaatagcacatcaaaaagttaattcaccaagatcaagtagatttcattcctgggatgcaacgttggtttaacatactcaaatcaataaatgtgactcactcataaacagaattaaaaacagaaaccatgtgatcatctcaatagatgtgaaaaaagctttcaataaaacccaatattgcttcacgttaaaaaccctcaagaaactagacattgaaggaacatacctcaaaatactatgagggtcaaaaattggatgcatttcccttgagaatttgaacaagacaaggatgccccctctcactgatatggtttggatctatgtccccacccaaatctcatgttcaattgtaattcccaatattgggggtgggtcctgttgggaggtgattggatcatgggggtggagttctcatgaatggtttagcaccgtccccccttaggactgtatagtgagtgggttttcaggagatctggttatttaaaaatgcgtagcacctccccgtctctttcttcttcctgctctgccatgtgaagtaccttactcccctcttgcgttccaccatgattataagtttcctgaggcctccccagaagcagaagccactatgcttcctgtacagcctgcagaactatgagccaattaaacctcttttccttataaattaccaagtcccaggtatttttttatagcagtgcaagaatggactaatatactcactactccaatgtagtactggtgctagccagagcaattaggcaagtaaaagaaataaaaggcatccagattggaaaagaaggagtcaaactatatctcctcatggatgatattattctacacctataaaaccctaaagactttgccaaaaggctcctggaactgattgacttcaataaagttttaagatacaaaaccagtgtacaaaaattagtagcatttctgtacaccaataatattcaagttgagagccaaatcaaggaggcaaccccattttcaatagtgacaaaaaataaaatacataggaacacatctaaccaagaagatgaaagatctctacaaggagaactgtaaaatattgcaaaaaaaaaaaatcatagatgtcacaaacaagtggtgaaacatcccatgctcatgggttggaatagtcaatatcattaaaatggtcatattgtccaaagcaatctacagattccacactattcctatcaaactaccaacatcgtttttcacagaactagaaaaaaactattctaaaatgtatttggaaaccaaaaacagcctgaatagttaaagcaatactaagcaaaaagaacaaagccagaggcatcacactacccaacttcaaattaactataaggctgcagtagcttaaactgcatggtactggtacaagatcagacacatagaccaatggaacagaatagaggaccctgaaataaagccgcatacctacagtcatctgatctttgacaaagttgacaaaaataagcaatggggaaaggactccctattcaataaatggtgctggggtaattggctagccatatgcagaataataatactggacccctgcctttcaccatgtacaaaaattaactcaaaatgggcaaaatatttaaatataagagctcatactctaataatccaaaaagaaaaactaggaaacaccattctggacattggccttggcaaagaatctatgactaagttctgaaaagcaattgcaacaaaaacaaaaattgacaagtgggacctaattaaactcaagagcttctgcacagcagaagaaactgtcagcagagtaaacagacaacctacagaatgggagaaaatatttgcaaatatgcctctgacaaaggtctaatatttagaatccataaggaatgtaaaaagttggacaaactaaaaacaaataaccccattaaaactaggcaaaagacgtgaacagacacttctcaaaagaagacatataagtgaccaataaacacatgaaaaaatgctcaaaatcgctcttagtcagagaaatgcaaatcaaaaccacaatgagacaccatgtcacaccagtcagaatggctgttattaaaaactcaaaaagccacagatgctagtgaggctgtggagaaaagggaatgcttataaactgttagtgggaatgtaaattagttcaaccactgggcaaagtgctttgacggtttctcaaagaacttaaaatggaactaccttgctccccagcaatcctattactaggtatatagccaaaagaaaataagtcattctcccagaaagtcatatgcacccacatgttcatcccagcactattggtaatagcaaagacatggaaacaacctaggtgcccatcaaaggtggattggataaagaaagtataatatatattatctacgctatggaatactacacagccataaaaagaattaaatgttgtcctttgcaacaacgtgggtgccgctggaggccattatcctaagttgattagtgcagtaacagaaaaccaaataccacatgttctcacttgcaagtgggagctaaccattggatacttatggatataaagaaggcaacaatagaaactggggactactaaaggatggaggggttcaagttttgaaaaacgattgggtactatgctcagtacctgtgtgagaggatcgttaaaaccccaaacctgagcctcacgcaatatacccaggtaacaaacccacacgtgtagcccctgaatctaacataaaagttgaaaaaaatgacataaaattaaaaaataattttgatacagaaaagaacatctgggaatggaatatatttgcttttaatatatatctacaaaagtaagcaatgatctctggtaaagtcatgaggcacggtatccttactggctgggataagagcatgcatcagaaaacaccaacatccaaaacatccaagctcaaaacactaatttatagccatctagatgcttttatattcagaattattatagaaagaaagcctaactgaaatcaggtgttctacatgcttttcattcaccagtgaaattagtccaaatagtgtgagactgaaaccagggatatcagctttcatcatcctgggaaagctcgtgctgcttcatttccttccacttcttgctttccagtcaggtctctggttagcagtccatgcagcccataattatgaccaggggtactaagcatgactttttcactttcaataggcctgcactttacagcaagtagttctgagattattatccaaaaatatctaataaccttatacttggaccaatgggcttgtggaataatttgggttcagataaaactacttcttctatctaaccatatgtcagaatacatagcccaccaaaatctttctaactctctgaatccctatggagagtaacacatagtttagcacttaatctttctctaattatttcctacatgctaattttatctccacaactgaaaagtaaattccctgtgtgcagtaacatgccctaatctttatgaggcagtaccataaacagtgttgagcatatttgatgcctgtttaataaatagttgtttatgattatccgatattaagacttagactcctgattgggagctgctttcagttaacataatacagaaatgaaacctcatgtcttttaggaaacatttctagattcctctccagcctcctctgaattactttaacgcttgatttgaatgactaaaactggaacatctttagaaggaaactagagttgtaaatccctgggaatgacttagggtaaataaacaaagacataactcaggtccagaggccaaaaactcagagttcatgttttcaaatattggccagtctgtctttcatacagctgtgtcagctaattgcccaatagcaacctttttgtttgaccatagcaatctgttcgtttctctctctctctctctctctctctctctctctcagcatttactgatgactgtaagtatctttaggtatatttatcttttctctgagtctgcagggtcccttatgatactcagtaactgtgctctcttctccattgcattcttattgctgagtataatgcccagcacttagtaggtgtttaatatatacgttggaagaatgaataattggatggatgaatggatggatgagagatgaaaatactgcctaatgaaagaaggtatcccatcttattaaaataagtagccctccttccttggattgtctggtgttctaaagcgttttttaaaagacatatatgagattaaacctaatctaggctctctccctgtgcgaacacaataattgaaacacatgactttagagaacaaaatgtgacttgactagctgtctgaatcatttcagggtggcatttaatatctttttaaacaaaagacatatatatatatatataactcaacagtcatttaactttctctgtttctcaattctcttatctctaaaatgatgataatatttgcttctttgtacctgtttcgtagttgaattaaaattttgacccctgccatatgattctgcagcccttccacatctttctgcagatactgacataaggtagagaggtcagggaaaggaccattgtagtgacctagtgaggtgtcagcaatgggacgataaggagtagacaatgtaagaaattcatgccagagtgtgggggtgggaatctatagaacttaatgcagatctcaaaggaaacagaagagtccaaatgattaacattgggtttcaaaatccacaccaaaaaaagattttaaaagttgattctttgttcacatgtctcatatatgcttatacaatagcagcattcaaaagtattttgagtcttatagttacatagatatttttacctaaatttctcctgtagcaagggttcagggactttgttaattttatactttttagcttgtcacccagccctttgtttcctctctctggatgtgcagaaagattttaaaatctatccctgccaaacaattctctttcgtgggaatttggtttaaaccagttctgttgctatggtacctagttttcagttaatggaaaaatacaaaaccaaaataatactgaatttgcagtatatatgtccccactcattgcatatcgacttattcatgttgattggattcgtaaacgatcaaaagttgctcagtgctataaaaaaagtatctaacctacttagaattcacatactgacacttatacctttcaagtgttgtgtgtatctgtgtgcatataaatggtagaagagatggcatggagcagtaagagtttttggaggtgaagaaacctgacattgaatttcagcttagccagctaaaagctaattgactttggacaatcacttattgctctggaccttttttccaatctacagagtgggtattcgtaatataactacttttcaggaatgttattaaaattaaagcaatatgttttaattgcctagaacaatgcctggtacttagcaggtttgcagaagcctactagtgttttcaaatgtggagatgatgtgtgtgtgtgtgtgtgtgtgtgtgtatgtgtgtgtgtttgtgtgcatttgtgtgatagggtgaattgtaaccccttaagactcaaatattgaagccctacccccaatacctcagaatgtgactgtatttggagagattgcttttaaagaggtaattacgttaaaaatgaggtccttaggttaggctctaattcagtctgactgtcatccttataagaagatgaaattaggatacttggaggaagcaccaggaggaggcatgcacccaggagagaccatataaagacacaacagaaaggggaccatctgcaagtcaaggagagaggccttagaggaaaccaaacttgctggcaccttgatattggactcctagcctccagaactatgagaaatttccattgcttaagccactcagtctgttgtactttgttactgcagccctggaaaactaatcctatctatctatctatctatctatctatctatctatctatctatctatctatctatctatctattggacaacaaatgttcgtaaaatagaagtgaaaataacatgctagttttcctgagtctttttctcttcatttactgcctccagtgtatagtttgttattatttactttttactaataccttacatggtataaagaaacacaagtcttaaatgtatatcccaatgaatttttgcatatgtgcacatccatgcatccactacccaaatcaagacttagagcattccttgttccctagcagcctctctcatgctcctccaggtaaagagccattcctcttccccacagtaaatacttgtgacttcttgtgttttatatattttgaacttcatataaatgagtcatacatcactcttttgattctggcttctttcacatagcgtcatgtatgtgaaatccattcattttgctctgcgttaaatgttcactttattcattgctgagagcagtattccattgtatgtacatcctccaatttatttattcattttggtgtcgagcatttttgtagtttccattatttataattatgaataaagttgctatgaacattcttgtaactatttttggtggacaaaaccactcttttctcttgggtaagaagtacatgggaattctataaaatgtttctatcttaatgttacttacaggataaagtctatttttctcccttctgagtattgctttttaatctccctactagaaattctcagtgcttcttaacccggggcaggcatttttgctccccaggggatatttggcaatgtctggagacacttttggttgtgacatcttcggggaggatgctactggtagtgggtaaaggccaggattgcagcaatatcctccaatgtgcaggacagccaccaccaacaaagtcaattatctggccccaaatgtcaatagtgctgctgttgagaaaccctgtatctagaccaatagaatttaattttgtatttttactgagtaggtattcattgcttgaccaacccacatattctttctgatacatcttttttagaacccttaggaagaaagagtaatggcagcagcattttccacccttttctattggggttattaattctcaaaaactatacagcctgactttagtgagttcaaggcatcagagcttgtctttatcaataaatatttccagaaaagggaaatagcatgtgtcctttttaagatggtgatgttgcattctgcgaagaaatatatatataaatatgacataaaaatatacatacatatattgcaaatgccatttctttgcctctatttagaaccagctaagatagccaggcacatggatacttgttctatttcaaaatgtctacagaagattcttgaaattcttcctgtcatttttcccagtctctaaaaactgtgatcaatccattcccctgaccgcatgtcatccattgttttctcaggcaacctcttctcaccttcagagtaactgaaggtatattatattcactttagttatcagaagtacctaaaagaaaaaaatgatcaagttatttccatttccatgagcctgagccttctcctctcccatattcctgccagttcttgcttttgaaaactgagcttaagggcaatattgtaacttgcactttttgctgattttatatcattcatctagctataggtctgacagaggtgattacttagctctccaaataggcaatgatgtgattgccttcatttatttcagtgacattgaaatggaggaatgatatttgttggctttgggctttaaagacatgtggtctgctatatttttggctgacagctggaactagtagtgcctgacactagaaaaccaaaaaagtcagcatttgcccttttcattttgaaaattgaaaatcacaggtaattaatcatattaaatgtgaatgtaacccatttcattgctataaaatcacctcttcaattaaaatttttttataaataattatatttgtgcagcttttagcatactaactttttcgtgagttgttttgtaacttacatattaatatgttttaactctgcttccttaactgcattactcattgttattgatatttgatgtctaaggtccgtgatgcccaaagtcttactatgtttgggagagtcttataaaatgaaggactgtctatattaaaataacaatgagaacctcattgatgataagtgatgtaaaaagagagaataactaatttttcaaaatgattctcaaagaaaaaggtactttctatgattatagaatcatggaaaaatgctggaaaagcttagttctacacttaagctcttgggaaatattttatttaagctgataaccaatattatagagaaatgacaattttggcctattttaaaaatactttcatcttcggtagcattatctaaactctaaatctataatatgtcattggaaagaaaagggttccgtgctttcttaaagacaatttgcattttagtaaagagcactatatcaatcagttcactaaataaggttccaaatatgaagaaaagcaagcataacgtgaagccataacagtcattgtttttaattgtgatcaataatctgtgtcgagaacaagtttttgttaattctagaaaaaagatatgacagacaagttgtccttaaacataagagaaacaagatcgatttcatattcactgtcactgtgggtgacattcttctgaataagatttcaaaataaatgctgcaaaatttcaggataaaaaatagaacattagcattaatcatattcatgctcacttctctattttctccacctttgccttctacagtcttcagctatacaggtgatacgcttgttccatttcaagtcaaatgacaccattagttaattagtgttgcaagtctggcaaatgagatctgaaacgaaacacctgtcctttgaccctaacttgttccttgcttatgcaaatgaagagagcagtttaagcattttaaatgttttatttctcgtattatgctgcaggttttatgctgacaaggaacacttaatgtgtgtgaaactagttctgatcatctggtttcagctttttatttattgaatggattttcagtgctgtcattttctttttacctgaagatcacataaaggttgcacaggtttacgtttgcgcataaggaccagtttggttttaagtttagctgtttgagtaacttcatgaaataaattagaaatatatctgttaaatttacccatatgttaaaatagcttttcggtttatgcattatgactattgcaatatgccacactaatatatgaacatttctataactaatatatgtttttaaaatagaaaattaaacgtgaaaggttttttatgaaatatatttatcagcatgaatctttactcactgagcaccatttaataagcatactgattgtaatgattgcattttctccactaaagttctcaataacaacccttggatataaaaataaattcactttcgttattttaaagcaagtcaacaaaataaaattattttggataaattgtataactgaattttcataatgatttatctcagtaagaatagaaaatattattactgtgcagataaggtggcaatggaaatccaatgagaaataaaggctatgaacattgaatgcaatattgttatctgtttgccttgattcatcaaggggtttccaaaatgtttttacaaagttcttattttcaataaatcacatcataaataaaacctcattaacatgaatagagggttattgccttgaaaactgtctattggaattcttggcgggaaagtgagactagtagttatttatttatgtataggtttttctttgcatatacagtagtctctcctggtccctggtttctctttctgtggtttcagttacctgaagtcaactataatctgaaatattaagtggaaaattacagaaatgatttctaaaatgtaaattgcacatcattgtgagtagcatgataaaatcttgcattgtcctgcttgtcctacccgggacataaatcatctctctgtctagtcaccatattcaagctgtacatgctacccactctttcatcatttagtagccttcatggtatcacagtgcttttgttcaaatgaccctttttttacttcataatggcctcaaagcacaagtacagtgatgccggcatactgttgtaattgatctattttattattagttatcgttgttaatatcttactgtgcctgatttataaatttgattttatcatatgtacatatgtataggaaaaacatagtatatataggcttcaatactgtctgcagtttcaggcattgactgggggtcttggaacatatatcctgtgaatagggagggactactgtgttttatggaaaaatggaaattatttttattagaaaagttttaacaaaaggagagcagagcaaatatttcctgtaacagtgggaaacttgttttgttatgcatatggctttctaggtagaaagaatgcttttggggaattttaaataagttgggatgaaaacttgacttctttaactctaaaagatgctttgaagttttagtttttagtttttgtaatgccaatcgtgtaagataaacaactttgaaaccccatatttcagcttatcaaaaatatttaaaatgttcaatcccaccatttaagaattattatatacagaagtatgcattatacagtaattcctactgggaagcttagagcctttagatatttccctctcttaaagagtgggagaaattccaagttataattttttagtattacatatttcagtgtcaaaaaattctcatgaacaactaaatgtacagaattctctttgatataccaagatatgattttacaacttcttttaatgtaatacattttagtgtctaaaaagcatcactaatttaattttagaaattcttttcttttcttttcttttcttttttttgagatggattctcactctgtcgcccaggctggagtgcagtggcgggatctcggctcactgcaagctccgcctcccgggttcacgccattctcctgcctcagcctcccgagtagctgggactacaggcgcccgccaccacgcccggctaattcttttttgtatttttagtagagacggggtttcaccgtggtcttgatctgacctcgtgatccgcccgcctcggcctcccaaagtgctaggattgcaggcgtgagccactgcgcccggcctaattttagaaattctactcaatccaagtaaagtatatgtattccagacctctgccctattaaaaatggagaatcatattcccaattaaaaaaattataagcacaaaggtttctttaaaaatccttaacttttttttttctgttgacttcttcacttaactaaataaataccaattaaaagtttgctctcatggcattgtacagttgatggaagtgggtcaaatgagtgggagctattttactggtccagggaaaagatgatgatcacttaaatttagatggtgcaaaaggaaaacaagaaaagtgcacagattttgtttgtgggtgattgtttttactgtggtaaataatcgcataacataaaatgtaccatttttgccatttccaagtttacagttcagtggtataaagaatattcacatggttgtacaaccattactaccgtcatatcttcaaaactgaaactctgcacccattcaacgtcttcccacttccactccttctagccccaggcaacaaccattctattttctgtctctatgaatttgatttctgtcggtacctcatacaagtggaattatacactatttgtctttttgggtactggcatattttacttatcataatgtcttcaaggcccatgcatgttgtagcatgtatcagatttgcttctttttgaagctgaacaatattccattgcgtatatatacaacattttgttcacccattcatccataaatgagcccttgggttgtttccatgtcttggctattgtgaatagtgctactaggaccgtgggagtagtggacagagttgaaatatattttgttacgtgctgatgaattgaatatgaagactaataaattgtcagaaatacctatccaaaagtatagaatatgatttaaaatttttttcttctgaatatcatatgatcttttaggatactaactattacataatggaagctcaataaatataattttataaattagtccatgaaaggcatctttaaaaactgctttaaatgtctgttaatccgttagggtatcaattttattggccttatttctgcagtttcaaatttgctttatttaattttctcattaaaattgtttatatttaaggtatatagcatgatgttttgatattcatgtacgtaatgaactgattactacaatcaagctcattaatatattcatctctttaaaagatgctttcttggggttcaaaaaccggtaccccacaatatggcactttgacatgttggactaaagaaacattctcaaggtctctctttcaccccaccccacccctcccagcatctctcaaccttctgtctctctcaaagcacaggatgaaggttttctctgaagttcccttatcagcctgaagcctggacccaccaaagaagaaaacagttacctctggtcccttccctgagtttcattaacttaacacatattgcaggaagaaagacaagtctgtcagcacacctggacagactttcaaaaaactatcgtcttctatttcattcccattcaggatttcaaagagaatcatttaccagctattgtctgctctgcaggcccaataggctttgttccaggccattgtatgttttccaggttcactcattttcccttaaaaatatttactatccctcaaattgccacatttcctccacctcccctccccttatgaagaagaatatataaacatttttaccccactgtgttgttgggtcattctcctgtgattcccctttgccatgcacattaaaatacattttatatgccatttctcctattaatatgccttttgtcagttaattttcagcaaaccttcacaggtgaagggtcaatattacccttggcccctacagttttaacttatttttcaggagacgcacatttgtttttttgtgcatgggtacgtaggtttctgtgatgattttactaactaaatgggacaactatatcgttacataccatggtttcactcattcttttaaaattatttttactactctagttaaatataaataccataaaatttgttattttaaccattttaaaatgtatacttcggtggcattagatacattcacattgttgtgcaacagtttcactcgttttaccaaattgaatgttttgtctactggccaggatttattgattgttgtaatgaaaatcttttcactcatagtttagcaatccttttgtaaatgccctaaatctgtatttattgtataattaaataccttagcaaatacttttaaactgaaaatcccggtgtactaagttcattcatgtttttcactctcctttttttttttttttttttttttttgcatttcagtttggcaagtttctattgattaagtgtcaatagacttttcttggttgtgtcaagcctactgatgagctcatcaaaggcattctttatttctgtcataatgtatttgatctctagcatttccttttgagtctttcttagagcctctatctccttttaattactcatttgttcttgaatcttgcctactttttcctatagccatcaacacattaatcacacttattttaaattctctagtaattccaacatcaatgtcatacctgagtctgattctgatgctcgctttgtcttttcagacaatgttttatctttcttttttgtgtgccttgcactttttgttgaaagccagacattttgtcttgggtcataggagctgaataggcctttagtgttaggatttatgttaatatggctaggagttgggctgtatttaatgatttctgtagctgttaggtgcccatggcttccgtttcctctagtgtgtttgtttttagcttcccagttttcttttgtcttccctaagaagtttttctcagatagagtctgtaacttttggttctttcagctgtaatccactgtcattatactggggccccgttagtttggttgtagagtgttgaggagaggaagcattctatcatcataaattaaatcacagtcttttagtgggcctgtgtccctggactgtgaaacacactcataaacgtttcttagctttttgcttcccctcttaggtgagacaggaaaaccagagggagctggagttgggaaaatattcttctttcagatgggataaggctctgataaagctttttcctcctggaaaataggactgtattatggagaacactcatactctgggcatagttcacaatgttttctcatcctgtccccctgccagaaccaccagaggatcaatcttggctcttcactgtgagaacaggaggggtggggttcttagaggtaaagtacagataactgtagaggccaccaggaaatttctgactctcatactaatccacattcagtttccagcaattcataaaaattacggtttaaggattcttacaagtttatggatccagtggccttttttttttttttattcgagggaaactaattgctgctttgactctgtatttgcctgtatctctgcatttcagtgtggaagtttgctttgtgacctcaattttctgatggatccaagaaaagtcaatgatttttagtttctttggctttttcttgtaagcatgacttcctagctctttacatgttggagctcttgggtggccttttaaactactaactagtagaatggaatgcagtaaaaccaacaaaaacgatggaacaacagagcctggaccattaatcgcgccatccaatctagagtagaaaagacaatgtaagtaaggcaagtgaccttttaggtcctaaaagcaactttatcaccagcccctgtaaacttttaggaaaaaaagattcaaaattataataaataatattcatacatatttgagtgagatcaatgatctggcttcttaaattcttcatggaatatcaattttgacatttctttggctcatttccacagtggctgaatctgttctcagtcagaaaggaaactcgtattttcttttttcaaactttgtaattttccaactttctaatgaaacattgtaggccttcattagaaagattacctcagactaacttactgctagccatgtccttcaacagtgcacctaagataatttattgaagtatcttctctcagatggcaaatgtttcttcattcactctcttagcattttaagttccacagtaggagctatgtaagtctcctaaagcccacaatttttagccctaaagagcattaatgtccctctaatatacagttgatccataatggtgtgccttaagctttcttcaaaaattgcctcaaaaaaaaaatcagtgatgtgaatctgcacttactgtaatactgtggtaactgggagtgggccatgtgtatactcatgtacataaacacactacacattcctagtttaactatttgctaaccctgtccattgattttcacagtatatttttttctcctctcaatagtttttaaggcttcctaaaatacaaattgaaataaccttttgctgcagatattatggaatccaggcaggcctgcaagtctgtgcagagtttactctctggcaataagactgagaatcccctttaacaggccctgccagaccacctgttatatttgaataattcacaaacagcttttcccattaattcatgccaggcctctaaatataatccaaaataagtcatgttataaggcatttggattagaaataaagtcattataaccatatgcctgcatttataaatgtacttttagacaacatagtaccattctaaattttcaccacaggatctgtttgacctacagagatatttgggtatctctaacttaaggaaaaaggccgtgaggcaaccattttaaaatacttacagacagtgagtttgaagaactttgaacttgtagtctcctgatgcctcactgatacatccatttcaaggcagacaattgccttccttaagcccaaagttagaaaaaatgaacaggacagtttttcaggttttgtctcaattcctgttcatgcacagtgcaatttttgccacactatcctcatctcttgaagagatggctagccatttcttctgtgatgtctcaaatgtgcttcaaagttcattgtagcccttataacactgaaacctacctgtgtgcacatctgtctctttcagttctttaaatggtatgagaacatgttaagattagctctataatgagtcatttctgcatccctcagatccctggtattgaacttgacacgtaatttgtatttggtgtggttattcagtgagtaattgacaaattcaatgatccatattatgcatgtcacattttagcttcccttaaagaaaagtttttaggaaaggaaaagaacactggggaggggggaaacaaaattaacttggccatgctgagaattgcaggaatgtgcactatgcaaacaagttaagtaagcacagtgtcttccttacttccatcagagaccttgcttggctaaaaagcaagagtggagcccactctctgtattcatttgcataatttgttcacactctgccttagccacagaagtggaaagcctttcctttcctggtagtccctaggacatgtcatctacctccctcgtgagttgtaatatggggaggactggaaggcacagcttagagccccatggtgtccagtcaggggaacatggggataatgtgtccattcactgacactagcgcttttctccaatatggttaacagtcgaaatttgattaaagcaagttaggaaactccagtaaggctaattttctcttgaactatatatggtgtctgttggcaagaaaacaagagttacacatttaagtaggttaatatcaactgagaaactcttaagaatcatagtttaagatcaggccaggcgtagtggctcacgcctgtaatcccagtactttgggatgttgaggaggatggattgctcgaggtcaggagttgagaccagcctaaccaacatagtgaaaccctgtctctactaaaaatacaaaaattagctgggtgtggtgttgggcacctgtaataccaattacatgggaggctgaggcaggaaaatcacttgaacccaggaggcggaggctgcagtgagctgagatcgtgccactgcactccagcctgggcaacaaagcaagactctgcctcaaaaaaaaaaaaaaaagaaaatcatagtttaagatcaaagttgaatgtatattgtgatgagtctacagtgtgggaacaactttttgaaaagtgtaataggtttgagaaaaatggcttaatttaaaatatgtattttctattatatgtgcatgatttttatgaagatatattctcagaattctttaaattagtggttctcaattcagtctatgtatcagaattgcttgtgaagctttcaattaatacatatggatacctaaacctaacccttgattctgattcatttagtctggagaaaggttggacattttttagcaactttgtttttgatttaggattgaatatcactgccccaggattatgaagaaattcatcatcatcctaaaaatattatagtacttcagccctttattatagtcatttttccataagtggcaaataataagaatccaaagaaacatgttgtgtatgcgtggggccatctcgatacagctgatgacaattaagttgttggctgtctggttttaaagatatttggaaagacaattccttttataagaaaaccaaacaaattccagccaatgaatggtcttaggcggtcaagaattttattctggcttactgacatcctcaagatctcaagacacagattagactatgagaagacacagtaaaatactccatctttattcttagagattctattctgaatcccacttttttcagttttattgagatgtagtgacaaaaaattgtatgtatttaaagtgtacaacacgatgtttcgatgtaagcatacattgtgaagtgattgccataatcaagccaattaacatattgatcatcttacatagtagccatattttgtgtgtgtgtggtgagaacacttaagatctattttcttagcaaatttcaggtgcacaatacagtattattaactatagttactagctgtacattaaattgagataacttattcatactgcatcactgaaactttgtacactttgatcaacatctccccattttccctactctcagccactggtaacctccattctactttctgctcttaggagttttaatttttagattccagatataagtgagattatgcagtgtttgtttttctatgtttggcttattttacttagcataatgtcttccaggttaatctgtgttgtcacaaatggcatgatatccttttttttaaaaaaaaatgctaaataatattttattgtgtgtgtgcatgtgtgtgtatatatatcattttctttacgcatttatctgtgaatgacacttctattgtttatgtatatttgctgttgtgaataatactgtaatgaacatgggagtgcagatatctctcccaatcactgatctcatttcctttggatatacacccagaagtaagatgctgaatcatatgataattctattttttcattttttgaggaacctccattatgttttttgtaatagttgtacaaattttcattcccaccatcagtgcacagaggtctctattctccacatccttgccaatacttcttctcttttcacatttgataatagccattgtaacagttgtgcagtgatatctcattgtggttttatttgcatttctctgatgattagtgatattgagcaccttttcatctacctgttgatcacttgtatgtcttcttttgagaaacatatattaaattctttagccaattttaagtaggcttatttgttgttgttgtttgctattgagttgtttgagttccatatatatttggatattaaccttttatcagatgcatggtttggaaataaatttttcctgtttcataggtagtctcttcactctgctaattgtttcctttgctatgcagaaacattttagtttcacacaatcccacctgtttatttttgctcatgttgcctatatttttggagttatgtccaaaaagtaattacccagaccaatgtcaaaaagcatttcccttatgttttcttccagtagttttaaagcttcaggtattaagtatttaatcaattttgagttggttgttgtatgtggtgtaagataagggtccaattttatttttttgagtgtggatatacaattttcccagcatcacttgttgaacagactgccctttccccattgtttcttagcatgcttgttgaagatcagttgactataaatatgtggatttattgctgagatctttattgtgtttcattgctctgtatgtctgtttttatgtcagtatcatactgttttgtttactatagccttgtagtgtattttgagatcaggaaatgtgatgcctccaagtttgttcttgctcaaggttattatggctattcaaagtcctttgtagttacatatgaatttggggaaatgctattgcaaatttgataggcattacattaaatctgtatgtggctttaggtagtatggacatttcaacaatattaattcttccaattgatgaacatggaatatctttccacttatttgcgtccctggaatagatccaactcagtcatgttttaatttgctggtaaattcagtttgctagtattctgttgtggaattttgcatctatgttcattaggaattttggcctgtacctttcttttcttgtagtgtatttctctggcttttgtatcagggtaaggctggccttgtgaaatgattttgtaagtattacccgcttttcaagtttttggaaaagttaacattaacaaaaaattggcattaattcttctttaaaagtttggtagaattccgcagtgaagccatttgatcctgggcttttctttattggaaggtttactttattactgattcagtctccttacttgttagtgttctgctcagattctgtatttcttaatgattcagtcttggtaggctatatgcttttaggaatttattcattccttctgttagacagtctactttgtgatttgacaatgtattttcagtagtatgctttgattcctttctcttagattttgtgtatctactaattttttttttcattgtggttaccatgaggtttacataaaacatctaatagttagttatgtctattttaagctgacaacttaattttgactttgtacaaaagctctatacttttatttccacctttcacattttatgtaattgatgtgacaatttatatctttttatatcatatattcattaagaaattattaaggctctagttatttttaaaacttttctcttttaacttttatattggagttacaagtgacttatgcaccactattacagtattattctgaatttggctatgtacttacctttaccagtgagttttatatttttatatgtcttgatgttactaacaagtgtccttttatttatatttgaataagtatttttcgcatttcttgtaaggcaggtgttgtgatgatgaactccctcagcttttgtttatcttacaaagtctatctcctcttcatttctgaagaattgctttgctggcatagtattcttggttgacatttttttcctcttgtactccggatatataatcccattctcttatggcctggaaggtttctgctgagaaatctgctgatagccttataaagaatccctagtatgtgatgaatcatttccccttattactttcaaaattctttgacttttgataatttgattataatgtcttgatgtaatctttgagtttttgtatttgtgtacttttgagcttcatgaatctaaatatctatatctatctcaatatttgggaagttttcaacaattatttctttaaataaactttctgcccctttctatatctttctggaactcccgtagtgaatgtatcggttctcttcatgggaagctctaaattctgtaggccttctgtactattttttatttctatgtttgtttctcctctgactgtgtaatttcaaataatctttcttaagttcttatatattttcttctgctttatcacgtctgctatttatgctgttcattgtattcattatattcttcagctccagaatttctatttggttctttttttatgatttccatattcattgaactttttttgtgaattgtttttctgattttgttcatttgcctatctgtgttagtttgtacctcactgagctttttgtaaagagttactttgaattatttgtcaggcagttcttagatctttatttatttggtgtcagttactaccaaaattgtgagttgtttttgttgtgttatgtttccttgatttttcatgttccttggagttttgcattgctgccctcacatgtgaacaaggagtcacctcctccttcaatccttactaactgacttcaggatacaaagactttcattagtcagcctgacattctaggggtctcgcagacctttactatggatacacctgccccactcctcttgtttcctcttcaagaagaagctttatgtttgaatgtcttctcttgatcctgcaaagccaggctgggtgctgactgcctctcttttgtttttcctagggcattgccctgaagtactcaaagttaattgccttctcccagtcccagagagttaagccagatgtctgtgtgtgcttgtgcatgatttgcagaggctatgggtagggatggacagaagggcatgcagagtgcttggagacacatacgagaaagttaaatgggtccacaagtgttgcatcttttgatgttcatgggcagggttcatggagttcatgatgcaatgagtagaaacaatggccctttgtttagttctttactgaagttgctgtgagctctcaccccttttccctgttcttagctttcccaagactattcaactgagccagtttcttctgtgttatgggtgaagtgagataaaagtaggcctcttgggcaacattctgactagctatgctttcactttcccctgtgaaacaaatcgtgggccaagaatgtctctcttggcactgagctgtgtgctgccttgggaaaggggtgatgcaagtaaaatgaaactgttttccttaccctcttcaaggtaatcgtggatcatttttttctcccatggtgcgttgggacctctcccctggtccctgggctctacctaatatacttttgtctgtgggtagttgtcaaaattggtgttgctatggggataagaactgaaaactcttatcccaccatctttctaatgtcactcttctctgaatggattacattagaaaagaacaaggtgttcaccttctttaatgatgtagttacaaggaatctacctctgggagagacagttatgttttcataaatcctaaggcaaaacattagatatgaattctttttatttttatattttctttttctttttcaattctatctatctatctatctatctatctatctatctatctatctatctaatctatctgtctatctatctatctatctatctaatctatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagtttcctgagagacatagagggtactctggcattgaagagagacactagaaggatggacatttttggaatgtttaacaagtctctcactttacagcatcagcagcagagagtgttaagcttgaaaaaataagaaaaaagtataaaattatgatcttagtgaattaatgacatattgccaagacttaggccatcatttatatattaacattaatgggatgtgaatgtttataataaaagacaaaaagatgagcttaaagaaattagacctattacccaaacataaatatttacttttacatgttgtcagagagtatttgtacctgtcatattgctgttttgcaaattagagagttaaattgactcctttttatagatattctatttccgtcctaaaactctttccatcactaaatctctcactaaactttgtggtgttacataatcctcactttctagttagtggcaatcataaaaacagataaaaaggctttcattattaggagtggcatggatgaagtagttgatactattggcaagatagaacatgacaaagagagcatgaccattatgacttatgcattaagtgaggtgttttgggctctttctggctatgcaccatatggtaaggaaatgatatctctgtcaggatagactagattgtaatgcagtaacaaatgaccctacttaaaaaaaattattgttatttgaatatttgcaaaatttaaggatcatgacatcatgatgaacatctatagaaatacatagctctctacctaagtacaaaatagagatatagagataaagtacaactgattcagatagttaaattattatgctattatttaatgttctcatgtgcagttttatgtattccagataatctttctaaataacttatgtagacatttatattttggtcagtctatttttttatttccaagtaatttaatttttgtcccaattgaattttaagaatagagctaaattaaaactgttactcagagctttttattcacttttatgttaataaagggttccttagagatgatatacctagttttctgtaagtggtttttattttcttggtaatctacaagtcagattttaggcaacacctgttgaaaaaaggttagggcaccatttacatgtttttcaaattgtaaagttctaatgcaggtttctgcagttagaatattcatgacacaaactgtttcaaatacaacttaaattgagattcaggtttaaatgttgatttatgaaagttcttctttaatgaaacttgtttttatgagatctctgaattgcaagaagtaggacttcagctttggaactgaaatagctcttggctatttgttttaatcactttccacacaaacctcacttctgaacggtcatcttatttagagttattatcaacttacttgccttagtgctgacattgttgatggattcgaagaagtgaaattggcaatcctgtatctaatgctagtgtctttggaacaacaaaaggagtttcaaagggaggctgaaattgaacacttaatattataaatcatgatatatgtatttttttgttttgtcttgtcttttactttggagaggggtttctttactgcatggacagttgtattcattaaatatatagaaaggtcatggctttcctaaaactttgggctgttctttaaaaattaatcttattctcatcaggagtttgtcacttctaaactgatctgagttaatttattggaactgtgagtaagagacattacataatttgggcacaaggagagaatctgtgtcctggaacttgctgatggcaccttcaaaggtgacccagttgaccagaaagtgttgatttccactttgtaattttaaaaatatatgacaatcaaagggcatttcatgacccaggagggagtggaagtagcaaataagcatgattattgcaaaagcttactagattgagtagaaggaatatgcactgctgtcaaaaagttgcaatgtaaaatagtcaaaactttttctatggctctgatgatagcaatcaacaaaatgaggaaaatgatgtggcaggattcagaatctgactaaggagtactaacagagaaaattatcatgttcttggctttagagacaaataaatgggccatgtgggcccaatcttttgtaacttaaaaaatgggaaaagctacgggagagttaacgttaccattttatgccttaagtgagatgttttgggctctttctggctacaaggtttggaaccacaattggattaatggtagttggctttaatggtccgtgggaagctaaaggttacaggcaatcatttcatcagcctcctggctggcctcaatggaaataaaattgtcagactgtaactttaaggaggctgagttagcaaatatattaatttcctattgttgttgttataaattattacaaatttagtggcttaaaacaacacaaatatattatgtcacggttctataagtcagaagttcaccatgggtctcactgggctaaatcaaggtatccacaggaggctgcaggaaacacgtttctttgccttttcaggcttctagaaactccgtgcattccttggctcatggcccctttttccatcttccaagtagcagtatagcattaccacaactacttcactgactctgcttctgtggtcatactgccttctctcgtctgtaacctgaccctcatgcatccctcttttcatttactgaaaaagcaatgactgtgacatgactaaataaagaaaatttatcatatttcttaaaataatgtatcaaaataattgtatttatcaaaatgacagcaaattaaaaatttaaaaagaaaacagataacaaatcaatacgcagggtatgaaattactccagatgaaatgaatggacaagtgattagaaaataattatattcatggttgctcaagatataaagagatagcagttactaaaaaaaaaaaacacaaacatttagagtcgctaaaaatctcaaaagaacacaactagtgagtgtgtaaaagaaattctagtcaatatgtataaaacaaaagatcactattcggaatatgcagatacctcttatttattaataatgaacaaatgacctaatagaaaaatggagaaaatatttaagcagataatcaaagcagccaataagcacatgtagtttttcagcttcactgttaatcatgaaaatgtcaattaaatatatatgtactattttctactcaccagattgcgtaaattctaaattgtcagacaattgaaaggttgatgaaaaatggctacaattttgcatattgattaaatctaaaaactaatcacccagaaattaaaacttttggtatttacccttgagaaatactaatacatgtatataaaaagacgtgcacagagatattatttatttttatggttgtttgtggtagggaaaaattaacatcaaaacaaacataaaggccatcaaaatggagtaaataaataaaatgtggtaagacatgtaatgaagaaatactattctgaaattaaatgaaatgcactaaatgtatgtttcaatatgtggggaaattttttgttgttgttttttttttttgagacggagtctcgctctgtcgcccaggctagagtgcagcgtcgcgatttcggctcactgcaagctctgcctcccgggttcacgccattctcctgcctcagcctcccgagtagctgggactacaggcgtccgccaccacacccggctaattttttgtagagacggggtttcaccgtgttagccaggatggtctcgatctcctgacctcgtgatccacccaccttggcctcccaaagtgctgggattacaggtgcgagccaccgcgcccggcccatgtggggaaatttaaaaaagatagtgagtaaatgatatgaaatatttatgtaaactaaagcacagcctttctgtagccagctaggtggtccgcacctataatcccagttatttgggaggctgagaccagaagataacttgagtctaggagtttgaagccaccttgggcaacatagtgaaactccatctcataaaaaaaaaattaaaacacaaaataacactagataatttgattggctacatattcatatgttcagaagtttgaaaactaattgagggataaatagcaaatttctaatagtgtttacaccagtgtagacgaggagtggatcatcaaaggaggtgaggatagaagagagcctggctagatgagtgatatctctaattattttctgtcgaaatatacctgtattcatattttcagtagtttgtgaagtatgcacatggggggaaatgtgtttatgagtaaactaaataaagtataaaaagtggttaattctggaagctagcaatataggttattaatattatttcttttttatgtgttttctaagtttgtaaatattttatcaggataattataccaaaaaaagtagttttaaaaaacagtgcagcagattaacttcagaacatacagagccactgggcaaattcctgagcagaggaatttatatcaaaagcaggatacagaggcaaagagatcttaaaaagacagttaagagatgagtatagcttttgaagctccaacatagatctaactgattattcataagaaattaataaagagaataaaaagaaggaatatttgaattgataatgtcaaataatttttcagaactgaaaaataagagtagagtccactgtttaaaagtatgcattgaatgcccagtatgataagtaaaaataaatccacctatagaaatcaaggttaatgagaacatcttattagataccagaaagaaaagacagactacctacaaaaaaaaaaagacaattagaatgacaccaagcttctcgttagcaaggagagatgccagaaaacaactgaggataaaatatttcaaccttaaattctatgcctacctaaacaattgttaagaagacaaaataaataaattttctgatgttgactaactaagacaacttctgtccataaatttagtggagaggaaggttttttaaagcaccagcaaatgtgaaaccaaaagacaaaaataggattcatgtaacaatgcattttttcttcctcctctcgaaaagaagttaaaacttctatattacagtcaattgaatttccagtaattttccttttgagaacaaataaagtaaggaaaatctttacattttgcctcctgtttcttgataaaatgttaggaaaagtcaaaataagtcgaatatttgatgaaattgatgcagttcatgtcagtatgcagtaattggaagccttggaaccctatgtaggctgacatagaaagcaatgtaaaaatggcacgtgaattttctttcttctttctaaaaagaagagctagatttttagataggaatacaaatgcttcatttgttcataggttatcaagattttctttcatttgaagttttgtttggcagacatcttcctttgaaaatgggagacttgtggaggtttcaaagggacttgtgaggaaaaagttttggacagaaccagaaactggctggattgagagacaacatttttatacaaatgcacattgaaagggaatgaaataacccttaattccaacatgatctgtttcagattactaaaggaaatatattatattgtatggtatataatgagcactcaacaattttatgttgaactagtagcaattatcttgtgctcccgacccactaagcttatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcattagattatttatgtactagataattaattcagtttaatataagaataatgaaatagattaaaagagagccatgcatgggttaatgatattaaaatgtcacaaacgaataattataccaattgtgtacacaggagctttttgagaaaaaagtagcggattttatgttctgttgaaaactgtaaagttctatataaatgttatttcaacagcattgaaatggtgattttctgagaaaattttctgtactagtttaactaaattatacatggagatcaaatgaattctcaagtgggcctatttattttgaatcaggaattatataaaatatggaggacattattaagaaaaatagcatttaagactaggcctaattaatattttcaatgagggtaatttcataggattgaagagagaataggatttttataactgaatatggtataatagagaccaagagttttctggtcattcattaccaagaaaattttaattatgtggaaaaaagcaaaagaacaagaaagtcaagaggatctgaagcagagtatttatccagcccagtgtcacttgattaaaatagagatgttgtagtcctttagaatgtccatagagacaactgaaactgacctttaaaaagtgttgactataggttttgttgttactgagctttgatagccactttaaatcccttctgatgcaatttatgccctcccttctttatcaaaaaggaaaaaaattgtttagtagataatatggaaatatgcctcatttctctacagtctagcaccactgaactagaaaatataaggcatttatattttctagtttggtgatttcgaccattgaagtgttcttcattccacgctttggaatggaaacttgaaaatgatgtaggaatatagtataaacattctgactagagtatgattgaaaaaaatgtaactagagtggttttctcttttctgtagactgttctttcagtgcacctcttaatatgattatggctccaatctcagagagcctgagaaacttgcccaagtccacatggctagaacataacatgattcattcagggtatattaacaataaggtttattttcgggttaagaataagaaaatgccttatattttttgagtgttcgtttaaagtccacagtcaaaaaatattatatgacttcatcaaggcctaactctcttcactttatcacattgcttcaacaatagactgttaaggcagtggaataatctgggatgattaattttcttgtaatcattgaggaccatgaataaaattgcaaaaaaaaaaaacaactgccattttttccatttatatttttaattagaaagcaggcatttaatgagaaaaattcacgtttgccttgcaactacttatggtcgcgttaaaatgtctatcaatgtaggataaatggaaacatgttaagatttgattattaagctttgcttaattaatatatttccaggaaaatatcagactactgatttgggctacaaataacactgcctggttttttgtagccaggtagtgttatttgcagctgaaatcagtaagtttgtaatttagaacctgttagcctaataaatcatcatgtgttactatgaatatgtgaaggcatttaactaaagtctaagtatgatccatcatatggaaatacgtgaaggcatttccagtctttagtaaggacatggcaatgtcactatcatatagaacagtggaatggctattatttgcctcatcagacggatgcattcttaataaaagataaattagattgaacccataagcggatgtcaggaactgtgagatttacattttagaaacatttcctagaaatatcatgggaaaacttatcaaatggatttttattatcaaaaatagctgagaattgttcgtacatctacatatgctcatgttccttaattctaaatttgcttcagaaacaagtcagtaatttaaatgacaaataaaacattggaaaaatattttcaatgcatataagctaatttttattttaataccaatagacattacatgctttcttagaaaaagaactgaatgtgaaaacgaaacagtttaatctctgctctgatatcacgcatttcactggtgagtctactatttttttctcatacattactacttaaaagtatgggagtttgataaattcaacaaaataccttttattgtagccttaggtggcttcctttgttttctcagttaagaagaggacattaatgagtatgaaaacatctaagattgttgctttatttactaaatgctgggctgattaaatagtaagtctgccaaagatcacagccttgaacaaaaggcatagatgcatatcacagagtaccaggaggggattccattcctattccatttgagtctcccctgacaaatgatactgagcactacgttacattgattcacttgcccacaaaaggttgtgataagagtgtctaatctttatgcttgaattgccttattgtacttgtagaaatgaaagcagaagaaaatatatggaaaacagattgtgtatcttatttgtcttctgtccaaaggatacatttaaaataatttgtctagccaggcgcggtggctcacgcctgtaatcccagcactctgggaggccgaggcgggtggatcacgaggtcagcagatcgagaccatcctggctaatacagtgaaaccccgtctctaccaaaaaatacaaaaaattagccagacgtggtggcgggcgcctatagtcccagctactcaggaggctgaggcaggagaatggcgtgaacccaggaggtggagcttgcagtgagccgagatcgcgccactgcattccagcctgggtgacagagtgaagactccgtctcaaaataataataataataataatttgtctaaacagagttctttcttcagtgtgctcttcacattttaatgctgatttgaagcctgtaaccattaaaattaaaatggaaagattatactttaagagtagaatcctcaaatgcatatagaagtataaacctaatgccctttagcaaagtctaggaggcatcaagataagattagttcctagtagttactctttgttaattaactccctgaagaaacctgagaacatttgatattaaagaaaatatagtagttcattttcagatagattgaagttttccttgctcttctaatagatgtcttcctaatatagtttccataatctctaaatatcataccctgcttttattctcttgtatatttcccctcccatatataaagtatataatgtactgagaaacatagaaataattgcaatatacaatattcctagttacatttcagtaattgttttgtggcatacagttacatattctttctgggagagtgtgatgaaggatatagatgaaagattggtcatttcagtgccaaatcatcttagactttatgtcccttcctccctacaatgtcaccatcctctgtaacgcttttctcagaattgagactccctgaaggtcttagagtttaacgatgccctttttgtccattagtttatttaataaatgattattgagcaactatatggcaagtactgttcttgattgtaaaatctggcaaggacctttaaggtcctcccagggtcttttatcttataagttgtcaaaaaggcttagtagtaattattttatttgagttcacataaggatattacaaggttaagacttttatcgtgacaaaagtttttgtgttttatttttcgtgtctctagttatttttgtttcatttttattctcaaaccagttttgaatcaagggattttatttttgtccagcatttcactttaagacagttagagtttcttacaattcctgtgctcatgaatgaaaattaaagcatataatcattcaactaaagcgtattgcttgtcatcttaaaacctattttaggatgtgaagtattatttattgaaattttaagttagcagtgtttgacgtagtttgtatcagatactctccaaagtcattttctgattaatggagaccatttaaatatataaataactgatacagaatgaatagcactggctattacaatttctttgtctttaaattcacaggagaatggtgttgcctaagaattgttggcattttttaatgaaaatttgtttatacatttacataataaaattaaaaccctttttcaaaggcacttgacatttagaggcattgtttaaaaatattttccagcatcttctagattttacaccaagtgaatgttctgtttaaaaatggttctatggtcaaacaagtttatggaatgatgcctgcttattctccctgtagaaattcataatgcccatttctgtatcagaaaaatcttagagaatcttgcttatctttatgtttccctttagaaaatgaaaactatttcaaacattttattagtatgtagaaaatactatgacagcagaagtattttatcagtctttaaatttttcccaaatagcaatacattccagttgcatgcaaatgtaaataccttctctcaattgcctgaaattaatacattaaaataacagaaaaatagtgttatcttagtctgtttgggctgctataacaaaatactttagacttgtaatttacaaacaataggaatttatttctcacagttctagatgctgggaagtccaagatcaaggcaccagcaatatcagtgtctggtgagagctctctgcttcatagatggtggcttgttgctgtgtcctcacatcatggaaggacaaacaaactctctcaggcttcctttataagggcattaatcccattcaggagggttccaccctcatgatatagtcacttcacaaaggccccacctattaatacatttgggattgcatttcaacatataaatcattgagggacacaacattcagaccataacaagaataagcttggatttggaaagaatttgaaaaggaaagtaggaatacaattgactttcccaagttcataggtagtaacaaagaatgagcaataatcaagatgcctttgttcttatctttccccaactcaaataagttatatataaaaattcatttcttactaggtccattatacttgtctatctcttgaaaacttgagtgtcctaatgaaatgagacttctattttgtaagatgagagaaaggtgaggcaaatattctgaggcaccttctagactgcagagcaacatgcactgagttttttgaaagatttaccagttttaaaaaataaatgctgtcttgttcttcatcatcctcccatcactggcatatcttggtaaaagtgagatgttatcagtgagagccctttaggtagatcctcgtaaaagttaccattttgagaattgtatttatgattgttggtgtgttaacaaaatcatgttgcaagagaaatggacttttggctaactgcctagctctattatcctagaaactagttaaatggtatatgtcaactattttatgataaaaatgtcccccgtggatggatgagatgtatctaggttggaagaaccataaatacttgagaagaagtcacagctttgggtgttcctaggtgcagggactcttgatatggggcatatcccttgaaggtctttggaagctgtattagtccattctcacattgctataaagaactacctgagactgggtaatttataaagaaaagagatttaattgtctcatggttccacagactgtacaggaaacatggctggggaggcctcaggaaacttataatcatggtagaaggcgaaggggaaagcaaacatgtcctatgtggctggagcaggaggaagagagcaaagagcgaggtgctacacaaccagatctcctgagaacttactcactatcatgagaacagcaaggggaaaatctgcctccatgatcatgtctaaattgcatgtcagattgtaattcccaggcccttcctccaatactgggaattacaatttgacatgcaatttagacagtgacacaaatccaaaccataactttccgtccctggcccctcccaaatctcatgtccttctcacatggcaaaatacaagtatcccttctcaacagtcccccaagtcttaacttattccagcattaactcaaaagtccgcagtctgaagtctcatgtgagacaaggcgagtcccttctacctatgagcctgtaaaataaaaaacaagttagttaattccaagatacaatatgtcttggctattagcattcggctcctctttacttatgcaaatctctgcagccagcttgagtactccccagaaaacaggtttttcttttctaccacatgatcaggctgcaacttctccaaacttttaccctctgctacccttttaaatataagttccagtttcagatcatccctttgctcatgcatatgctgttagaagcagccaggcaacatcttgaatgctttgctgcttagaaatttcttccaccagatactctaaatcgtctctctcaagttcaaagttccacagatccctagagcaggggcacagtgctgacagtctctttgctgaagcataacaagagtgacctttgctccagttcccaataagttcctcatcttcatctgagaccacctcagcctgggtttcattgtccatatcactatcagcattttggtcacaacaatttaacaagtctctagaaagttccaatctttccctcagcttcccatcttcttctgagccctccaactgttccaccctctgtccattaaccagtcccgaagctgcttccaccttttcaggtatctttatagcaatgtcccatttcccagtaccacttttctgtattaatcagggttctccagagggacagaactaataggatatgtgtatatatcagaggaagtttattagggagaactggctcacatgaacccaagtcaaagtccccaaaagtctccaagctgggaaaacaaggaaatagtagtggctcagtccgagtccaaaaacctcaaaagcggggaagccagcagtgcagccttcagtctgtggctgaagggctgacagcccccagcaaatcactggtgtatgtccaagagcccaaaggccaaagaacctggagtctgatgtccaagggcagaagactccacaagccagcttatcccaccttcttctgcctgctttgttctagctgcactggcagccagttggatggtgcccacccacattgagggtggatctttctctcctattccactgactaaaatgtcaatctcctctggcaacaccctcacagacacactcagaaacaataccagctagctaggcattctgcaatccaatcaagttgccacctaatattaaccactacagaagctgtcagtggtgttgtcctgaatgacgttggcctgtacctgttagggtgatagctcttctaaatcagaacaatttccccatctcaataatgtggatctgtttccttgaacctaaactgtgtctctgagggtatagcttccagagggctgtgtgagctgtcatacacatgaaatgcagcaaggactcttatggagaggacctctatcacctgacgtagtttctgagaagactcatggcaacagcgcctatcatagttttgagtgtctgaatgtttaattaaatctacagtgaccccttggagggtgattgaatgatatttctctactctccaaatatgcaacttcgttcttaccctctgcatcatcatttataaaatagaaagactagagctggttttctccaggtgtggatctctgataatcctcagcagagtcacttgggatacagattctcaggtctcaaccaagagaaattaaatcaggatctttgaggttagggtcctgtaatcttcttttttaacaccttctcctccccatggtacttgaatacacagctggacaagatgctcattagtttattttctattttagcccttgaccttataattctaatgatttgttcctcccattctacataatgtcttaatgcaattcaaatctcatttcttcagaagaccatcaaggaataaataactgggagtttcagaaatggcaacagtttagggaaaatctctgtagttaagtcaggtttgagaaacccctggaacaatttgttgtaattgtatacttttttaaagatccttttggtcccctgtaatccttatgattattaaaacatacaggtccttagcaccatataacgattctgtttaaactgttggcttttcttttttttcaacatgctatcaccattgtcactgttgccttgactgtagggtagtgacttgctagaaggtcagagattatattaggtcttaccaaacaagtgaaaatcaatattttcactctctttaggagaatgagtttcatatatactcgagatgaaagaaaaattccctttgttgttctgctgaagttgtcaagccttccattagtctaggttaagtttctggggttatgaatttaattttggtttctaatattgatttatatttcataaagactttgttggttacaaaaaaaaaatcctcagtaaatttttctacttcaagggcagtgctttagtttagaaaaagatgtgtttctcagtgatttagtttccatttctggacttaacaataatgagtgaaacaggaaattttgctgtgaattatgaaaggttattatacagtatttccaagccactcaaaattatgcattcatcttaggctcttaaatttaacaaaactgaatgagattcaatactattttctctgttttatcaaaatgttattgaaagttgtttaagattttatactcctcgagggcacatatcttttgtcatctttgcattttcagtagtgtttttatactgcagataatttatgcacattttataaatgagtgaacaaatagatgttatgaaaaaaaagtactgttatcagattccaggataaagtaaaaagcaatatttagcaatcctccatatactacaatgccctacccaagcctgttaattccactcctcatcctcatcctgccacaaacattttcagaagtcctcagacatctctgctatattccctaacttgccccaaactcccgtgatccaaaagtaggcttccctttctcaattaaacttccctttcgctcagtaccccaatctgagcttgctatcctgcggagagttacctgggaaatgaagagatgcagctgtatgatatatatgaacaagtttacccttactggggagatttgtattttaaaagatggtgatggaaaactacagtgatatatacatgctaacttttcccaatgttcaaatttcaggtagtgggacatatggcaaaggtatttttcaatagcaacctaaagacctctcagggaggtgacctccttttctgcctccaagtattgctggttctgctataacctgatatgattttttatttatagagtgctttttataagttgccttcttcaggaaacataaaagagtgggaggggaaatgaataatctctcatgcttttgtatcagttattatcaactttggctgtacattagaatcacctggggagctttaaaaaaatccttgtgtccaggccatcctccaagccaattaaatcagaatctccagggatggagcccaggtatcagtatatataaagttcccaggtaattagattgtgaggcccactaatctaaatgaggatgaggaatgcagtagatctctgatgcttacagaagacaatagttataagaaaaagccatgtgagaaaaattggaaatggttgaccctttgggaactggagagcaaagacagtggctactgagctccaaccaagtgttgcaccatgggagggaaggagcaagatgattaagaggatcagccctagtggcagatcccctgaggttaaagtacttttctgcccttcactatgtgagtttgaatgagtgtcttctttgtacttgttttcttattagcaaagtgaggatgatgattatacctatctcttaaggttgttgtgaggattaaatgaaatcataagcataaatcacttagcattatgttgggcacgtaacaaacatattctacacttttgaactattttgttatgatgatcaactttgaaatactagagttcacttgtcttcttttcagtaggaagttggcttccaatctagggagagagaaggaagagaagcaagagctagggagatgataatcaaatggttctgagaatgatcttaaatttttaagatttttaaatttttaaaaaggctttctatccccttgttcccaccctcagccctcaagaatttcttactgtctttatttcctgccatttcttgttcttttataatcttgtacctctagtttcactatacatcaaaaagatgggaagtgatatgctaacataaatgggtgaatttgtagatgtatcagttgagattttgctgtgtagtaaactacctcagaacaaacaataattattttgtagcttaaaacaactattttgtttgtgcctcattaatgaatgggcaatttgggctgtgttctgctgggtggttgtttttatggccttactcatgtatcagtgtcagctgttggtcatcagggacactctttatttcaggatggactggctgaggctgggatgaaggggttgactgagccatgtgtccctcattatataactagttaaccttggcttatttacatgatggaaacagtttccaggagtggaagattggaagcttttaagatcaaggctgataaccagcactgcatacttctcccaatttcttttgggcataaaaaatcataaggctagcgcatatccaagggaaaagtaagatgagagttgcttcaaagcgttatggccattttttggtaatctttgacaataacctgttgaaataaagcaaatgggaggaaatgaggtcacagtgaggctgatagcattggacatataaaagtcatattatagataggctttggcagatgactgggtatgtgtggtgagagatagaaaaaaattagtggaagttgcagacttagtaattatgagaattgaactttgattaactaaaataggaaagccagaaggtgacaaagtagcacggaggcttacctatatattctcttacagaaaactttgtactgtattccttttctaaaattgcttttgttttttaataaccattttttcccaagggcaagatgtgttttaaaattcattagttaaggactcaaatgaccaattcgatttttctacttcttagttgactccttcatgaacttttggaataataataaaatgtataaatagtgtatgtactttatgctttaaatgaatattcctctaatatcaactccaaagcaggttattcaaagtatgaaaaccaacatatctaactctgtgctcagaccaagatttgtgtagcatctctagagaatctgagagaaatctatgagaataaaagacagtggcactgagacattatctttacatatgtgcttattgaatctgtatagaattcttctataaaaattatagacttttttgttacagatttgctctcatgaatttaattttatattgccttactcttatattgtcactttatataggccactagactgtgaaataaaatcagataaaggtagatgttttccaccactaccccttctccccaatttagtattcacaattattttgctatagcaagatggtctctcctttttactggtattttccctcagaaagtcttttttttttttttcactttgacgtgcattacgttaggtactttaaaaatagcatattttcctaaattaatagtctttaatattcatttataaatacccagcaccacttaacctagtgctttaaaaattgattattatttattattgccattacttaaaatgtgcttttaaataattaaatgactttttaatattcccctctctctctcactaacttgaatacattttaccagccttgatttgtggagatgtctccacatggatagctagctctactggacaggatagcttgtgttactagctcaggcataaataattatttacttttgttctcttacagtattttcctgatctgttactttgctacttccatattattgctgcataataaactatctaagtactcagtggtttccaataacaatccttaattctcactccgttatccgtggatcttctgggggttggctatctgtaaggggcttagctgagttagactctaagatgtaggttgagtctcggtctgtgtcatataactcattctctttaaacccatcataggtttgaacatggtatggtctaggaagatgactctgacagcactttttctctttgccaatttgaacgcagatgactagacatctcaatgtataagatgtgaaacaggaaacaacatgcaaatatacctttattgacttataacagatgacagcaattccattttcctctactattgcattttctactctatttgtgaatgtgagctttcctcatcaatttatagaatctctgtatgactcattctgtcttaatctaaaactgaaataactttatattgtggaaataaaatatcttacatctcaatgtagtctaaaataggttaaatgagatggttcttcctgagcaagcacagcaggtctgcaatacatcttctttctccacatacattatgtcaagtattcctttagcatttatataagttgtatatgtcacacagatatggatctataaatgcaaacagagcacagatgctggcacgatacacacttaaaattgttttatagcttttggattttatttgtgtcgacttaaaagcaaatttataaatattttttatttaagtaaaagatgtgagctgctattaacactgaaagtgattttagagatcatatattctacctcccacattcgtcacattagggagtacaattcagatgtgtcaagtggcttatcagaggttggactgtgagttagtagaagacctggaaatgaactccagctctcctgactacccagttggctttttccatcctattgccatatctcctaggcctctgccaggacagagtgccacagaactgtcagatggggaaatgagacacaattgtttcctggattctattattgttgagatttttaaaaatgtgttttaattcctaacctagctttgcaggcacatcaaagctgagtgcatgtccttccgaaatcttccctggtatcctgtaatggacactgattttttttttaaatcttcgaattcttgtaacacttaaacattttggtgtgaggatagtaaaatcattaagaataggaagcatatctcttgctccttctgcaccctctcacagagattagggcagttctggctgtttaatattattgacaactccccagaaagatgaacacaataaactgttgattgagcacagccaagtttactagatcaactacagtaagagagagcaccatctgaatggagtcttggtaatgtgtcaaaatatgatatttttaagagtttcaagcccaggctgtataattttagggttggtcttgcaaaatgggtagttagttgaggcttgggctgagtttatgtcctaacaggtttgaatgggtgagaacaacactacaagaacccatgatatgattagtgatgggtaaggtattccagtatttttagtgcaagacgaggaaagcatgcatcttcccagaattgcttaacgtgggaaaacatagtggtatcagtttttaatatttgcttatggacaggtcattattacataatcctaaaaatgaaactgggtaaaccccaagttatatgtaggaggcatttctaaataacactcagaaattggaaactatgtaattaatcaattaattaattaatttttggtatacaaatatagctctattaaactaatgataaagatagcatctttttttttttatttttttatttttttatttttatttttattttttatttttttttatcatactttaagttttagggtacatgtgcacattgtgcaggttagttacatatgtatacatgtgccatactggtgcgctgcacccactaacgtgtcatctagcattaggtatatctcccaatgctatccctccccgctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaagatagcatcttaaaaggatacattgggcatcagattcaggaactagaggcagaaaatttatgggaaaggattgcaggcactcagaagtaattgtggcacaacaaagtgatctctgtgccatatcatttgtcctacagtgcatgctttctagtttcctttgccttgacttcatagtaacctcctagatagagtctaagattgctcctctggcactggtcccttgcttacttgtgcttggcctgtctgttgctgacttcatctcagacttcagcctacagccctgatccctgccttcagtccatatccttggtttggtaacttgtttatgcggtcttcccagtatgtaaccactgtccatactctgtccatatcactgctccaaggtggcttatggtactatatttccaaaagcctgctaaaggtcatcactacagcaattctcctttttctcccatcatcaattttctcttctctactgaatattcctgaaaacatacgaacagtccattgtttttcccattctaaaagaaagaaaacctttcttgactccaatttccattatatttaactccttattatctcttttccataattgcaatatgcctaaaatttcttcaatttctttaattaatttatctcctcccattcttacctgaatctaccccaatcaggccttcaactccaccgctttgctcaaagtgtactggtgaagttgagtcttgatttccatgttgctaaattcagtagtaattctcagtcttcatcttacttaaaattatccaggctggagtgcagtggcaagatcatggctcactgcagcatggacctcccaggctcaagtgatcctcccacctcagcctcatgaatagctaggattacacatgtgcaccaccatgcttggctggtattttttattttttgttgagatggggtctcactatgttgcccggtctagtcttggctcctggactcaagctatcatcccgccttggcctcccaaagtgttgggattacaggcatgagccatcatacctggcccatcctacttaaaatttcaagaacacttcacacacagctgatcaatctgttctctgtgaaacattttatcctcttagcttccaacataatcacttgcctgtttttccttctaggtatctaaatgctcattctcagatttgtttttcttactggtttctcttaatttcctcatcttcttttttaaactgtattttattgtgttgagaacacttaacatgagatctgccctcttaaaaacttttgaatgtacaatacagtattgttgactataggtacaatgttatacaacagatctttatcttatttaactgaaactttatgcatattgattagtaattcccatttatccccacctctatcccctggaaaccatcattccactctgattctatgaatttggctattttagatacttcatgtaagtggaacaattcattatttgtctttctgtgactggcttattttaattagcataatgtcctcaagtttcattcatgttgccatttattacacaatttccttctttttaaaaggtgtattccattgtatatatgtatcacatcctctttatccattcatctgttaatgcacatttaggttgtttccacatcttgctattgtaaataatgctgcgatgagcttggggtcattgatatactgatttccttttctttgaataaatacccagagttggattactggatcatacggtagttctattttcagtttcttgaggaaccttcaaactgttctccataacagctgtaccattttacattcccactaacagtgtgccagggtcctaatttctccacaaccttgccaacacttgttttctttctctatattaaccatcatgacaggtatgaggtgatgtcatatgtcattttgatatgcattttcctgatgattagtgacattgaacatttttctcacatacctgttggccatttgtatgtcttctttaaacatctgttcaagtctttagcccattttaaaaattagattactagtgtgtttttctgtttgtttgtttgtttgtttgctattgagttgtaggagttccttatgtattttggagattaactctttatcagataaatggcttgtaaatattttattccgtgctataagttgcctcttcattctcttgattgttttttgttgttgttgtcgtgtaggagcttttcaattttaagtagtccctcttgtttatttttggtttggttgcctatgcttttggtgtcatattcatgaagcaattggtaagattaatgcatgaaacttttcccctgtgtgttttcatagtagttttacagtttcaggtcttatatttaagtttttaattcattttgagtttatttttctgtatagtgtaaaacaaggatcccattttatgctttcatatgtggatatctagtttccccaatatcatttgttaaatagactgtcctttctccattgtgtattttcggtactcctgtcaaagatcaattggttgtatatacatggatttatttctgggttctctattctgttagattggcctatatggctgtctttatggcattaccatatcttttgaatactgtagatttgtaatatgttataaaatcaggaagtgtgaaacctctaacattttctttcaagactgatttcatcgtttatggtcttttatggttccatatgaattgtagaattttttttacctatttctgtaaaaatgccatggagattttgatatgaattgcattgaatctatagattgctttgggtagtatgaacgttttaacaatattaattcttccaatccatgaacacggatatctatttgtttgtgccttgcttattttttttaatagatgttttgcccttttcagtgtacaactcttttgcctccttaagtttattcctaagtattttgttgtttttggtgctaatgtaaatgggattattttattaatttcttctttagatattttgtttgttagtatatagaaacacagctaatttttgtgtgctgattttgaatcctgcaactttaccaaattcgtgttgtagcaggtttttggtggaatctttaagattttctttatataaaatgttgtcatttgctaatgggaacagtttttttctttcagatttggatgctttttgtttctttttgttgcctaattactctggccaggactttaaaaccatataatttagtctgcagacatcgttagccatgaaattcacaggtcttatgcaaagctgggactgctgaaagtgccatttgaattttaagaaacaacagaggagtttagtcagttattctttcatgtgttattgaaactcagttttgagtgccatctcaaaactaacagaataaaaagaatgtgggaaaattctgtatgtactcaatctcaactttcctccttgaaagttaatatttagtaaaatgtagtctgaaagaaggaagccactagaagtcatagaaacagagagtagaatggtggttaccaggggttgaggttgtgggcggggggttggggggcattggagtatgttggtcaaagggcacaaaatttcaattagataggaagagtaagtttaaacgatgtattgtataacatggtgactgtagttattaacaatattcttgaaaattgctcagagtagattttaagcattttcaatgcaaaaaataagtttgtgagttaatacatctgttaataacttgattagccattccacaatgtatatgtacttcaaaacatcatgttataactataaatataaacaacttgtatttctccatttaaaaaataataaataactatttatagaaaaggaaaccactgggctcccccttgcactattggtcttatctggggaaactgttagcaaaggcgaaataatatgccagatgttccaaatggatacgtgataccaacaggcttctgttagaaactatctcctgcctacaatccaccaactgcagtagtgcttttgtgtcctgcatgtgtactgtcgaatgccaaattatagctccattttccctcagcttttctctattcaaactattgcaggaagttcacttgtacattttgttttgttttatccacccagtgctactatttggctccaattctaccataagcacagatatatccccatgcactgaaatcttgtggcaatgcttacagtggttaatatttttggattatcttcaaaatgaaagcagcacactatttttaaattgttcttgagaaccctcaagcctcaatttgaaagatactgccctagagacctaacataaacatgattctctttttaacatgcaaacattcattccttcagtaaatatttattcagcacctactatgtgtcaggcattgtactttgcactggagattcaatgggaagcaacaatggataaggctgttgccctatgaatttatggtgtaatggataaggctttccttgaataagtcacaattataatgaaccaggcagctaaggacatgttcacatttttatgtagtatgaacagctgtagtacctcaaattgatagaagctatgagttatatgcaacttaaacttgaagtatttttaccactgaaatagtctagaagctgttcctgagagattaagttgttttgcattatcattaccttgtcatcatcagtggtatgtggatgtcatggttaaaagaggaaatataatttcggaatttgtggcttctcagtagagaacacatttaaggaatgatctctaaactactatactacgatggaagagagagttctaagaagtgaaagaggataacaagaagattattaggaggcaacaaagataggcttggcctctgttgatattttctagtgataagtgcctggggatcatctaggtgaagctctaggcgaatagtcagaagttgttgatgtctggtaagttatattaatgtaaaaccaggcaccagctgatttaaaacatacataattcaatagaacacttctatatgttaatcaataacatcaggtctgatcatttaggctacttgggttctatgttatttggagcaagccgtgctccagatcctacgagacaggtacactgaggatacctagcagagtccagctctgctactcctatggtccttgaatcatcctgatggacataattggtaggcatgttaagagtgccgaatcttaggccacatttatactaagtcagaacctgtattataacaagatccccaggtatttggaagaaccttaattaaagtttgagaagcacagatctagtaaactgactctctcttagatctactgataatgcattttccaagccattgattctcatatcaattttacctttttaactcattttatagcattctctgggcttatcatttttccctcattcaacatcactttttaagatccttcattcatactttcatgcattcaatgtattcatagttagcgagcatcttctatgtgtcagtcactgctctaggtgctagggatagaggagtaatccaaacaggccatatccctgactttatgaagattttagattatcatattttccatggcactcctattttcaggtattctttatgatctcagatcattgctcttgatttttggtataaaatgttatgtagcatgacagaataaagttgattatactgagattgaaggaacagaatgctttgagtcatcacagacttttgttacagtcctggatatactatagcctactagctatgtggtcttgggaaagttacttaatctcttcgactcaatttcctaaactgtgctattatatattaattagtaggataaaataaaataatatatattaaatgtctagtaggatatgtggcctaagagactttcaataaattggaggaagaacaactctggctgttcttgtattgctataaagaaacaacagaccaactaatttctaaagaaaagaggtttaattggctcacagttctgcgggctttacaggaggcatggtgctggcatctgctcggcttctggggaagcctcatgaagttcacaatcggcgcagaaggtgaagggggagcggacacgtcacatggcttatgattaacgtatagaagctttctattgaattatgtatgttttcactcagctggtgcctggttttacattaatataacttaccgggcatcaacaacttctgagcaaggagcaagagcaggaacgagagagagagagggaggtgctacctgcctttaaacagatctcacgagaactaactcactatcgcaaggacagcagcaaggggatggtgctgaaccatttgtgataaatccactcccatgagccagtcacctcccaccaggcccactttccaataccagtgattataattcaccatgatatttgggtggggagaaatatataagctacatcagagcttatacaagaaacagcatgaacttgcttggggccagtttattaaatccaatgaagctctattagatacaataaaattagacactttagaaatgtacaaaaggcctaaatttgggtagtctcatgccttcccaagggcaggtattttccctcttcctccctgcctctcccgagtgattccttgcacacgtggaagggagatctggcaggatgctgaactagcctgacgctatgctggtcatggcctccatgtttcctgtgaaacccacaagaatagttgagcacaattcttaataggatggcagtgtctcttgctgacccgcccatgctccttgactctgcagagggcttgtaacaggggctcatccaaggtcaacctcaaaactccacctcagacatcaaatggagtctgaaagagcccaaggaagcctggctccttatagaagtcacagtgatcattggagttgatgactgcataaactataaggtgaccacctgacgacagagtagcactaacctgacatcattaactcacctaccacagcttctctggcctcgaaggaatttttctgcagtactgtgctgtgaagtattcaggaattatgttttgtgctgtaacgtgccatagccataaaccaaaataaagtttttaaaaatgagatagctacttaactaacctgttaagatttaggctaatgattagttctctggcattacacatcctcgaggcatgcaccgtagggtaaaggacaccagaatatgagatatcagtggtctggacaaacagatacttttacttcagagcagtgggaggggagatggaagtgttagtaccatcctgtgatcacataaaggtgactcttcacctgcagttgctagggagaggcttgtttgttactcaaatgaacaggaaattaagagatgagcttagttaatgctaggaatgcttcatggctctctataagtaagcacaaacttgtggggtaggcattgtgacaacgaggtgcctgtaaatatgaagttcagtgcacatgatgtggcaaaaaagacttctgcgattcagacaagcacttcttccaaagagctctaagcacaaccctgacgctgtttccttcattctcaggacacttctgtgaattagccaaaggtcaaacccagtccttctgcttagacagaggtagagggagagcaagtcaccagtcgggaggagcagagggggcaccatagtggggactgcctggctcgtccctctgcccttgtcttcttcctctgccgggcactctcctgtctctccacagggctgagcaggatgtggttctcacagccagtggcctaagtgcccagcagtcaccggagaaccaggcccactgaaccttgggggaagccctctgctgttagggaaggagacagatgcagctgtttattaagggtgaccctgtgcatccactgtgcggagcagcaatttgcaggcccaagtggactcaatctttgggaaaacacagagctagatggattcttattactgccatttcacacaggaagaaacctgctcacagggagtaagtgaaggtccaggatcacatggccagaaagtggtgaacagggatctccaacccaaatcctctgacctgctattgaatctggctgggcagcctctggccagctgtctatgaaaggctggcaggcagcagagtgtggccctagaggatctgatgaacgggtgaaaacctaaaatggggaaactcacacaggatgggttcattttctacaatgcttcaggtgacaccatttttctaagttttaacttaacaaagaacatgagagtgttaataagaattgtatgttcttgggtacatcacgtgggacagaatttacatagaatatatatatatatctttcaaaacatatattcagccattgataactctgttgctttattaaatattatgattcttagattagttgtatcatctgtgaatgagattgataattgtgtttgcaataagatatattcataaattccattcattaataataaccattaagaactgcttgaatttcatgtcttagaccatatagtagcttatatgtaatattatcatttaattcaccagtgtccacagagaggacagagcaacacatgtcacaggaagaatcacaacactatttgataatccctgtcttgggttcttttttggaatgaggtggggtatatataaataaatagtaaatgaagtcaacatgaccatgcttttgtatatttctttctggtttacctcgtttcacctctcttttcatatgaaagttcttgctccattaagttcatatcaactgcaatgccacattctctttcccattgccatcaccttctgacctttagaagttccctatatgaataatgccttcagcacttttgtcatcgttttcagcttcaccccaactgccagcatgattctgagattttatggtgccgagaggagcccccctcaccaatgtcctggcctcacaggccttgatttcctcagagccagtgaggcagtcctctctccccttcctcctcagccagctccttgcaccaggcccacagtttacactgtcactgtaagaaattgctggccttctctgaatctctggtttaaccatcccatgctgatgccaccttctatccctctttcaaggtctctggaggatagtgttcctcctgcagaaggtgatccacgctgcttacagggaacttcacttctgttcttgcagagtgggaaacaagtcagttttgcatacccgttggagctccaacagttcttttccccagccatggtgtttgctaggttttgctcagatgggccctgcttggttgtcgtattagcctgagtgtctaaggacaccagtgttcattcctccctcctcctccactttatcccattctccagcccctcgttagtcaggcttcatgactcctaaactttgtgatgtcattggtgacactgggctctgatcagatcttggcatatggttcctaccaggttcgtggtggaaacctgattaccctaatggccgaatccacttttagaaggaagccttgactttctacattgtaggaaagtaaatgagggtttcagtggaaaactttgccttgtatagagtacatcactctaggttctctgacactaaccttgcatttgtctttgagctcatttctatcattttgtaagttgtaggtcactgacagacatgcttaatatctcgtacagtggaggttcagttgtatctcctttcatgttataataaaaccagttttgcctccatttacacgttcatttcaatatccttgatcaatattctagtatgtattctttatattcttttttgaaccagccacaatttctactcatttactcattagttaaatagactctttaaatacatgttcatttcatatctgtatgagtatcatgattttactctgtttgaaaaatatttttaactgttttggaagtcccagtgagatgcccaatgtattcgcttgccagatccagattatctttaatgacaagaaattgcacctcctatgtggttaaaacccaaatgtgtcttttcttggccctctttaggtgaatccaaagcaatgagagaacattgttcactctctatttttctagctttaatttccctctctactaattttgtgtttctctttggttttgtttcatttacagccaataagttattctcctttgttggcagcaatcgttgtgaacttgattttagggtctgacgatttggagatccctctaagtagataaatggtgtatagaaatctaatgactgttgagtgaaagagaacagagaatctggcttatctttctttttgtctgtcttttttaaatctcaaatcagtgaagaattccatgtcctcttacaggaaaacagctcttctatctagactggggagtttttctgtttctgtgttgaattttgacccatgtctgaacaagaatcgaagctataagttgtacttctctgtgcctgtagggataccttcacctttgattgtgtgaatgtattgtgtttcttagttccatgtggtaataatatatattataaagtctctcaaattaaaggagccctgttctgattggtatatctgaatacttgcttatataaataaaaattgcctaaaattctctgaaataaatgaaattgaactaatactttaaatgtgctagaatacaatatatatattcttcatgaaaccattcagaaccataataaaaaatttaactacacataatttaaataaatatttggcaaaaatgaatggtttactttagaatttattaaaaacagctatatcttttttgatgtcagtgttattacaaaagtgtgttttttaatgagttggggattttttatttgtatttatttatttacttttaatttattttttatttcaataggtttttaaggaacaagtggtgtttggttacatgaataagttcttagtggtgatttctgagattttgatgcacccatcacctgagcagtgtacgctgtacccaatgtgtagtcttttatccctcaccaacccccaccctttcctcccagtccctaaactccaatgtatcattcttatgcctttgtgtccttatagcttagctccaacttatgagtgcaaacatgcgatgtttgattttccattcccaggttacttcacttagaataacagtctccagttccacccaggttgctgcaaatgtcattatttcattgttctttatggctgagtagtattccatcgtatatatacaccacatttttcttttccactcattgattgatgaacatttacatttgggctgattccataattttgcaattgcaaattgtgctgctataaacatggtgtgcaagtatcttttttgtataatgacttcttttcctctgggtagatacctagtagtgggattgctggatcaaatggtagatctacttttagttctttaaggaatgtccacacagttttccatagtggtcgtactagtttatattcccaccagcagtgttacagtgttccctttatactacatccatgctaacatctattattttttgatttttttgattatggccattcttacaggagtgagatggtatcacattgtggttttgatttgcatttccctgataattagtgatgttgagcatttttccgtatgcttgttggccatttatatatcttctttggagagttgtctgtttgtgtccttagcccactttttgatgggattgtttgttttttcttgctaatttgtttgagttctttgtagattctagatattagtcctttgtttcatgtaaggttgtgaagattttctcccactctgtggattttctgttaattctgattatttcttttgctgtgcagaagctttttacttaaattaagtcccatctatttatctttgtttttgttgcatttgcttttgggttcttggtcatgaagtctttgcctaagccaacatctagaagggtttttttcaacgttatcttctagaatctttggttttaggtcttagatttaagtctttgatccatcatgagttgatttttgtataagctgaaagatgaggatccagtttcattcttctgtgtgtagcttgccaattatcccagcaccatttgttaaatagggtgtcctttccccagtttataaaagtttttgtttgttttgtcaaaaatctaagtatttgggtgtgtttctgggttctctattctgttccattggtctatgtgcctatttttataccagtaccatgctgttttggtgactatggccttatagtatagtttgaaatcgggtagtgtgatgcctccagatttgttctttttgcttagtcttgctttggctatgcaggttctttttttggttccatatgaattttaggacggcttttctagttctgtgaagaatggtgttggaattttgatggaaattgcattgaatttgtagtttgcttttggcagtatggtcattttcacaatattgattctactcatccatgagcatagtatgtgtttctatttgtttgtatcatctatgatttctttcagcagcgttttgtatttcatttttagaggtctttcttgtcctcggttaggtatattcctaagtatttgattattttttgcagcttttgtgaaagtggttgggatcttgatttgattctcagcttggtcactgtcggtgtatatagcagagctactgatttgtgtacattaatttgtatcctgcaactttgctgaattcatttaccaattctaggagctttttggatgagtctttaggattttctaagtatacaatcctatcatcagcaagcagtgacagtttgacttctgtttactgattgggatgccctttatttctttctcttgtctgattgcgctggctgggacttccagtattatgttgaatagaagtggtgagagtgggtatccttatcgtgttccagctcttgtgcagaatgctttcaacttttccctgctcagtattatgttggctgtagctttgctatagattgcttttattaccttaaagtatgttctttctatgctgattttgctgagagttttaataataaagggatgatggattttgttaaatgctttttctgcctctattgagatgatcatgtgatttttgtttttaattctgtttatgtgttatatcacatttattgagttgtggatgttaaaccattcctgcattcttggtatgaaacccacttgataatggtggcttatctttttgatatgctgttagaattggttagctactattttgttgaggatttttttttttttttttttttgagactgagttttgctcttgttgcccaggctggagtgcaatggcgcgatatcggctcactgcaacctctgcctcccaggttcaatcgattctcctgcctcagcctcccgagtagctgggattacaggcatgtgccaccacacctggctaattttgtatttttagtagagacggggtttctccatgttggtcagggtggtctcaaactcccagcctcaggtgatccacccgcctcggcctctcaaagtgctgggattacaggcatgagccaccacgcccggccttgttgaggatttttgcatctatgtttatcacggatactggcttgtagttttctttttttgttatgtccttctctggttttggtattagggtgatactgacttcatagaatgatttagggaggattccctctttctctgtcctgtggaatagtgtcgataggattggtattcattcttctttgatataattcagctgtgagtccatctggtcctggactttcattgtttgcagttcttaagttacatttcaatctcactgcttgttattgatctgtttggagtttctttatctttctggtttaatctaggagggtttcaaagaatttatccgtctcatctagattttctagtttatgcacgtaaaggtgttcatagtagccttgaataatcttctgtatttctgtggtatcagtagtaatacctcatgttttgtttctaattgagcttatttgcatcttccttcttcttttcgtggttagttttgttaatggtctgtcagctttatttatcttttcaaagaaccagatttttgtttcatttatcttttgtaattttttgtttctgtttcatttatttctgctctgatctttattgtttcttttcttctgctgggtttgggtttggattgttcttgcttctccagttccttgaggtgtgaccttagattgtctgtttgtgctctcgcaaaccttttgaggcaggcatttaatattatgaactttcctgttagcaccgcttttgctgtagcccagaggttttgataggttgtgtcactattaccgttcagttcaaataattttaaaattttcatcttgatttcgttgttaacccaatgaccattcagaagcagcttatttaacttccatgtatttgcatggttttgagggatccttttggagtcgatttccaattttattccactgtagtctgagagagtactttatataattttggttttcttaaatttactgagacttgttttgtggcctattatgtggtctatcttggagaatgttccatgtgctgatgaatagaaagtatattctgcagttgctgggtagaatgttctgtaaatatcttttaagtccatttgttctaggttatagtttaagtccattttttatttggtgactttctgtcttggtgatctgtccagcgctgtcagtggattattaaagtcacccactattatggtgttgtcatgtatctcatttcttaggtctactagtaatcgttttataaacttgggagctccagtcttaggtgcatatatatttaagattatgatgttttcctgttggactagtacttttagcattatataatgtccctctttgtgttttttaactgttgttgcttcaaagtttgttttgtctgatataagaatagctacccgtactcctcacttttgctgtccatttgcatggaatatctttttcctcccctttaccttaagattatgtgaatccttatgtgtcaggtgaatctcctaaagacagcaaaaacttggttggtgaattgttttccattctgctcttatgtatcttttaaagtggagttttgaggtcatttacattcaaagttagtattgaggtgtgaagtactattctattcattgtgctgtttgctgtttgaatagcttgtgttttcttttcattgtgttattgttatatcggtcatgtgagatttctgttttggtgtatttggaggatttgtttcaagattcagagctccttttagcagttcttgtagtgctggctttgtagtggcaaattccttcagcatttgtttgtctggaaaacactatctttccttcatttataaagcttagtttcactggatacaaaattcttggctgataattgttttatttaaggaggctaaaaatcggaccccaatacttgtagcttgtagggtttctgctaagaaatctgctgttaatctaataggttttcctttataggttacctgatgcttttgcctcacagctcgtaagattctttcctttgcctgactttagataacctcacgattgtgtgcctaggtgatgatcttttgcagtgaatttcctgggtgttctttgagcttcttgtatttggatgtctaaatctctaataaggctggggaagttttcattgattatttcctcaaatatgttttccaaacttttagatttctctttttcctcaagaacaccaattattcttatgtttggacatttaacatagtcccaaacttttcagaggctttgttctcttttttgaaattcttttttctttgtctttgatggattgggttaattcaaaagccctgtcttcaagctctgaagttctttcttctgcttattcatttctattggtgagactttccagtgcattttgcatttctctgtgtgcccttgatttccagaagttgtgattgttttttatttatgttatatattttgctgatgatttttccttttatatcctgtatgatgttttttatttcagttagacttcacctttctctggtgcatccttgattaacttaacaatcgacctgaattctttgaattcttttactggtaatttggagatttcatcttggtttgcctccattgctggtcatctggtgtgatctttttggggtattaaagaaccttgttttgtcatattatcagaattgtttttctggttccttctcatttgggtagactgtgtcagagggaagatctgggactcaagagctgctgttcagattcttttgtcccgcagggtgctcccttgatgtggtgttctcccccttcccctaggaataaagcttcctgagagccaaactgcagtgattgtctttgctcttctgggtctagccacccaatggagctactgggctctgggctggtactggggagtgtctgcaaagagtcctgtgatgtgatctgtcttcaggtttttcagccatggataccagcccttctctggtggaggtatcaggggagtgaagtggactctgttagggtccttggttgtatttttgtttagtgcactggttttgtgttggttggcctccagccaggagctggtgctttcaagagtgcatcagctgtggtaatataaggaggatgcaaacttgccctggagacacgtggttaagtattcaggtttttcaggcggtgggcagggccatagacctcccaagagattatgacctttgtcttaggctaccagggcagtagagaaagaccaccaggtggggggcagggataggagtgtctgagctcagactctctttgggtggggcttgctgaagctgctgtgggggatagcggtgtggttccctgaccaatggagttaagttcccatgggattatggctgcctctgctgagtcctacaggttgccagagaagtcaggaaaagcagacagtcacagatctcaccccgctcccacacagctaccagtcctaaaggctggtctcaatcccaccatgcccctccaacagcactgagcctatttccaggcagctggtgcccagggctgagaatttgccccagaccatgagcctccctactgaaaaagcaagcagactcacagtttttctggtgtctctgggagcctgcagcagtgatcgggttccttcaaagggtctgtggattctctccacaaaggtgtaattttttaacttgggtatgtttttcctgaaagtaaatagatttactaatcacctaaactagcatacttctagttattatttaaaattatgaggaatataaattcatgtttgactaaattgaaccattgtgatgacagtcttttatttccagttataacatttagtagtacgtcaacttaaagaaattttccaagttgtttagataatccttagattgatattgtattagttgatgaacattaactggatgcctagatcattcctatgtaagataaaatactgaaatattaattattaagcataaattgaaatttgtatactttggctttttagtagtaaatcccacagagaggctgtattttaaggtctatcagtgaacatgttcctttctgccatgttgagaattctatagggaaattgtgctgctgtagaaacctgggctgtatgggttccccaaaattacagaatgttcacaattacccaccctttagttttctttataaaacagatgtgactttgtataaaagtcataattaataatatctgaatgagactctgctaggagtcttaaaaaaatgagacatgctttgattaaagtaaaagaatatagaatgcttctgtctataagtgaaatgacttttgttccagaataagaaagaggatggtgaagggcaacacaacatatagagatctgtttgaggttcacagaaagtgaatctgaaagggaccacaaatttgtgttaaaattttgcaaaacctggttcggttttgatgggtgtattcataagatttccaaatgcaaacctagaatttggtttcttttcaaatatagtcacagtttctttggagtattcatttgtttgtttttttgtttgtttgttttttgttttttttgagacggagtctcactcttgttgcccagtctggagtgcagtggtgcgatcttggctcactgcaacctctgcctcccaggttcaagcgattctcctgcctcagcctcccaagtagctgggattacaggcatgcaccaccacaccctgctaattttgtatttttagtatagacggggtttcaccatgttgatcaggctgatctcaaactcctgacctcatgtgatccacctgcctcggccttccaaagtgctgggattacaggtgcaatccattgcgcgtggcctattcttaataagaggttgtaaaagtttgctcttcacattagaggccaatttgcccaaatagcagagatgctatatctcactagaatgacgttccacactgtgtttttgactttgtcatgctcttgattattctcttaaaaatacaaaaaaatacaaaaataaaaataaaaacccacaaatactctcattactgaaagtgttgagtttttgtttatgtaaatattgtattgtcactttgattaataggcagccaagccacagccattcgtacactaagacacccatgatcccaatcttaagtgttcaaatctcctggcaaattttaattttgcctttctcaaatcaaatccttaatggaaaaggaaataaaaaatataaaaccttcacagtgtctttggcacattaaggtttctttaatatttcccaggctatcttaaagactttcccctggaaattcacaaagatttcttttatgcctgatggaaggagaagtaatagaagtaaatatgttcatttgttatgttactattgatgagtttcataattgtccaattaaaagtagatgctacttaatatctaggactaccctgaatttgcatatatcatataatcatcatttgtgaatgaatgagaaagattatgatttttgataatttatttcagtggttataatcaaattttcagataaaatagtgaacaaggccaggtgtggtggtgggcgcctgtaatcccagcactttgggaggccgaggcgggtggatcacccgaggtcaggagttcgagaccagtctggccaagctggtgaaaccctgtcgctattaaaaatacaaaaattagctgggtgtggtgatgggcgcctgtaatcccagctactcaggagtctgaggcaggagaatcacttgaacctgggaggcagaggttgcagtgatccaagactgcgccattgccctccagcctgggtgacaaagtgagactctatctcaaaaaaaaaaaaaaaaaactgaactaaatgtttaataatatttatgaaatgtagcctatgtcactagtatgactttttaaaattatttaaagagattttattttgtccagaatcttggcagtcaggaatcccaaataaatgctgcaactgataagtgcatcattgttagctgatcttaggaaaccatcacaggcatttcaactgtgttttccaacatacggatttgtttgttgaaatgtagctagtcaattttcatttttccacaagtcaaccagctgatctcgcagcccaatcagtttttttatttttatctttccaccaccccccaccacctccactgctggaatacatttgtagagaagttttcaaaagtttagagtttaagaattctgtttctagattgttaattgtgcatatgtgagaattatgggagatgacactgatcctgtttggtgaccacatcacataataatggaaatgtttccaaacataccattttcaaaatattttctccataataaagtttattttttaaagctatattttcattgttaaagtgaaacctccattttgagtaaatagagtatatgtcatttatttattgatttaatatattctaggaagtaaatcactgacgaaaaggtggcaacttttgaattactcctcatttttatgaaaagaaaacatacataacttctgttaaatttgacaactctttgaagtactctacagtgagtgaaataaccagtaagcctccatatggcctgagggatttccatagtcactcttcatttaattgcagagtattgtacagattttacagatttttaaggtaatgaaatccataaattcctttacatggacaatatatcaaaatatgttaaagatgtacaaatgattgaggccacatcaacctctttcccctttcaaacttctactttctcctctgaatagctgctatgatgtgaatgtcttataagtgtctgatgtaaactgggtgaggatcaggatcaatctatatatgaaatattagcaaaactttgaaaactttttgataaaatggatagaggaaaaccaaaagctcttaatattttcttctagtattccaatggatttgacttgtgtgcctcatttttggaagtcagtggaataaattgttactttacttttattttatttatttatttttttgagaggtagtctcactctgtcacttatgctggagtgcagtgatgcgatctccgctcactgtagtctctgccttcctggttcaagcgatttgcctgccacagccttccgagtagctgggattacagacgtgagccaccgtacccggccccaaattattacttttagatgatcacttttcacttcctgttagtggcatattagtaagagtttctgataccataggaatgtacaacatacaagtcatttttgaatattccagtgacataaactcttcagaccatgaacccaaactgagaatggaatagaaagtgcttttttaaccctaaagtaagaagacttcctacagaaggtgctgttggttgcctatcatatttcccagctttgcctttcctaatacaacccgtatttttttcaggatccaccctcctcccataacccatgtgctttcagggtgggctgacccttctccacacccaggccaacatggtgtaaaccaactcatccccaacgtcagtgattcattttggaatggatacgtattacagtttggctaatgaaatcagaggcatagactttttgggagatgcttctgtgctaaaatttcctaagtcttaaacacacacacacacacacacacacacacacacacacacacacacacacacacacacggagggagggagggagggaaggagggagagagagagacagagagaaagagaaaggtctcttttcctcttttgtatattatcaaaggacatgatgcctggagatgcaggtgaataaggctgaagatcacagaatggaaggaagccatcatgtctttagacttacagttatgtgtattaataacttccccttatttgtttaagtagctgaattgaggttttctgtttggtgtaatttataacccactaacacatcataacttaccaatacatggactatatactgttatatggtaaggcttcactcattgttattgagtattattcacctacatttttttttaatgtgcttgtttggttttcctacacatagcaccttcaaagcgggaatccttaagattaatgccaggatatcagatattagaggatgttagaggcaaacaaatgactgtgggggatatgaaagctgacaggctacttttgaaggaagaagatgctaaaaagaaaaagagctgggagacacagacttatactgtaatacacaaaatggatactcgttattatggctttgagacatcaagggaaaagttgaattatcctttttatataaagactgagaagtgtatattttacaaagactttcatcaaaaaattctaaaatgtattaaatgtgtaatgttttttgaagagggaagttatgcagaacattgttaggcaggcaggatattctttatttctcccaacacctagtacagagaaagggatgaaggacatacttaaaatttgttaaaggagtaaagagatggatttcgaagacaaatgatatataacagaaacatttccaaaaacactgttttcgaagtgttttctccgtagtaagaaacctagctctataacctaaatctattttgcagtttcataacccatctaacatctgaatgattacttctaaatatttttctctacttaattttctatgatgtctgttccccaatttatcttctttggatgtttaagaaaaaatattacaaagaagttttgaaggttttcctttttaagttatgcatagaaatgtacctgccaaatttcgaatttcttgtcaaatttcattcatgtagcaagatgagatttcagggtcacagtgaaagtctatgaatgaaaaaaaatgttaaatattcatattagtgatgcatggggtaggaagtagtggggagcggtcctcctaataggcagacaataaagggggaacgtgtttgtagaataatttagaaacaataaggaaactaacaggtgatctactttttatcaccgtacaccagcaattctaaacaatgtctgtgatgaagtattttccccccaaaatattctactggtctatattctaaacaactgatgtggctactgtttgttttaatcatctttatgtgaacttcaaattcgcacattattggtcatccatgaataaacatttaactctacatagcagttaacttgaagacctcccaattgcacatacagtctctaccacacagactcaactacatgcatttattttcagagtaaattcataatagtttggaattgcctgagctacctttgggagaagttactgtattccaaccagtggtactagatttttttttttctttaaacaggagaattcatgtaatgaatgatggcacagtaactttaaagataaagacataaaacatgacttgcttaaattttgacattgtatgacacccctttagaatttttgtgttcagaaagttaaacagtgaagcaggatgtgacctataaggggtagtatttttgtttgtaaggagtacatttttaatgaatgaaatatgttactatattggaaaaagacatttacagtgaaaattattttattgttttgaaactaaggaagaaattcagaaaataatgactatcactgagttttgcatgatttttagtgacactaattttatcatgtagaggaagagggtgttaaaatatgattcactttcgtagtcgggtaccctattacttctctaggtcatccctcctatgtaacatgcacactgttaaggcatgaattaattattttggaagtcaacttaccaaataaaccagtgctaccattttctagtctccatggatcagtttgagagccatgaaaaggattaaaatgatccttacaatatacagatagtcttctagtaagtcatgacacactgtaattaagttgtaactgttagtctctctgcttgttcctttcctatcttgaaatgaatatgttcaagatcaaatatgaacaagcatttactcagtggaagatgaaatgggtatgatatgaatagattaatgacatcacatgtgccttctttgaagaaattaattatccaaatgatgttagtgacgtgaagcctcctgggggcacttctcattctactttcagtaatgagctgtatcctgtcaacttactcagcaaaattcacaggaatgcatgtttctctttcatgggacacttctctgggacttaatgattccacactctttctctttttctactacctttctggattttcttctctgtctcctttgctggctgatatttgttttactagcctttccacatgagagttttttaatactatgtcctagacttcttcctcatctcatgttatattcttatcaaagataatctcatgtatgctcttgacttcaaccagcatgtatgagtggatagcgtcaaaatttctatctccagtctctccataaactccttgtagtcactaacagttggagattgccacctgactgtctcagggacacttcaaactcaacctttatgtttcaattatctattgtcgtgtgaatattatagctaaaacaatgaagatttattatattttaaaattctctgcactgactgggtggtttttaatgctccacttggtgtgggctgtagagttactcgtgcatcagatggaggctggactagttggaacctctaagatgtcccctctttccacatgatgtctcttccatcagggcctcttcatatggcctctttctttaacaagttagcctggactttttaatagcattacagctggatgtcaagattgcaaaagtagaagcttccaggcctcttaaggccttgtcccagaagtggcacagatcagggaagcccattgctttagccaagtgcatgtacctatgaaaatcttaagttttagagataaagtaggtattaccatcatagaaggggtttcaaaaaaaaaaaggaaggaaggaaggatgggagaaagaaaggaagaggaaagggagaaagaaaggaagaggaaaggaagaaagaaaggaggaaaagtaggaaagatggaaaaagaaaagaaaataatctcaaatcagcttcttaaaataagaggaggaggccgggcgcggtggcttatgcctgtaatcccagcattttgggaggccaaggtgggcggatcacgaggtcaggagatcgagaccatcctggctaacacggtgaaaccccgtctctactaaaaatacaaaaaattagccgggcgtggtggcgggcgcctgtagtctcagctactcgggaggctgaggcaggagaatggtgtgaacctgggaggcggagcttgcagtgagccgagatctcaccactgcactccagcctgggcgacagagcgagactccgtctcaaaaaaataaaataaaataaaataagaggaggaacaaatattcagcaatcagcgtcattgacactgacacttgatcagtgtctgaagtgagagcagctgttaggaaatcctacttctatctatcaagaagggtttatttaagaaaatagatgacatacacgctataattatcaatatagtttcttccatgggctaccaagtccaaagtattattgcttttgcataatttatgctgataaccttggaatcatggtttggatggtttaaacctctctctccataccaattgaatcattcatcaaatcatatggaatctccctatgtgtaacctcccgtcaagtcctccattttaatttctgtcaccactactctgctgtattttcctttcgcctcaaatttgaggtattataaaaatcttataatggcctatcccggatctaagctatcttacacattaattacacagattccccattgcttatgtaatacaggccaaacatcttagcctggcattgagtgttctctataaatcgttgctttaactttatttctagctcccttatacacaaacttccctataaggccaactggatgagtttcctgtatttaattggtcaagctcttctccacctgaattgttcttccctcatactaattttcccaaatcctgccttctttgtgtgtcttggctcaagtaccatcacatatctttctggaccaccctagccttcaatgatcatcagtcatctatgttcctcttaaaatcagagccaattggcttttagtgtaaaccagtttactgtttcttaaggtttcacgagtcttaaattaggtaacaaagtcttctggaatgcatcaatataattagtcaaaaataaatgttcaatgtatttgttttctttacttttgaggaaaaaagaaattaacagtctcggattatgtatctcctttatacaaagctgctgtctgccaccaaacttattgggaatgaaatgaacagcataagaatctgcttttagaaccagagacagggcagatctagggatccaggtgtcaagaacctcccagtattttcaggtattgaccatcaggatgaattaaatcttaccatttttttttatttttctgatacattttgttcataaattaatttgaagagagagtgattggcagagcttcaaccacacacactttctacttgaagtatgagggggagtgggtctgatgaaaacttgaatgacttcctatcaagactagtgagagagaggtaattctccaaaacagactagtgaagcagttatcagaaaagaaggaagcaaatgttaggcaagcatgtaattctttctttatattaaatcatatgacttacctgtgtttaatatattcagagcctgacaatgagagagaataacttagaaagcaagggagattagttccagtagaaagactaatatttattttgttgagatggtaggaagtgggagtagaggaacaattcaaaagctgttcttgactcgcttttaaactcttcatggtggccagaattgctttcaaaaatactatatttcccgtagacagcatattaatttgcatttcaagcattttgataactgttaaattatttttgtcttgaatacactattttatagtgttttataatgctagttgagctctctggaatttctaagaaaagttccagaaattaaatctcctgggtaatgtgtgaataacagaaaaggatccaatgtattctcaccaaaagataactgtccctaatgttaaaaagcaggggaagatgtcatcattttattgttaacctgacggtgaaactggagaattccctgaactccttgcaggtcttgtgacaggggtgtgactcgtttgttagtttgcgcaattgctgctgcacaaaccccttacgggatggggagcacacagatgggcaggtgcaggagccggggcaagcacttttgggctcctgccccacagtggcgtctagggttgtgttacaattaatgctcttttagcagttgccatctgcacatggctaagtgttgaggactaagctctgattttttatcttgcccaaattcctacctaaggggcctagggagtcatgccctacaaaccatgaattctcatcagatgggttttatttgaccctatatattgtgacttacttttctatctgactctggcataacattataagacaaggaaaaaatatttaaccccaaaatatatttccttgccataccttgaaattgccctgcaaagtctcttgtgggaaaaatccacattctatagagaatccctttccccctttgttttccttcctttccttcctgatccaggagataatcaactaagagccaggtacccttttaggtccaataagaaacattttacaacctgctctctccctctgaagtcttctgtctgagagcttcctctgcacagtaaaacttggtttccacagtcttatactaacctgaacattcctttccattaatcccaggtcttaggtaaactcaaccaattgtcatttaaacatttaaaccagaaaatgtttaaatttacctgtagcctggaagcccctgctttgagttgtgccacctttctgtaccaaaccaatgtatttcttaaatatatttgattgatgtctcatgccttcctaaaatatataaagccaagctgtaccctgaccaccttgggcacatgttctcaggacttcctgagggctgtgtcatgcgccatggtcactcttatttggctcagaataaatctctaaaaatattttagagttttactcttttctcaacagtgttaaactggctcagtggagagtcatagtgacagccttttgcaccctgccctcttggtacctgggtccttgtctggtgtccaggaagaatcaggtcagacatggacttgaaggatgttgaatgcagggattttattgagtgatggaggtggctctcagtgggatggatggggagctcgaaagggtatggactgggaagatgatcatcccctggagttcagctgtccttgcctgatctcctcttggaccgtccccggcctaactcctattgacattcagacactccttctcttttcttctctgctataccactctgctgctctcctgctcttctgctcatctgtccatggagcctagggtttggggtttatatgtgtacaggataggggggcatagtaggacaaaaggtaacatttggatgcaaaaacaggaatgcctgttcccatttagggctgcaggtttccaggcttgacatgaggcctttgctaaagaaccaccctcttctacccagtatttccctgcctcctgtccgtatcaattctatttaattttgtaatagagcaatgggtaatatttttgagtcaatggaccctttagtaatattttttaagtcaatggaccctttagagttaccgatgacagccccagtattctctccccaaaacatacatttgcaaaatgacacacaattttgcatacaagttcagaggatctacatgtttctgaagcccatctatggatgccagatttaaactcattttattaaaaaaaaaaaaggatattagaactacaatgaaagagcacaggagaaaggataactgtctttcatgggaatgtgcacttttcaattttgctgtattttcctaaattatctctcagctaatacctgacttcatcctttgttatatggcagcaaatctcactaaaatggaactagtacaaggatcctagactttatcactcctcctcccacccatctcccttctgtagtatgtgttaaataagaaagtttttagtgtgtttctgagacttgttcctgatttgatttcacacttcaacagtagtgatccttaattattacttaggaattactttatgatttggtaatatttaaggacttaagctacaggttacttttttaatccttaggtgacatgctacctaacactttctctctgcttattttataattctaatttgagttattagctcttaattactcaataattattcactgaaccctctgtatgtgccagaaactgtcctaggtactgagaataaacaaatgagtaaacacataagtttcctgccctctgggaatgcacattcttaatttactaactgttaaattcaccacatacttttgttaatttgtctgttttagaagtctggctaacttgtttaaaatttattgtactcattctttctgaagtggctcttctacatcagcactatcaaataaaaatataatgacagcccaaagatgtgattttaaatattctagtagtcacattaaaaatcacgtactaagaaacaggtgaaattaattttaatagtatatttagttaacccagtatttacaaaatattgttatttcaacatgtaatcaatgtaaaaatttattgatgagatattttgtcttttttatactaagtctttaaattcgggtcacatttcaagtgttcaacagctacatgtagctactgattaactattggctagatcaggccaaaatgttcaaccctagccacttgctcttcctccgagagcttcaatctctcagcatttcttatgcagagctacttagctccttctcagatcctgtctctaaaatacaataacaattcgatccctcctcaagctccttaatgtcttaattcataaagagactcttgccatgaactatttgcctaggagggcaatgaaaggttataaattcaacattgacaacaaaaacagtttgctataaatgatagataaatgataggactgaaagggataacgtgcttgggtcagcgaaacttgggtgtggtaggacaaatgggagaagctgggtttttttcgtgtgtgtgtgtgtgtgtgtgtgtgtgtgtgtgtgtgtgtgtgtgtttcttttttttttttttttttttgagacagagtctcgctctgttgcccaggctggagtgcagtggcgcaatctcggctcactgcaagctccacctcctgggttcgcaccattctcctgcctcagcctcccgagtagctgggactacaggcgcctgccaccacgcccggctaattttttgtatttttagtagagacagggtttcaccatgttagccaggatggtcttgatctcctgacctcgtgatctgcccacctcggcctcccaaagtcctggattacaggcgtgagccaccgtgcctggcagagaagctggtttttaaaatgctatgttcttatattatggaacacttacttgtcctctggtatactcaaaattatgaccaaggatcttctgagagatttaactcatctggagtaattacatccgctgacaaatgcatatatagtgccaatgtcatacttgccttgttttctcaaccttccaattcctaggcaaattgtcagattctcaaggtaatagctgtcccacatgagactctggtatgtgcagatctttattgtgacagttccttttggggcttctgtgacccaatgaagtgaaaataaagatgaaatatttcaagattttgaaaagtagtttctattaaaagttattcgtctaaaatgatttctgttttatagtatttagtgcataaagactggaataaaatgctgtaaactaactcatttaatatccttctgtgaattcgaatgagaaagacaaattgactggattaaaaggaaacattgagtaacattctgtctttagttaaaaaaagtccaacaccagcaagacttaccttcttttacttacacatatagttaatattagtgtacggtaaagcttctccacacatctaggaaagaaacaggaaaatgcattatttcctttgaaagctgcctaaacacaaatctgttattcttctgagaaagagtgatgcctatacagtaaaaaagttattctaaggaaggaaaaaacaaaatacagtatgtctgttgtttaagccaatagatgtctttaaggaaacattttcttaagaatattctttacaatagtgaggctgaggcaggagaatggcatgaacccgggagacggagcttgcagtgagcggagatcgcgacactgcactccatccagcctgagcaacagagcgagactccgtctcaaaaaaaaaaaaaaaatctttacaataatataattttcaaagttctcagaattctaaaatcttgctggatgatacatagatgtatagacatgtacccaaaggtgctctactaaattaatcactacctccaacaacctaaagattacagtttattgtttaaatgaaggatgcaaaatataggtgtatatacaaaaagcccctgttttatagctcttctaaatgtgagtatcacacacgggaaaaatcgaaaaacaaatgtaagtctaaatctccttacagagaagaaaatgtagtgtggcctggcctaatattacgacttttccaaggagttactatatatggtttaacagaagattatttccatcaaaaatatccattgcttgtgaatcttaagaacaggaagtttttcaatccaaattaagctgaagaaaaacaaaggagaggaggggaggggaggggaggcgaggagaggggacgggagaaaaaagttctctgctagcttcctaagcagttcagctctgagggtatgctttgcagcagcaacagcacacctgcccagaccactgcagcaaaggctttcaacaattcttgggaaactaagtgagggcaaagatacatggtagttccaggacatcccacagtaggatttgtctcacggaggtaactcagggaggaagaagtgagcagttcactctgccttaacagtttacatatatgaactactaaacttaaaaaaaaaagtttttcaatccaaattaagctgaagaaaaacacacctaaatagtatatacccaaagtattatgtggcataatattttaatcataaaaataatatgtatctatttttgtttctcctttatagtcaaagcactgtagaagtacagaaaggattgttctgagagagttcttgaagtagaggttgggggaggcagcctaggattcttatctgtaaaatgtgtggttccaacatcttatgcctacacttgatctcactgctagattgtgggcaaggtgctttgaagggatgggcattaaagggaccctccaataagtgaggcttaatggagtttgcagagatcatcatattctagaaatcacacatgccgtttttgtaggaacagagacagggtcccaaaagtatcactggatactggagcagaaaatgagaaaactcatcttgtgatgccaagagaagcaaagtcttcaagattctttctggtttatttctatagtatagctatcaatgttagtggcataatgtagtatttcatgttcattctgggtcactttagactcatcgtagcactgatttggaggaaaacagtatgaatgggcacaactggatgatccaggagggattcttttttttttttattatattatactttaagttttagggtacatgtgcgcaatgtgtaggttagttacatatgtatacatgtgccgtgttcgtgtgctgcacccattaactcgtcatttaacgttaggtatatctcctaatgccatccctcccccctccccctaccccacaacaggcctcggtgtgtgatgttccccttcccgtgtccatgtgttctcattgttcaattcccacctatgagtgagaacatgcggtgtttggttttttgtccttgtagtagtttgctgagaatgatggtttccagcttcatccatgtccctaccaggagggattctttagggaagccaggcaagtgggagtggtcatgtaggaggaaagtctatcccatagtacctgagaggtgtgcactaaacttgccacaggagacgatgctgactggggaactctattgagggtggcaaagcccacagtttaggtggaaaagcacttgaaaggggaatggattcattgcttttgtcatttttacctagactgttataagggcttctttttttatatctctattatcagtttttttcttttggaagtctgtcttttaagtttactcattaattgtataaccatttattgatcatttatacagcaggcactacgctgtattctcctaatacaacactaagaacaagtccctgtcctcatggagcctccagtccaagcaaccccaatgatgtgagagaactgccacaggatatataggagcatgtagcgctgactcactgtctgattatcatcactcttttaatgatgccaagatcgattagtgggttcaactggttacagcctcatccctgaattgtaaaattccctattagcctaaaggtgcccaggatttaattgttctggataatgatttcttaagaattctgaagaaggtttattcagagtttcctttcattcattgatagagctagtatttattcagcttattctaaacactaggcattatgttgttgctagagatacaaaactaagtgagccaagatgaatatagaggaaacataagtgagtaacttcagtgcaatatgagaaatgtgcagggctagatgcagagtcctctgggaacagaaaggaagcacagtccttaatgacagcaatctctggtgagtcaatgaatctctcgcagtttatttaggtcaggagctattaactgtcatgcattagtgagcagccaacagtgggactgggcagtctgagccctgtattgaaaagccggcaacgaaagaaacttcactagaggcttgatgaaccagttcttaaactaaagctcatgtgtctgcaatggacaatcctgcctcaacctcgtgaaaaacagaccaggattctctatggttatgcactactgcatttgtttctttagcgttcctagagttgttttcatcagttatttaagtaagaatgcccgaggtagtccacttcactccctagatccctattaatacatttcagttgaaaatctgttgtcccttgcctattttactgcttccaacattgagatttgatggaaagaaatcagctctcaaataagaatggtgtcacctgctgctggttcagcggcactgcaaactacagattatgcaaattacataaagatccaatctttctacccggagcctaggaagaggccttcttttcccactgggtcttatattctagagtcagccatttacttaatttcccaaagaatactgcaagagaatactgtgaaagcattatctaaaatacaacaaaagaattctgtaaatgttatctaaaatataataataagaaaaaccaaaagaattcataactaggctgaaagtattctcttaggattttaatattagatacaaaattgctcattagcctttaggttttcttccctctcccaagcactcaacaattgatttccttgcatactaggtaagtgtcctatgacacataatactttcaaatatttatatcttttgtaagataatatttttcatgtaatcctagatggattagtttcctatgactgctttaaaaattgccacaaacttagtgactgcaagccacacacgtttaatttttttcatgtctggaagtcagcagtccgaaatcacttttactggtctaaaatcaggtgtcaacagggctgtgctccctccggaggatctaggggaaaatcattttccttgccttttccagcttctagaggctgcattttcttagcctcgtcttccctcttgttgcagtcgtcccaatgacttttgtctctgtagtcaagtctctctttgcctccgtcttaggaggagatgtgtgattaaattttgcccacctatataatccaggataatcttcccatctcagaatccttaacctagtcatgtctaaaaagtcccttttaccttataaggcaacacaaattccagggattaggatctggatatctttggggaccaggaatcagcctatcacactaggtaatgaagtcattatcttaatctgaagtatctagatcctcatataatctaactcctttagtctatttgagttgttttaattttttctcaagtacattagctgccaaatttaaaattattgcagatggaactcttgtaggtctataatgtacagcttgctgagccacagtaaacagtatcatttttagctttctatcaatgtttgacatacaaaatggtcaactgcagaatgtttcagtgacttctctagaaccctattgaatatttaaaatgtcatacatcatgttgttgagtggtcttcgtggaaaaaatcatgtttttaagaaatctattccccttcgatttagtgcttgggtttgtatattccgatgaactgatatgcaactagagctatataactaatcctgatttttaaaaatttgtcttggcttccaggaagtacagactaaatttagtatataattacagtaactattcttagctagtatttcttgtataattatatattcttcaccccaaccccaataatcatttctcctactccttactaggatgcttttgataatttatcttcatttaaacaagcttattgcatgggttttctttattataatctatctcaaaatcttttttggaagcagatatgaaataaagcaaacaaacaaataaacttggaagatatatagaccctatgaattatagcccatctgcatcttttttgagtgccaaagacataagttcagctatgaatacattctgttactacaaaagcactttaaaattgtgtttctgtgcattatatagctccttagaatagacagatatatttagaggggaaggatatgctaatcaatgccactagagccagtagttttcttgatttcattcaataccttccagttttaataatttgcaactgatatcaatgatcataataaaattttaaattaaaatgtgtgagctgtttttttgttaatacttcatgcattgaagagacataaacaaagttttgaaatcataactacattttctgaaaggcttccacaggaaaaaaggcttcatattgatattattttgtacaattttttggacaattttccctccttcacattcagtttattagaactgaacataatatctgacataagtgattcatatatgggctaaataattcatgtatatcagaggccaagcctattggatatggtggaagttttgaaaccctatctttgtggaacaacaaaaaattaaatgtaagggtcaaaatgtgagggctcctttctcatttgttctgtgaatccagtttctagtggttacttatcatatcaaaatttctcgtggcgttttcagagctacacctccaataaacctaaatgatgactagctttaagacaatagtctatacagttacgtactgcttaaccacagggatgtgttctgaagaatgcgtcgttcagcaatttcattcttgtgtgaacatcctagagtgtacttacacaaacctatatgttttagcctactgaatatctaggctatatagtatagcctattgcttttaggctataaacctgcacggcatgttactgtactgaatactgtaggcagatgtaatacaatgatatttgtgtatctaaacatagaaaaggtacagtcatatttaattttaaatgtattaaagtaacccatttcctcttcccacttgactagctatttcctttttgagaagtagacattatgtttaaaaatgttttaaaatactgcaatattgttgatattattagtttactaaataagacaataaagacagaactcagacaaataaaatgcagcagctgtcagttgatgggggccgccattacttgtagaagaaaccttcagtaagcgttgaactagtggcctgggatagttgattttaagaagacaaataaaaatgcctggagagaaaaaatattttactcattccatatgagtagaaaatatcctttgaaatattatcagtgacttacttacgtcagtctttcttaacttgggttgtctgttaaatactttaatatggcttttgccatagctgggtcattgctataagttaacaaagggctgttttctatatcgctggaactctcctttgttagaaccttctttaaatagaaagaattctcttgcagtacgtggtaattgccatagattattgaaatgaaaaatggctatgattactcctaacaacttgagatgttctgcttacagtggatgttaagaacatatcttagtaatttaaaatttttcttaataggcataagcaagtttttattctttaaatgtacttcaagtggttacaactaataaagattggtatataacaatagagaagaggttccaaagtaaaaatccacattaaaattaaatttaggttacattattgcttagcagtttaaaacaatatgttccatatatacatacatgtgtatatatttatatgcatacaaaacatacatgaacatgtataagtatatggatgcagatgagtatatgtacacatatatatagaataaatgcataaaggtatataaatatatggctgcatttgtgtaattggatatatatgatacatattttatatctgtatgtcatgagtatttttctcattttttcctctttgagaataagtctaggtctatactatcaataaaatattgaaaattaaattaattacccaagtgaaaaaagaaagttctcagagttatgctgttcatacttatgggagaagtgtagattttttctgatttgcttatcttttcctttatttaaatgtaatttttactgatatgtaatagatgtacatttttaagggtacacatgacaatttaatatattcatataatttgtaaagataaaattagcataattggaatatctgtcaccttaaatatttatattttctttatgctagaaatacatgaaatattctcttctagcaattttgaaatatacagtagattattgtaaactgtagtcaccctactgatctatcaaatactaggtcttatttttttctatcaaactctatatttggacccattaaccaatctctctttatctccttctccttcctacgctgtggtaacaaccaatatgctatcttcttgagatccacatttttagctcccacatatgggtgagaacattcaatatttgtctttctgtgctggcttatttcacttaacatattgaccttcagttccatccatgttgctgcaaaagacggatttcattttttatgtctgaataatattccagtgatctgccagaactgaattttaaatggggttttaggcctggattgactttagataagcttataattatagctctctacttgtggtaatcaatagcataggcctgaatgtgttattgtattaaatatttctcattcattgacatcacaattgtggatcaaatctctgtggtttggatatttgacttctgacaattcattgttttgtctgactttaagttgtgtttaagtgattattttcttggtttgctctcattccaaattactggggaatttaactgatgaatgaaccagacatatatttaatatacatctgctgtgtgcaatatattgtactggagggatgggtaggtatagacatgtaagacataatctcttacttcaaccagaatatggtttcactgggttcctaagatcaatatgcataactgcagggacctcgtgctacattggatttgaatctggggctccagttccagtcccattccttcatggccatgtcaccttagcatgtcacttcacctatggcctcttaacagttagataacccaagaccactactatttctgaagagtatttttttaattacaagccaaatcagtatcaaatattatatttataatggttctgtgtaatttactaactcatttaccataaaatgacatatattgtactattagaagaaaattgtgggatttattaaaaacatcaatttattgtaccacacacttgatatgggcttataattgaacacaaatatatagaatatgaatatctttttttagttctgtcattagctctttgagtgagtatataagcatattcataaatgatattgtatctatatttatctatgttttaagaattcttgcagccgggcgcggtggctcacgcctgtaatcccagcgctttgggaggccgaggcgggcggatcacgaggtcaggagatcgagaccatcctggctaacatggcgaaaccctgtctccactaaaaaaaaaaaaaaaaaatgcaaaaattagcctggcctggtggcgggcacctgtagtcccagctactcgggaggctgaggcaggagaatggcatgaacccgggagatggagcttgccagcgagccgagatgcgccactgcactccagcctgggcgacagactgagactccgtctcaaaaaaaaaaaaagaaagaaagaaagaaagaattcttgcatctcaggcatggccaagaagcatattgcccttcatcctttctcaaataccatagaattggctctgacctcacctcagtttacttatgtttcttaagctataagatgatttgtaagatcccattcacacttagtatcctatggttataaagacattctcttgatagttatttgacatggtgtacacattggatcaatttctttggtgaaaacagtctcgccatgaccttgatgtgccatttgatgttcttggaaataccgttcctctactgttaacagtaaagtttcaaagaaaatagattcccagattatttcaaactcattaatataggaataatatttttaattcttcaagatgataagattttacacattttgatgccagtaaataattttgtgataaaagcaaacacctggtttgctagaaaatattggcattccgcaagcctaaattcattagagaggaattccacgtgcatcgcctctgagctgcagctcctgtgaactgaaaaaactgctagttaatgtctcagaagttattaggaaatgtaaagtacatacaattgtcagtgcttcaaaaatagagataacatcttagtccttatgtagcccccatagttagctggagcttggacatattaggaagtcaataagaatactgacaaactggcatgtaagtcaggtttgcctgcatcaggtttgaaaattattctattttagaataatcttatttatcctatcgtttctcaactaaattgatgtgtagtccatagatttcttacctttgctttatattcctttagagctgtgatgcaagctaaatcatttttggggaaaataacttcttaaacatttttgttgttgttaatgcttcggatgggcagttattgtctgaacatcatcaaggcacaagcaactgactgtagcatccatatttttttgacagttttcattgcttatgtgttccaagagctgcctacaggatttctttccttatatgagaaatattgtaatgatactcaattatgtataagagcaagattcctgacttgactaaatacaactactttagtattcactatttaaactacgtggctttttaataagtaaatcaacattaaaaagtgaataggagattgcaatttagttttcttagaaaagcttgactatttttattatctgatattcatgtcacatgtaatcacacatttgatttttaagtaatttttattggcttggcatggtggctcatgcctgtaatcccagcactttgggaggccaaggcaggtggatcacctgagcccaggagttcgagaccagcctgggcaacgtgggggaaaccctgttttttacaaaaaatacaaaaaaaaaaaaaattagctgggcttggttgctacatgcctgtagtcccagctgctagggaggttgaggtaggaggattgcttgagcctgggaggtcaaggttgcaatgagccaagattgcccccactgcactccagcctgggcagcagagtaagaccctgtctcaaaaaaatattattataattgaggtgaattaattgacatctatatttatgaaataactatgaataatacaagatggccacttgaaggtatgccctaagacaggggtctgcaaacttttcctgaagggaccagatagtacatattttaggcttgtgggatacacaaatttagtgctactactatctactatcttctgcctttgtagcacaaaagcagtgatagtcaatactgaatgcaaaaatatgtgcgtggctttgttccaataaaactttctttacaataaataaggatgggccatagtttgttgacccctgccctaataaattcattgacttggcctaattttaagaatcatataattttaataaaagtctgttaagtttctttatataatttgtaacatcagtaatatttttaagaaaaatgtaagtcatctgaaagtataacctaagtaaattttatttgatgatttgaatggaaatacatgatgattttttcttatatttgatttaaatatattgatctaaacctacctgttcttaccataagcctagctattataaaaattatacaataacttaatttttaaaaattattttccctagaatgtactggactcttggacaaatacctccttattattgaactttgggctaaatgactgcaaaataaatgtttggtcttgatttagctaagtgtcttcaaactacacaattctatatttctgtgagtgtcatatcatttgccggtaggactggtgcccttgtttgttgtgttgttttaaaactctctcattgagaatgtcacttctccaagtgatcatattctttttgaaagtcacttctagtttctatataaaaaatgtcttctaaaatcaataccagtgaaagttaatcagtgatataatgattacaggatgccttatttatcattggaaggctaagatggttatctctgtgatgatccttccatgtgatttgaaaggacagaggggtagctttttctggccatgccacttctaatttgtaaaatgcccccattataactcttatgtaagaaggcagcctgcctttattgccatatcctaaaaagattcgttagtattatgcccaagtgctcagtatttcaccagccctgctcccgtcttaaatttattatagattcgacattgtcataaagggcataattagaaaatcatctcacgtctcatctcattatgtaattgtgcataaggaaacaatcattttaaaatataaagaagaaagatttgggtcatgcagctgcttcctaaatgttatatttttatttccattgcgtctgtttttcctcattgaagtgcagagattactcatattgagatacaactatttttccgcaactgagtcttcaatgcctgctattttattagccccaaataagagatgattggaagtgtatcaatgcaagtggcaagtgagaatcagcaggttcattcttcataaacccttctgtagagcatgctcatgtttctggtaactggcttttctttctgctcctctttttgagtggttacagtggaagcaaccacatttttacaaggtgaccatatctcacccatagagatgaagacagaggtttgctcattacataagctgaattaatataagtccattctcaggattttaaagttggaactagaaaatattcacccactgaaactctgagctcttaagtaaaagtgatgcaaactcacaagctgttggcagaagttgttttctgatatgttgtttttaaaaatagaaatattattctaaaaagagagagaagaaggaagaatgaaacacacacagagagacagagttttgatatgaaaaatcaacgtcttgtttctctacagtgtttggatcagtggttccagttcaccccattactcagctggatctctgcctttgggttgtgtgagatagctgtgtatatgtttaataagctcacttttgctaaacttagttcaaatgggtttccataactttgaactgaaaaactaattgtgaagtttatttcatactctacacagcctttataatatagaatgtaaatataacgcctacgtaactgttctctcacaaagtttgatggtaaattattaaaaggaattaattactcatgagatactccccagagaaaaagaccacaaaaagttcatatgtatgtattaagttatttatttttaataatttttgggtcacttctgtgagccaggcaacagtgataagtaggcaacagtgaataaatacaaaagtgaatgtctagtttgttgggggagagatgtattaaccaaataattacccagattagcagatgattttaaaatgtggcaaatgctgtgaaggaggggtgagggacagtgagccaggtagaagaggctgtacgtgaaggccctatggcaaatgcaaacaaagcatttcggcattgataatcggaagggtttttggttttggttttggttttggttttccagaaagccatttattaattaggttggaaaagcattgtttctgtttcctgttcatcatatttagcttttatgtcagaagagcatttttgtttttgtttcaaatgtgtttcaagtcacctaaaaccctctgtccttaacattattcaagaaagtatgtaatgtacaatgttatttacaccatcgatttgtttaacgaactctctctttgtagtcaatgccaaagaaaatttcgtctcacgtatattcatggtttcctgatggattgaccagtaagttactgaagtcctacttagtgtgatgtgactgtggtggtgttccatcacattattctaagccattctcagccccatctaaccccggtggtattcagcaaaggcatacaagcccagaaccatgggaatgttcatctccatcagaattaataggaaaagacactttagtaactgtctttagtaagatacacttaggggagcagcgtgaagtaactctcttggactagcatccctctgttcttaaactgccaccaatgctactgtaacattgcagtcatattctaataaatggtgtcaagcatagaagagagaaaaattctacttttgtgacttctcctgatttctgagtgctgtatgcatgaactatttacctgtgtacacaaacagctgtacatttagttgccatggcaatgcttatctgttatctttacagggaacaaaatggtactttaaccacagttgactcatcccgtgaggtaaaattgataaagctgcctttcttaactttcagccagaatgcttcagttggcaaaagttggttgtttttgttcttcttaaagaaaggctacttgttgacaaaggcaggtttaacccccattctcaataattgatatagcctcgagcaaagatcaaagtttcctggatatcattgttataatttacacttagtaactggacaggagatattaataggatggccatcagagaaattgtgttttcctgacatgtgtcttcttggattacaggtaagtattggtgaatgcgtgacactgataactgctggtattattgatgagggactatcaatgatctgatgcatagggtgcccttgataagaaatctttattgttcatcagcatgttactgaaaagagtccagccaatgttaggtatgtgaggttaagaattccccagtcactatgcaacttggaaatagaaaggacaagtgattctaggacaaatgtgagaatccatgtatgtatttataggcatgatacccaggcagaattattaatatcctcccttgggctcccatagcactgtgtccatacttccatcatgacacttcacttcaaattaattttctttctatcccgttgggttactagctttttgaagtagatggcgctattatttttattgattatcaagtccgaagaaggaagagctcaatacatgcttgttgaataaagtctgctttgagaaagttatgctcattttgctttaatattctgcaagagatacaaagaaaagaaggaaggaaatctgagagctatcagttgactggatactcgaattggattacttttagggcaatgctcttggttgtgcctagacttgtaataatagctctgatttcaacttatctagaaaagcttaaagaaaatagtccaggactgagaaagctatttttcattttcttaaataattggcacctttgaaaggctccagaaactacagttttggaagcctctaggaataaagatttcttatttcctggacctggcatatagttttagtaaaggaaatgaattattctagatcccaaccaattgtcttcaatcaaataactccctgacagaaatgaggcaaaattttaatcactaatttaacctctgcaataaaattcctaagaaagaattttgtcaaaggcagagaaaaaaatctacagtatcaacactgaatatacaaagtgtactaaatgtttttaaatcaggaagtatgcatctttttatctttggtagtttttttttttaattaacaaaacttcaccatcaagactccactcaaattattgtaggttatcctagaagtttgagaaatacaaatgggataatatagaaaagattataaagtttgtattccatgagattttgcaatttactcttcattgatatagaaacaagtattgaaatctctaagctattcaagatagtaatatgtagtgtatttgggaaagtgaaattacagcacacaagcattatctcagtttaaaaagtaggtgtaggtggtgtgttgcatagcttaatgtttgtcttctgaagaaatgcatttagttcccattctttcttgataacctctatgttatcatatctaattctttgtgataaaatgcactctgttttagtttcatgaaccacagtcaattttgttttcctttgcaaacaaagaacgaaaagatcaaatctctctctgtgctagactgtggatctcttcctagcttgggtggccatcccaaagtcatttttgcatcttcctctcccactggcctgaaagagtcaactggaacccgttcaatgctgtttgtattcatcaacacttaatgtatcaggaggattttccaccttctttcctttaaaatattttattatacctaaatgagtatcttagtctgctcaggctgctataacaaaacaccacaaagtggataacctgtaaacaacagaaacttctttctcactgctctggaagctggaaagtcccagatcagtgtgccagcagattcagtgtctggtgaggatgtgcttcctcatagacagccctccctcacatggtgaagggagaagggatctctctcaagactcttttgtaagggtactaactgcctttatgaggacttcatccctatgacctaaccacctcccgaagactcccatctcctaaaaccagcgactctggagtgaggatttccacatatgaattttggggggacataaacatttagatcatagcaatgactatatagtaaaattctattaattcaggtttattgggagaaaggtggtttgaatttagtgggaaggacttcgttgctgtagatatctaaattcaaatcaccttattaagaattgtcaatacaactatttcactaccagtctcttattagaaatgaaacatttaatactccagagaaaatagtttctccagactttttttttttttttgagacagagtcttgctgtgtcacccaggctggagtgcagtggtgcaatctcggctcactgcaagctccacctcccgggttcacaccattctcctgcctcagcctcctgagtagctgggactacaggcgcccaccaccatgcccagctaattttttgtatttttagtagagacagggtttcaccctgttagccaggatggcctcgatctcctgacctcgtgatccgcccacctcggcctcccaaagcgctgggattacaggcgtgagccaccgcgcccagccctctccagacattatttaaatggataccacttttaaatatttaactgttctatcttttttgacatattaaatttgcattttgacttctaaaaatgtaaaatgtgcatcaaaattatacatttttggtttaaatatttgaatcataaatggccaatattgaaaatatgttttttcaatatattgaacatttattcaatatattcctgttctaagaatctgtatagtgatgggttaatacaagtaaatggaagcattagattgtgatctttaactaaacaggcactttttgtcattgtaattgccttgggactaatgtatgtgactgttacatttgtttccaacatgattttatttatttattatttgtatttattttttttccagctcttggttgtgcttagacttgtaataataactctgatttcaccttatctagaaaagtttcaccttatctatctagtttcactctgtcacccagactggagtgcagtggcacaattaggattcactgcggcctcaacctccatgggctcaggtgagcctcccatctcagcctccttggtagctgggactacatacgtgtgccaccatgcccagctatttttttctattttgtaattttttgtagacacagggttttgccatgttgcccaggctgggctcgaactcctgggttcgggcattctgcctgcctcggcccccacaaagttctgggattacaggcatgacccaccatacctggcctcaacatgattttatacctatttgaaaagacatgctatatgtcatagatattcagttaaaataaattagccgggcatggtgttgggcacctgtagtcccacctactcggaggctgaggcaggagaatcgcctgaacccgggaggcggagcttgcagtgagccaagattgtgccactgcactccagcctgggtgacacagcaagactctgtctcaaataataataataataaaatagttcagttgattacagctaattgaatcacacacacaaccacaaaactctattcaagtaatattcagtacaaaactaatggatacaaaaaggagaagatttagtattaagggtcagatagcactgccttgatctttccgagaaattataattattggcaactgaacttctaggtgttaattagtgtgacagaaaaatcaagccctttctcaccttactgtgactaattatatagttatatgagttttaatctcttcccattcaatctcaaaatggtgcctcaaacatgtatttcctcagaagcttaaggataaggcagatatagttttggttgtaacttttttttttttttgagacagagtctcactctgttgcccaggctggagtgcagtggcatgatctctgctcactgcaagctgcgcctcctgggttcacgccattctcctgcctcagcctcctgagtagctgggactacaggcgcccgccaccacaccctgctaatttttttgtattttcagtagagacggggtttcactgtgttagccaggatggtctcgatctcctgaccccgtgatccgcccacctcggcctcccaaagtgctgggattacaggcatgagccaccgcgtccggcctgtaactttcaataaactatttatttcactgaattctaggcttctgagggtgtatactgatatgtgggcagtggaaaaatacatataaaaattaaaatgttttatgttcataagatcataagaatgttattactctggtgatactgaagtccaatgaatctgaaatagcattcttaatcttatgctgacggtgtcttgttagctttgtcatctgtgtaggcaaggaggaacctcacggtcagtcacttcagcaaatctgagctttacgtgggtgatagtttcaggagtagaaaggaatcatgtcatttttttcactcttttccaaacctttatggtgatgtaatattgaacgaatttacagacactaatgattttatgtctgtcaatcctatctcacaaatatttgtctgctacatgatacccattcttaatgataacaccagcaagatacctaaccttcagaaatactctcaagctttgctactgggattgtatattagtaatatcatttttaaaaactgtcagtatctaataaggttgaacatatataattcatccttttctttcctaggtatatttccaacagaaacatatacaatatacacgagtatgttcatagtagcactattggtaataggccaaaatttttaactacctaaaggtccatcaacagtagaataaattgtgatacattcacataatggaataacttacagcaataaaaataaatgagttccgatttcacacaacaatatgagtgactctcacaaacataatattatgtgaaagaagccagaaaaaaagagtatataatatatgatttcatttacctaaatttccaaaacagtaaaattaatcaatattattagaaatcagaatagtacttacctttgctgagaagaggtggaatggaaacagaagagaagagcttctggcatgttgatctaatgttctatttctgaatctggttggtagttatgtgtgtatgttcagtttgtgacaatttatcgatatatatatacacacacacacacacacacacacacacacacacatatatatgatagattgaactcaaatatttaatttgtgcttatattagtttcccagggctgctgtaacaaattaccacaagctgggtggcttgaaacaacagaaatttattccctcacagtgctgatggccagaagtctgaaataaaagttttatcagggttgtttaattctggaggcttgtggagagaatctgttctatgcctgtattcctagcgtctagtgtctgtcagcaatctttgttattcattggcttatagatgtatcactccaatctttgccaccttttccacatgatcttccttcctgtgttctcttctcttctgtctctgataaggccactggccactggttttacccagcacccatctgggtaattgagatttttaacttaattatatccacaagggcgcttttttccaaataaggtcacattcacaggttcctgggtgacatgccattttgggggctactaattaatccactacagtgttccttccccaaaccccacagaaatcatgatagcggaaatataaaaatattgtacagacaagaagatttaagaagggttaaatacagatgagataggttcaagattttgaaagatcgtgagtcgatattacttgattcagcaaaatgcaggaattaaagttagttgccagtgcgaagcaactcaggcagtctcaggatctggagatacgaggtacttctggattcaggggtaaaggctggggcttaacatagtaaatttggttaacaatccacttaagaaagttaaagtcttagatcaatgtccccactctgggcatcaagtgaatataaccatcccatattgaggcagaaagaaaagataattacagctttataaaaaaaataaaacagagaggagtcaaagtggctctggactagtggacatgaagaattgctgagggagggtgagttactgtactcaaacaaggaagtaaagaagcagcctataattttaatggtgtagactccctcctaccacccctctatgcttatctaccaggaccctggcagttgggctcataccctagtcacgagattcttctcagcagaaaacactccaacccaagagaaaagacctgcctttggtgtgggtgtggtgatggtggtggtggcagggggtgtctccaaatgaaaatatcaaaacttccctgatctcataccctggagttcaattagcaatcaccatccttctgcacacaaagcttccattcagcttttcattacctcacttataaatagcagtggtcagccaagagttacaagatatttgaggaaagcttgcattgtaaaagacagagattttttaaaaatgagtgtacagataaaacgaactattagaaaataaaggctattcagggagatgaaaacttcaaaaaattacaatgaatattctcaaatacattaaagaagcactttataacatccagaatgctataaaaatgaacattgagggaactaataagaactcttgagagaataaaatattatggcataaatcccccagaaggtagaataaattatcaaagagatgacaagatttttttcaaaggaggattgatacaggaggtctggttaataggaattttgaatacctgaaaaaaatgagagaaatagagaagggggaaattatcaaataagtgatgcaagaaaaatttatttaattaataagcctggttttccatgtttaaagggttcaacaggtgaccagcaaaaggaaattaaggtaactgacatcaaggcatagtggccagaaatgttaggacaccaagggtaaagattctaaaaacttttccaaaggtgttagaggaaggtgatatacaatatgacacaaatcagagtaccactgacttctcaggagcaacacttgaagcaaaaatcaataaagtaatgtcttcaaagtttcgagagacaattactaattgcttttcacttataattctaaatctgaaagatcagatagatagaaattttcaggccaacaagttctcaaaaaacataactacaatgtatcatttcacaagaaagttctggaggttatatgttaccaaaatgagtgaataaactggcaaagaagagttgagaaccagacagcagggaacacattgataaaaaaatatattaattaaagagaaaacctcttgagagaaatgtgtggattataagcaacagagaaaacagaaacagaaatatatagaagaaaatcattttcagtgaattcaatcattagtaaatttagatgttaaatatgtaaatggatgcttccggaaaaaaaaaaaaacccaaaaactaaagatctctaaacaacttgctatatgtttctgccttttctatttctttgattgatatgccctttctccatcctcattgtaggtacgctagtcattcaaagactcatcttaaaatgtaatcccttcaaaaatataggaagatatccatatgtccttggttaaggagagctttcttagcatagacccaaaatacagcaataaaaatagaaattaaaatctgaccacattataatgttagtcttataacaaagtctaaagcaaaaaaaaaccataaacatgtttaagaggtaaatgacagagtgaaaaattaaatttccagtggataatatgacaaaaaatggtatgtaaaatctgtaaagttttctaagtcaacaggaaagatatcaaacgcaataaaataaactcgtgcaaaaaatggtcaaagttatagtattataattcacggaagataaaatccaattatgagaggatgttcaacttctacttttatcagtaaacaacaacttaaaacaatagtgagttcctatttttcgcccatcagattgacttttaaaatctgtttatcacgtgttagggaacatataaggaacgttttaatctcagatattgccagtaagagtatacatttgcacaaccatttttggaactatttagcaacagctcataaaattgaaaatctggatgccttattacaacattaatcatataatttattattcattctaggacacctttgaacatgaaagagagcactattaaaatgtatgccagaacaaaggcataaactggagttatcccaggccaatctcctatactgtcaccctctgtatgatccacttagtgtatagaacctagttagcttcttgtccatgtgtactatgtgtatgtaaagctactctttgtcacatagtttataacagcaaaaaaaattaggaacaggctgggcactgtggctcacgcctgtaatcccagcactttgggaggccgaggtgggtggatcacctgaggtcaggagttcgagaccagcctggccaacatggagaaaccccgtctctactaaaaatacaaaattagccggtggtacaaatacaaaatacaggtggcacatgcctgtaatacagctactcgggaggctgaggcaggagaatcgcttgaacccaggaggcagaggttgcggtgagctgagatggagccattgcacttcagcctgggcaacaagagggaaactccgtctcaaaaaaaaaaaaaaaaatttaggaacagtctgtcaaaaggaaactcaatagataaaatagataacacagaatagtaaataataaggaaaacagatgaactagatttctctgtatatcagtaccaatagacatccagtacacacacttaggtataaatagaaaattcaaaattccagaatattcattaacatatataacattatatatctcttatgttatatatataacatatatatatatatatatacacatcaaacattacatatgatgttaattgatgtgagtgcaagtataaaaatggaatggaagaatatacctccaatttataacagtggttgtctctggcaatttagaaaagatctggatgtggtttaaggagaattaagctatattaataacgtttaatttctttaaaaataatctgaagcaaatatgacagattttaaagttgatatatatgaattggagaaggtatatatgtatgttttaaatttttttgtatagtgattttttttctcaaagtaaaaacaaaataaatcctctttcacaaagctttccttgatctctttaagccaaacatctctgtgtgtcctctgtatgcctctaacactatagctctcataagaattaagctttctgcctatggagtttatctctcccattacattggaaaagcttaattgaaaaagcagtatctcatccccttttgtatctctccacagcacctgatcagatatctgttgcatagtaaatacccaataagattttattaaacacaatagcaaaggaatagaatggtgtacatagaaacacttgctctttttaggcaactctagaaaaatgttaaatttttcattttttcatgcttttcttcacacagcggacctatgtttgttttacacctatgttatgtttctattgacatacttttagaatgaatacttagaaaatatagtgctttgtaataatatacatggtcctagcatattggagatacaccagacaatctaattgctgaaccaaatgtaggctagcttggtgatcaaagggaattgttttgatttctcctgtctcatatatatctgttatttgtcctaatgctgagctctagactgctgaatgaacggtgacatttttcttggttactccattgtgccacctcacctccatttgtcactctagtaatgttaacatctgctgtcaacaccaattaacttttttttttttttttttttgagatggagtttcactccatcgcgtaggctggagtgcagtggcacaatctcggctcactgcaacccccgcctcccgggttcaagcgattctcctgcctcagcaattaacatttagtaaacaccttctgggtccatagtagaatgtcagttacttgctgctcatttaaagactagttgttaagcaaaacttgaatacagtatggcatttgctttgagtttattttttttaatttcaagtttcatggcttttgtttttccattctcataaataaaacatatgcttttattccttgacagttatcagagtttgttcagttgaacaatgcccaacttgcaaatgaatacttttgcaaatacatatggtggatatacaaatacatatgtgaattcatttggctctaatgtgaacttattgaatgtgctatgtcgagttatcttttatcaaaagaactgttagtaactgaggacatcaaaaaattatgcttgctcatacatacataaatgctatatttaggttttaatgctagcttttaaaatgtcttctttgcccgctacttacactaacaggatttccttgttcttgaaagtgaaatatatttttaagaacaggttttaaggccaggcgcggtggctcacgcctgtaatcccagcactttgggaggctgagacgggtagatcacaaggtcaggagatcgagaccatcctggctaacagggtgaaaccccgtctctactaaaaatacgaaacattagctgggcgtggtggtgggcgcctgtagtcccagctactcggtaggctgaggcaggagaatggcgtgaacccaggaggcggagcttgcagtgagccgagatcgggccattgcactccagcatgggcgacaaagcgagactccgtctcaaaaaaaaaaaaaaaacaggttttaaaaaaatttttagatttgttttttttgtttgtttgtttccagttttctctgctgtttcagacttaggactagacatgcctggctctaattgtcctcttagattgttatccagctttcctttgagacaatattttgcacaaagtgtgttctcttagctggttgattccagtgatggctggaatctatgcatagtgtggtgtttcacagttagacctgactagttatcctggcactttgaaacagttggtttcaggtacccttccacacatacatacaaaagatgtgctgatgatagcactgacttttcagagtggtcttttcatcataattaaaagttttttttttttttttttttttaaagcctgaatacacaatctgtgcatggctttgatgattctgtagttaagaagggcaggaacagccttggggaacacttactaacttggaatcatgaagaaagtcacaagcacctacagatgagcagaaaagcaagattatttcattcattttacgtccacaataccacagggactggctggtcagttacttgcgcatgttgtcaaagctaacctttaaagacagttcatctggctaaaaatcaaataccttatacccagagtattagatatgcatcagcgggtggccagggtcttaaggcaggaagtatattataggtggcctggtattttgcaggctcttctgagccagaagcattttttatcagaaaggttttggaaattatgctcagcccctggcatctttttggtcctctcttgatcgctagtccagctgttgaatgaaaagaaatgaagctgaagagacatcactgtggctacagctggtgttacggaggttggtgtcatgctacaagataacacacacatcatttttactcatgtggaaggctgccttgctgtgcatttccacggctgtcagaaagattgattcctgaaatactttgaaaaaatgctaagtactagctactttgggtgtttacccaggggcaccacagctgcctggcattgtagtatggcagctgaacagtaatcactgctatttctctgatttgtttgtgtctttgtcagcatctgagaggagggaggttcaatcccagagtggggccctcactccacagtgatctcattcagcccatggctttaaatactctctgcaatgctaatgactcccaaatttatgtctgtggccctgatgtcatccctgcatcccagactcatagatccggctgcctattaaatagcactgctttgatgtctatgaggtatctgaaatttaacataagcaaaaccaaatttctgatctgtccacccatatatgacccaacttatcatcccaccatcttcccacaggagtaaatggcaactccattcttgtggttgctccagccaaagccttgtgatcatccttgacccctcccttactttgtatcccacatcccaaggtatccaccttgaaagtggattcagtacatgaacacctctctactgctgctgtcttaatccaaaccaatgacaaatctcatctggacgattgtaattgcctcctaacatgtcaacctgcttccttttcccaatagtgtactttctcatggcagtaaaagggaatccttaaacacaaattacattacattatcttctgcttagaaatcaccagcggccagatgcagtggctcacacctgtaattccagcactttgggaggccaaggcaggaggattgcttgagcacaggattttgagatgagcctgggtcacaaagtgagaaccccatctcttaaaaaaaaaaaaattaaaaattagctaggcatggtggtacgcatctgtagtcccagctaatttggaggctgaggtggaagcatcagctgaacccaggagatcaaggctacagtgagtcacgatcgcgccactgcgctccagcctgggcaacagagtgagaccctgtctcaaaataaacaaacaaacaaacaaacaaacaaacaaacaaaggaaatcactagtgaatttcaatcccaaggttcaaaccacatctgtaaaaccataagcgatcagactgtctcatacttgtttgcttatccttctgttatttccttagccgatttccttaactcattcacctgcgtattcaatggccttttcatttctcttcgaatagtttccacctaagtgcctttgaacttgatcatctctatgactggaatgctcttctcccaggtgtttacatggcctggttcctcttttcatttaaagcccatgcccactcaaaggccatatctccttgtcagtaagatctttcctcaccagcctttataaaatatagcactgctcccaatggtctcttattctgctatattttcttaatggactttataatcctgatgtcttttcccactgagtgaaggctttgtttcgttcactgccagttctccagcaccaagaacagtgcctagtgcacaaagggctttgataagcatctgtggaaagtgcaaacattcacctgactcttctttctatctctatctccaccagctgtaaaactgtgcttagaatccctgaacattttattttaatgaaattacctctgcaatatctttagctcttcagtggaaaaatctttcaaaatccagggtctcatggagctcatgtctccatctctgacttaaatagtccatgaaacacatgattctggaaactgagattgtgaaaagcacatcttgctgcaccctccagtctttgtgtggtctctagcacttggtgccatagtgacagtgtctgggtagaacagatgtttttagtgatctgaaaatcactataaagaaaaggcatttcctacatcttggagagaaacttgaaagttcacaaacatgttaagtctaacaatttcttagacttgccatttgcttttatccactttcaggataaccgtaatgtttgcaactcatcttctgtgtctcccccaaataattcatgtttccttttcctccttgtcttatatttcaatgagtgagaagtgaggcatcttactcttattttgtattaaagccctgcgctaatatttctaacgttctcttttacgatttagtgagatttcagaagtgagagggatagttttgttctgttttccatgagttttctagttctttgagaggaagagggaccacgaaattcaatattagtgtttgtcataatactcagcaaaagccttgcctgtggtatacactcaataatgtctgttcatttgggttttaacttttttcaaatctcctcagtgttataattacctgtccttttcattagaaatccaaacctgattagcaattgtttttccagagaataagccacttgccttctctaatagtattggattggatatcaactaaggcatagcttcccaacggatgtgcagtggcacatgactgtactccacatggatttcaaatgtgctcagacaatgattcctgtaagctctcaggggcagctggaggctctagaccaatcatttctaaccacaagattgtgtattccagggtgctctacaaaaattataatttccattatgtgctacggcatgagaaatgttgagagttagtctagtccagtactgcctaactaaactatctgtgcagtcatggaaatgttctagatcttccttccaataaggtaaccacagtgcagctggaatttaaactctaaactatataaactattaggaaccaaagatgaaaaataagcacaattcagcaatttatcagactcgacaaatattaatttgaggtgttaacaacccacagtggtaccagcaggcagaaattaaattaatatatcactaacttgagaataaaggcatcaaaggaaacctcattttttaatgtggctaacattgttggatattagctggctgatgctagctatgtacgctttttctcttgttgtcttctttttgtttgacgatgtggcaaatgacagtgctgttgcctgaaaatggcttcaaagtcacacttgtatgtcttactgtattgggtttaggtgaattctggtgtctgtgttgttcttctaatggggcctggagcaatctaataatttgcatttgggtcctatagaccatatggtgtttatcacccacttctccatcttagatgatctgccagtcattgatgaggtgaaagctgtgtttggcagtgctttcatgctaggttaatcattgtggaattagctattgtttatagcactttttaatccaagcaagagtattctggagtctgtacatctgtaagtcaaaatttacaacctaacgtcgatttacaatgaggaaaagcaagttagataacatattgcatattcataaattactcctaagagataattagtacctggcctccacttcatgattcctctgtttgttagttcttatgatacaatggttgtggagatgcctatttgatcgtatttctcaaggagactctgatccagtgtgttccactgcctcattaacctctgccctcaaaatacaccaagtcaacctctgtttctttattcatgctgctccctctttctggaatggcccatcccacctttcttctcaggtacattttagccttacttatggaggcattgaaatctttaatattagtattaatgtacactagcatttatggaacacatttttttgtgtgtgtcaggcgtaatacccgccaccttaactaggtatttcacttaaacgtcacaacaggacttcaagatatattttttcaagatatatatgtttaatacctatctcataaatgaggaatctgagcttcaaatatgtgaagcaattttcataaaacaattttgtaatgaagtagagtaaggttttaagctaggacttcctgactctaaagtctttgttctttccattgcaaataaagaagacaaagaagtctattaaaggtatctaatgaaggaatctgttctccattaaccttgtactcacttgagacacagttgaaacacagtaaaacagctttgtagattgcttgcttggcttattgatttccaaatcctgttttctttttgctaccatcttacttcctgtgtcatagtggaaaccaacaaaagaattaattctttgtcaagtgtgtgaggaagagcatggtggaccagaagtcttggtccttcctgggcaaacagatacattgtcttctgcacctatacatgtccctcattcgtgaatttcgccctctgatttatatcctatctgttctatcttttaactaagaactgtgaaatcacccatatccaggactacatggctaatctttttattaaacattgtctatcatgtgtttttttttttgttttgttttcttttgtttttgtttttgagacacgtgctcactctgtcaaccaggctggagtgccgtggcatgatctcggttcactgcaacctccgcctcccatgttcaagtgattctcctgcctcagcctcctgagtagctgggactacaggcatgcgccaccttgcctggctaatttttgtatttttagtagagatgggatttcaccatggcagccaggctggtctcaaactgctgacctcaagcaatccttctgccttggcttccataaatgcagtgattacaggcaagagccaccacgcccagcctctgtcgtatgttgttgaattcttggtcatgcctattcaatcagagtgtaaattgcttgtgtgtagtatcttatttggtcttgccctatggcaccagctcaaatgctaggctaatcactggcagtttttacatattgttgattatgtgaatgattatcttcacattataactagacaaaaagagaagtaaaacaattagatattttccccagagatgagtgaaataactgaataaactaactcttgttcataaatttcttaaagaaggatgacaaatttatcttgtaaacatacaaataactggtacctaatatttttcagtggggtggagggtggagtaggatatcagaataggactctccagccattgtctccctgaagaaactttaatttgaacaactatccatgcatgaaaacatcttcaccagggctaaggaaatcaggtgagcaatcaaagcactaggttatagtgtaatgctaagaaaagacgcatcaaagagggcaagaaaaacagttttattacctctgtcacccctccacaaacccagtaagcatagcatggaaagagattctgtctgcttgggggaaagagagggaagtaagcataagactttgcctgctacaatgaaatctagcatcagtcagaattccatgaccactgactccaggctaaaacctatgtacggagcctttagaaccaacttggcacccgagaggagcctgtagcccctatgaaatggaatcaagttttggtctgcattgtggccagctgactacagtggccttgagctgtgaataacccacagtgataggcaggccttagtggctgtgggtttcaggcatgccccagggctgtgctagcctcagtggccacgggctttaggcacactccaatgctgcaccaacattggtgaccataggattctagccctatgccaagctcagcagccgcaaatccaatcttagtacagcataatttgcagtggtctagggcttagggaattccctagcactgcaatgactgtagtgctcaagggcataggaaccataccggacaaccttttcaaaatgtctggacaggcttactgctgaaagatgttttcagacaaaaccagattgtgaagggcctacttgttcagtgcacagacattgattcatgactacaaggaccaaaaataattaggaaaacatgacatcataaaatagacaaaataaggtgccattgactgaccttaaagagatggagatatatgaactacataacagaaaattcaaaatacctcctttaagggagatctacaaatgtcaagaaaataaagagaaataataaatttcaaggagtaaaacaataagtgaccagtacaataaatttaacagcaaaattgaaatgataataataaaatattcaacagaaaccctggaactgaaagatataaggaatgaaataataaatgcaacagagagaatcaacaaaagtattcatcaagaagaagaatctgtcacttgagaacaacttatttgaaaatatacggtaagatgagaaaaagaaaaaagaataaaatggaatgaagaaagcttactttggggatagtatcaaaaagaaaaagcaaattatgagtcactgacatttaagaggaaacaaaggaatataaagctatagaaagcttatttaaagaaagaaaagcagaaaactgtcaaatctgcagaaagatataaatatccagttacaggaaggtcaaaggtctccaatcagattcagtctaatcagatttaaataaaagccaagtcatattataattaactgttaaagatcaaagacaaagagaagattatatacacagcaagaaaaaaaaaaagaaaataaagggagtttcagtacacttagcagtagcagcacatttctcagcagaaaccttacagaccagaagagagtgggatattttcaaagtgattaaggaaaaacatgcccaccaaaaataccgtaccaagaaaagctgtccttcagaaatgaaggagagataaagacttcccaggcaaacaaaagtcaagggagttcttcaccaccagacctgtcttacaagaaatgccaaaggaacttcttcaagctgaaagaaaagaatgctagtgagtaacacaaaaacatttgaaggtataaaactcactggtacaagtaagtacaaagtcaaattaagaatactctaggccgagcgtggtggctcacacctgtaatcccagcactttgggaggctgaggtgggtggatcacctgaggtcaggagttcaagaccagccaggccaacatggcgaaacctcgtctctaccgaaaatacaaaaagtagctgggcgtggtggcacgcgactgtagtcccagctacttgggaggctgaggcaggagaattgcttgaacatgggaagcggaggttgcagtgagcgagatcatgccactgcactccagcctggtgacagagtgagactctgcctcaaaaaaaaaaaaaaaaaaatactctaatacggtaatgatggcgtgtaaattccttatatctttagtaagaaggttaaaatataaaaatactaaaaataataactacactaacttattatggtacatgtaatataaaaagatgtaaattgtgacatcaaaaattcaaaatatgagtgtgtgtggagttaaagtgaacaatttttttgtgtgtggtcgaagttaaattgttatcaatttaaaataacttataaaatgtttttgtaagcctcatggtaaccacaaagcaaaaaacttataatagatacactaaatgtaaaaagcaaggaatcaaaccatagtactaaagcaaatcacttaaccacaaaggtagacagtaaaagagaaataaattttaaaagcatttacaaaacagctcgaaaacagtgaaaataatggcagtagtaagtccttacctatcagtaactactgtgaattaaattgattaaattatccagtcaaagatatagagtggctgaatggattaaaaaacaagactcttctatatggtacctataaaaaaattcactttactggtaaggacacacagagactgaaagtgaaagtatgaaaaagatattgcatgtaaatagaaataaaaaacaataggagtagctatacttaaatcagataaaatagactttaagtcaaaagctatgaaaagagacaaagtcattatataatgataaaggggccaattcagcaagaggatgtaatgattatagacatatatgtacatcacattggagcacctaaatatacaaagaaaatagtaatagatctgaaaggagagaaagactgcaatacagtaacagtaggggcattcaacaacccactttcagcaatggaaagattatccaaacagaaaaatcattgaattgaaactgtactctagaccaagtggacctaacagacatatacagaacattccatccaacggatgcagaatacagatccttctcaactgcccatggagcatgattcaggatgggtcccatgttagaccacaaaacaggtgttatccagctttagaagactgaagtaatatcaagtatcttttcagaccatgatggtataaaactaggaataaataacaggaggaactttggaaaattcacaaatgcatgaaaattaaacaacatgcccctgaacaagcaattgatcaataaagaagttaaaaggaaaatttaaattttttaagacaaataaaaatggaaatacaacataccaaaagctatgagatatagcaaaaggagttctaataggaaagtttataacaataaatgcctatatcaaaaaagagaaaaatcttaaatagcctaaggttgcactgcaaggaactagaaaaacaagtagaaactcaacccaaaattagtagaaggaagggaataataaagatcagagcagaaaagagtaaaatggagatcagaaaaacaatacaagagatgaatgaagcaaaggctttttgaagacaaaatcaacaaacctttaactagattaagaagagagaatattcaaataaataaaatcagagatgaagaaagagacattacaacctagactgaagaaatgcaaaggatcataagagagtattatgaacaattatatgccaacaaattagataatctaggagaaatgaatatattcctggacaaatacaacctaccaacattgaattatgaagaaatagaaaacctgaacagaccaataacaagaaaattgaatcagtaatagaaagtctcccatcaaatagaagcccaggctttactgctgaattctaccaaatatttaaggaagtaataccaattcttctcaagctattacaaaaaattggagaggagggaatacctcctaaatcattctgtgaggccagcattacactgataccaaaaacagataaggacacaacaacaacagaaaactacaggccaatttccttgatgtttacacatgcaaaaattctcaacaaaataggagaaaaccaaattcaacaacacataaagatattatttacatgatcaattgagattcatcaaatggatacaaggatagttcgcatacacaaatcaataaacatgatacatcacattaacagaaggaaggataaagaccacataatcatttcaatagttgcagaaaaagcatttaataaaattcagtatcctttcaagataaaaactctcaacaaattaggtatagaaattaggtatagaaacagtgcacctcatgaccataaagaccatatgtgacaaacctacagctaacatcatgctgaatggggaaaagttgtaagcttttcctcaaagatctggaacaagatatggatgtccactttcactacttctattcaacatagtactagaaatcctagccagagcaattaggcaagggaaagaaataaagggtatccaaatggaaaaggaagatactaaacttttcatgtttgcagagacatgatcttatatatatagaaaaccctgaagagtccaccaaaaaactttagaactaataaacaagttcagtaaagtggcaagatataaaatcagcatataataattagtaacatttctatacactaacagcaaactatctgaaaaagaaatattattttaaaatctttatttctagtagctacaaaaatgtaaaatacctatgaatacatttaaccaagagggaaaaccatctctacactgaaaactgtagccgttttacattttacagaatcttgatgaaataaactgaagaagacacagataaatgaagaatatttgtattcacaaactggaagaataaatactgttacaatgtccatactactcaaagtgatctacagagtcaatgcaatctctatcaaaatacccatgacactttccacagaaatagaacaaagaatccaataggttttataaactgcaaaagacacaaaagagccaatgcaatcttgagcaaaaagaacaatgctggaggcatcacactacctgacttcaaaatgtactgtgatgcaatagtaaccaaaatagcatgatactggcataaaaacatagaccaatgaagcagaatgaagagcccagaaataaatctacacatttacagctaactcattttttttttttcaaaaactgccaagaatacacaatggggaaaaagcagtctcttcaataaatggttttgggaaaactggatagccacatgcagaaaaatgaaattagactattatatctcactctatacaaaaatcaattcaaaatggattaaagacaaaggtaagacccacaagtgtaaaactattagaagagaacatagggggaaaactccatgacactgttttgggcaatgattttttggatgtgacttcaaaaacagaggcaacaagagcaaaaaaaatagacaaatggaattttatcaaactaagaagcttctgcacagcaaaagaaaaaatcaatagaataaaagcagcctatagaatgaaagaaaatatttgcaaactatacatctgataagggattaatatacaaaatatataaggaattcaaacaactcaatagaaaaaagtcaaataacccattaaaaatgggcaatagacaggtatagacatttctcaaaagaaaacatacaaatagccaacaggtacgtcaaaaaatgttcaccatcactaatcatcagggaaatgcaaatcatgaccacagtgagctatcacctcactcctattagaatggctattgtcaaaaaaaaaaaaagataagttttggttagattgtggagaaaaggaaacccttgtgcactattggtgagaatgtgaattagtgcagccattatggagacagtatggaggttcttaaacaaattaaaaatagagccataatatgatccagtaattccactcctcggtatatatccaaagaaaacgaagtgagtatgtcagaaacatatgcacttctatgtatattgcagcattattcaccatagccaaagtatggaatcaacctaagcatccatcaatggataaatggataaataaaatgtatatagatacacaatgaaatactgtttagccaaaaaaaaataagaaatcttgtcatttgcaacaacatagatgaatctggaaggcataagtttaagtgaaagatcccaggcacaatatgacaagtactacatgatcacactgacgtatggaatctaaaaaactcatctcaaaaaggtagaactttgagtgatggataccagaggctggggtggctgggatgggagtgttggggaaatgttaggcaaaggatatataattatagttagatagaaggaataggttcaagtgatctattgtgcagcatgatgactatcattgatgacagtacattgtattcttgacaaatgcagagactggatgttaggtgctttcaccacaaaaatgacaactacgtgaggtaatgcacttgttgattagttagatttaaccattctacaatggatatatacttcaaaatatcatgttgtacatgatagatacatacaatgttatctgtcaatttaatttgaaaaagaaagaatgagaaaagatacttttcaaagagtattaatagtcatttttctgaattcctgtagtgtattttcaagatgaataagttttctaaagtaactgaagcatatctcattagccatcaaaaattatttttaatggcagtttttaatgtagatcttcagaaaaaaagcacacaattactgccttttaaaatagaatgcatgaaatacaattaaatctttccttgactagtcaaatcaaaaaatttttttggaatatcttctgttttacctgttatgaaaaacactaaaatccagggaaataaaagtttagaaatttattcttagtgcgtttacaatctcaatggaaagttaaatgtgtagaaggaaaagttacaatctggcctcttaaaggcgggacagaggtaaacagattgtgtttaagagtcccagaattagtaaagtttaacctacaagttgacatctgtggtagtcatggaaggatgggttaggatttaagaaggagggatacggaaggatgggttaggatttaaggagggatacagcattctagaagaaaaggaggggcattctaaatgattccaagaaagtggtaaattggggaaatggtaaaatgttcagtgtgcttgattagtagcagcttgagaatagttccagactttacaggagcatgaaaaaaattcaattcggatcacattactttcttgcttacaaaccattgttctgctgttactgagtaaaagtcttagcttgttaaaatgcaaaaaatgtgagcaagcccagccaagatgagcaaagccacatgcttgacctgcagttaaccacagatacataagggagtaaaacaaagatcattcaagcctggccctgatcagttatcttggagacctatgaccaataataagtgaccattattttaagctactaagatttgggatattttgtaactcagtagtatttcactgatgaattgtattagtgcttttctattcttctaccctaaagtaaaaatgtctttgctacttatcacattcaaagaaatgtggagctgtaatagaaacaaattttgccaggcaaataggaccatggtattgctttgggctggcatagatgcaattccatgtaattccatttcttgttataaacttggctctaactgtacaatgtatacttcagtatatggacagatgtagatgtagatactgtgtataggtatgcactatttatacctctcaaaaatttaccaaagtcttcatatccatagcactgatattttttaaattaactcttgttagtatggacaattttagctataatattcacaaacgtagagagaataacataatgaaaccctatgtacttatcaccaagctttagtaatttctaacattttgcatgtgttgttgtttgtaacaggcttttgttttgttttatttttgtttttgttttcctttcttttgacaacatgagtggtgttcaatgctactaagaacaaatttgcagatttttcctgcaatgcttgaaatgattaacctctgtttgttgccaagtaactcttgggtacgtactgatagcaaaagtaatataagaatattcacagcatagttaaatttggatagcaagtattatttaaagggtgcctgatattattgcttataggcatgtttttctttcttgtacctcttatttttggtagtaatcatgtttttaatgacttgtgatagacttgttttatgaaacaatagaaaatcaccataggacctctttagtaagcttttagagtgttgaagctacttgaaatcttctctggtgggagattattatttgctaaataattgtttgcataaactgactcctccaacagtgttagttaaatgaatcataacaattagtataaacagagaaaagtaatgatgatctaggcaagtaacttataggtgttctgtttgttgaacaaaagaatgaatggaaaattagggctcttatttatttatttatttatttatttatttatttatttattttttggctgtatccaggatagaataaataaaatgtttgttttcagtctgccttcacctatacttcttggtaagaaaggaaggatgaaaggaaatggtggattgagggaggatgagaggaagaaggaaaaaagaaaggaagtgagagaggctaattatctggaggttttttttaaaagcagtaatgccaccaaattaaagtagcttttcaatttaatgcacaatatttatattactattatattggcatttcagggtgccaagtgtaaagaggttatcttagatgcacagaatatcaaaaaaaacctgtgctatcatctcccagtgcagcctaatcattgacagaggtcaagaaagttaaagcaagtgctgaagttgaatatattaatatacaaaaatatagtatttgtattagtctgttctcatgctgctaataaagacacacccaagactgggtaatttataaagaaaaagagatttaatggactcacaattccaaatggctcaggaggcctcacaatcatggcagaaggcaaaggagaagcaaagtaacatcttacatggtagcaggcaagaaagcttgtgtagaggaactcccatttataaaaccagtagatgtcgtgagacttattcaccatcacaagaacagcatgggaaagacctgcccccatgattcaattgcctcccactgggtccctcctcccacgacatgtgggaattatgggagctacaattcaagatgagatttggtgggggacacagccaaaccatatcagtatcattacccataaagacacagatcaccaatgaaatttaattcatctagagaaatgcattgtagtagtactaaagttatttggttaactttatgttcctatattttatgcaaatacgaatttttttataagatttgggctgttataaaatgtcattctaaagaacatctctaatattttatgtaattactacaaaaattaaaaatagttttatatttataaaccttgaatttcagtggaggccatgcttattaaaattcactttctttttggttacagcattaaaggggcttctagaatgcttaccttttttcagtccactatcataatgagagcctcaaattgtatgtcatcattgggtcatgtaatcattaaagagttctacttatgagagccaataacagacatgaccctttcttctagtctgttcaggcaagcagatcaaacctcttcaaatcctacagtaaaagtttcactattgtcaaatatagcttagtcctaatgaagtacattaaatttacacaaaactttctgtccttgtttccaaacttcatctaaataagtttctcccacctccctcccacagcattgctcataatcaggaaaaatatggtgtctagtagaaaccatgttggaaaacacaaatgtgaaaaagcaatctacaggctgggcctggtgactcttgcctgtaatcccagcacttttggaggccgaggtgggtggatcacctgaggacaggagttcgagaccagcctggccaacatggcgaaaccaggtctctactaaaaatgcaaaagttatccaggcgtggtggtgggcgcctgtagtcccagctactcaggaggctgaggcaggagaattgcttgaacccgggagacggaggttgcagttagctgagatcatgccactgcactccagcgtgggtgacagtctccaaaaaaaaaaaaaaaaaaaaaaaagcaaactaccgaaatagaaaatatttgaagtatgtgaccattaaaattagaagaggtaggtttgaattctggcttctgtcctcactggacatttgtttttgaagtttctatgtctgttcctttgtagcaaactgacagttttaaataaagtaacgtaaccgcacaccccaaaacataagtgttaattttccctactgcacaccccaaaccacacaccccaaaacatgttaattttccctatgcatatgcttacttgtgatcttatatttatgttcttgtatcttataagccttaaatttatgctgagagttctagccaacaacacatctacttaatgttttgtcagtgaaattaagcagagggtgttatgtcaatatttaatgatagattgatatattgcatgggctactttgtttttaatccttggccagggccgttaaatatttattgacagttaccaaaaaaaatggtttttaggctaacttctttttgtaaatatatgttcagtaattgccaataacttccatactaactgaagtatattagtatataggaagctgttgctatgaaataactgtaatatttcaaaaactaaatgttttttatttcaatagttttgggggaacaggtggtgtttggttacatgggtatggtctttagtggtgatttctgagattttggtgcacccatcacccgagcagtgtatactgaacccaatgtgtagtctttaatcccgcactcccctcccatccttcccccaactccccagagtccattatgtcattcttatgcatttgtgtcctcatatcttagctcccacttataagtgagaacgtacaatgtttggttttctattactgagttacttcacttggaataatggtcttcaactccatccagggtgctgtgaatgccattatttcattcctttttatggctgagtaggtatttcattttatatatatatatatatttatacaccacattttctttatccactcattggttgataggtatgtaggctagttccatatttttgcagttgtgaattgtgtcataagctaaatgtttggaaatacattggaattatttctgaagttccggaatggctttgctattctacattaggtggtttattgaatatttttagagaagaacctcttgattttcagttgtttgtgtggggagaagagatggtggtggtggtcattcttcatatggggatttggaagatgaaagagtaggttactcattctttatatggattttcatcagtccttctcattttggccttgcatctcttccccgtaccctatcatacctgatctttctgggtactaagcctgtacaaggtttctaaacccttcatggcttccttcatggctgtggtccactctatgacagcccaggctgcagtttccaccactatgtatcaacagctccatgttaacaatagctttctgtctaccagaaaattgaactttcctgaccatttctgtttgaaatataggtaataaaaccacttttaatatgtggttatcatagggcagaatttttcaacctcggaattattgagcactattaacatctagggccagataattcttgcgtttgtctttcctgtgcatcgtaagatctttagcagcgtccattgtcaagtaacaccccctaccaattgtgacgatctcagttgagaaccactgtcataaaaccatgccaatgagtaatcatgcaggactgtgtatcacaaacagaataccaagaaatgtaaataccttctgcagaagcgcaagcatatgtaaaccaactcaatataatctggaaggtcattaaattacattatactatactttagaaatataatgtctttgtgatatcctgagacaagcagattatttaaaatgttctgactttcgcagtgacattgtgccttttttgtgttccaaaattttcttttgataagcatttctaaataacttgggatttatcctttttcatttatgaaggccttttatctgctaatagaaagaagaaaaaaagatatgctatgatcattttgcatactgcctcattgctagagatgctttccctcacaggatacataatttcttggaatagactattgttcctagaagataattagtgactgttttttttttttttttttggttttttgcctgtcaatagaagtgaaaacagtagttggcatgctcacctacttgattatagctattacatcaatcagcatccttttcctatgcttcatcatcatttatctcaataattatatattgtttcatttttctcaccattttttctttagcattaactatacacaaatttatttaaaatggctgaaattagtcatgcaatcagttggaattcatcctcacaacatttatgcaaaatctactgcagtaattgttttaaaagtgaaatttaaaaatattgaaccacctttatttattctacatctagtcgtactctcttttgtttaccctccatgtttttctccactcatttggtcagaatcagggtttagtgggtggttaaatgtgttctgggatctgccgtgagtcttggtgcatcaaacagggctgaagacaatgaaagctgtggcataaaggacaaatgtagaaggtgaaaaacgaatagagaccctgaaccttaacattatctccatgttgaccacggtttcctttggtattcttgagtaattctatgacgaaaataatgaatagagtattttcattgtttcttttaccttggaggtttatcaagatgttggacagcaacgaaatgtaaattccgtaactcatgtgttaggacactacttcataataaatattttttaatgagaaaaaactaaatcatgattatatccaatttgccagttaaatatgttccacacatcagtgaactaaggaagtgctggagaattgttcttagtaacttggataagcaggaccccgattgtattagtcaaaaaataaatttgggtgtatactttttattgatgtgtcatagttatacacattttggggtgtatgtgatattttgatgaatgtaggcaatgtgtaatgatcaaatcagggtaatggggatagccctcatctcaaatatttaccaattctttatgttggtgggaacattacaattcttctcttctagctattatgatatatgcaataaagtattcctaattataattttcctgctgtacaatagagtactagaatttattccttctatctaactatatttttgtacatgttaatcaacttctcttcaactgcccaaagcaattgacacattcattgcaatccctatcaaagtactaatgtcatttttcacagaagtagaaaaaaaatcctaaaattcatatggaacgaaatggagcccaaggagccaaagcaatcctaatcagaaagaacaaagttggaggcatcacactacttgagttcaaattgtactacacagcaacagtaaccaatacagaatggaactggcacaaaaacaaacacatacaccaatggaacgaaatagagttgttatgaccaaccattctattctctaccttcataagattgacttgttttgctctcacatatgagtgagaaaatgtgatatttttctttccgtgcctggcttatttcacgtaatataatgactttccatctatcttgctgcaaatgacagattttcatactattttattgctgaatagtattccaatgtgtacatatgccacattttctttttattattttgaggaaactccatagagttttccacaatggcagtactactttacgtttccaccaacagtgtacaggcattcacttttctctgcagcctctccaacatttgttattttttgtctttttgataataaatagcatttctagctgggctgaaatttctcttcgtggtttttgtttgtgtttttgtttttggtttgtttttgaaacggagttttgctcttgttgcccaggctagagtgcaatggcgcgatctcagctcactgcaacctccgccttccgggttcaagcgattctcctacctcagcctcccaagtagctggtattacagctatttgtggttttaatttgcatttctctgatgaagatttttgctgttgagttgtttgagctctttatatattctacttactaatcccgtgtgtattagttcattcttgaattcatataaggaactacctgagactaggtaatttatgaagaaaagaggtttaattgactcacagttctgcaggctgtgcaggaagcatggctagggaggcctcagggaattcacaatcaggcagaagtgaagaagaagcaggcacatcttcatatggcagagcaggagagagacagcgaagggggaagtgctacacacttttaaacaaccagatctcctgcgaactcactcactatcatgagaacagcaagagggaagtccgcccccatgatccagtcacctcccacaaggcccctcctccaacattgaggattacaattcgacatgagatttggatggggatgcagagccaaaccatatcaccttgtcaggtagatcatttgcagataatttcttccattttgtaggttgtctcttcactttgttaactgtttcctttgctgtgcaaaagctttgtagcctaatgtaatctcaattatctgtttttgcattggttgcctgtgcttttgaggtcttaaccaaaaaatctttgctcagagcaatgtcccctagcatatccccaatgtttttgtctagtagttttatactttcaagtcttatatttaagtctttaatccattttgagtttatttttgtatatggtaaaagatgggtatctacttttctgaatatgaatatccatgtttcccacaccatttattaaagagactatcctttccccaatgtatgttcctggtgcctttgtaaaaaatgagttggctgtaagtgcatgggtttgcttctgggctctctattctgttccattggtgtatgtgtttgtttttgtgccagtaccattctgtattggttactattgctttgtagtacaatttgaactcaagtagtgtgatgcctccaactttgttctttctgattaggattgctttggctccttgggctctatttcgttccatatgaattttaggatcttttttctacttctgtgaaaaatgacattagtactttgatagggattgcaatgaatctgtcaattgctttgggcagtatggtcattttaatgatattaattcttccaatgtatgatatgagtgtgggatgtcttttcatttgtgtacatcctcttcaactttcttcatcagtgttttatagttttccttgtagagatctttcatctccttggttaaacttattcataggtattctattttttgtgctattgtaaaggggatttctttctgagctagttaattatttgtgtatagaaatgctactaatttttgtatgttgattattatcctgcaacttcactgaattcatttatcaaatctaagagttttttggtggagtttttagatttttctatgtataagatcgtgtcatcagcaagtaaggataatttgacttctttctttcaaatttgaatgccatgtatttctttctattgcctaattgtttttacaaagacttgcagtactatgttgaatacaagtggtaaaagtggacatctttgtcttgttccagatctgagtggaaaggctttcagtgtttccctattcagtaagtgaaggatagtagagattagccagagcttatctcataataaatgactatgacattagcctaaaatatgaaactttccaagaccacttccctttgggggatcacaaggagatgagtcatcagtcactgccttacatttttgaaatataaatcaacattgaatagtaaaattagccttatggataaaaagaggtgactaaactgatttataaaaacttgtctctggataattaatccaccctaaacttgcttctcttatgttgtctccacatatggttaaatggtaccaccattcatgtgtttgctcaagctcataactagggatcatgccccttaactcatgaacattcgtttataattcacatctagtcagtcagtaaattttgttagttctacttaccaaatagatacttaagggaaaaaaattctaccacttccaccaccaacactgtgccgtcgcctttcagtggactgcctcaacatcttcctccctgccttcctgcctccattctgcctctctgcctccacaccacttcattctcccagacttgaacaccaaaatgccagagtgatacctctggtacaaatgctacttggggctctcttatttttaaaactctccaaagcattcctcttatacttaaaataaaacccaagtcctttccatgttctacaaggcccttcctgcattggccagtggctatctttgaattcattgtcactctttttttacatcattatagatacagtggcattctttgccctctcttaagcatgccaagtatactccatctcagcacctttgaacttgctcttccctctgcctggcataaacatcctccaggttttgctatgactcacttcctcccttctcacagatatgttccaaatgatcatcagagcaagctttcctgacagttttttctaaaatagcatttacattagtctctatctctttagctgctttaattttcatagtacttataatcacctggcattatattgtgtgtgtatcaatttatatgattattttgcatctccttctctggaatgcaggcttcatgaaagcagaagttttgtctgtcttgttcactattatagcccctagtacctggtagagaggaaatattttaaaaatattttttgaatgaataaatgaatatttttatagtttaattacaaaccacacttatcaaattaaatgaacaaaatactaagtatcaaagctagccaaatgaattccttggctttcctaaatacatgtcttttgatggatatattatgagttacttccttggaagtatttgttctgtctccttggcatgactcttaagttaccttgtatatgttgttagtttagtcatcaactgacctccccgcacctttctgttcagttgcttagtcactcctcactctttgaggctcctgaggctccatgactccgtggttagtcaccacaattatttgcaacagaaaggagaaatgttgccaaccccaaagcattagagataagtgaaaaatagagcacccctttcaccccaagtggattcacctagtaaatgttgatgttttcttctgtccatttccttcttctgcaaggaccatgagattgtgtttacattctacagctctcacaagatgtatgctccaatattagaaactaatgtttaaacattccaggccaaagaaagcaaaactgaaattccactcttgagtcattcagaggttgaagcattatgggtgatccaagttcccctgactatctgtgaacacaggcagttgtttgtcaattcttttaagttaaaaaaaaatgcacaaacaacctattgtaaaatggagtgagtcagtgcaattgcacaaagcatgttttattgtcagctgtataaatctgtgaatatttttcgtgaccagttttagttggtggatttaaatgaggtcaccaaaaagttatctctgagtatagcactcgccacagtgcatcataaatatgctctcatctatgaacatccttatgaatgactctatgtcttactcattcttttatctctaaattagtactgactattttaggtccttcataaatgcttttgaaattggattatggaggtatttataattatctagattataagctctttcaggactaaatgctatgttttgtttacatttgatccccttatagtcctgtacattgccttgcatatttaaaagtctttagaatatttttgttgaattgatttgttaagtatagatcaatccccctgctatggaaactaatgtggaaagtgttaatgattcttaaatcagggtctaaaccccttttgatcctttggttggatgtccagttcattatttcacaaatagtaatatttttcttgtcaggctatataggctgctaaatgctattatcccaaactttgatggatataattagaacagatttattttccgtctactatatgcaggaacttaatctgttttcctattaaatcctcacgacaattcatgcaggaagactatgtcacattctccatataaaaagactgagactaagagatgttaagtaatttatccaacttgccaaacaaataaggcagaatcaggaactgttagacctgtttccttgaacactaactgtgtgaaatctttcctactctaccacaatgcttctaagaaacaaagtgggccgggcgcggtggctcacgcctgtaatcccagcactttgggaggccgaggcaggcggatcacgaggtcaggagatcgagaccagcctgactaacgcggtgaaaccccgtctctactaaaaatacaaaaaattagccaggcatggtggcgggtacctgtattcccagctactcgggaggctgaggtaggagaatggcatgaacccaggaggcagagcttgcagtgagcggagatcgcgccactgcactccggcctgggcaacagagcgagactccgtctcaaaaaaaaaaaaaaaaaaaagtgaagggaactagttaaaatacattatgaaaattatatatgactttgaaagaaacattttatggtaggataagtatagatatccaaaatgtatcgaatattctcaatagtatttgagggattagtatgtgaaggattaaaattaacttttaaaggcgtgattgttcaacagagaaagatacatgtattatagacacctcacatttctctccacgttaagaactttaaaaagactcaagaatcttggcctctttaccctggtgttgtcatatttgttttaggaagatagtgttttactttttaccgttccatagctcaagtgtaaaagggatggggaaaagagggagaggctgtatccctttatgaatactcaggaaaagttaatatagatagggaatcaatcctgtacacatcttcatgtgttctgacttctagatgtttctctaactggtagctagtaagaaaaattagtgtccttaaaatgttccttctattatgcagaagctttgtcaactgagacattaataactctgtaagagaggtctgttattatttaaatgtctatagagctttaccgttgttaataggatgttctgaagaataaaatgaggtcttgaaaatacttttgttggtgaatacaaagctatgtttaatgcaaaattagtgagagaaaaatctctactataattgctgtgggtttttgtggacaaaatatgattaggatttaaaattaccctgtgcttcatatcattactgttacactttgtttagttttcaaagtgatttccatttgtgagtgagtgtgcatatgtgtgtataggtgttttcaaggaagagagaaatgtcttcgtaacacaagttgttttcttaactataaaaagccagttggcttagtcatggtctaatgctaagaacgtttcttttaaaattgtaatttgtttgaatttccttctagtttcacctttgccagtgcagaaaataaagagggtttttgtggttgtgtgtatgttcatcttgattggccattaccatagctgcatttgttttccagttctgtgttctgtcaatttaatccaactaatatttatgaaataccataatgttccagaaacattcaaataatggaaaattcagctcatattcttcctttgtgactttgtgacagcaaaattggtcaccctcaagtgactgtagaactgagctacatcttagctttagcagtcacctccttttcacagtcattttgccaatgtgtcaaatcagtggctcagccattgtggtctctggaagtttcccttcacttctatcaaagacaggcaaatcacatgagaaatgtatccaactgatacccatgataataccaaaacatgacacttacagatgatgacagattgcatggcaagagctctctgccgtaggttatgattatttagttgcatgtttccagtcttgtaacagattgcacacaccttgaggggagactgcacagacccatgcaatatttgcttgacagaattttccaaggagcacataacaaagaatggggaggaaaagatctaggaaggattctagtttgaatttgctctgttatttttggcaagccttttgatctttttgtacctcagatccttgatctctaaaataatagagttgaatcagtccagtttttttttaagttattaatattttttattaaattaaaatttatttttaaatttttattaaagttttttaactacaaagcaccgtaaggtataaggacagaaactaaagatattccaaaccctgtatcataatatctggcacattattctgtttaatatatatcagttgaattgaattggatttgtttggtcaacatcttgggtgaaatactgatgtataaggtaaaataaaagcagaactaattttgtcaaagaggaatgggtggcacaacaaggcagggaactgagcccagtgggcacccccaaactccacctactcagaggggcatggtgaaaatcataccatgttagagaacacagtttccaaatcaaagaacttaataaccgtgtaattcttcctggcttcaacattctataattccatgactgagctttaaagaattcctttactaacatctagtttgccacatgaaagtaatatgaaagatgttaaggatgttgtaacattatgccgtcaagtgggtggtgggttatgatggagaaccacaaaaccgttttgtatttctgaacaaatgtactgcatacgggttttattatctttctctgtagatctttattttttgccttactgcaaactaatgtggtatgcgtttgaacagggaacagttctctcaggtgctttctgtaaaaaactgtcaagtcgtctacttgtaactacatagtcacaagattatataaactgacataatttactgaatacaacacttatttagataccatagttgcttttgaaattcactgaaaccatttgataaccagagtctaagaaatgtagatttccaacctattaatggcaaactattttgccaatatttagtgaatataagctgattatttaggcagtagaaaaataaaatccattaagatcactttaggcaggaaataagagtattaaagattaatcagagtgatatcatatctttgagaagaatttcaaagcgattgatctcatcctattacccaaactttcctttgccctttatttctgtcctcttgttaaatagtaataaagatgaatggataattattccatgagctatgaacaaaagctatcaatcatatatgaggttgttcttccaaactaaaactcaaaactcattccttttattctctgacttggggcatgtcattcctttgtacttaatgtgttttcctttaaaaagaagaggaggcaagctgctaaagcttgaattcttgaaccctctggtgataagtatatgtggccaactcttggcaattctgcctagattagccttccagttatcaaccaagctggcatgtcctcttggcaaggaagaaagaaagccctcaaagcaaaaacatttagtttagcaatccttaaatgataatttatatacttgatacagagtagaaatttcggtgacaggtttcaagggacctaggcaattcgatgagagagggcagggcagagtgaggaggctagatgaaggagagctgactaactaaagtccagatatagtctagtttagctaggaatgaagtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatggtattacagcactgtcttacaaggtttgaattggttttcaaacagacactatggaacaatttgatttataatatctattaataggttaagatgcaatttctgaaatttaggggaaagggttcaaatttattaaaataaatgtcaccattatggttaaaaaacattttaagtgtaatcaaatataatataaattttgctagttatattttggataatctattaataaaatatgaccaagtgacttttggttaagggactagcagatttgggacataaggctatagacaaaatatgtattgaaaaaatgtacaattatatacgaatcagaattctgacttatcttagaggttcatctagaaattttgagtttgatttagctatattcagttatactaaattatgaaaaatttccctcttaattataaatatatacatagcaattctgttatattctcttaggtcttattttatttgaaatgtagtatgcaggcatatgccataaactttggcagaagagtttttgtttgtagtggtgcattataaaaggttatcaaaaatatgaatttaaatgaatatccatgtttgttaaggaatttcttcttagattaatcatacaagagtgaaaatgcatgtactgtatataactaaaaagaatcagtataccatcccttaagttattaatgttattcttattcctggagtgagaatttgcatcaaaattgtaaattcattttccaaatgaagattacagatgtgataatctttactaataacatacccaaagttatagtacacaaagatatgatgatggttttagcacctataaaattattgtggtcaatggctttctagcacttgaaatgcttatatttgctaagtttaaagcatgaacatacaggatttatacaagtcagggtgttaatatctttctttgattcaagccttttgaattaatgtcatataaatgcaagtagtattataattgctgttattttgagatggaaggttacagatagcattgaaacagtgccacatatgaagcaaataggtgtactcaaattttatcatgcactttatgcatgccatggcatccttaattacactagaacttattgctacattatgaatacatttttatttataaattcccataagtagccatgctcatactgatctttcaataattcataggaagatgtatttctaaggagttatataaaactattaaacattttgggccgagaatggagggttttatggtaccagttactataatgaacatagtaaaaatgaaattaattgtacgcctttgcttgacaatataatgaaaagaattttatggttgattgttgcccattgggtttctttttactgtccttgaatttgtaataagtcagattgttctctacctcttactacactgttttacaaaatagaataattggtaaagctgtatttaaagctttaccttctcttgaacaaagtcacaaagactaaccacagcaaattaaaaatatggaaatttcttaagcaaattggaagtgactatacattcatttgaagaaatatgggcatgtctgttactaaaatgcttcaaaaaatactcttaaatcctttattgtcactcaaaaaggagcatgaggtctctttaaccactgactaaactagtggattattttaagcaacttttattttgttgtgttttatgattttggttcatagtgtacagataagtcgtttactagttagagaaattcaaccttaatctttggatttgtgagcaacagttgatttgaagtaactaccttaatagtattcttgctactttgctagcattgctagtaagtaggtgaatcaaaaagggtaagtgaaaataggaaagaatattaaagacaaaaaaggcttgagatgaggtgtctaaaatatacgttttttccaaaatatgtatttggacttttcattttcttaaggatttaatttttgccctttccatatttgacaaaactgcctattcaacaggttcaaaatatgatataaatcctaagagggactgagtgaagagtcacgggttgggagtaaagagggtggcctgcgcccatgatggggaacttataacctactctgttgaaaaccttcaacagaattttacggtccaagtattcagaggtttgcctccacttgttcccaaattgagagttgacctcagagggataaccaaactcttgtaagagttacgttataagaaaaatcatcaggaattacacaaagctaagcttgtacatgtctggtgacctaacttgagcatcctagttaagttacacacgtatccaatcaaccctagtaactgtgtgtccatagattctctagtttgctcacaaatatatgtaattcattaataatgaactttgatataatcaggaagtgcatggatttgctcttcatcttcaaattcattttctctgccatttgctagccgtgcctacctttcccattttctatatttctgtattttcttgtgtcctgttcttctaattcctccatcttttcaaactggaaagggtttgatagtggtcatttaaattcttttattgtagaaagaaagcaaaaagcactaaaagcaaagtacttaggaaaaaatcatataatggaaactaaattcatataaaatatgtaaattgtcggctttgaatttgaatcaatacgtggtcacaacctggcatttccattttaagtggcaactgtatgttatttctaaatgtaaaaaaaagaacactgtccatttacataactttcaggcatcagcaaatatgtgaatagcacttttttgggcaaaaggcccagaaatttcactgtacagttctggaagtcaatctgggaggtgagcctgagtattttttcaggctactatagtcaagagaatcaaaagacagccacaattgtcttgctaaacctgagccctgaggatgtcattcagagatgtggcctgcctgttacggccaggagcccactttcagaaccgtccaggacagagagcatattctatcgctaccagactttcaaagagtagaaatccaccctacccttgacctaatggtacaaattatattttacaactcagaattcactgaaaattatcattaattacttacctagatatgtgtatcactttatttaaatgtcagtgttgtctttaaaataattataaaggttaatggtagaaattttggggaaatagagagaagaatctttttcttacactctacattataaacgcattctgctcctattaaatattctcacaaaatatccttttaatggccgatgtgaatgtcatataatttcatatatattgctggaaatttgaattcttcacatttttgttattataaataatgtgatggtctttacctatacactttccctctgactctatagttatctcaacagaacaaattcctaaaagtaaaaatactgggtaaaaagaaataattttgttaaaggttcttagtacatattttcagaattcttaccagagaagttgtataaactcccaccagaagtatgtaataagtataaatactacttaatctttaacaaaattaataaaagtatatctttataacataaaactcttaaagatctctttgatactaaaatcacctctctctcctctcttttacctctttttctctcttcactcattaagtacaagtggatgctctttgagtttatccgtatttgaaagatctagcccatttaggtaaatgtctacccttgagaaaatatacaaacctaatcgaatgtctataatctctatccattttcttctcttgctcatcctaatgctcagctaggaccttcctccagattctatgtttcttaataaagtgcccagtaatttcgtgatgtactgtgggcacatggaatgtcaataaatactaactgacaataagttcttcacagcacaaaggacacacacctctaaattttctgcaagagaatataatgtgtagactgaactgtgtaagctgcccaaccgtgctcttatttttctttactaatttattctcattgttaagcttgttaaaaagcaagcactttttgtatctgagtgggtaataaggattcaccagatattcacatctggaggaaaatggttggggacataaagaaacttcagatttttaaacatagatcttagtaaaaggatacacattttatccaatatatgcaattttatccagtttaactataggctacttaaaataaaatgtcacactagaaattaattagcactccttggcttgttccaccatactgtagttgcagaattttagatttggaatagaccaaaggaaaatgtccatacattttattacagatcataattgaccacaccttttctgaatagttactactctgtgttagtaaacttgggaaatctttttgtttcctctctagggtgagaaaatacttaatataaatatcctagaaacaacattatttaggtgttgaatttgataccgaattctgaaagtgtcatgtaatactgttgagtctaaacattattgttttgctgagttgtacaagtgatgtaaatatgacagttcccagagataggaaagtcagtatcggccagattttctcatctacattcacgctactggttgtcataagcaaatgtaaggccattgatttgattttaccggatcatagagcatataaaggacatattttcaccaacaaactcaaattaaaaaaccgtaaaacttccctttctactacgagaaaaacaataatatcccaagtccaagctttttatggaaaatgtggttctttttgcccatttaagaaagacataccaatcagcatatttctagtgcctgaaataaacctgttagacataaattaaaccttttggacaaatagacatcgtaattaaaccatggaaagataaataaagactggtattataattatttaaactatggcattcaattctactcaatccaaatttatcatcccaaggtaaatgaaagtggtaactcttaacagctctcttagtctgtcttgcttttgaaaccaaaaagcaccctaaaaattgtgactgacctaaaaaggaatacttgtcataccactatttcagttattatcgtatatcattaaacagatgataaatcaataaatggaaactagtattcgtattttgaggtcattgtatgacctaacttacatgattctctcagattctcaaattcagtcactttttggtgacagagaggagaaataggtttggaaaaaaatacaactgcatgtttgctttaaaaactgctatctacgtagaagttgaaattcctttttatgttttaagtggtcagggccagtcacggtagctcactcctggtatcccagcactttgggaggctgaggcaggcaaatcccttgagctcaggaatttgagatcagcctggtcaatatagtgagacctcatctctacaaatatacaaaaattagcttggtgtgttggcatgcgcctgtagtcccagctacttgggaggctgaggtaggaggatcacttgggccgaggtgattgaagctgcagtgagccatgattgtgccactgcgctccagcctcggtgacagagcgagaccttgtctccaaaaataaaaaaaagttttaagtggtcaagccctagttctaggacaggtttgcaatcccataaaaaagatggacgtgaaggtaagaacagttccagtgggccaatgatatccaaaagtttggaagtcagttaaagcacttttttaaaaaaacttttattttaggttcaggggcacatttgtaggtttgttatataagtaaacttgtgtcacaggagtttgttgtatagattattttgtgacccagctgctagtacccaatagttatttttttcttctctctctctctcctcccaccttccaccctcaggtaggccccagtgtgtgttgttcctctctttgtgtccatgtgttctcatcatttagttcccacttataagtgagaacatgcagtatttggttttctgttcctgcattagtttgctaaagataatggactccagctccatccatgttcctgcaaaggacatgatctcattctttttatggccgcatggcattctgtagtgtatatgtaccactttttaaaaaaatcgaatctgctattgatggacatttagactgattctatgtctttgttcttgtgaacagtgctgcaatgaacatatgcattcatgtgtctttatgatagaaggatttatattcctttgggtatatatccagtaatgggattgctgggtcaaatggtagttctgtttttagctctttgtaaacagacaacctacagaatgggagaaagtatttgcaaactatgtatctgacaaaaaaggtctcatatccagcatctataacgaatttaaacaaatttacaatgaagcacttgttaaagtctttaaaaactgggacagagacaagtgagttttcttgttcacttactttccaaaagggccagaagggaaagaagaagaaagaaaaggcccaagaaagagtgctgtcacagagcaatgcagagagtccatttaagcttccaactcctggtctagtccccacgctggacactgacacatattatgcagattactcttttgctgcagcactaagagtactattttatttgttatcagtcagttaagaagctatataggtataaatctttgcaattctaaatgaagaactttaggaggtggagggggtctggaagttatcaggtcaaacctttttctttcttttttttcctttttttgagacagagtcttgctctgtctgcccaggctggagtgcagtggcgccatctcggctcactgcagcctccgcctcctgggttcaagggattctcctgcctcagcctcccgagtagctgggattacaggcatccgccaccatgcccagctaaagtttgtatttttagtagagacggggtttcaccatgttggccaggctggtcttgaactcctgatctcgtgatctacccaccttggcctcccaaagtgctgggattacaggcgtgagccaccacacccggttaaacctttttcatttattgatgagaaaatggagactcaaaatggctacatgttttttacataaaaaatttacaaaagcttgttattgccattatcatcatcctcatgatcatcatattatcactgttagtgtttttgttgttataattaagaggcagtgtacagtagtggctcccagttgaaatctcacacaggcctatgtgacagtttagctccaccatttacttctagtgtgaccttgaacaaccagctttcagtttcctaatcaataaaaaaggtaccaagatagtactgcttctatggaggtaatgtgagtatttgatcggataatgcatgtaaaaattaatagattacttggcatatattaagtagtcaatacatgtttgctgttagtatttgagacatttgaatgctgtaaaagagtactgtatatagaagattcttgaaatgcattttgaatgtcaatgcttatttgatcatgcttatattcttactacagtatcatactatggcagcagatacagccttcattacaggataaataagattttagaaaatttatttccatctcccctttaaggattcaatatgcatactaaatttttgtatttcaatgaaactttttaattatagaaattattgattttagattacttaattcatcaagtctagccaaatgcatatagtaagtacatagttataacagaagaaaactatctctattcttatttaaagaaaatgataatttaaaggacactatgccacatgaatttataaatgaccatcaagacaaaaataagagtaaaaaaatttctcttttgtaaacagaggaaattcaggtataatatttttaaaaacaagagacctggaaaataattttccaccattatgcctgtcaagttcttcatgaaggttttgatgatagtcatatcattttatacaaaaaaatgctgcttttcccctgacaaacactgttatcacaaagctttctaagtcattcttaatgattgaagtttactagcatataaaaatacagtcagtattgtatgttaacaagaactactcctgaatttgcaaagtaaatgccaatttatcagaaataaacctatcaaagaacattacgttgtagaatattgaaagaggttttagaataagagtatgcactgcatgactgatgtccattaaaatagaaactataaaaagacccacatcatttaaagtttgaatataaagagatacattcacccataaatttcctctcaaatttcagctaaataactaaggatttctaaattatatgcagactctccatgaaaaataactagtgcttcaataagattatgaaaataggttaccagtattttatgctttcatgttaaaacacttagcattcctgtcaaaccttactttatcaacttagtatattcccacagatttgtgggtaaattgaatcatcatcatttcagagaagtgttcccttcatttttgattgattttcgattagcagtggcttaacatgtcaggtttaagaggctctgtcccccattctcttttaagcagctaatgatcaatgaaagatttatatgcataaaggaaatatgctatttaaagaaactctgtggtgaataattttatataagaacccttttgtaactgaatgatcacccccataagttttccctgtggtaatgcagatttttacatttttgtaagatgaggttcatcgatatgaaactgcaagttgcatctccaactgatccagaaaaaggatcatccacccattaccatgtgtgacctcccgttgtttattaatggaaacaaatgtcctcattgtgactttctgcctcctctgaggaaatattacattttactcaccagcttcagaatcaacagtatttggttttaatctaattctttgaaaatatattttgtagggtagaatagttaagtaaccagaatatctcatgtccaattatgacaaaatagtttattttcataagggatatgctttgaacgccatcctactaccttatctgccttggttttgttgaaatataccctagtaggataactgcccatggtgtcacttgtttttctataactgtgatgagagttcttatttccaggtttaaaaggaacatcttgtattttgattcttctaaaatttgtatgactctcattttatcattctggcagtcacttctttttatcttaatgtattcatatatgtttaataatttcttttaaatataaaagtatgtacaatgccacttgatttgcagctttatgaatgaggctattaccaaaatgtacttaaacatgtgctccgaaacatgccagatatttacatgagtccaatacatagagtgtccataaggctttaaaacctaagccccatagcaaaacttcatgaagaggcttccttccaattcaccacacacaagttcaacactactttttttttttttttttttttttttttttttgagaaggagtctcgctgtgtcgcccaggctggatgcagtggcgcgatctcggctcaccacaagctccgcctcccgggttcacgccattctcctgcctcagcttcccgagtagctgggactagaggcacccgccaccacgcctggctaattttgtgtgtgtgtgtgtgtgtgtttttagtagacacggggtcccaccatgttagccaggatggtctcgatctcctgacctcgtgatctgcccgcctctgcctcccaaagtcctgggattacaggcgtgagccaccgcgcccggccaacactatttttttagaaatgccaaggatctttatttaattttgtaataaaaatttataaaatctcattataacatatactaattgaattatgaaaggaaaacaatcttgatttaaaaatttttgttttccaaaattaatctgttttaaaataagtcttggcttcatggtcttgtgagaagatacctcccaccgctagatctggtctacaacaagcatgacaaaaagccaggaagttgcttaagagtccaagagagtgaataattttctctcccttccacttctccccagtgaggctaccgactttctcactctctgagtgtttgtttctagtttagtaaaagcagagtacccaccttggacttgcctgttgaagaacttttatagaatggcggctctttgagtaggaaaaaagcaaagcagaatgcattgcttttctggaaaaataaaactgagtgcatcctgtcacatcaagccatcactaggaacaggatacttaacaatacggcaggtcctaggaaaatttgagattattaccacgaatattcagtaagaagccattaccattatgtgaaatagcttagggaaagttcagaaaacaaaatattttttattttctcttcttaaaagaaaaaaatgtaatgtttccgatgaacctgtatttctgatgatgatcatgtcaattatcttggcaactttaagacttcttaattaaatgattaaaagttgttactactttctgtaaatgtacctgtttttgactgaaatatttggggtgcaattagactagttttatgcactctgcttattgtatagcctatttataagtagtatgaatatttctttcagaattacatatcacatacaatattgattaaaagacttaaacaagatattgttcttaggcataaatataatttgttttttaaatcaggttcaccatattcaacatgaatgtaatttgtaatgattattattttaaaaaaaaccctgtctctatttaccataaataatatgttgtcactccaatgctctttattaggacttgctactaattacagagtgagaataaggtttttatgtaatgggagctaaataaaatgagtgaatcttatattagatgaatacatgagatttcagcctcaggagaaattgtgtgtcacagagaacatcggtgactattatgaaagacatgttcagtcaagagggaatcgtactgttgactatcaacagggcagaaagtactggattgtattttctttcagtcactatgtgcatgacctaaaatagagaactgaggcaatatatacataatttagaagggaaataatccagaaattttatttttgtctcaaatagatggctctttcaagcaaaggttaatttggggatttttttttgaggggtcaacttcctatgtctaagcaatttaaacttgaagaatcacaggatttaatacttcatagttagagctctggtcataagtgacaaatcacttaaaagacaggagtggtgctggccttaagaaggattggaataatgctcgactgttctctgtctttcttctctactctttctgcatgtcatcattttgtataggggtggagagtggtgggtctgggtgagtagaggagggcatacagggtgaaggaatacgttgctcagttcttctaaccaggaggaaatgtgggtttggaactttagtgagaacttgaagttccctaaggagaaatcctaattggcctagaatgagatacagatctaaattttggacggatcactatggcattagaggtgaggggcattggctcagtggctgttgtgtgtctctctctcctgtgatgaagcctgtatttttgtgtgagtacgtagatgtggcagttggtgggtgggtggggaggctggtaatggggcttttaacagacaaagataggggaaaaagcaatggttattatggagtccatcttttcatattccatattcaatatttgtttaacatccctggttaatccatctcattaatttagctgtcatctttattatgcctcttcattaacttagtgagggtagaatgacccatcctgattgatgcatttgaatgcagtctctcttgggctgaaaactcttccattgctcttctcccaactaatactgacatcctttcctgtgtatctgtagtgcatacgtctcaactctagacctgcattcatctctctgctgtctctaagcctgcagagtatgttctcttccagccttaaacctaaaccaaatggcagattcttagctgttaaatacatttttaggaaaaaattaatatgctttctagagctagagaatggattataaaatcaacttcacgtaatatgaataagtaaagtgaggccagatgtaatgctataaaggagaatggagaccatgctgaagtggggaaaacattttctacctataaaattttaaatttattgttaataccatcttggccaaataaaacttgtctagtgggtagttttagtccagtggcctgagtgtctgatgtcttgattggtaaatcgagagtttatactacgaaatactgctgcactgtggagccggtaggctctggattcagaatggctatcacgaaatatgaatctgttccatcatattatagattggaacatgacataatatgatttgtaatgtgtttggagtaactaataaaatctcttacccaagaagcaaggagtttagagcagcatagttaattatgaaaggagaatctccccatcaggcgatacaaaaatcatagagttagaatgaaatgggcaaattctctttagcaatctggccccacaaaaaagtagctatgtctattttgtcattacagacttgttaagttaacaaaagtagaaatgtctgttaactctcccagcagacattttcatttactcttctctgcacatttccactggatatatgtttgttcctaaggtcctttactcaaggctaggcattacctaatttacttgtgaaaatgtgccaagaaaaggatcagtgattattcttgcttcattatttaaagcctactttcatgaatgtaatgcagtcatcattcctatgtattgtcatcagagtcgagagttgggacgacagagagtagaaatcctataacaggcattagaatttttagtagataataccaaaaattgaagcagagtcagtatgtcagactctaagtttggcttggtaaaaaatcctctttgtaaattaaaaaaaaaaattaccagactgccagcttaaaaatattatgtgtttccaaatagatgagaaatgtttgaggtgataaatattccaattactctgatttgatcattacacattatatgcatatatcaaaatatcacacatacccctattagtatgtacaattattgcgtattaataaaaaggaaaaacatttgatgcaaatataattcttgtgtatgtgtggtcttaattgatattcttttaaccaagcttactgagatatttatattgagtaaactatatcgtgttcagggtaaaaatgtatatgttatgtgtctgcctgttatctagaagataaaggccactttcttcacagtctgaccccattttgtctttatagtctcatgcactctcctcttaagcccacgccactgaccaggcacccttgaccataccatggacctacataactctatcatttgtacatgctatgcccaccacctgaaatttcctctcctgcctttttcccttgtgcctatctactcaaattttaagaccaacctcaatgtcaccccaatgaactcttccctgactctactcccactaggcagaattaaataccacctctcaattgctagcaaatctctttttcacacctttattagaacatttctctcatcatttttgtacatatttttgtgtgtctatttctcttgttgcatttcggactcttagagcatgtactataatgttttcatctttacatccctgatatgtaggacagtatctgatgcacagaaataaataattcatttagcattcactcagctttaatagtcataaataaaaaccaacatacatatgtcactcttcttttagtagcatatactgcagagtaatggagtaaaccacgctaaaactgttggttttgatttaattgcctggtgtgattgaagattccccttcatggatgagagagacagatagagaaaggcctaggagtctggctagggaagtctagcaataagtcaaatcccgattagacagaggaggaaagatcagatggatattgaaggtcacaacagagcagtaggttgagtttggataaataaataggggttgaaagaacagttatatatcagttcagctagaagactggtcaagggtagagacttttcactggcgtcttgagtttcaggcagatctctaaatttagtaaagtagactccacaatcttagggccctgaatgagaaattggttcgctagttccatttatgactttattactgggcacaaggtctggtcaaatccacataggtggctaggtaggtagataggtagatgaatagatagatagatagcttaacaaacagacgactgtctacaaggagtttatgttataatctcggttaacctctggatgttccttgttccccaagacgccaagacttcctgtctttcctcacagtttcagtcatgaatgtcagctctcgttctaatgagctttttaatcacacagtcgtgatccagtaggtacagctttccttgattagtgatcttaatttatctttgctttgagagtaccttacatctgcaagacatttaagtatgttgtctcatttcatcttttcaacagcctgtgatgtctattttgcctccattttacagataatgatcaaagcttatgtgtggcacttgttgtgacacttctatacattagtgtattgaatgtgattacctgttttgctcctttgttgagttctaattgtgcacaacatgcaatactcccttaaatccataaccttcctgtaatatttaaaatggtctattcttacagactacttgagttctgttttcttccactgttaagagagtctatgtctcatcaagtagaacatctagtaataattccattgaatataaacttgtctttgaaatgtttctgtattatccagttcaggttgctaaaacaaaatgcctttatactattgcttccaaatcttaactattggaaacagtgccgcaacaaacataggagtgtagatatctattacagcataactgggttattattgttaataaaaacattttaaaataacttaaagagtgtaattggattgtttgtaactcaaaggataaatgcttgaggggatggataccctattctccatgatgtgcatatttcacagtgcatgctgtatcaaaacatctcatgtatcctataaatacatacacctactatgtacccacaaaaattttaaaaaactgaaaaatgccttatcctgattgatttataaaccacagaaattaatttctcacagttctggaggatggaagttccaagatcaaggcgccagcagatttggtgcctggccagggttctctgcttcatggatgatgccttctagctgagtcttcccatagtggaggaagcaaagcagctctctaacccctcttttataagggcattaatcccattcacaaaagcagagccctcatcacctccgaaaggcttctaataccttcgtcacctgctgataccatcagcttggtgattaggtttcaatatgtgaattgggtggggggatgaaaatattcagattacagcggtttctcaggtttttggttttgggttttgttttttgtttttctattcagttgcatgtctcttgaatctgcttctgttcatctttgcctcctattttctcattcccattttttttgtacttctgctctttcaagtacattttaagagacacttttcttctttcactgatcttcgagcatgaagttcttttcaaggcacttaggaaaatggaagtacttaggacattcatgaacagaatgtctcgagagctgcaaaagttaacgtgagaaaagctgatagaaaagttgcctagttcatcagagttttactctttaaaaagcagcaagttataatcccttcttaaatagcaagcaaaagcaagtggtctcatttcacttcttgaaatagacaaagtgaaactaataattgacttgtcaatttactacgactattaattccctgcacgcaaagttggacttcgttaatttaggattcacgttttctttctgaatataattatctgactatatacagaaaggtagtttgaagccagctagttattgtttgagcatttaaagttaaaaactatgtagacattagtaaatatccatttagaaaacctgtaacaactggatcaaaattaatcttaactgagaagttaaatttgacttacgatatttttatgacatttacagtgcatcttgctcatggcttgtaaatatatgttaactttaaagaacttgccaggagtggtggctcacgcctgtaatgccagcactttgggaggccgaggtgggcagatcacctgaggtcaggagtttgagagcagcctggccaacatggtgaaaccccatcttgactaaaaatacaaaaattaggcacgcatggtggtgggcacctgtaatcccagctactcgggaggctgagacaggacaatcacttgataccgggatgcagaggctgcagtgagccgagatcgtgccactccactccagcctgggtgacagagcaagcctccatatcaaaaaataaataaatcatgaacttggtaaggtttatgtagaaatagaggtgcttttattatgtaaatgtttgctgtattaacttaggaacataatttgcaatttttcctaaaggctgacatttaccaggtgtgaggtttcataaacactagtatcagaaaaacatttccagttgtgaaaatgattataagaacagaagtattggccaggtgcggtggctcacacctgtaatcccagcactttgggaggccgaggtgggtggatcatgaggtcaggagttcgagaccggcctggccaacatactgaaaccccgtctctactaaaaatacaaaaattagtcaggcatggtggtgggtgcctgtaatcccagctactcaggaggctgaggcaggagaatcacttgaacctgggaggcggaggttgcagtgagccaagatcatgccattgcaccccagcctgggcaatagagtgagactccgtctcaaaaaaaaaaaagaaagaaagaaaagaaaagaagtatagtcacaaggtgagcatgttattttaaacttcaatgacttaaaaaatataagtattgattttaattgcacgatagcataatattgaaaataagagagaaactgactttattctagtctgtgagaacaggttctcagtggggagataagactaagattctcatagtttattgaaataatgatcaattcaattatcaaatgcaggatagcattttgtattcagtttaataatccatcagcttttcaaataacatgttttaattgttttaatattatagattattttcactcttaaagtatcattttccaaataaagaagtatcatgatataagccattgggtagtggtcttgccactgactaattgagaatctcagtggtctgaggattttaatttccaactgtctatggcaatgattcttcactaggaatggacatgataaatacctgtagagcttttacaaaacatatgcacctagtttccttgatcccctgcctccccccacccccctaaagatttatttatttatttatttatttatttatttatttatttagagactgagtctcgctctgtcgcccaggctgcagtgcagtggtgcgatctcagctcactgcaagctccgcctcccgggttcacgccagtctcctgcctcagcctcccgagtagctgggactacaggcgcccgccaccacgcccagctaattttttgtatttttagtacagacggggtttcaccatgttagccaggatggtctcgattctcctgacctcgtgatccgtccacctcggcctcccaaagtgctgggatcacaggcatgagccaccgtgcccagcctaaagtttaatttattacatctggaagggaagctgagcaaggtctgcaaattttgaaaattcagagaaatacacatcaaatctacagtgagatatcacctcactctaattagaatggctactataaaaaaaaaaaacaaaagataacaaatgttggtgaggatatggagaataaacccttccatactgctggtggcaatgtaaattcatacggtcattaggaaaaacagtatggaagttcctccaaaaataaaaaatagaactatgatatgttccaagaatcctactactggatagctatccaaaagaaattgaatcagtaatttgaagagatatctgcacccccatgtttattgcagcgctatccacaatagcctggatatggaatcaacttaaatgttcatcagtggatgattgggtaatgaaaatatgttgtatatacacaatgaaatactattccatcatgaaaagaatgaaattctgtcatttgcagcaacataaatgaacattggggacattgtgttaagtgaaataagccaggcacagaacaacaaacaccgcatgatctcactcacacgtgaaatctaaaaggttgttctcatggaagtagggagtagaatagtgtttaccagaggatggagagggtaggaagatggggaggggtggcgagagattggtcaattgggtacaaagctatagttagattgaaggaataagttctggtggtctgttgcatagtagaatgactagcattaaaaagaatgtatatttcaaaatagctcgaagagaggtttttgagtgttctcataaaaaagaaatgatatttaaagtgatagatatgctaattaccctgatttgattattacacaatttacacatatatggaaacatcatgttgtgtcccataagtatgtctaatcatgtgtgaaccactataggaaaaaaaacctctgacctggtgggtttgatgttttcttagtcattatcatgatctctctatattctagagctctttgctctccatgtgagggagctaacagacctttctgggtgatctcatcagaaaggctgttagtgccaagaaaggaagactttataactcaggcacagagagtcccagtgaggctctgaagatcttttcaagtggaagcttgtatgacaggacactacactggggaatgagggtgggagtgaggtggagaaagaaggcacttctcagagcatagtaaaaatttagcaacaatttgagtcacttaccttactaaaaagttatctttatatctatgttagttttctgtggctggtgtaataaattacttgatggcttaaaacaacagaaatttattctcacagttctggtggccagaagtctgaaattaagggctgaaacccctcaggaggttctaggagagaatctttgcctcttccaaggtctatggctgtctacattatttgtcttgcggccgcaccagtccaacctctgcctgtgatcaacattgcctcctcatcttctctgtttttctttcccttccatctgtctcagctcttcctctgccttttctttaaggtcgcttgtcattgaatttagagcccacttggataattgaaattgatctctttatttcaagaagcttaacttaattatatctgccaagaccctttttccaaataaggtaaaaaattttacagtttctggagttgtaaaacatggttatatcttttgtgggggtgaggcgggcacgattgaacccactatagtatctgtcacatgctctgctacattcacaaaaactgatacttagtaaaagttcatgagattataaacagtgaagtatcaacaagacccctcattcaataattatcagggttgcttctctctctctctctctctctctctctgtgtgtgtctgtgtgtgtgtgtttgtgtgttctgtgttcatgtgtgttgtgctttgtggtcttttttttttttcacttgaagagtattcccatttagcccttgaagttaccaaatggggaagacattaccaaaaactatccattaacataagagttttgtggagcacaataagtaaagcaaagggaaacatccctctaaccctttcccagcaagaaaaaacaagataatcctggtagttccgagaaagcaaagaaagttagctctaactctttgtagtgaattttacagtattcagttgttctcgtacatttgtcaagagttgattcacctgcaatagaaaaggatgtctgtttacaagtggatcaatgattatatctactaatggaaaatggtagattgttcccaaagtcttcacaaataaaatctcggagataatatatctttctccgttagtagacacatcgtagtatctaaccataatgattacaggcataccttttttaaactatgggggcagtcacagtgctcagcattgcaggttttaaccttcatcagcagagtcagatattaaaaagcttatttcacgttgtatgcctgtatcaaaacatctcaggtagcctataaatataacacctactgtgtgttcacaaaaataaaaaataaaagttctcaatgtattaataagaaatcatgcatttatcaagcacttgttcaatgtttgtttgaaagtggtaggtaaataccaaaatgaatgcactgtatgagtttagggatgaagagcttatttcaaaagctcggtcaagcaaggcctaatggtgaaaatgttatgtgaactctaccttaattaaggtgtaggatttaagcagacattgatgaagtattaatagaaagacattgctgaaagaccagcattaggagaggcagagatgacagaacatatgttggcttttggagtgggcaactgttgtagccaactgaagaaattcagccaactgaactgatgaaaaatagtgctggaaaaaatagtgtagacacattacgaatttagatacactttcaatggaatatatcacaatggaatgtgtgtatgtatatacatatatattctgttgaaagtttcaatttcttatacaattaggaaagaaagagagcccaattaataaggtagtctcataatacattgtagaatgaataagaggaagtaggagccagaggtcagagagccaactgggaaactaattgtctaggcaaaaagtaatagagtaggatttgcaaaaggtcagagttgagggaaattgactttcagagaagtataaatcttattgttgtgtagactaatgctaagtaaagttgacagataggagtcaaagaaagtagattttaattatggttgagtgggaggaaggtgatatcaataataagaaaaagaatgttgtaaagaggagcaacatttgtgggaaatatgttgagtcaaactgtggttacacgacgatagtacattctgacaagtctctcccacaactggaaatatgtacagagctttagtgaggtattcgggctggacttgtatttgagagattctcttaaagaagtaacaaaggaagtcagatatttattgatgggaaggataacttactttctcatttgatctcagtattattggaataattaagcatactaattcctgaatttcttattttcctcttgaggacaggaaatgtgttttatttacctctgagtaatcagctgatagattgtcttcaaaaagttcctcttgaattactagagtttaggttgccgtgtttctgagattatcttactttttcaagtttaatggaatttaaaaaaaaatttactatatttactgttgtatcctgaaaacaaaagtatttctatgagttttactgtaatcctattatcatctcactgcttaatctttcaggtttccaaatacttttaaaatttactttaattgtttttaaatgtaatgagatgttattttaaaaactgttgattatttctacaaatgtgtcatgtccattaaaagtcactcattcataagtatatattatcaagttaatgtactagcgagacatcataaattatgcttcatctttctgctgttaattcacattattctccttctatccagggaaagaaggtactatatatacatgttattaaaatatttagaatctttgaataatttaaacaacattttaaataacagaatatggaagaaaatagaaaaaaagttaattgattcaatattttttttcaacaatttcttttaaatatatagacaaacccatacttggcatttatttggaactgtgtctgtttgcatttaaatttttgtgacctgcttaccaattttaggttttgtattgttttcttcttcctttatttatctttccatgctatattgattcctgagtgtttgagggacttccattttccagctcatttaagtgcatttcatcctgctgtgttggtcatcagcaagacacgaaaatggtactgaaatggccacataatgcaatgtgatttgaaacgaaggggaattgcacttgtctgttgggcaaggaatatttatcctgggttgctcgatgtatttagaaagtcaagagttatcaggtatttatttgtaagagtacagagaatcttgaatgctagtgattccaagacatttagatttcaggaaccagttgaattatttaaacaaacaaacaaaaaataagtaacgggaccataataaaggtgccaaatgatgttattaaatgataaagaattaagatctgctattaatgtaatatggaatttctaaaaggagcagtttaaaatccaaaacttggaaggtttctcagaggaagtgctgatcatttgaattcaatacattcaattttatatttgtcttaaaagctcactatagagccgagattgcgccactgcagtccgcagtccggcctgggcgacagagcgagactccgtctcaaaaaaaaaaaaaaaaaaaaaactcactatactgttttctgctgctaccaaattttgcatctaagagcatctgagacatagcatgattgttaatgatcgtgtcctgcctctaagaaacactacaatcataatacgttttgttttctctaccctaaaataaaatacttgagagtgaaaaccaatgcaaatgtgcaatatattttccccatatttgggaatggaatgtcctcactgatatgtgtgtgttttgtatttcatttacaatgaaggtgacacaaagaatttattctcattacagttgtatgtgtatacactgtagaatcatgttgtgaaagccatcttatataaaatataagtttcccctctctttttgcccacagccttaccccactacccagaggtaaacacctgcaactatagctgatgtttggtatttagttccatgcctcaaaatcacatgctgtactaagaacgcatttttctattttttaaaattgatttattgatttaatatgttgacttctcagtactgtagattaagatatagttctctatcaaattcttacccttcctacacaaatatgcatttcctgccttctcattctcccatgtagtaattttggctcccgtgctatctgccagttgtttgcaattatgaaaactctagcaaaagctgagccacttatagtaaatttccatctctttctctctttgatttgctttttgggacctttcctacactttgtcttcctgtcttcttactgaataatttttctaatacgtatttgtaattattaagagttttcatttttctgcatatctctttttctatagcagcctattcttgtcacatggagtcaagagcatctcttctcattctgaaaacattgaagttagttattttgtctgattttgttttgtggggttatttttctctctacataatctttatttttcccaagttcctattgtctgtttggttgcatgtttgagtctccctcatgttcaaggcttcctttgattttttgatggtccttggttgtctactcattaagtagaggtcactaaaaaaagtgcttggtaattcttagcagaatgttgattgtggatcttctggtttggttttctgctgagttgagaaatttctgctgttggtatctttaggtcttttgttttgcactggtcagattcacagagaatagtcctccaatatccagcctgtctttctgcatttgagagatgagcgggaaaaggtttcacatttggcataaaagtgcgtttcagctgcatgtttatgggtctggtgtcctgcagtgcagagactctctttcaacctctcaagagaataaacatattgtccctgtgatgacaaagaagggaaatcaatagctaccttattcataaacagacatttgacagaccctcttatttcctcccaattcttactctaccttccataggcagctggtgtcatcattcactgagcccttctggaggttctgcattggcaatcaagttgattcttagcttcaaccgctgttggattaggattcagctttttcaggcttctaagtgtgttactacttattcattaactttccagcttctaaaattctgctgccgtggtgtccttccttgttttctttgtcattatgggtttgtgcttaatttaaaatcccttcatttatatttccatgtgattttagaagggaaaaaaactctacttctgtgttgaattcactaccattacctgatagcctgcatgtgactttaggaaattggttcctgacattttatcagacaacagcataaaaactaaactgtcaacaagtcttcatagaggatttatgagcttgagcaataattgcaatactctctataagctaaactgacataactctaaatgaaagtgagcagtgtcatgtttgctattgttgatgtgctgtggacaacgtgaatgacagtcagttttaattagcccacggataattgcagtcatgtacctaagtcccattaatggtcactttttaacacctataacatggaagtagtgaaatgattcatttctttttttttttttgaatatggtagagaaggtcaactatgcttttgaggtaggaattattgataggatacttctagttggcttagcattttcatatctttttagcttaactatccattgtgagactaagcttattactgtcatgtaagattcggttaagtagcactattcatatctacaatctaccatgtggagtgatttgtcatcatttaaggaaaacccgtacatcagatataataagcagctattcttctggttaaccttttaatacatattattgggcagcaaaatcaaaacagaatctgttgtgtcatctctttggtacccaggcattttctacacaattgtaacaagactgctctggaaatagctataaatggatcctgctgagatctgctttttctcaattatcttatcctgtcaaacaagggatttttctcctcttcactttctcctccatttataaggatgtaatttcagcttgcaaattcgattttatcctttattgttagagcaagagatttcccagttttgatccagtctccacacttatggagggcccagtgtgaatgcagtatgcatatagatatcaatcagggatagcaggtcattccagccagaaaaactgatgtttttgcgtatatgtatatatgaatgataatatagggtgatggtgcctcagtctacttgtgctgctataataaaataccatagactgggtggcttatgaaccttgaaattttatttcccacagtcctggatgctaggaagtccaagatcaaggcactggtggattcagtgtctgttgagagcctgctttctggctcataaacagtgccttcttgctgtgttcttataaggtagaaggaatgagggatctctctcagggctttattttttataagggaattaattgcattcatcagagttctagccccgtgacctaatcaccttcccaaggctccacctcctaatgccattagctttgggttaagattttgacgtaataattttgggggaacaaacagtcagaccataacagatggatatggaaagagatctttagggacaccgtagttgggatggttatatctacttagaggggctggacaaggctccttcagggagacagtgttgactttgagattcaaaggatgaatataacttctccaggtggagaaatgtacaatgaccaaaaacaatatctgcaaaactcatgagcagggaaaaatcttaagtggttacaatgaagaaatgccttgaaatagaattaatgaaatttcacctttaggtctaactatgacagtatctaacatttactgaggactactcatgtgctaaacacaatgctaagataattatttcatttaaaacaccaactagattataaatcacattttacaaataaggagcttgaggtacagagaggtttcccaaggtcactaattattggagaaaatgagacttgaacccaagaagtatgatggtaagactcatagtattcagtgatatgctaacaacaactgacacaaatagttctttctgtcagctatagttgtactttggtctccagttatataatttgaagatacttgcagtcatagttcaggctgctatagcaaggtaccataggctaggtagcttaaacaacaaacatctatttctcatggttctgggggctagatgtctgagatcaagatgtcagcatgatctgtttcttggagagggccctcgtcctggttatgttctcatttagactttccttggtgcttgcaaggtggcgagagagagagagagagagagagagagagaaacagagagaatcttttatctgctcctctttttaaaaggagaataactctattatgaaagattcatccttacgtcataattacctgccaaaggccccaactccaaatgccaccacactgaggattagcgttacaacatatgaattctgctggtacacaaacattcactcctcagcaatggggtaccgagagcagcatcacatgtgggactgtggttgatgatggtgataaagatactgaaacttatgctattcttattgctaaatcatgaccacactttacattttaatggaaaacttcagaatagatggcaatgtatattttcataataaaaataaaatctcttctggtaaatttaagtacgtattggtcagttgagtagtttatgagatgtctttccctatagatcatagaattttagtgaggccttagaacagggtttctcatcctcggcactactgacattttgtgcttaatgattctttgttgggaggggttatatactataggatatttatcagcatccctggcctctacccactagatgccagtaccagtcccccagttgagccaaccaaatatttctccagacattgccaaatatcccctgtagggcaaaagtcatcccaaaacccaggttgggaaaccacagatttagagaagtctagtataatcccctcaactttacccaaaaagagaattgacgtgctgtaagcaaggtcatacagctaaactgtggcagaattttgattagatctcaggtctcctgagcccaaaatcatatttcacatataacaaactgtggtgtcttccacttaaagcagtgccttcagaacatatgatttaaaaagtacacatatatcatccataacagctcggcagacaggtagaataaatgcaatttgatcagtggaaatgcatggtgcgaaaagttatgatttgtcccaggttgcctacctagcatggaagacatcctgaacacaagacttcagatgacagctctgatgctctttccaatatcgttgcttaccgcagttggtcaacatgagcttggtttgagaaaggagcaacagaaaagtttttggggaacatttctaaatcattgctttcatttccagcactctgaccctatatcttttgtaggcaaaataataacaatcgcctttttttttttaaattggtagagagaaggaagtcataatattcacatagatattagctatttactaacttgtgcctcggcataatttttcttatacttgaatgattagagaataactgtcctcaaaaacataaaatggaaagttacattactttatgttatggatgcctcatctataaagacgtgactaccagtgattcctaaagacttatagagagttataagtgaagtcatattccaaagcctctgctgtttgggatttttttataggtcactgtcatgtagtgatatgaaataaaaatatttaactatccgcctctttccattcatcactgcactgccgcaagtgagggctttatggagataaacgatctggctttgaacacacacctggcaagtcacaatggtaaaatgtcgaccctttctgagaagtgaagtgtaagcagttctgagcagacccaccagctacgatgctgcacatttggttgtttctcttttaaaaataaactcagtctgaaagtttaaattatgtatagtttgtatagtggcttacatacaactgtaagaatgatcaaaggaaaaaaggacaaggtttgtatatctgcatattaatgttttaattttaaaaacaggtagccctaaattaacataagatgtttccacaatgtttttaactgactgaattctgtgggcaaaatgtatgtgtgtgtctgtgtgtgtgtgtttgtgtttgtgtgcttgtggtgtgtactacctgaaacgaaagttggtccaataaaatgaagttaatatctttaaaaatttggaataaattcagaaatgttctatatatactccagacatttaagtaaagtggtatttaaagtcctccttacagttatcaagtctggaactggtggagcagtatgcatctctgaccattacatctaatgaatcaccaagttctattgacaatacatccaaaatatattccaaatctgctcactgctctccttcacagccgacatgagcgcattagccactgtcagcatctcattaggagtaccgaagttgcttcttaattgttctttcacatctacacttgctcccttctgattaatttggcccaaagcaaccagaatgacctttctaaagcgtaatatggaccatggcaccatgctttttaaaatccttcccatgtctttccattgtacttggaataaaatttcaaattctaaacacgaaacataaggtccagtgtgacttgccctctcctcccctcatctttactttcaccaccttctctcatcccatcttttctaagctccaagaacacccctccatgcatcaaacttttcccaactaaagctttcacacatggtctttactatttctggaatgttctttttttttttttttttgagatgaagtcttgctctgttgcccaggctggagtgcagtggtgcggtctcggctcactgcaacctccacctccagggtttaagcgattctcctgcctcagcctcccgagtagctgggattttcccataccttcatatggcaattttttattcagtatgcagttctaagcttaaatatcaaatcctcaatgagtctttccatgatttccccaaagtatcctggttattcgctgtcttagcattctgtttcttttcactgtaaccacagtcatatatgtaactctggaataactttgtgcatggttttgtgcatggtatatacccagtggctagttcagtgctgaggacaaaaggagggaaggagtgaaggaaggaagaacagaaggatagaaggatagaaggaagggagggagggagggaggaaggaaggaaggaaagacagaaggaaggaagttgccagttcttcttcccaaaggcaaccaggattgcaattgcatgccaaaatttaattgttctaatgatttctgaactggttttgcagtgtttgtttgtttcgctttgttattctaaaccttggctttcgtcaacattagaaggaaggaattaagaaaggaagaatagaagttagaagtgggaagttcctgcatttaggattctaattctaaacttatttcttttatttttattagttctccatacagagagtagccctgtatacaacaatcattcctaacttgataactgaacataggccaatagttttcagtcttccatataaagttaaggcaaatattacgtgtacataacagaacctattaaaatagtcaaatctattatgtagcataagattatgtatctgtttatttgatttgactttttaaaaattaattcatcttttttaacaggtaatgctcttgcatggaacataattcaaaaattatgaaaggatttacaatgaaaagtctatgtgccaaccccagctactcagtttttctccacaaaagcaaccaggatttacaattgcatgccaaattttaattttgttttaatgatttctgaactggtttagtagtttgtttgtttttgtttattttgctttgttattttaatcattggcttttgtcaacattggaatagttgccttaatggtaactactattacataactcatgtgagtggaacacgtgtggttataagaattgtccagcatgctggattctattacacagttatttcatttccaaatatttgtctttcttgtaaaacagtcattatcaaatgactttgcttttacagccaaatgaggagacagttcttggatttaaagaactttgttacaatgattactcaagtacttagcagaaaatttttcaagcttttattccaaagactctcttttagaaaccccagccagaaattccaaattttcccagtgcataagtcacatcatggcaaattaggtcttcactttctcttttctgtaaaaagttactaactccctaatcaagactttgttctgacgttttgattggtctggccttttcaagtagattaaatgttattgattttaaaaatagttttcaacagattctttgtgagtggctacttctagactggcctaaagagaaaggatgacttcactcaaaagttcataaaaggagaatactgacagtcagcctttttgttcataagttgatttttaaaaatagaaatatggtaggacaaattgttgaattatttctttttactggaggctgtgggtatagtgatgaatcttcaagttggaagaatcaagaaacaagcattctgttgtccatacttggtatctctttttgtgatcttgtgttattcagttgacccattggtgcctctgttttctcttctttaaaacaagaggcatgaaccagattatctcttagaaactcccaggtttaaaatcctattgaatgaaaaaaaaagaaagaatgaactaaagccaaaaatttttaataagtttgaggcaaaagactggtttgcttttcccttatttgatatgaaatgcacatcatacaattaatattttgatctcactagagtctaatagaaattacagtatcacatcttgtcaaacacagaatcttggcttcacagtaattcagaggtcaattatttatacaaatggagttcaagttatagatttaattttcagaccaaaagtttctcacattaaaacccacttgcttcagttcattttgcagatacgaaatatgttttcttggtattatgaatctcttgttttaccctctgtttcattatgtaatcaatggatgtgaaaaatgaaggtgtcatgaaatgtcagaatctttaaaaaaatcttcaaaattatttaactgctatttaattgaagaagtttttcataggtattgtattaaattatatttatttatatctcatcagagtaacagtattacagctctgccggaagcttatattgaaagagaaatcacataaattctcatgtagcatatttgtaaagaaagaatatgttgacaactttctttttggtgacacgtcaggagttgtgagggattgaactgcctgcaattattgtttaactacatgaaattaccatttaaaaactgtccactaaaaaaataccaaataaatttgtagactcatagcaggagacattatactttattttttaaaatagctgaacttttggtaagacggaaaattccatgatttgccataaatgtataatttatctatagagaataattgtatttggatatagtaataaactctttatggagtgtgctgaatctacaaactttcaggaactttgattacaaggaccatcagagaaaggagaactgaaattttacgttacaaaattgctctacccaaattttcaatcaattgttagaataagttcaatgttgggtcatttttgtattttatgcttcaaagaaaatgaccattcagtgattcatctgggggcagaatatcagagtggttaagaagatggggtctggagccagaccacttggtttcaaaatgtggcagtgtgttttaagaaaattactttaataccttgatgttcaatgcatccatcttgaaaatgttggtagccttcatatttaacttatgggattgttgagaagataaaataggcgaatatgaataaagatggaagacctacaacagtgtcaacatctcaagaaatgttagttgttgctgttgttgtttttattagtattattcaagaggatgtgaaaattgaagttttgtctgatgtgccaataccgtatatgataattgtcatatattcaagagagtatgagactgaatagctgggaggaagcttcaaagtggataactcaaaagaatcttcatgtctttgaagacttcacccactttgagaatataaacgaatctagaatggagaggcagagggggctggccaaatttgttgagaaagagctgctgcagtgtatcccatatccttcaggtggggtgaggcagaccttttacacctgacctccaaagggtggagaagtcagtgggaccactcagagaggttaatgagcagtgtactgatgcctcatttatacctgtgagagttaaagcatgtatgaacaaggggaagagagagaaagagtgagaataaagggccacaaaatgatatccctgagggctagaggaaggcaagaggagtaaaagaaagcatgagtgtttctcacagagtaaatgtgagccacagggaaaaaaagaccatctggagacattttaagaccttcctggccaggcgcggtggctcatgcctgtaatcccagcactttgggaggccgaggtaggcggatcacctgtggtcaggagttcgagaccagcctggccagcatggcgaaaccccagtgctactaaaaatacaaaacctagctgggcgtggtggtgtacacctgtaatcccagctactctggaggctgaggcaagagaatcacttgaacccggggacggaggttgcagtgagccgagattgcgccactgcactccagcctcggcaacagggcgagactctgtcaaaaaaaaaaaaaaaaaccttcctaggaatagactctccaggtaatgtgggtccttagagatgctagttctaaggagacagtgaccatccaaatgggaggctcacacaatcacaggagttgggtgcaagctggggaccaatgacaaacccacagaagtacccagcagtgaaagatttatttgtagacatttgccgttcaccaaccaaataagaatagttttgccattatgtctctttctttactcctccctgcctctgtgttcctaagtgtggatatgacagggcggggaagctggtggtctaggtgacccattataaggtgtatcaaggacaaagggagatctctgagctttgactgacaattgaaatgttcatttgcgtgatcttagactggacactacagtgctacttataccttaaagtctggctggctatagagcatggaatcatgggaatttctgagttttcttcaagtgacatgggcagtttatccccattgactaaaactaatccttaaaaggaaagaagcccaaagttcccataagtttgaaatgcttatgctgttctgctggtttgttacaacaaaagaaaaagcaatcataaactgcatatacagagcacatgaataaatgggaaggatcctggcctaatacagcattactaaactaaatgctcatatgattcagtgcctaggctaccacatgaattaaaaatgaccttatgtaatgaattaatttccaaaataaatagaacaaagagaaaatcatcttagcatcttcttaccttaaatgagtatcggagaggtcaataataagacatgacattgtttccaaattattaaaatgatttgaaaatatatttcataaattgtaattataagtaataataatgtgcaaactctctactggattttatatatacgcactgtgttcaacattttaactattattttctgtcctgtttttgaaagttagatccaaaaatgcagtattgattcagatagaacataccgaaaaatatttattggttgatgatagcactggttcttgcacatggaatatatattttattttattaattattttcatttgtttatttatttattttttgagacagagtctcactctgtctcccaggccagagtgcggtggcgtgatctccgctcactgcaagctccgcctcccgggttcacaccattctcctgccttagcctcccaagtagctgggactacaggcgcccgccaccacgccctgctaattttttgtattttttagtagagacggggtttcaccttgtttgccaggatggtctcgatctcctgacctcatgatctgcctgccttggcctcccaaagtgctgggattacaggcgtgagccaccgcgcccagaatatatattttaatactaagttttgatttatttttgcttgattttaaatgaggcagaaatatggaattcatatacttgcttgtagataaaacatgttccactttaaaaccatgaaacgaagtttactttctttggggatattttaagtgttgaacctagaactctaaatcttgagggtcataaatatcagtcaaaaatattttcattataaataattatcttcagaaatactcttaatatcagactttttaaaaactaacaatgctagttttatggtgtcaaattttgtatttttaattttttttaagggacagggtcttgctcaggttagagtgcagtggcataatcatagcttactgcgacttcaaactcctaggctcaagcgatcctcccacctcagccttccaagtagctattactacaggcacgcactataatacctggctaatttttattttatttttttttggtggagagggagtcttgctatattgcccaggctggtctcaatttcctgtcctcaaggaatcctcctgcctcggcctcccaatgtgctggaattacagatgtgacccacagtgcctagcctgtctttttaatgtcaattatagatatcttaaaagaagtttcctattacattttaataaaatgcattatttattaattagtgcttgagggatacaatattgatattgtctgttggaaggccgactaacatgttaaaagatagtaatagaaaacctatggcagggtgcggtggctcacgcctgtaatcccagcactttgggaggctgagtcaggcagatctcttgaggtcaggagtttgagaccagcctagccaacgtgacaaaaccctgtctttactaaaaatacaagaattagctgggcatggtggcgcgtgactgtaatcccagatactcaggagactgaggcaggagaattgcttgaacccgggagacagaggttgcagtgagccgagatggcgccactgcactccagcctgggtgacagagtgagactccatctcaaaaggaaaagaaaaaaaagaaatagaaaacctattttagaactacagaaatttcacccaggttgaactaaatctagcttacttttccttaatgtactataagagaaattttgttcaaaaaataataggttctcttttattatatattacattgtcttatcttctttgatccaacttttcatataacttaattgcagttaaaccttattgcggttccatgaccatagaattctacctttcaatttttttaatttttttatttttataaatttaggggatagaagtacagttttattacatggatatattgcatagtggtaaagtctgggcttctggtatagccttcagccaaatagtgagcattgtaccctatatagcctccacatattaaattcatcgttcaatattaataaatttactatgaacttgttaatcacttttagaagaaccaatatttaaaaacccaactgtaaagaatgatagaactgtaaagtaataataatgagcaactgtgctttatacactatttcgtgtctattacttctttttttgtttgtttgttttgagacagagtcttgctgtgtcgcccaggctggagtacagtggcacaatcttggctcactgaaacctctgcctcctgggtttgagtgattctcgttcctcagcctcccaagtagccgggattacaggcgcccaccaccacacccaactaatttttgtatttttagtagagatggggcttcaccatgttggccaggctggccttaaactcctgagcgcaagtgttcagcctgccttggcctcccaaagtgttgggattacaggcatgagccaccatgcctattgtctattacttcatttgaccaactttggccctcctcctagccccatatggcaggcattttcataatcccattttacaaatgagcagactaacattcacagtcattacgatactttcccaaagccatgtagctagtggacggtggagcatacactgagactctgttctgcggaaacctgtccataacatcccttccttgctagcaatatatttatagtgagaaaacatggacttgagcttcagatttagtacttgatacctatgtggaattagagccacgtttttaacattaggtcctccccttgtaatatggagatgaaataagaatttctttgggttcttgttaacgaataaacaagttaatgtattttttaaagcactttgtattagtccattttcatgctgctgacaaagacgtaccctaaactggacaatttacaaaagcaaaagatttaaaggacttaaagttccacatggctggtgaggcctcacaatcatggcagaaggcaaggaggagcaagtcacatcttacgtggatggcagcaggcaaggagagagctggtgcagagaaactcccgtttttaaaaccatcggatcttgtgagacccattcagtatcacgagaacagcatgggaaagacccgcccacatgattcagtcatctcccaccgggtccctcccacaacatgtgggaattatgggagctacaagatgagatttggctggggacattgaaccaaatcatatcattctgcccctggcccctcctaaatctcatatattcacattttaaaagcaatcatgccttcctaacagtcccccaaagtcttaactcattccaactttaactcagaagtccacagtccaatgtctcatctgagacaaggcaagtctcttccacctatgagcctgtaaaatcaaaagcaagttagttacttcctggatacagtgggggtacaggcattgggtaaattcagccattccaaatgggggaaattgaccaaaacaaaggggctacaggcctcatgcaagtctgaaatacagcacggcagtcaaatcttaaagccccaaaatgatctcctttgactccatatctcacatccaggtcatgctgatgcaaaagatgggccaaatacttagagccaactgattgtttgacaaacccaacaaaaatatcaagtggggaaaggacaccctatttaacaaatggtgctgggataattggaagccacatgtagaagaatgaaactggatcctcatctctcactttatacaaaaatcaactcaagatggatcaaagacttaagacctgaaaccataaagattctagaagataacaccagaaaaacccttctagacattggcttaggaaaagacttcatgaccatgaacccaaaagcaaatgtaaaaaaaacaaagataaacagatggacttacataaatgaaaaagcttctgcacagcaaaagaaaaaatcagcagagttaacagacaacccgcagagtgggagaaaatcttcacaatctatatatgcaacaaaggactgatatccagaatctgcaaagaactcaaacaaatcagcgagaaaaaaataatcccatcaaaaagtgggctaaggacatgagtagacaattctcaaaggaagatacacaaatggccaacaagcatatggaaaaatgctcaacatcactagttctcagggaaatgcaaattaaaaccacaatgcagtaccatctcactcctgcaggaatgttcataaacaaaaaaataaaaaaaaaatagttgttggcattgatatggtgaaagggaacacttttatgctattggtgggaatgtaaactagtacaaccgctatggaaaacagtgtagagatttcttaaagaaccaaaagtagatcttttgatccagcattctcactactaggtatgtacccagaggaaaataagtaattatatgaaaaaaagatacctgcacatgcatgtttatagcagcacaatttgcagttgcaaaaatatggaaccagcccaaatgcccatcaatcaacaagtggataaagaaaatgtggtatatgtatgctatagaatactactcagctctaaaaaggaatgaaacagtggcatttgtagcaacctggatggaattggaaactattattctaagtgaagtaactcaggaatggaaaaccatacatcctatgttctcattcgtatgtgggaactaagctatgaggacgcaaaggcataagaatgatacattggactttggggactcggagaaagggtgggggttggtgaggaataaaatactacacactgggtacaggatacattgcttcagtgatgggtccaccaaagtgatgggtgactcagaagtcacctctataggatttatgtaaccaaacactacctgttccccagaaacctattgaaataataaaataaaataaaataaaataaaataaatatataacaggaaaaaaaattgctttttttcccagttacaaatatactcacatatattttaaattttctaaattcttcttttcactctgagcttttctatgtaagatttatttttgtgtctagtgtagaaatatactttttattgattttaagtgacaaataataattgtgtatatttttgaactataatgggatgttttgatctatgtatacattgtacaaagagtcactcaagctaataaacatatccatcttttcatcaatttaccatactattgtggcaagaacattaaaaatctattccgtctgccagtttccagtttgaaatacacactacattattaactgtggtcaccgtagagtgcaataaataactaaaacttttcctccaatttaacagaaattttattacctcctgcccccctctgcagcctctggcaaccacctttctactctgtttctataaaatcaactgttttagattctgtgtgtgaggtcgtatagtatttgtctttctgtgaatggcttacttcacttagcataatgtcttccagttcaatctatatagttgcaaatggtagattttttaaaggccgtataatattccattgtgtatatataccacattatctttatccattcatctgttgatggacacttagtttggttccatatgttggctactgtgagtaatgctgaaataaacatgggagtgcagatagctcttcaacatgccaatttcaattccttgggaaatatacccagaagtgggattgttagattatatggtaattatatttttagttttttgataaacctctatactatttccaaaattactgcactagtttacattcctgccaacggtgtacaagggttgtcttttatccacacacttgccaacacttgttatcattcctcttttgataatactcattctaacaggtgtgaggtgttattccattgtggtttcaatttgcattttactagtgattagagatgttgagcatttatttcatgtatctgttggccatttgtatctcttcttttgataaatatttgttcagatcctttgtccatattttaattgggttatttgttttcctgctgttgagttgtttgagttccttatatatttgggatattagcctgttattagatgtatggtttgatgcaatcctatctgtcttgtttttgctttcgttacctgtgcttttgtagtcctatccaagaaatcattgcccagactgatgttgtggtgtttttcccctatgttttctgcaagtagctttagagtttcaggtcttacatttaagccttttgttcattttgagttgagttatgtatatggtgtgacatatacggtgttcagtttcattcttctacatgtggatatccagtttttccaacactattttttttggagaaatcgccatttccccattgtgttttcttagcacctttttgaaaatcaattgttcataaatatatgggtttgtttctgggctttctatcctgttccattggtcgatgtgtctctttttttgttttgttttgttttgttttgtcgggaccatactgttttgattacaatagctctgtaagatattttgaaatcagggagtgtgatgcctccagtgttggtctttttgctcatgtttgcttttgctttttggagtctttgctggttccatatgaattttaggattgctttttctatttctgtgaaaaataacattggaatttcgataagtacaccaaggaatctgtagatcactttgggtagtatggacattttaacaatattaaatcttccaatctatgaacatgtgatatctttccatttatttgtgtattcttcaatttctttcattcatgttttacagttttcagtgtacagatctttcacctctttggtgaatttacttctaagtattttactgtttttattgctattaaatgaaattattaatttctttttcagatagctcattgttactgcatagcaatgcaacagatttttgtatgttgactttataacccacaactttactgaatttaagtatctcgattctaatagattttggtggaatatttctttaaggttttccatatataagatcatgtcatcagcaaacagactatttcacttcttctgttctcatattgatgccttttatttatctctcttggctaattgccccaggtaggattttcagcatcatgttacatacaagtagcaagagttggcatccttgtcttgttcttgatctttgagaataagctttcaattttttatcattaggataatgttagccgtgggtgtgtcatatatggcctttattgtgttgagattcatttcttctatatctactttgttgagtttttttttttaaccatgaaaggatgttgaattttctcaaatgttttttctacatctattgagatgattatatgatttttttgttgttcgttttgttaatatgatatatcacatttattgatttacatgatttttaatttacatatgttgaaccatcctttcatccctgggaaaattcccacttgatcatggtgaagtagtaatacgtctttgtattttatatatatacacacatacatatatgtgtgtgtgtatatatatatatataatatatatataatgttttgttctagaaacttttattgaatagtttatcttttcttcccttatttttgtgacatttttaacacttaagtttccatgtgtggatctgatcttagattactaaatttattttattggtctatttgttcctgtatgtataccttactatatttactaacaaacagttttataaaagaaatttatggaaatcttgttatctgctagataacctcttgtttgttatcttaaatttatgttctattcttgactttgctattaagtgtgaatcttcggatctgtttatcaaaatctgtgaaaattcctactgaaatttattttttaaaaattgattccaatttatagataagtttagagaatcatcacctttatctttataattctgagtctttttatccatgagcatggtgtgtgtgtgtgtgtgtgtgtgtatacacacacacacacacacacagatatatattttcccattatttaggcctctttacatcttttaatattttttaggtttaaacttctcattcagttaatcaggtcctttttttttcttttctttttttttttgagatggagtttcattcttgttgcccaggctggagtgcaatggcgtgatctcagctcaccataacttctgcctcccgggttcaagtgattctcctgtcccagcctcctgagtagctgggattaccgccatgcgccaccagtcccggctaattttgtatttttagtagagacagggtttctctatgttggtcaggctggtcttgaactcccgacctcaagtgatctgcctgcctgggccttccaaagtgctgggattacaggtgtgagccaccgcgcctagccaggtcctcatttcttcatgtgtgaattgaaaataattattttttctctgtatatttacagatataaatttgaagataaaattaaatgatgcttatgaaccaattacataaataataaggttttgtgtttattattttttaaacagaggtatgggtgtattttatgcttaatagtacatcatgattatctagattctatttaattattctctttccccccagtgtaaaagttaggatcttataattatttaaggtaattgttattcttcaacattaagaaaatcattgttgtgtttaatgatgtctggaatgctcagtaaaccatgattttttattaatcttatgcagtctttgattaatgagaaatataaacgatcatttagtcaattatttattatatcacctactaggttgctaagcactgaatcagttttaagatagttgtcttcattcagggaacaaaataaaagatggtaagaagttttgagggcccagtactgatcaatgttcttttaagtttagcagtctacagactttactaaatgtggaagttttaaacattattttattattgctgtttttttggagaaaaaaatgattccaaattttcttcttttttttttttgtggttgtaagtgacgtgaaactataggatttatttttccattggcttcttttaattaaacattttaataacatgtattatccaaaacttgctataccaactatgtaatcacctcttccttctatttttatgaatatactatctgacgactaaggtgatatcagaaaattttcactcaaatgaataaaaaaaagaatgacaatgaattgaatgtatatgcttcagtagataatttataaagaaaatttaatactctaggaatgatgctatacaagctggcgtgtcaaataataaataattttaaaataggacaaggaccttcatacactgaggaatgatataaaaatacaaaaatattttaattgtttaaaataagaacttaaatctaaaggagatacttatgatgtctaaatatgaaattctatactcaggttgaaaaattatattctataaaggcagactgaagtatattaatattgttagcagttagttgatggtgaccgtatgtaagttactgtgttgagttaaatattttatgactatgtagcccatatgaatggaagacatttgagtaaaaagagtatatttcttgtggagtctacattggtgcattgtggtaaaatataagaactactttttaagaggggcattgattaatcaaactgcattctgacataagtaactgggttgataaaaacaatctgaaaactctcacatgaaaatggattgaagggctagaagatattacactgaaaagataaatctggtgcaatggacaaatcagtttgaatacttgagtagttgttatatatgggaccaaattaagttttatttactccagaagaaccactaaactgttaaagggcaggtttcatttcaaacaaatttttttagccaattaaattatctaaatttggtaaagtctcatttgtaattagtagaggagcttcctaatttgagtagaagactgaactaggtaactgtcagccattatttaacaaatatttatgaagtacatacaatatacaaggtgttaaaaaattataaagaaagatcactgatccttaatggtatgtgattatagattttaatctataaaggaaatgtttcttgtagctatttgatacatataaagtttagagtaacttcgtaataattaatacattgcatatatcaaatagtgatcagtgtatactaattatacagttctccaccaagtagggtaggtacagacatgagaagacaagacttgattaaattttaaaaatggattcagtaattggattaatttgtttagagcaaaggattttcttaggtggaaaatgagaaaaatgatctaatgaagttgtgcttcaagagaaacaaagtgaaagagagctggagtcccagtgtgacccctagaccagaagcatcacctgggaatttgttaaaaatgcaaattcctgggtcccactccagacctactgaatcaaaaactcagtgttggcggggtggagtagcaaggtgtggtttaacaagcccttcaggtgactgtgattcatactaaatttgaacagcagtgtagactgctgttgttgtgaagaggagtttacatatgatttgtttagatataatttggaaggcaattcatggtcactgcacatcagtggaaataaaggatgcagatgctatggcttcaagtagtaatatattgactaacttatgtaatgcataactctagagaacattttaaatagcacagtgttgaaacatttgaaacaaatttattgatatagttttttttaagttaagttttacatctaacatttaaaatgatagaactaggtatagctggaaacaatgcctgtttattttcttacacagagaatgaattctttcttcccttaaaacagtgttgggtaatgttccagaaaagtaattacaggccagttagtaaatatacgctgagatagtagaatgccagatagcaacagctatatgtctgccactactggttaatcagctacagaacagactgattttttgacttaatatggcatagggactccattaaggacagaatctgcatcttaattactgaacatatcccccccactgttttcatctgtatttacgtatgttttctttttttgttgtctaatagaagacaatcagggttgtgcacgatttacaaattgcttcttcacctcctgtcttcctcttctattcaataggcttgtcaagctataagagattatgaaatttggggtagttagaaatcacagccaattcaatctcatttccacacaaaccaaagagtaataaattactttattgtagcagcttattgctttgaacctaaattacagaaaaatagcttggaaattccgtaacaaagatgaaatagtctatttgtgtaggcatacttcttacagtttgtgttaactctcagctctagcacattttatatgatatttggatatattggtttggaaggagacagtcatgatctgatggtctttctgattttgtttctctctaaccttaattgctgaacctattaaaaaccccattttaggtttagctgccttagattctaggattattcatgtgctaggtcaggaaaatacagaagctctatgtctggaaatggaagagttgccattgactcaaccttgctgcttatcctcttcttaccttgtatttctgttctgataattcaattcttgccttgtcactgatgatcaggactttccctcatactcaacaattgctctagagctctgctttgattctcagccttctcctctgttcatttcaaaaacagggaattattttcataatcttcaatctttctgtctccccagacacactgaccacatgtctatccaaacaggtatcagatcatcctctttccaggtaatctgatttgattttcctcatatacctcggggcatcctgctttgggatgtgaaggatttgtgtaaacatcttttgttgactgtttgttagaaaatttcttcattgccagctattggtaccctgctcagatgttcttaaccttcaagcacgcctatttttccagctgctaggagttttgggttataactcacagctaccaccatcacaacccctttctctggagtattatcttaggccagtggtcctaaaacattagctttcatctgaatcacctagggggcttattaaaacaaaagactggactcagagtttctgatttagtaagtctagggtggggcaagagaagttgtattcctaacaacttccaaagtgatgctaatgctgttgctctagataacacatttcaagggccattcctctaatctaaataggagcttattattccctgaaggctctttgtcctgtctctcctcagggtagaccacagtgagtgactgattgccacaagcttatacaagttggacctcttacctcaaagtgtaactatctacattgtttcatttgtgtttgaaagctgcctagtgggatcagaattaaagggtcaccatcagtaatgatattctggctaagcattcttttctaccctatcctgcttcttccactctccttctcctgaaagtactctcccaataaattacttaaataaaatctccatctcagaccatacttctaggagacgtgatatgagacttatacctgtggatctatggtttctggtctctttaattcaatctatctattcaataaacttgcattgaatgtctttgaatgtcccagaaagcatatggtatatggaagataattaagatccagtttctttaccaagcaacccaccatttggttcaagggtagataagcaaatgtacaattatagcagcatgattgatactatgctacctcagtgctgataatttgaggtcctgactgctttcatctgagctttggagagtgtcacatgcttgattctctgggacagagtctctgagatggagatttgtggatagaaggtttatggggaatattcttagagataccagtgaggaagtgagggaaacataattgtgcaaatggagaggctgggtgagagctcaggtgaaactgggaggggctctggagatggaatgtcccttcaaatttgtccagaattaaggaaagagatcgatcactagatgcaggctgcccagtaagaggagcataacattggaagaaataactctctttggctgagagatgcttgaagaggatacatacaatacacacaataaaagttggtccctggagagccttgcttgtgatcatctcagtaatatatactggcttcccaccagaaaaccatttatcctattcctcccaacaggaattttaattgagtttgctcttaagcactaaatttctcagatatcccaaatgctaaatgcaagccaaacctgagatttcctgaaaatatatcctgtagacagatgtgagagtgtttcaaaccttattgaaattactctgaggagcaatgcagcaggtaacaaatctgacacacagcaatctttagaataaacatatgcaggcccagagttcagaggctaaagtcaatttaatgagaaagctgtcactattcttttttacatgaattaaacgtattccaagttgcccaagtcacggcctaacagtaaagagtctggctgcagagctgagcatttgttttatgttgttctcagggtcacttaaaaatgaatgtgagttacctggattgaacagaattctatttagtgtattctaatatgtggtgataaaacttgggaacctcagtaaagggaactgatttgaatgtaaaattgtttattttgaagtacatgtatgccaaacactgaaattttctattgatattgaatatctatcaatattcaatattttccattaattctgttgattctatttgctattgaatattgatataacaccatttagtttgtaaagagaaatataaaatcttaatgaataaagggaaaactattgataagtcttcatagagttaattatacactcttaagacattagactcaagtaacttcatacctactgagaataaatgctggaaaaatttacaagttttattttccatatttagtgccagagagccagattacacacacacacacacacacacacacacacacacgaacaagaataaataggttcacatgtttccttgcagtaaagtctgtcctgatgggatggactctgacaatattatgaatgagtatgaaataatagcaaacttggcctctagaaacaatcttccctctgaaatgcgtgttttaaattacctcatggcaaggccagtgacattcaaggattgggaatgaggttagaaaaatggaaatgattctccacttctgggaaggtcttttgcctgattaacgttatgtaaacattttgctgaagaaagaataattctgcactttagccaccaaatcattatagaaaaacaatccagttttatgcctcctgtgctccagtccaagggtcagcaaactatggcccttgagccaaatcctgcttaccacttatttttgtaaatacgtttctattggaacacagctctgctaatttgtttacatattgtctatggctatttttgagctgccatggcatggttgagaagtgcaaccaaaaccatatggcccacaaaacctaaaatatttactatctagccatttacagaaaaattttgctgatccttgctctattgtgttttagttctgtgtatcccaggtttactgataagaattacctggagtgcctttcaaccaacagcttcttgatctcctcctttggagattctgattcggtgaatctgaatgagacccagaaatttctacctttagcaagtactggaactttgggaaataccaagctagttatttgactctccaatattctagcataccattttttatgttcaaaaagtccacattcttttcttcaaattcttcctcatctccccacataaatgcaaggtatggacgaatgtattgtacaggattgtcacggataaggtcggctagaagcagtttgtgataatgattagggtgtatgttgtttgttgagggagtactctcaggagtaaggaagttatagaagcagtataggaaagggcgataaagctacagaatgtgctctcattacacatacaccatggaatactatgcagctataaaaaaggatgggttcatgtccttcgcagggacatggatgaagctggaaaccatcattctcagcaaactatcacaagatcagaaacccaaacaccacatgttctcactcataagtgggagttaaacagtgagaacacatggtcacagggaggggaacatcacacaccggggcctgtttggggggtgggggactaggggagggataacattaggagaaatacctaatgtaggtgacgggttgatgggtgcagctaaccaccagggtacatgtatacctatgtaacaaaactgcatgttccgcacatgtaacccagaagctaaagtattaaaaaaaaaaaaaaaaaaagaatgtgctctcagctggagacatgcttcagtctgatcccatggggacctctgcagcataaattgaaccacagagttgatcctgccttcaggcaagagggctggccttttgagcactctcttcccattgccatcagttagttatttggatgcagggagtccttgaacaggggacagacattagcagcaatcattgaggcacaagtacacctgtggtaaaggcagaggaggggagaagtatagcatctggtgcagaagttatacccccaaatgaatgaaatttagacttggaatgtgccctgaagaaagacctatctacaagagtctttaaaagataattttgaaatatgttttcaagttagtaacccttcggaagtcacaaatatatttgctagaactgatacctatcatctttgaaaagtaagaggaaaatatgtatcagagagaagtgacttttccggttaataatcattgcttgttgatacgtgcttttgactaggtatttagtaagatcttttggttatgtttacctccattaggatgatatgagttccttatgaatttaaatgcatgtgaacatttcagagtcccacctggaatgcgactactgtcagacaatgtattctctctagcccctaacatttcatgatagattcactacagttgtagaagaatccttcaataaaagttatgttatgggaatgtaaaacaaagtttaaccttccataattatgatttactttccaaggaataatcatacctaccactacttgcttatcctcccaacctgcaaggtaggcatcaattacccaatccttacccaaagtcacatgtctagccaatggtggtgtcgaatattctgatgaaagagttctattggccccgctaaagagttgtggggttttttaaatctttaactcaagttgtttcagtgaacctagaactaagactttttcaaccactcccaaattattgatgcttgggttttgcaacaaatgccctctaagctctcaggataagttgggggaggaaaatgaaaacataatagggtaagggttgttctctaactattcccagaccagttctcaccttcaaactgctctctctctctgaaagatgagcaaaaaaaaaaaaaaaaaaaaaaaaatgtgacctcacaaaaggttgtgtgacctcaaaacctgccaagagtcctcagtgcagcccactctgaagacagtggaacaactcaggaaagaaggtagagtattttatagaccctagagtcttatctcatcccattctgctttctgtcttcttgaggcacagttggcttaaccttttcttgaagtgaaaactatgtgaataagaatattaacccccaaacaacttaaaagcacagtcaaccgcttcatcactggtcattagagaaatgcaaatcaaaaccatgagataccatctcacgccagttagaatggcaatcattaaaaagtcaggaaacaacagatgctggagaggatgtggagaaataggaatgcttttacactgttggtgggagtgtaaattagttcaaccattgtggaagacagtgtggcgattcctcaaggatctagaaccagaaataccatttgacccagcaatcccattactgggtatatacccaaaggattataaattattctactataaagacacatgcacatgtatgtttactgcagcactattcacaatagcaaagacttggaaccaacccaaatgtccatcaatgatagactggattaagaaaatgtggcacatatacaccatgaaatactatgcagccataaaaaaggatgagttcatgtcctttgcaggaacatggatgaagctggaaaccatcattctcagcaaactaacacaggaacagaaacccaaacaccgcatgttctcactcataagtgggagttgaacaatgagaacacatggacacagggaggggaacatcacacactggggcctgttatggggtgggggtctaggggaggcatagcactaggagaaatacctaatgtagataacgggttgatgggtgcagcaaactaccatggcacatgtatacctatgtaacaaacctgcacgttctgcacatgtatcctagagcttaaagaagtataataaaaaataaattaaaaaaacaaacaaacagaaaaacagctgacaaaacagaattgcccagcgtaactgtatttttaagttagcagcaaaaatagaattttgattttatgtcatgtatattgggaaaaaggagcaaatgatatgatgtcagttaaaagaaaactagcatagttcaagattttcccatgattctcctatgaacttgaaattccaaaccaaacccagctgagtccaaagccagtagtgctcttatcaactttccatggcaatgtcttacaattctctttaggctagggccaggggaagaatccatggaattgaccacttggcaggacattaccaaggtaggggtggctatagagatttcagccgaaccaccctaggggatgaagcaagaacacaatgaccggggcagctccaggctcacctcctccatgaagcttttccttctctctctaggtagattaggtgactgccttcttggggaaacattaacatgggttagataatatgagctattcctatatggcaacaagctaggtgaggaaaatgaagatacgatgcatctatcccatctctccagcacccaggacagagccactatatcctggcatgctgtagcacagagtagagagccctgcagcatttaggcacattgaacatacttgttgatgatattctgagccctctttcctttaaatcattgttgagtattttctgggtcaactcacaatataaaacccctgtcataaacattcaaaaaacttgataagctaccagaaatgttcaattaaggaacaaaaagaaactgaagagcaacaatggacacctcccctcctgaactccaccagagaacttcagtccatttaaaagatgaagccagttttaatctataatttatgtcaaatttcactcttaagtcacaaggttaatatttttagtagaaaatgttgattataacagaaactcaggtatctcatatgcacatactcacggtatgattaaagataatcaggtacaattttactatgagattggacaatgtttgaagaatatcaatactgttttagtgaaaagcagatcaaagtatgaaattaaaaatatctttagaatagtaatacttaaaagaattcagtaattggaatgcttatccatgttttttaatcactctgttttaaatctgactttcagttgtttcaaaatgacaggttatgttgattaggtaaattatattagcatttatttgtatttaatttctacatttcctgttaccatctttttgcccacttttctattggtatgcaccttcttttttattgtatttatttaaggtatgcaacatggtgttttgatatacatgtacatagtgaaatgatcactatagtcaaccaaattaacatttaccttcccacatagttaccttttttgtggtaaaaagggcatgctcattcttatctttttgattcatataaatgtcttatatgtcacttatattagcactgcaatacaaatggttgttttaaattgatcttctgccttaaaactttacttgaaaaattaattaaaatacttttttcagataaattctgtctttgaatgtctgtttcagaaaggtcatatttatccaagaggagacaaatagccacctacattttctcccagtgctcttaaaattaactgcaatatatctgaatcttttgtggcaagattatctttttccttctgtttttctcaaatgagtaacacatttttaacccaattttgagtgataaatcttttttgcattgttttgagatgctatttatagtatgtaacaaattcttacgtatgcttgatatgcttctagactttctcctattttgacatctctgttcttttttcaacaccacatcaggaccattcttttcgtgattattacctcgatttacattgtgatatctgctgcttcaggcctattcaaactttcttgacgatccttgcacatttaattcctctagactattttggcatgagtctaataatgtcattgggatctttattgagattacattaaaatattttgattaatttaggaacagctggcagttttacaatattaattttccattcagaacatatgctttctctatttttcgaggcttttaaaacatttctcactgtaaattgttatagttttcttaatgcagatcttgcacatttcttataaagtttattcttatgcattttataattttgttactgttgtaagtaagttttttggatcatatttctaatttttattcctgggcatataagaaagctatagctttatgtatacagtgtctattttcagactttttatcagaccggatagaatgaggatcttaccaatttcagtgtgggtataaatagaatattagcacacttgtacattccctatgattttttaaaacagtatttcctttgataatgagttattcctgagaactttacatataactctgcatgtttgttttgttttgttttgttttttgagaaagggtcttgctctatggcccaggctggtgtgcagtggtgcgatctcggctcactgcaacctgtgcctcccgggctcaagtgattctcgtgcctcagcctcccaagtagctgggattacaggcactcgccaccacgcctggcttatttttgtatttttagtagagacggggtttcgccatgttggccaggctggtctcgaactcctggcctcaggtgatctggccaccttggcctcccaaagtgcagggattacaggtgtgagccactgtgcccggcgtctgcatgtctttttgtgaatgatttactttacttcccatctgtggctgatgggacaaaagaaaaattaagagcaatgtgattaatgctaagattgaccaacagtttttagaaaattaaactgcttccacatgagataattcatgttttctagatactttatcttccaacaagtggtaagtaatgaagtagataaacttcgttgtcactatgtttatatttcaagttttctgaatgaggcaggcggtgtaatgtgtatatattattattattgtttttatttttgagacacagtctcgctgtgttgcccaggctggagtacagtggtgtgatctgagctcactgcaacctccagctcctgggttcaaatgattcccctgcctcagtctcccaagtagctgggattacagatgtgcaccaccatgcccagctaagttttgtatttttagtagagatggggtttcaccatgttggccaggctggtctcgaactcctaacctcaggtgatctgcctgcctggggctcccaacgtgctgggattacaggcgtgagccaccatgcctggccaatatgtatatactattaattaatatgaagatattgttatgcttggatgacacccttcctgttgctgaggcaggagttacaaataaaacatagctcttcggtctgctcccagatcctcctcactgtactcttgctcacattttgtccctgacagatgcctaagggccactgaccactccctcaggaaatctctgtagctatacaagcagcaggcatagaaagaaatgaattgtaagctattcttctagcactctaattagacttttcagtctaattgcaggagatgaaattgaggcagatcaaattctcaggatgactagatttgagaatcattacaaagtaatacattgacaattacaaagctagcatgctcctgagagtagaactgaaccttcctcagcctcagagtatcagatgtgaataagaatatctcatcaacttgtttcacatgcttgtccacttgttttaaaggagaaaatgcaaataaatatgctgcaaggcagtctaggtaataattatttacactctagagacagacctggcttcaaatcttgacatgtaccacttattaacagcacgttgaaaaacacatttctttaatacctagagcctccacttctagccagaaaagttaagataattatagaacctactgaatatggttgttttgatgataaatgaaattatgtatgtatgaggtctatcctgacgccttatatatagtaagcatgacataatattatgtactgctactattgtatttgctaaatctccaattgttttaaagtataaaagagtattattattttattaaggacacagagtggtattctgagaggagtgggaatcctcaagagcttttttcctggaaattaattttgaaaagaagcttgatgaaaatcttgcatttagagtgaggaagacagtcaactctgaattacataattatatatatgtactggagacacagttcgttcctatgatataagaagggctgaaaaaaaaagttactcctttatttaatcttaaactgatctggtcttcttcatgagtcctcatccataaggaaattatatatatattccttatccaacagaggaaaaataaattctcattctggcttaatctgatcatttagggcacaatctctcataaaaaagacagcttagtctctctttcaccctccttctactgttacttgttgcaaataagatgatgttcctccattatatgaggtaaaggggatgcttcctaagccctcatggttgcaaggaaaaataagtgcccttgggtatcatgtcccttgttttctgagataatatcccttgttctctagtcactgataagcttgtcagctggtagaacacacgatcggcctcctaactagatcagtgcccaatatcattctctggttcagttagattcttcttaaattggaatgtctccagactcccaagtctctgctgtttcccattcagccctctggcccatggtccatctctggcatcctccactggggcaactagttttgccactgcaggtccaccacaaaccccttagcagtatctagctagaactcaacattcctaaagatgtgtgtgtgtatgagtgtgtatatccatctatatccatatctgtgtctatatactagactgtcaaaaaatttatatggtaacttttgttctacgacagctagggtacattgtgaaagtttcaaagcagagattatgtctcatttatttttagctttccagcacctcacctgatctctgatataagcaatcaatctgtattctcttcatgatgagaaatattctccattctcactgatagcagatttgtgaccactaaacacacacgcagtactggtgtgaacgcacaaactattgaaacaacaagcacgcaacaagcaaggaaattgtcactgctctataatttggtgatgagatatctggttactttcagacaaaagaaaatgtctcataataatagggttttgtatgattcttctctttcttccagaaataaaaaatttagaaacaaaacattgagggacattttaggttaattatgcattttagaagagttccccagatatcatttttgtctaatttatttttcaaattggcatataaaattatatgtatttatcttgtacaacataatgatttaaagcatatatacattttagaatggttaaatccagctaattaacaaatgcattatacctcacatagttatcattttgtggtgataacccttaacaccctggataacttttgattcagtttctgaacttgccatgtaaaattagtatttgtactcaatcagtttcttcagtttggagtatccttatagtgatcctgggcccaaactaaaagtgcatagggaaagtagcatagtctctttccatttgcctctagtcatttttatgtactgatgaacatgtaaatgctgctgtacaaagtacaagacagggatgaagaccctgttctcaaatatttccaggatagggagaggctttaattatattttttaaagattttctaaacagaagaaagaaaaatccccattgagaggggaggcagtggctcatgcctgtactcccagcactttgggagactgaggcaggaggatatcttgagtccaggagtttaggagttcaagaccaccttgggcaacagagtgagatctgatctctatagaaaataaaaataaaaaaagagaagggagtgcatggggaaaaagaaaacaataacaacaacaagaaattcagaagtggtttgatgtgttgaggttaaactgaaacaatgccttcattgcaatgagtgcctttgacgtctgtcaaaggtggtacagtcagtgacaatgactgcattctttctggctttgggttcacagtgctttgcagtgctgtgctattcagaactaaataactgttgtcactgctctataatttggcgatgatatctggttactttcagacaaaagaaaatgtctcataacaatggggttttgtatgattctgctctttcttccagaaatacaaaaaaaagacacatttaagaatttatctctgttcacattgaggaagaaaataagctttaaaaagttttactcctccctccctatagcaatgcttgcctgactttccatcgggggaaatgttactttcagcatattctgtgtgtgaaatagacagtgccagatgcttcaaatggtcataattgtgaaggatatgaaaaaagaggcatcttcctactgcgctttattaaatgtggagggaaaaaaaccctttgggtaaattagcacttggaggatttagcaaaagtgaattaactatgacagggtcccctaacacatctatttgatgatcttgcaagtcttattcccggttacctgggatactactttgctttgggatgccatggggtcattaaaatgtgagacaggttctctggaagagaaaaatcagatgaatcttgacttacagacagtatgtcttcctaaatagtatttcttttgactgaccatacctttcccttgatgctatatttctccctcatgcgctcatctgaacaaagaactgactgcgaatttcagctgccaaaaccaaaggacagttggaaaggctttttacaagcaattggcaagtgtgctctcaaaaactgaatatataggtgctgtttttctcttataaattagtattgaaatctagcctctattatgccatgggaatataaaaaggagaaatgaaggcagaagtatgtggtgactacattaaaaaaatgagtccactattcttattcttcttcttgttatttatttatttatttactttgagatggagtctcgctctgttgcccaggctggagtgcagtggcgcgatctcggctcactgcaagctccgcctcccgggttcacgccattctcctacctcagcctcccgagtagctgggactacaggcgcctgccaccacgcccagctaatttttgtatttttagtagagatggggtttcaccgtgttaaccaggatggtcttgatctcctgacctcatgatccacctgccttggccacccaaagtgctgggattacagacgtgagccaccgcacccagccgagtccactattctttcttttctttacacataattccaaaatcaaaaatagctccgagataccagatgtctttgtggtaactcattcaacccaacttgaatgtatttggtgcctgaaacttatctaacctaccgtgagattatctttatctctctcaatgtgactgttcatatgcttcactgcaaaaatattagtgtgtttgatgacaggggtgttgtagaccccactgggggtgctatagaatctgtgtagtgttacttctataaatctgacaaattctggattttagaacagaaaatattttgttacaagtgaggcactgtgctgctttacagactttatctcactgaagcctcacaacctcccccagacgtggacattgctctgatctctagtttatagatgaaaaatttaaggattcaaaggtgaaataagttgctcagagtcactcttctattatagttacgcactattgcataataaacatcccggaaatatagtgacttgaaacaacatgttattgttaacacacacttctgtggattgactcagctcagctgagtggttctgatatgtggctgctgtcagataggagctggggttggaatcatctgtaggattattggctcacatgcctatacctcagctggaataccttgaggctggtcaagcatgtctctctgcatgtggcctctctgcatggctatattattcctcccaacatggctgcctcagcatagtcagaagcagctcctagactagaacaagtgttccaggaagtggaacctgtcagtctattaaatcctgggctcagaaactggcatggtgtcatgtctacgtttttcgatgggtagaaatagtcagagacatcatatagtcagttatatcccctctgatatctcacaggggatataactccaagtattcatgtaggaatggaggctgctcagcttgtaagtgaacatctgggacttaaatttacatctacctagtgccaacgtccattgacaatgaagtaaaacctacctgtcacccatttttccctctgcatgccaccccgacctggtggcttaatattccattttttttcagtcactttcctataatcttctacctccaccagactgttctgtaaaaaggctattctgatgatgccaaaacgtagacctgtgctttatgtatttgaaggaatgggcagggagtattcttctttcccctctcctctacttacatgacttcagtgatcctgatttcaccctcatttttaaaattttcatcttgataagaaatacctaggaaataacaaacaaggagattcaggtaagaattgatgtgaggaagagaactggggagagcattctggaacattccaactacagtgagcagctttactcctttctccaccttcccattacctccaaactctaacacattcctcctactaaaatgtagtatatttaatgtttccttttttttaaacatttgccccagctcctaacacagtgactgtattaattcccatttctgtctcagaaatgcacgtgtgaaactccataggctggcagatatgctccccagacatgtcacctatgacctgtctctagatctgccctctatccaaacggaaagtggaaaaaaatagcttggtcatgcttgttagctgataaggttttagctttggctatattgagaccttgagctgtttttgcttttgttacttaagctgtgggatctggtcaacttggagacaaatagagaaggccttgagaattgaggttctatactgatttgtgggggaataatcacaatgctgttcagaaggagagttgttgcacttgctgtctttttaggaagaatcaaagcttcactgggatttggctagctggcagtcataattttgaaccctatccccattgggccaaacctatcacatgtgtcaaaatgacatggttctttcaggggacttttgggagtgagatccacagcaggcaactctgctaataaaatccagctcaacagtaacattgcattatttagccttcctcagagacatctggcatttgtcttccatttcctttctgttacaactttaccccctggatgctggagatacaagtaacccttcttgctgtgtcttctcttattctcccaataactaagcaacttatttctatttcttaaataaatctcatggttttctgacttctccaaggtcctcttgtcaagtcaaatgaaaactactgatggccccttccaaaaaaaataagtatcattacctagaatgttcctgaattctggttcattagcacaaggtgaagacatgatgtgtcactttttagggccttatcctcttgtttcagtgatgatgctgtagtagacaagaacattttctaaaagagaattatagtcttcagggccaagaaagtagttaggccagcagtcatgaacactatgctacaaacaccagataagaacttgttgccttgccagtggtagaattgttacaaatctatgtgggagggcctttgggatcttctcatctaattgcctcatttttctattaggagattggtacccaggtaggtaaatccatcttcccacagatatgagatgacacagtaaggctataacccagccctcctgatttctcctagctcagtgactgttctgcaataatgtatttagatcagaattcctttctttgtccatcagcatatcctgagtgttttactctatccccaaattacatacccctgtgatttatacttatgtcacatcaaagctatttttaattttctaggtctcttttaaattttggtacgttggtcaagagacctttccttgatctttctcacttgctaccaacgttttcattcctaccctctgtctttattgaactgttaagcccatgttgtcaggaaaattggcacacctttttggccaacgaattaaaggcaaagggataaagtgggttctgctgatcatcatatagctttccatctagtctcaccaggcctggctgatggaggagatttccacctcagcaaagactgtaactacagcaactagtgagttgtattgtccactttatgctagctggtgaggagatccagccaatgtggaagggtttgtaagtacatacatgtagtcccctgcagaatctatgccagaatcccatagtttgggcatgcgtcaaagacatctgatgtggaggccccctcctcacctgctcagggtctgagagactgtgactctgatctaggtgtctatctggcagtcttaatgagggatcctccaggaagcaaaaatagtgcaaagtaaaagggttgatacccctgcctttgacctttattttcaatctaataaacttacctttctcaggaaaagaggtgagagctggtattttggttttggtaactagggtctggggacaaggagctggtcacgtgctctgacagaaaaactaggatttcaacccccagctgggagctggaggggagttctgtcttcctcacttactaagcatgcttgaaaaacattaagctgaatatcagagcttgattgtcctgcagatgccacccattaagacagcaagggctgaggaaggagcctgagcaagtatagaaaagaacttacctaagagatcttaaagcagaacctggaaacactggaagcaggacataaattccttttgcacagcaaagcgatcttgtgttcctggtcagtagaggctcctttactttccttcagctaatgaaccacaaaaagaagatatatatagtattgacttctgaggccagggaattttgttttctttatttttctaaatttgagtagcatatgcttcaaaacatcagatatttactatcctcaaaatgactggaaaacttagaaggataaggcacaaggaatggcctaaataggcttaaataacaaatcccactaatggagtgatggtatataatggaaagacagtgagacattagtcttctttggaaataacgtgtaagaggattttgttaattctcattacttttccttcacttggcactgtaccccacccccgcacttctaactgttacgatagctagaactaggcaaaatgggacaaagtaattcatctgatcatatctttactcattttcagtccttatctcaaaatttgtgagtgatataaaagtcacgatccattagtggctccatacccttcataatgtgatctccattttcctcgcaatcatcaactcatggcacctccctttgatctatcctttctatgccctaactacgaaattagctaaaaaatggtgtagactttcaacacacagcatgtgctctttccttccacataatgaacatccttgctcttacctggtaactcattacttgtcctatacattccacttgacttgtttctccttctgcaaggattttgtcagtgatgttatcatatttttctgatgcatcttctttatgaatactttttggagaatgtctctgttgctggtctcaggcccagggcagttttacttctctcttaggattggttcgtatttatcttatcaacgcttagtagtgacatctaccagcttttcccttttgcaatggttgccagaactctcagaggcaaatttgtcgcacatttgtaatcaagagtatgaattttcccaaatacatttctggctatatttttacaagctgaactgttctttttctcccctttactttaaaatgtgatatcttatattttatggaacctctttctggagcaaggtggccaaggaaggaaggaagagaaagggagggaggcagaggaagaggatgagaggggagggaaagggaagggagcaatgagaagggaaaggaagagaagaaaatccaaattcaaagcctactttcttcatgagtctgtcacctgaaaaaattaatcactttccctctgagctcccccagtacttggaagaagcctctgttatggctgttatagcacttacatctctgcatgtcaattctttgtcttcttggacttttttccctcctatctgactgcaaattctttaaaacaaggacgacttcttcctttttttagtattcccagcttctggctcagttcctagttcaagtaactgctcaatatatgtttattgagtgaacagtagctgaaaagtagctccaggggtttaaaccaatcacacaagttgatttacttaattggagttctgttcaagatttagcctcattctctgaatcagacttgtgaccttcagaactttatgtgtgactagtcacagtcatatttctcattgtacatgtctccaactgactttcagcaaataacctgcagctttatttaatacaaatcagatcatattaaatataattaaaaatctctccatgaaataggataagatcccattggggcatcacaaaacacaattataccttcatggcatatgctcttttttagcaaatctacttgtgagtattaaagtctgacaatcctttctcaaagttagtatcatcttttaaataataccatataccaaataagaattaagaagtcactgtattatttctatcctggattatttctctaagcagaatcatcaacattgatacataacagggatttatttgagttcaatggcaaatcagttacatcagtataacagttaattatattcattctctttaatagatgatgaaattctacaatatgaacttaattaaaagtatcccagtgagcacaggtatgctcaaagtttctttctgcgcaagttgaaacagatgcgaccactggaagatttgctcacttaggtcttccaggtcattgctagggcaattacctaaaatgtcatttgaagcattaaactaaaaatataatcatctgaagaaattattattgattccgattttctctctgttatttggagaagtaataggcacaggaaaaaagaagacagtattgtgagtaggaaaatagattatcatacagtgtttttcaagttgcaagaaaagaagcatttaataatttcttcagacaggaacaaatcatcatttaaataaagggacaaacaaacatgatttaaccttcaacacagatatgtgttacatacacatgcattcacacacataaacacaggcacttgtgggttagagctctctctggttaaattataatgtcaccgtagtcactaatcatgaccagacaccaggacaggacgcggtacagagcaatccacactccagctccccaacttgccagcaggctgctttgcagtgtttcaggaaagaagaagaaaatgagttgacatctgcaagagataatgtctggaaattcacttctacatctagtaaataactgccattctttccaaagatgcagaatttcgttgataagctatctcatcagtgacttaaccatttggaaacatctcccttcaacttactgttccgtgttctcaaaataatagtttcagcaagatcaggggaagctacccctctcctttttttcccccttcccttgctttcagcaccatcaaaatctggagagctgaatagagattacaatttgtgaaggggaaacctaaggttgtatgagagatatgaaccccaccccccaattcccaggggaaagcacctgtcttgaactttgcacaaggatctgccactgagtttcatccttattttctcttcttgctctgtattcctcatagttgaatcatttgtagtgaatattttttctaaggcatctgtatttgttttctattgccattatagtaacttaccacaaacttcacaacttaaaatattccaatttattattttataattctgaaggtcaaaagtctggaatcgaactccctaagctaaaatcaaggtattggcagggctgcatccctttctggaggctccaggggagaattggtttctttgccttttccagcttctagaggctgcctacattccttggctcatggtctcttcctccatcttcaaagctggcaatgtctacttgtgtgtttctcatgctgcatctctctgacactgactctcctgtctgtttttcttacatggacctctacaactatattgagcccacctagataattcaggataatctctttattttagggtcagctgatagcaatctcaattccatctgctatcttaattaccccttgccatctaatttaacatattcagattctggggatgtggatatctttgggggaccattattctacctaccataacatctttctggaagcctcagcttctactcaaacaagctgaccccaagctaggggccacatctcttctttgtactcatgcatttttttcagttgaagttttttcaattggaataagttccagactcattctgtccggtgtgagagtaggtagcagcatttcaagaggctaagatgcttctgtcatcccaagctttgcagagaaagggttgatggggcacagtatgtttgagattttttttttcctagcctaagaaccaaattggagatcttatttatagatattccaccaatatgtctttattttcttcacatatttttggctagtaagtgttggaatcatcatcatttacatatttcccccaatggaaaatcagttactggaaacagagacaacaaacagatggccattaggccagctgtgttgtgaataaaaacagagtagaactaagttacaaagacatggaagacagaatagacttggttctggccgttagccaggttaaattggtatgtatgtggcaactgtgctgcaaaaccaatgaaaccattatgatcagctagaccacaaagagaaagaaaacctatgagaacactgaagttgtccacaaagaagcagattctaatatgaagattgtgcatcctaaaggttatgcaagataacccattggggtgtgaaacaaactgtaagcatttttatacccatatctctatttaaaataagaacttcaactttaccaatatttaaaatacaagccaggcttgttgtcacatgtctgtaatgccagctactcaggaagctgaggcaggaggatgtcttgagcccaggatttcaagaccagcctgggcaacatagcaagaaccctgtctcaaaaaaatacagtttgacactgccacactcattggctttgtacttcagccattcacatatcacacatgtgtattaaagaatttgggctgggcgcagtggctcacacctgtaatcccggaactctgggaggccgaagcgggcagatcacctgaggtcaggagtttcagaccagcctggccaacatggtgaaaccccatgtctactaagaatacaaaaattagccgggcgttgtggtgcatgcctgtagtcccagctacttgggaggctgagggaggagaatggcttgaacccgggaggcagaggttacagtgagccgagatcgtgccagtgcactccagcctgggcaacagagactccgtctcaagaaaaaaagaacttgtttgtgactggggtatctttggttcatatgcagtcaccttaatgtggctaattgcaatactcatgaaattgctaagtagactgattattatattatctagttttaactaaattgacccttacaaaatggacaagtgcttaaaaaatatgcacgtatcttaaagattctataagaaactgcataagaagataaaactaagatgggcccgggtaagcatgaagcaaaaggaagaaacagtattcccccaaccaccagtgtaatctcttcagtcacagaaaaatgcccagtgtgatcaaatcggacacattcaattttgagcacaaaaatatttttgtattttaaatgcatacagtaaaaataaaaatcatgttatattaatacttgtttcatcttccgctctgtttaaatttttatttagtgcatattttaagatgtttgtaatagattagtacaatagtccatgcttgtactttatattctgagggtgtatacacatattttgagggtaggtattcaaatttcttttatggataagggtacacaatcaagatggtttgtagaccattgctctagaggatagagcttttggagggaggcaacaaattccaaaggaaaggtttggcatggaaaaacacttaaaagctcactgagagaagggtgtatcagggaactctagtgtaggtcataggacttgctacactaagttgcaaatttgtccaaatctgacattgccaggaagctaagtcttgcactaatctttgtgtagtacttttatcctataatagggtccatgacatattagataaagaaaagaaaataaaccataagggtctcagtgagatcttcaaaattttacacttctactttgtttttaatgcttagtaaaagaactgctgaaaaagtcattaaaaaatgagtattttgtctttaaccaagagccgggaagtatctcagaaacatatttcaacattaaaatatcaaataatcaatttttataagaagtgcatttaattagcaacttggctatagctagcacacagtgagttaatctaataatcagtgactctctggacagagtcatcttaaattcagctattcttttatcgatttaagaaatgtaataatatgcattttatagcaaatggctagaaaatttcagctacagaatacttcattctatgaagcctgattattttatggcttagaagatgttcataacttctgttccaacatgatacagaagcatccttcagaatgttatctttaagatcacagaagttaagagatttaaatttcaaagtgaatattatccattttctgttcttttttagcctacttctaggcaagccctctgatgccctcatcgtttgtttaaagtttctctttcttccaggctactttgcgaatcaattccagatcacagaggagagaaaaccttattccttttttccaccccaagctcaccttcctagacaagatttttatctacattaaatacattcgctaacccaggatagtgacctacccatagcagtggcttctgtggagctcagcagaacatagagaagtcccacaatgcttgattaaagccatcaggaaagcctgaggtaattctaaaagatcccactctgtggtacaaaatggccctagaagccaatcttctgactacttgtcattttatttcatttcatttcattttttcttttcttttcttttttttttttttttttgattcagggtctcactctgtcaggctggagtgtatggtgtgatctcggctcactgcagcctcgatttcctgggcacaagcaatcttcccacctcagcctactgagtagctgggctacaggcgagtgccaccagctaattttttgtattttttgtagaaatggggtttcactgtgttgcccaggctggtctcgaactcctgggcttaagtgatctgcctgcttcggcctcccgaggtgctgagattacaagtgtgagccaccacctggccttgtcattttgttaccgttaacactttcctctaggtctggttcccaatgcgcagaatccggggaatttgaacagggctctcttggagagttgtttcattctatgtgctgggataaaaacaaattatttttcctgctaggaatgcactaaagatccctccactgtatcttccaggaggttcatattagtatttgctttagggataatgttttggattgcaccacagagcaaagtttttggtcagacaatctaatgggactaataacagccgacctgaacattgacaattcttgcacattatcccattccatcctcacagatcagagaaacccaattaggtaacatttccccacttcatagaccagggaaggaaatttctgagaggttaattgatgtgctgaaaggcacataaagtgcccggctcagtcccacgtctggctctagattcctttttagttcttctgtattatgctgtctcttctaaatggattattaggttggtaatgttattcttagtcattctgcccaaataatgaataacagattatacatttaagatgttaaaatgtatcataattttattataactgaaaatgttcagaatttttttaaataataattttggggaaaagaaaacttccttatacattgtttcctcagtatttttttcattaggtattttttccatttggctgtggcaatccttgagattgattctcactgtcagggtcataactctctctctttcacccagcggtaaccatggaaacatatgtataacacgtcctgcttcttttaatatgattattcatgagttgccataaaaatataaagtgtatttgtttgcatatttaattgttaaaataacacaagtatttgcttttaaaatacctactcatagctctgtggtcatgtatacataaagtaccaaccattcttaaatcctaggattaagaagtgacatgttgcaaatttagagtaccttgctcttcaccagttgtatagcaaaagagttttagtcagtttagaagtaccatgggtccaccgcgtggtggctcgcacgtgtaatcccagcactttgggaggctgaggcaggtggattgcctgaggtcaggagtttgagagcagcctggtcaacacagtgaaaccctatctctactaaaaatacaaaaaattagctgggcatggtggtaggcgcctgtaatcccagctactagggaggctgaggcaggagaatcgcttgaacctgggaggtggaggttgcagcaagccgagatcgcgccattacactccaggttgcagtgagccaagattgcaccattgcactccagcctaggcaacaagagtgaaactccatctcaaaacaacaaaaaaacaaaaaaacagaaaaaaaaaaaaaaaaaaagaagcagcagcagcagcagcagtaccattggtcgaattagggttcctgtcccatttttctgcatacatttaaagtctaatgtgatatagtaagtactttctcctttgaagatcagctataatctcagaacttaatatttcacttgtatagaagttactcttaaatcagattctatgacccagacagccatccagaattttagttcgtcatctctagcttcctaataaaaatatccaagtggatgtcccactaccccttccaattcaatttgcctaaaaccaaacttgttatctttccttcagggttcaagtcctttcagaaatttcttaattcaatctccaatcccatcattctcttagttactcaggcttaaacttttgttatcctacggcattttctttctctcttctttcacgtcctatatcctataaattattcttagcttctactagcctttctatttccactgccacacttgttacattgtgctgagactaccctacagtgctttaacaagtcttctcccccagctctcatctctttgtatctgccttccagtctactccaaggtcgaactgtctaactcaacattttgcatatgaccctcaccccctcacgacaaccatttcttctaaattaaattgatgtataacaccattcaaaagttatttctttcagcttcaaaacaatcactccagtatatacattacttgccaacatgatgtgaggtgaaccacatttcttgcccacacgctgttctcatttctgttctagttcctcacttatgacttgtaaattgaaagcacctagatttctgttgttattctggatgagtaatggcaggacaaccctaaatcccaagtatttctgtggctcttttaaggaaaagaaatatacaaaaatagtctaaaggaagaaaaatataaatattctaaacattagtcttatatctgtgttacattgccattatatcagttttgcttgaaataagactgtggagattagatattagttttaatttatgacatttggcaattgtaaacaatttgtgttactttattcttttagaatctgtgtagttttccaaaattaaaattaaaattccatttctagccatagaggagtcttcttagttctatttgagtcaacaatcatttttaaagttttaatttgaaaattaaggacagatccaactaggattgtgagtccagcagacatactgtgtgagcacacagctgtggcatatctgtggaacggataagggtggcatattttggcacttgtggaacttattcccatcattttaaacaatgcttggtaggtttatatcaacagatttattttcccttcagctattacgagagtaaagcagagacctaaggtctggcatatgaatcttacaaatgagggatttttaactaggagcgactctgaaagcttcttacattcttgggacagtctgcagtcatagattgaatgagaaaagcctcatattttggctgggtgcggtggctcacacctgtaatcccagcactttgggaggtcgaggtgggcggatcatctcaggtcaggagttctagaccatcctggccaacgtggcgaaatctcgtctctactaaaaatacaaaaattagccgggcatggtggtatgtgcctgtaagtaatcccagctacttgggaggctgaggcaggagaatcgcctgaacctgggagatgaaggttgcagtaggctgagatcactccactgcactccagcctgggcaatagagcgagactccgtcaaaaaaaaaaaagaaaaaaaaaaaaaaaaaaaagaaaagccccatgtcttttcattgaccatatacgatctcttaaccagcacagcattgatgcatttcagccatctcacaaaacttcccttttatcattctgaaatgattttatctttcccaagagactgatagacaaagcagctttgtatactcacgtcctggttattgtgcattattaggaaacagataggaaagctaccctcatacagaggctatgtaaatattatttggggaagaggaaaaacacatatgggtgctaagaagataagacagtgcctctgaccgttctatttgatgtttcttaaacctgcattgttatgaaaactcaggtaaatgaatttgtaatgactactgaaaatgaaacaggagtatacttgaataagtattgacatttttttttcaggtcatttactttaagactcacaaagaacatattagctaatagaattcatggccaaaccatgatgtaaatggagctaaggtcagaattagattccttagggagctgaagaaaaaacacggctatgaccctaaaaccaatctgctgactgttttctgctgactcttttctgatgcaaagtaaatggtgggaaaaaaaaaactgatactaaaaacaaacaaataaacaaaaaaacctctaactatccaaccacctgtgcaatacaatagctttctataaaataaaacagaatggaaaaaaaatctcaaaatcatgagttgaaccaatgaaacatacgggttggttcagcattgcaaccagatgtcatcttaataaaaaccaacactattagctctttgatgattaataatagtaaataccattatcacactcaaatatgactctttaggctgggttactaatatatacaatcaacctgcatttttcccgtctttccggatttgacaggaagagtggctgtggcatggaggaagattaaaagtctaagagaacctcggatttagattctagttgcggccctgccctttcttagttgtgtgaccttgagaaaatcagctaacctctctgaatcctatcccttcacttgaaagtgtgttaaaatggcacttatacatgataattgtataaatacgtttatatatggcatatataagtaatacatatgtaatatgacagtattgaagttaatataaactaatatgatataatgtgtttatatactatttacaaattatatattaatataatgtatttatattaacataaatacatgtatattagtttaaattatatatgaaaatcttataattaaaatttttacatataattattaatatatcataaatttctatattatatataataaatttatatataaatcatatctatacacacaatgctttgtcatgtggggtcataaaagagtactgcaatcattattatgtcttcggttaactttacaatgaaaagcttcttaatcaatattaaactacgggcaaatataatgctgctgccttctaatgtaatttactttaggaaaagcaattgatgagataaaaggtctttctcttttttcatttttatttttttgagacagagcctcgctctgttgccaggctggagtgcagtggcacgatctcagctcactgcaacctccagttctctagttcaagcgattctcctcctcagcctcccgagtagctgggattacaggcacacaccaccatgcccagctaacttttgtatttttagtacagacggggtttcaccatgttggccagaatggtctcaatctcctgacctcgtgatctgtctgccttggcctcccaaagtgctaggattacaggcgtgagccaccgcacccggccaaggtctttctctttttaactttgtttgcaatacctagcttgccttcatgctgttatattaggttagcattaattttccattattggagcagattgcctacaagcacacacatacaaatagtacactgaggaggaaggagccagtgctgaagttctttttctgaaacgtaatagagcttttctcattactgcaaatacatgaatgaatgaacaacattgcaagcacagacgttgcatacattctctcatcaagcagcgccatcactgccttagtactttttgttgttgttcagcattattgatttttccaacaatcgagtttgtttgcaataaactgaactggagcataaccttcactaattagaaaaaatgtatgggtattagcttaaggaagcaataacacttcttgtacgttttctatcgaaactcagggtgatgctttgtaggagtgctattgtttcttttcccccttgtgacaatgttgttaagtatgatgcaaaaaagtccaaagaccttttaaataatttgcatccattctagaaggaagaagaactacaaaggccaggtgtgaatggatatgaaaatagcaacttagaatagaaatatctgccattactctctctgcatacctctaagcctttgtccctatttacaattgtttttatattctggtccactttgaaagtgaacaccttaaggatctttgttttaactataaaatttagaaaatattccttgattcatatttatatttgctgggtaattatcatttataaaatcatagttgaactaagaagctagaaaaaactacatgtgtgattaactgtttagtttttcaccatttctggtcaggctgtttgaattggccaatgcagatttcttcatcccagcaaagcttaatcatagaagtaatttcaattatataataaataaaagctgctttgcctcagcatattcagtgattaaaaatgagtcgttttttaaaattttcaaatctgacagtatttcttgaaagaaataatttgtgatggaaataaactgaaaatgaggaatacaatggtcattgaggtgcaaaccaatgcaacagaataaagttaacatgaaatttgaaattattgcccagaaatcaaagtaactataaaaatatagctgttattagggaaatctctagtaggaaaagaaagccagaaattatcacattagcattaccatgggatgtcattctagttcttaaatagaactaaagacgagagcatcgtgactctaccattcatatgaaggagactaaatagacaatgatcttgaatccatttccttttaaaaatcttaacagcatagggtaagtatttggtgatggattcttggctgcagaaaattcctcatgataaacagggtgctatcattaaataacacacatgctaaatgctgggaatacattaattcctccaagtccaattccctgtaagtcatcttattctctaaaaatcattgtcataaagggaattctgtgtgtgacatctgagagtaagcatgtttagaagtgtctcaagagtacctgacagtaataaaatcaggaaggtaagacaagaattatccagtctttgcagggtcaaaaatgacccttctctttattccttaagttttttgtgtttttttttttttttttttttttttttttggtgagatacagtttagctcttcttgcccaggctggagtgcaatggtgcggtcttggctcactgcaacctccacctcctgggttcaagcaattcttcggtcccagcctctcaagtagctgggattataggcgtccgccaacatgcccggctcatttttgtatttttagtagagatggggtttcaccatgttagccaggctggtctcaaactcctgaccgcaggtgatccacccacctcggcctcccaaagtactaggattacgggcatgagccaacatgcccagccctattctttaatttttaagtagctttggccttcactagcattactacagtcctatatgtaaaagtatactgctgatgaggaaaatatacctcatttaaaatgtgtgctttaaagtcgagtctctgctatctaccataccaatgtaggttttggtcactatcaagttattttcgttctcagcaagtaaaactgccatgttcttcatgatttttttctatgcatacacagtcattgctaagataaacattatttttagacatcaaaattcctagcttattattttacatcatattagtgcaattgtcaagagacaattttatatttcttaattcactttttctctttgtaatctgagttccccaaataagagaaatattaataagggtggcatattttggcacttgtggaattaactagcaatatgtaaattcctaaatagcatactgttaaaatgcttctattcttcaaactctaataatttgctaagaaattatgataataaattttaagaatttttggctaagtgcagaaaaatctgttgaattattaatacattagcaaaatgtatcatttagggaaataattttattgtaaggaaagaacttagaaatttgataataagcataatttaatgaataattttctgaatgagtcatttctttgcaataaaaagaatttttctctctacatatgtgtggagcaagtttctgtaaaggaatccaaaacttgtaaggaagggaagccaaagaattaccaaaaaatattcctgggtgttttgaggtttcataagatatttgataacatattgaatgactctctttgtgaaacatttagtagcagacagtgcaggaaaaagctcattcttttttttttttcttcgcgacaaattcttactctgtcacccagactggagtgcagtggcgcgatctcagctcactgcaacctctgactcctgggttcaagtgattctcatgcctcagcctcccaagtagcagggattacaggcatgtgccaccatgcctggctaatttttgtatttttagtagagacagggttttgccctgttggccaggctggtcttgaactactggcctcaagtgatccacccgtcttggccttccaaagtgctggaattacaggcgtgatccgctgcacccagctgaaagctcattctttactaatcatgaaaccctatattaaaaaaaacaaaacaataaactattaggctggtcttttccagtgatatagccaaagcaccatgccagcaagtgaaacataataggccctcaataaataattgttgaaatagccatatgatcagacttcacacacaaaggctgaactgagttgaggtaattcaggatagaacccactggataatcaagcacataatattggctttaattatgtagctgtttcagaattgagaggtgatgaagggactcaaacagcttgatgctctggctactgggctgtttggatggctatgtgctctttgctcttactccattgtgaatttctgaagccaggacagccttaattagatgtgagtctgatatgataaatatgttgctatggtgaatatgaatgtttcatacaacaatatttcatgccaattaacagtaaattccaaatactttgccaataaaattgaaaataccattattccattggcctgtccatgatggcataaataatgcatatttgtttatttatcaagagggctcttattgaacaccctgagctttctaacagttatctcccttgtgcagtgtgccagctcattaggaagactaaagtcacagtggagtcatcctgaaatgacttcaacacaaattccatgtaaaaagatttttggagagccatctgtcccggggtctaggttatcttttggaaattggaactaaatggatgaaaagtatagaaatgctttggtcttccaaatactttcttaatcacctctaattgtaaaaagaggaaaaagtggctttaagaaaaaatagcaaattaaattaattcataagctattttgtatgatacaggagacagacatttataaaagtaattgtgcttagttatcttattgcaagccttcatctccacatttgacttcactggcaaatgcggcaacttacaaaacaaatcaggccatttcaacgctagtactacagagcttgtttttctcccccaatcttaaagagacttcatggatattttaatgttagattttacaatttaacatattaagatatgattactaaagactaattcttgtctctgctacctccatgatttcattactgtcatgtgccgttgggacgcttataaagccagaaacaactgtagcagaatgtgtagattacatgccattagtttcactgttcataatgccgagcatattccagagtatgtgctgaatgcctccaaccttcatgaagatatcctttttccttttttccataaaaagacatcattgatggcaactagtataatggacagatcattcaaaaagcacatttgatcatcaaacattttccaggtaccaaaaactttctggaaacacacaatagaatttaaacctagtaagaaggctggatgtgaacatattgaactctaagccaataaaatgtacaataatagaggtatgcaattagtatatggagacacagttgatgatgccattaatttttctttgggaggtaataattataacatctaatcttaactgagtaattactgtgggtcacattctgctttaagtgctttaaatgtactaacagagtgagagggaatggatattatttccatgtttttagactctaagatataatgcatcttatccaaagccatggggctagttggcagtggagctaacattttaactcgggaaatatgggtccaaaacctaggtttttggcccccaggccatactgcctttctgttttagagtcatctaagaaaagtctggagacaaattgatatttttgttaaaatctaaaatatgaagatgacttcatcatttaaagaaagagtaggaagagaatttaaacaaaggacatatagtgagcaaaattaggaagaaatatgggtccaaaacctaggtttttggcccccaggccatactgcctttctgttttagagtcatctaaaaaaaagtcatctaagaaaagtctggagacagattgatatttttgttaaaatctaaaatatgaagatgacttcatcatttaaagaaagaatagaaagagaatttaaacaaaggacatatagtgagcaaaatgaggaagaaatgaaagggagaataaattgatgggaagttgcccaaagtttgagttgctaaattggagggcatgcaggaagcagcatgggaatgaaattgtaaagggagatggagcccagactaggagtcaccttgtaggccatgaaataggatttgggcctgttctgtgggatcccttaggggatattgttatactcactcttaacattatactgactccctagccaggtcaaagtacaatttaagctgccaatgaaatatattggctttaaatttttgtcaccatttttaaagtgtagtgtggaactgaaacattatataaacattgtatagacaaaagaaaccatctattctaaatattcttaagctgtttgaataatgattggtctaaatgtattcctttcacataaattatataaactccctttgaaatgatgtatgagttaaataagcaatttttatgttaaaaagttcagtaattttaaaaatgaaaatgctcttactgaagcctccaaatcatgcatactatatacaatcttttatgttgtaaatgtccatgataaaagaaaacaaacaaaacaagacatcagcaccaccaccaataaaatttcaatcagaagggatcacttggtttgaaactttatgcagctctcagatagccagactttctttgtcaaaaacattcaatacaatgtttaggaagtgtcgtgtttaacagaaaacatcatgtgctaatattaatttggaaaattctatgtggtggctgacaccctacagtgttccagtctcttggaagctattcgggaatagtgagtgttccttctaactgttttatgtgggggtatgtggaatcttctaatctccaaagccactaggcttctatcctgactcttatttcctgatatatggaccctcttcttaactctggagtgttggactttctcttttctgcccttcactggtggcttggtttagttttctggtaactgcatttcttcctgagcacatccagaatcttctcagaggaggcaatcattccattctttccttgtgacacctcaattctccatctccttacccaaagagcctcctttatgtgtcactttccctttgaaattatcttttctttcttagaaaacttttcgtttctattttaagaaaagctgggtaacgtaagaacatgaaacattaagaggcagatggtaaattgattagacataagatgcttcgtatttgtatcctctgtcctgttttccactttttcttcagaaagtagtccgtgactttgtattcatagctgtttttcactttacatatcaagaaccaatgtttgggaaacaaataattgtgagtaagtggttatattgagttgcatatcagaagatatttaattttataggttaaatttataatatgaattgctatggtataattttgagaaaaaaaatcatttttagtcattacaaatatttattaatggccacactaggaaacaaagattatgagcctcatataggatacattttttgaacttgcaaaggaatacaccatatttcattaggtcagtaggtctttccctccttaggtattgatacgcctacaagtgtaatgacgtggcatttataatttggtaaaaataattaaagttcatttttgtgaacaacttagtttttaaccaattagaatctacttagatacattctataattacatcaccctaagatatttacaatctgatcaatgctatttttcatgaggaagagtgatagaattagagccacagtctagctgatgtaattatagccatggaacgaaacatatgtgcctgccatttatctcaggtatctcattgaaaaaaaggatgagaaaagctgatccagagtaggtcactaagcatcatccataaattgagaattggttctcaaacaataactttgaatcagcagaaatccagtgtttgctaaaagctatacatgaagagttaaagtagttgatcccctcaactctagtctctgcttatttttatattaaaagtcaaatgcttgctttgttctgaaattaatatacatatacacacatatatacatatatatatacacatatgaaatataacatgaatatgtggattatatcagagcaagtcatcatctaaaactagattctagctaatatttcagcaaatatgggctaaaaacctatgtggccacaaaatattgatacagctgtgaataaattaggtataattccttctaaaattttcagtctacagtggagacagccattaaataaattatcatgtactaaccaaaataaataactgcttatcattactgaatttctgatgttcttgcaaaaacaatttgaaaaactatatgtataaatttactactgaatatggtagtcatcctttaaaagacaatttaatggcttcttggccttttggctaagatcaagtatagtatctgttcttatccatttaaaagacaatctaccataatacctgaggaagaacatatattttataataacataaatataatacgtgttctcaaataaaaattaagccttctaacaagtgattttacttttaggcacgtaacttcaaaaatatggaaaaatggacgctgggtgtggtggcccaaacctataatcccagtgttttgggaggccgaggtgggaagatcacttgaggccaggagtttgagaccagcctgggtaacatagtgagaccccatctctaccaaattattttttaattagctgggtgtggtggttcacacctgtagtcctatctacctgggaggctaaggcaggtggatcacttgaacccaggaatttcaggttgtagtgagctgtgatcacacagctgtgctccagcctggacaacagagtgagaccttgtctctcaaaaaaacatgaaaaaatgtaactacctatatctatatatcatatatatgtgtgtgtatatatatacacacacatatatatatgataatatgtaactacctatatctatctattttatatatatatatgtatatatatgtgtgtatgtatatatatatatatatatatatacacacatatatatattaggtcccacagatgtacaaatttttaatgtacttttattgtaaataaacactgctggatttatatatcaaaaatattgctgattaagacttgatggcccgggcgcaggggctcacacctgtaatcccagcactttgggaggccgaggcaggtgggtcacaaggtcaggagatcgagaacatcctggccaacatggtgaaaccctgtctctactaaaaatacaaaaattagtcaggcgttgcggcatgcgcctgtagtcccagctactcaggaggctgaggcaggagaatcgcttgaacccaggaggcggaggttgcagtgagccgagattgcgccactgcactccagcctgggcgacaaatcgagactttgtctcaaaaaaaaaaaaaaaaaaagacttgatagacattagaaagttaactgagggaagtcatcaaatccacttccttaaataggtaagattctccttcgatggtgctaattcctttgagaatacttgaatgaaaggagatgagcgttcatgtattatttgaatactgaatcaatgctttcctgagtaaccttggtgatatggtccttccacatctgagagtttattttgcatccccagatattctaccttcattgcaatttttcctccaattggtttagaaatggtacagaggaaagttagtaaaagtaatcactctaaaagtgagtcatttattcttttatcctatgtaagtaaaagaactgaaaatcaagcagttagctttaccctgtggtctcaaacatatgagttaaaagacataataaaaactatcaatgtgtccaatatatttgtccttagcatcattaatctattccttgtaaggttggagtttataaaatgagactccataaagagagagatacctagtctaaatcaaagtgtgtgcgttatgacatagtagaatatattgataagttaactgaaatcaggtaattgcgggtagattggcttaacatgtccaaaacattctgtgtaagttaaatgactggtaagtaaaatggtgggactcatgaaagttaatttaattatatcagtcaaaaatacataaaataatttcaatactgttacaacctcactctagtaggtgtttctcagaggcacttgcttcattgtttatttgtcatcattcctaataaacatatatttgagttcatgtcatctaaaaataaatggcctaccctacagagacatggaaaactgatgtaggcatacactcacccaacatttaatgacctgaatccatctcaatgacttccttttctattcaaataaccagtttggaatttgatttactaaaattaacttttgtggtattgtttcaacaaaggacagccttttgtgtgacaacctataatatttagctactaaaagacctaccatatttctctcccactgagaattatttgttatctaatatcacttatagacttcatgtaaatcaaataattatttctggctctgcatggtgtaaggatgattaaaaacttgtcaagctatcagaagaataaggccacttcccagcatggaatgacattatttattctaggtccaatgattggtaccagaactgacccttaataataatatttatgacatgggggtgggaggggagaaaccatttagaatgattagtcttatcacaatcctaaggcattagaattttcaaaagtgctgaaataattgtgcaactttaaggaaatgtataagaaggtagctaaattatcactgaagttagtgaacactatgcagtgctaatcatgtatggcttctcaaaagcatttaacactcttgacaactgtcctcttgagatgctgtacctacttccctctctgttcttcaactttttctctattcatttgctgtctctttggctgtttctctgtattttgttcctccattacatatttgaatcctgtgatttgtcatgcattatctttgcttttcattttatgtgctgttctggaaaattctactccttcaagtgcgtttactgcttttcatatattctttaggcaagatctttttcttgaccttcaggcccatatcagcacaccaggagaaatctcccactgataactcagattcatcctggataaattgatctcattatctgtcattcaaaactggcttttcataatatatggctccaaaattcttatagtcatgtagcaaaattcctgggagttattctccctcacagtcccatccattaaaatctgataagtgaactgaaatgctactcaaaactctattctgggtcttctttccccactaccctgactcatgttcccattacctgtccattatcaccattccaaaagactctctgcctgaattcttgcacatctataatccagcttcccaagtgtgtttttttaatacacagaaacgattagccgcaacagcctttaacaatacaagactgcctgaagtccaaacatactaacttgacataagtatcctttgtggtcatatgttgagcctcctttccagcctcctttagcttggtcacctttgtgctctaagtttcagctatactatgctaccaaggcatagcaggatgtttcacacctatatgcatgagcatgatgtgtatgtgcatggacacatatgttttacacaattctcactgcttataaaacacactgcatcagctgtctattgttacgtaacaaattagcacacatttaatggcttaaaacaatacacatttattatttcacaatttctgtaggttagaaacctgggcatggccatgctgggtcctttgcttcacagtgtctcatagatggcaataaaggtgtcagtcaggactacagtctcatctgagggctcaaccggggaaggatctgcttctatattcactcagtggttgttggcagaatttagtttctcaaggccttaattcctaactaggtgttggccagaggcctttttcagttccttactacaagggcttctctataggcagctgcctcataagtatggcagctgcttcaccaaagccaacagtgaagagagtcttttagcaagatgaagttcacaatcttacataacctaatcactacagtgatattccatcatctttgacattttctattttgtaggcaactaggtttagcccactctgaacaagttggaattacacaaagatgcaactattaggaggctgggattatgaggagccatttcagaatcgaccacacccaccaaccccaccttcctttacccccatcaacctgacaacacctgctcaaattattgaagactcatgtgacttaccaagacctcagtttttcaatatttcccaacaaacccaccatgaagttggttactcctttcttcatactcccagtacacctccaatattatttttcaattattgtttacatagttttctctcccgtcaatactttgagaacaaaaaatgtagtgtgttattttctactctctggtaagatcagtccaaagaaagtgctcattaaatgttgaataataattgtttaaagtaaataaaaccacagatattaaatacataaaattatctggaaacaggtaattaccccagggataattgacagctaacgatgtgcttaacatctgaatgtatcatttactttagttagagtacacatggtaatcttttgtgagtgacatcacaaagtgacagattcggatgtctctattatttttaaattctttcaaatgagaaacaactataaaatgaaatgcgatgtggataatatagtatagtggttaagatcactggctttagcatcagtcaatgggatcaaatcccacttctaccacttattaactgtatggttttggacaagttactttaacctctctgttcctttctttactggtctgtgaaatggggtctgaaattgcacctacctcatagggctgttataaagattaaatacaattatttatggaaagcagttaataaagacctagtgtgtatttgactctcagtaaatgtcaatcattattatctcctagtatactgaaatagaaagatgtccataatatgaaacttggagagatgtatgtaagttgttaattatctttaatatatacatagatatatacagttaattcatctatatgtttgtatatgggaaaattgggaagtatacacagatttttaataatgattatttccaggaattagggaagaggtgagggtggataactttatttttttattttgcagattattgtattatttgaattattctaaataagcatatatcacctttctcttttttttgagacggagtttcactcttgtctcccatactggggtgcagtggtactatcttggctcactggaacctctgcctcccaggttcaagcgattctcctgtctcagcctcccgagtagctgggattacaggcgcccaccaccatgccagacttatttttgtagttttaatagagacggggtttcaccatgttggccaggctggtctcgaactcccgacctcaggtgatccacccatctcggcctcccaaagtgccgggattacaggcatgagccaccatgcccggtcgcatatatcacttttataatctgttatggattggatatattcgtccaaaaagatatgttgaaatcctaaccccagaatgttactttctttggaaataaggacattagagacataattagttaaggtgaggttatgctggtgtagggtgggccctaattcagtatgattagtgtccttataagaagagacatctagacacataggagagaacaccactgggtaatgaagccagtgattgagtgctgcagctgcaagccaaggaatgccaaggattgctgacagagcaccagaagctaagaagaggcaaggaaggattcccctacatgtttcaaagggatcgtggttccgccaacaccttgatttggactcctaacctccagaactatgagccaatacatgtctgttgttttaagccacttagtttgtggttctttgctactgcaggcccagaaaactaacagatagccaaaataaattaattaatatttttaagtatatacaaaaaagaagagaaaagacaggcagttgcatagctcataaaattataatctcttgaagttgaagcttcaggttcattttgactcttacctctccggccatgccaatagaattattagtttttgacatcccagccaaatatttgacaagcagttcataaactaatgggaagtgctaagaaatataatatggagctatttctttctattctgttcctccatgaaatttcttctatccaatttccaatcatgcaaatcgtatcaagaaggcaagtgatccaagggttaagcaacatttgattggctgctgtgactgcatgtatctaaagagaaatagaaagcaatttgactacggtatgtgactcaagtgatatgtgttttagataagtaattagaaacaaaacaaaaagtcaattagtttctagcctgtccttcaactgtttaaaatattatagcaataaaactaatggagagttttttcctaactacatcaaagttattaaaatgtagagtcaattagaaaaaaaatataagaatgtacattcataattgttgaatactaacaactcatatcaaatggacaaactgtttgacaccaatatatgtgggaaaggtcagggcttctaaagaaatgtttctttaatgatgaaactttccaattttaattttttttaattagcatcttatagacggaggaagaagagggtcaaaaacaaagaactttttcttgtcttaatatgtatagccatggaagatggcagaagggagtgaaaaaattcaatcaatcatttttataaataaaacaaatggagaaagcagtggaaccagtaaccccaataatggatcctatattattatttattttatttgcctatctctttcacagatatctagctattcatcaagtagacattccctccaaggcacaaagaaacactgaagttttaatctaccattgtttaattctttcttctggcagaaatacttgtgttcataagaaactttccaaattaattaaacttgtttaaggttgatactggccagagactttcctgtcttccaatttaagagattttgatgaacatatgagaattacattacaaaatatggcaagacggggaaagaaaatagaagaggtgaaagaaaggagagggaatgaaaggaggaagaaagaagaaagaaaactgaaaatggaaatacaggccagacgcagtggctcacgcctgtaatcccagcactttgggaagctgaggcaggtggatcacctgcggtcaggaatttgagaccagcctgaccaacatggtgaaacccccgtctctactaaaaaattacaaaaattatgcgagtatggtggtatgtgcccataatccgagctacttgggaggctgaggcaggagaattgcttgagccctggaggcggaggttgcagtgagccgagatcacgccattgcactccagcctgtgcaacaagagcaaaactcttctcaaaaaaaaaaaaataataataataatacaaattttctctcattcatttcacaaatgtcaagtattggccattattcctaatgtaaaaaacaaaacaaaacaaaaaaacaaaacaaacaaacaaaaaatacccaccgtgtttcacattgttctgaagtagttactgttggttattattgagagtgcaaaccacccatgcttcctcttgggctaatgcagaggttaaacagcctgagaattacctgcaccatggaaatgtattctggggttaataagaacaaagtgtccatctttgagttattttaacaactaaaccctagagaccagagataaactaaaggagaataaagaaatataattacattggacagtaatgtcatgaagagttaattaattaggattcaatgagtcataacttattttgaagatgtggcattttagaaaaccacctagcttcattcatattaccctcagacattaaaggtgtaattgttgtcattagcattttaattggtcctgtaatttaatggttatacacgtggttgttgtaaggtcttttaagctgttgggattttaatatttgacatgtagcttgaaaaaataattatgacatttcccagatctgaggttggcctttgcagttaatgacaacactgcgttttcaaaatggttattattgatagtacaaatactcaaatggcctacagagctaccttcatctgtaccatagttcttttttttggagatcactgggattatctaatcagaccaacactgccaccatatttaagcagtatgtaatgtatggtagatatattgcaaaatgccaaaagaaaagcacttgtagtagtttctacttggaaaacagtattgttactaaaagttatggcagaaataatattttattaactgtaggccttgattgtcttgattgcaaatgctaggtactatattatgcacacagcttgaaatgtatgtggcacaatgaataaaagcttactttcctaaaatataaaatgattgaggaatttgatgatcacatttaaatattttcaaaaagggttattttctacccagcagtagaataattgatagataattacaaaagaggctatgccaaaattattgctaggccctttatattgagacaatggtctttatatagtgtttgatgagaaatctatcatttcccttggggtaatggccagttatttaccaccgtaacaacttaaatgactctgtttctagacttctagttaggggcacttcttaaatcttgaaaatggggcaaagcataaatttctaagatttacttggttgtcttcacccttagtacatggggtgagtttcagcttacaaacctggcctctcctctgaaactagcaaggaagaaccaagtgtcacaatatagcaggagctcttaatccgtctgcacaatcattgcgagatggggagtggataggcttcccagtcagtgcctctgatttgattggtccagatctggggtgtggacaatttcttataaagctctcaaggtgattctaatatgcatccagggctgagaaccacttcattagtgattattagatcggttctcaaaatacagcctaacattgatggactctgtcgatggcaatatcctggttgtgatatcgtagtatggttttgcaagaggttaccaccagaaacaattgggtaaagggtacgtggaatagactctgtctgtattatctcctagaactgcatgcaattctacagttatttcaaaataaaaaagtttaacttatttgttaatagtctgccagtgaactccattaaacttacttgtgactcttaaaagatgcagacttttgggccccatcacaggtctagcaaatcggaatacctgtgggtatgtcctggaatctacatttttaaacaagctcaccaggtgattttgctgaaacactgatttagctacttacatgtttaggttttgagtaatactgggcacctggacagtcctaggtaagtgagaattaggcaaactggcacactaagttccctgccctattcagtattctgctattcctgctacacttgtcttaaaaaaataggatttcatataccaaggtgttatgatgatactaaggcacactaatgcataaaaataatatataatgaattattcagtcattcaacaatttttttattgagtacctattatgtgccaggtacagttctaagcattgcttttaagaatgagtataagaataacatttgtaagcctatcacctcaggcattctgatagtacgtggatttcttatttaagcttcacaaccaccctgatgtaggttcttttattctcccctctttgcacaagaaaacactgaaacaagctgttttatgtacattgctaaggatctagaagtaaaaactttgaatctgaaatcagatttcgactgtttctttatggtaaaatatacataacataaagtttacctttttaactatttgaagtgtacagttcagtgacattaaataccttcacacactgtgcaaccatcaccaccatcaatctctaaaacttctccatctttccaaacagaaatccagtacctattatacaatatcaggggctgtttttattatacagtatatgacacccccccaccaaagaaacctttaattgtagaactttatacaaaaggtaaagaaaacaatttgggagaaaagcctctcgccagcatttcttcaatcacacaacatattatagaaaagctgctgtgtgtaagatcagccttgatctggctgtatttttattgaatctaaaaaaaagtaattatcagaactattgttataacttaacccatttgtgctgcaattgcttctcatttgtgaaatagacactaataaggcatactaatggaatctttagtgtgagtatttattaaatcactaatgtatgtgaaacacttagaacattgcctggcatttcctcagtccacccacccaatcccacccacacacagtcaaaagttagttcttatttccccgattgtcaattttgtatatatcacttgatgcacatcattttcccacatctttgtcactgattgttagttttatctagttcagtagcaagcacaatatctaacaacctgaatttatttttattgtaatcatttcaaagaaattagagtcaaatgtcctcaactgtatgtctccagtaatttcacttagaaagtttttcaggcactgaattcgttcttgagaatagagtagcattcccctgtctgtaatatttgagcagaaaggacattgcttccatgaagccttgtttctgttcttcttctgtttgttagaaaatactctgttgatggcaaattcgtgagcaatctaaatatataattaattagaagaacaaattgaaattgaccaaatctctcagagctttgaacaaaaggactcttcaaatggtcaaaacaattacttagaatttaagcgttcattgaaatgcgagacagtgtgcggtagagatacaaaagagaaaccaggctcccatgatattgtaaatgctaaccctgctccttaagcaaacaaaagtctctttctattgtcagtagctgtcttctaggacaaatagtttggtattttataaaagggagaaaaacttatcaaaaacattccatgaaatgtacctcttttgaaaaattactccttgaatttgagttaaagaattctttagaagccaaactgctgagatgatttatctgcacaaaagaaaactactgttcaagaagcatatttgaagaatatgtcattgcaaatcaaagattcttttaaaaataagtctcaaaaggaagagagggagagagggagaaagagaaagagagagaaatatataattaaagtcataggtaatttaagtttggaaatgaacattcattcactactttgttatattgtcatatggtggtaaacaaaacaaagcaataattttgtctgattttcttcgctaagaaatggaaccatttatgaagcttagcaactgatgcgaattttgctttgatggtaattatgtaacagagtggcaggggtttcacttccagataaagatggacaatgaaggtcaatttctatcctgtcgttttgaatattcagtgccagcacaatttaattgggatcaggtaattgctcagaaggctacactgagcccactatcatccctcagtgtcgctcctgcacacctacttatcctgatgttgtttgtcaaaaactgtcacaaggaatgtgtctcactgagaaaaataacctgtttgtcattgctcagagcttcaagaccatactctaaagtgataagaaaaagttttttgttttttttttttttgagcaaaactgtcttgtctctgaactgattaaattggtccatcatggtaatataagggaacattttaatgaaataaattatttatgggagttcagtgatatttgctctcctagctcttgtgcgatagtatcaagtgtacctcttactctcttttggcattgaaggatattatattagtcttgaatatcttttgcaaaatattataaattatgcaagtaataaatgtaaacattgttttaagaactagagtattgtgaataaattgctaaaaatttatcttgtgatttttctcattggcattagagagaagcagaaatttagaaactaattcgtatataatgtgtgtttgtataataaaaggaaactatgtgctcaggaacagtctgatgtcctcagaatgaaaatactcatagtaacagtaacatacatatatgtaatgtgatttataaggattgcaacattaaatgtttgtttgaattggcactagtaaattttaattaccacctatgacttctgacttctgtctattgatacgaggactaaaaggatagttaatgttattattagtattaataaaagtaatgtaagtttagtataagatttctaatctgttcaccatagacaatgaaccaaagaggaactactttgtgctacatttttatctgtctcagggcataggttcaagacaagacaatttctagttttgtaaaatgaaagcagtgatacagaagacacctatttcattccctcagattaatagtatataatactatatattatatactttacacaaatgttagaataaaaatgaagaaatatttaaaatgataggctcactactatatttaatagcattaatcctcaaaggcagtatttaatacattaatttcttaatatgcgtgcattgtgaatacatgagaaaaaggaaaaaaattctttaaatgagttcctgcaattaatatcatcaaatgatgtaaattacagttttaaaacaaaaaagcccttaaagcgtgctatgaataaagtaggaaacaaattaaattttaatctttattattattaaaataatctttgcattgttctttttctacttgaagtttcagtggttttcattgatagtcataaactggagagaaacttgtgcccacctatgatactccagaggcacaagacgccaaggcttactgtcttccagcattgcttccattttatgtctggaggagataagatatgggtgtagctgtgaaggagaattggatatgcagacgattgctttatctttatctctgaatgatggacacccaagcagttttaagggagggcctttactggctctcatttgccttgtttttattaggagacagcctctctgggttgcaataggttgcaagttataaaattcaaatgactctggatgagatgctacctttcttaacttaatttgaattgttcatatcaggagtcctttttaaggatcagtcaataggggaacaataagacagtctatgaatcttcagcatgggttacagctggaggacataaaaaaggaggttggaagcactggacacactttaaaaaaatcttgtctgggttgaaaaatgcattttctttgtctaagtcacatgttgtattccatatttagctgtagtgttgaaataataggaaaaacactgtgtcttggcaggtaggcccctgctctgagctggacccaatggtcagagcacatttttgtttaacattcagagggctgtcaagatgaggaagtccattttatgggttttctaccatgaatttgctcttcctggccaactccgctcatgcctgtgaaaagaactcaccagcgtactggagaatgagatactaaactaggacaagagccgctgctgaaaagctcatggctgatatcaactggaaactaattcaaatgactcttacaataaaccagttctccactcactcaaagtgacagtgaagtgaaggaaatcatcctttgtgtttcctttgtttcatgcaatagtttgtgtggttaattcattatagtctttgttctcaagcgaaataaaacagtcaggtgaaagaagagttttcttccttgactttaaagtggatttccttttataacaggtaaaactcagctttcaattgtttttagttctgaagttaatagcagtagttctaggctttttttttttttttttttaaatcaatggcttgttaattgtcatcccagttatttacatgtgactatagagactgcattctcccagctgccaggccgccagggctttgccactggtataatttataacacgactaattaaaatgaatttgcttgcaataaggttctgtgtgctatttgtgggagaggagttattaaaattttcagtacagtaatagtaaacttgaatgcaaagtaataataatcatacatttttaattacatgtttaatacccatttggctaatgtagaactattctgaaaattacttgggatcagcacaatgtctttttgtgcttagtagtatccaaagacatccttctgaatgggcttagcaatatgcactgtcatcaagatacagctgtttgatgacagacacacagtgtgttcctatgatactttgcacaagatcagctatgacaaatacaagttcattttgcttattgcaggcaaataatgtcctttgcaggaacttggatggagccagaggccattattctaagtgaaatacctcaggagtggaaaaccaaataccatatgttctcacttacaagtgggaactaagctatgggtacacaaacgcatatagagtaatggactctggcgactcatactacatattgagtacaatgtacactacttgggtgatgggtgcactaaaatctcagaatttgccactgtgtcattcatccatgtgaaaccagaaaccacctgtacctcaaaagctgtcgaactaaaaaaatataaatttttaaaaatgattcccggctgggcgcggtggctcacgactgtaatcccagcactttgggaggccgaggtggacggatcatggggtcaagagattgagaccatcctggccaacatggtgaaaccccgtctctactaaaatacaaaaattagccgggcatggtggcacacacctgtaatcccagctactcgggaggctgaggcaggagaattgcttgaacccaggaggcggaggttgcagtgagccaatatcatgcctttgcactccagcctgggagacagagtgagactccgtctcaaaaaaaaaaaaaaaatatatatatatatatatatagatagatagatagatagatagatatttttatatatatatccaaatatatatatatttatatatccaaatatatatatatttatatgtccaaatatatatatatttatatatccaaatatatatatatatttatatatatatgagatttccattttccaccaactttcttttgaaaaatttcaagcaagactagtacaaagaacatccatatgtcctccacccaaatttatcaatttcttacatttgctcacttgctcactctccctccatcccctttctcattatatatattatatattaatatataatatataaatataaagtatatattaatatataatatataatatatgatataaacaaattacataatatataattataatgtataaattatataatgtattataattatataaatataaattatataatgtgttatatataatttttatatatctggctgaatcacttgaaagttatttgcaagatgtcatgatactttacttctaaatgcttcatcatatatcttctaagggcaaaatattctcttacatagtcacaacataattatcccatccaggaaatttatggtactgttatctaatacacagtccgtattcacattctttacagttgttcctcactctccactttgctccaggatttaatcaagagccatacaatacattccgatgacatgtccatttgatctttaatctaaaaaagagttttcagcctttgttgatatttatattctttatgttcttcaaggattgctcccagttgtaaatagtttctgatgtttgtttgtttgcttgttttctaagtcaactcctgaagaagcatgtatttatacacaactaatcttgaatgaagaatggtcgttgttaaggacttgatattagcaaactgtattcccaagctctttgctattttacccataatactgcaagacattttctccgactcatttggaaggtgtttccatttgtatctggcaagctattctcttagttcttaataataccgtcattgaagatcttctagtatgtagaaaagtataaagtgctattagtattccaaaggaaagtataatctaaatggtgaaaggaaatagaaacatgggcaaaatcaatacagctgaataaagtttaaagatgcagaatatgttacaaggcaggttagcattaattgctaaccaagtgatatagaacataagtctatattatctgtaatttacatagctattgattttcataaggataaggcaataccacttgtctaaaatggaaaagaattatgttgatgttagaaataatcatttacataagcgtacatgtgatttcaaggacaataagctaatgatggctcataaatatgcatatttttcattgatcaaaactgcgcagtaaacttctggtatctgatcttgtaaattgttacacaacattaaggtaattaagaagagaattaaggcaaataagactgcctttaaaacatacctttgcatggttcttcatcttgaattcgataatcacaaatgtgacaaatctctgtgctaagtttattcagtttaacagttgtaaattaaaaaaaaaatcctccattatgtttatcaagtcttccaagcttttattcaccatttttaaattatgtatttatttgtacaccatttaaaaaaattatatttttctacttcatgaccccagccaaatagcatacaatgtttaactccttacaaatcatacttatttctttatagtatattgacaagttttgtgatagatcttcttttagaattcaataacctaagaattaaaaactattttagagttagtgattctaacttcatgaatcttctgattaataagcttcctcaaatgcattttaagcagaaagaaaattgctgaatataaactaaaactgctcagagaaatgctttttattatgcactttcaaatgaaagtgaatgcacaatgagcccagtcctctctttagtgttcagtacacagctcagggctgtgtattaacccagtgccctctcctttctagctatgcaattagtattgattgactgatagatagcacacttgatgttggtggtcactgaggtacgtacacctctgtacaatgcccgccaggccattgtgtgtgcctggtacgttactgaggaataacaaaacaactggtgagtttttaatcaactgtacatggaatacaaaatgtggtctgtcttcctgtgtctagctacttttacttcgcggttttattttcccagtgatgtgtacactttagatttttttcccagacataagagaaaatgtatattgtattctacttgctgttttaagctttctcttaaaaagtctatacattatatttgtgttatttaacaggcccccatacatagcacttggtatgtttaaaacacctcatttgatgctttataaatatgagttaatttgaaggaaatcatgagcaaaatctcatgcacatttcttttgtgtatgaaatttagtggaggatgtttttgtctacatatcagcttgcaggacttctgctcaggccgcatcatcttttataatacacatgaggtccaatatggcctccttccaatctatctgctgggacaggaaaaggaagctctaaatatctcagcagtaactcccccattccctcattgccccagcccctagaaaccactaatctgttttctgtctataactttgcccattccatatatttcatagaaatgcagtcataccatatgtgaccttttgtgcctgacttctttcacattgatgttttcaagattcagccacattgtaggaattattttatttctttttattactgtataatattccattatattccacattttatttatccatttaccaattgataaacatgtggggttgtttctgctttggtgctattatgaataatgctgctatgaaaattcatgtacatgtttttgtatggatatgttttcaatgttcttggttatatacctacaagtggaattgatgagtcatatttttgagggactgccaaacagttttttttttttttttttttttttttttttttttgtgatggagtctcactctgttgcccaggctggagtgtagtggtgcaatctcgactcactgcaacttctgcctcccgggttccagcgattctcctgcctcagcctcccgagtagctggaattataggcgcccgccaccatgcctggctaattttttttttttttttttttttttgagatggagccttgctctgtcatccaggctggagtgcagtggcgtgatctcggctcactgcaacctgcacctcccgggttcaaccaattctccttcctcagcctcctgagtaactgggattagaggcacgggccaccatgcccagctaatttttgtatttttagtagagtcggcgtttcaccatgttgatcaggctggtctcgaactcctgacctcgtgatccgcctgtcttggcctcccaaagtgctgggattacaggcgtgagacaccatgcctggccgccaaacagtttttcaaagtggctggacattttaccttcccaataaatatgctttcatatttgaactgactgataaaatttcaacatacaaagcatataggaatttttacttcaagttacatctgaaatggttggctatatttaaaagtagatattctgtttttaacaataaaacataatatcttgcttttctatatgactgacattattatgctagatgacaactacataattattggcaaagcacaatttgtagaattacaggaataaaactgatggaagcatgtagcatttcattcttccaaagcccagaatggaaccaaatagcagattagttgcaatattgaggttgaaactcaagttcggtgcatgtctatttcctcctcctttcttccattcccatatcaaaataaaagaaaacaaacaaaatgctttttttttaataacttgtttttcagtgtaaggaaaaaatggtacagtgtgaaagctaaagtacatactagctgagaaaacctgacatgagactcattttttaaagtataaacctgtatagtagataacatttcttgaatgctcgctatgtgccagacacaatcataagctctttcaaggattaacaacacaaggctatgaggttggtattattgttctccatattgtacagatgaggaaataaaggcacatagaggcttagtgtcagagctaataaatgacagaggtggagttcaaacctaggcaggttagctccagaatctgtgttttagctgccattctgtgctgctaaagagcgtctgttaccaccattatcctactagcaactttaaatgcattcatgtaatcattggaaacttcacatgctatagtaatttttatgcagaatttcagtaaaatatctctaacatacaacttccagattcaaatttgcagatctaccattgttatctaaagggtgttttgattgatttgtatcttattttgtgggacagcaggattcagtgagaatttccacagggtggaatcagtattgagtgccctatggaagtgttaactccattccaatatccatagttcaagcaaattgttgtttcctgtgaatgttcttcaggctgttactatatgtgcctgtcatgtcattccatgaaaaaataatgctggccttgtagtttctacaaactttactactatgagtgtcacctctgagtttgaaatatttgaagcaggagactctataagttttcagagataaaattgtgtccagaaaaatatgtccccctttgattgacgtgggtgagcatgactgtgtatcatagattatagtattccgttcactcagtttcctttcaacaatgtctcatatatttcaaaggaaaatgttgccatgtcactttagatttaaaaggttgcagtgaatgatgttttcttaaataaaagggaggaaaaagtaattgtcatgttttgtagatttaagccctgtcattgccaaaatatctgcacgtgaaatcagtagatagaatttttggtagggcttctctgttgtctgaattcccattactggaaggaaagtatgagaaaaataaaatgaatgtctcatttttcacatgttcttcagtagtttggggtcactgtttggaaaatcttaagaaactgtgatggcttgaataagtagtagagagtcaatcactttaacctgtgctatttatctattttcttctaccatcaattcccactatatctttaagagaaaaatgcagcacagaatttctgacatagaccatgttgaagtaccatttttccccatccttgaaatctcaactcttccttaaaaagtgtcaagaaccaggtatggtggctgtgttagtttgttctcacactgctaataaagacatacccaagactgggtaatttataatggaaagagctttaattgactcacagttccacgtgcctggggaggcctcacaatcgtggctgaaggcaaggaggagcaagaggacgtcttacatggcagcaggcaagagagagtatgtgcaggggaactcccctttataaaaccatcagatctcatgagacttactcactatcacaagaacagcatgggagagacccgcctccatgattcagttgcctcccaccaggtccctcccacaacacaggggaattatgggagctacgattcgagatttgggtggagacacacccaaaccgtattagtggcgcacacctgtactcgggagactgaggcaggaggatccattgagtccaggagctcgaggctgtagtgagccctgattgcaccactgcactctagcctgggtgacattgtgagaccctgtttcttaaaaaaaaaaaaaaaagtcaaatagattcattctcaattttattatgtaagtattaggatgagatatttatagtatgatagaatctgaccaaagagtatctgttcagccataaagggagtatgtaataatattgtacgttagtgataatatcaccatcaaaaattatttctcagttttcctttgagtgtacatctgtaaatgtgtatgtttgtgtgcgtggcaagatttgcagatgccaaagtcctataagtgtccttcttcccatctttttatttgaacttctgagggtctgcggtgaaaggcaataaaagcccttaacttcattactgtactttatactaaattcaaacaatattgctttatttattttaattcacgtttagatttgcattatattttgtacaagacaatgggtagaacctaatttccagttttcactggagcagagggtggaaaggaatcagcagtaaaagtgagtcctgattagtttcccctcctcttgctttagcctttgataagtaagcgccttctactttcatttccaacagcgtttaccatagaaataatacagtgctcttctccatttgctgtggagccctgtggttcattgttattatttcctcaggaatccctttaaaggtatcctgcaataatgctataatctcagagtagctttaccccttgccacctatataatgatcatttctagttaaaaaaaaatcatgtggaagagagttgataatattacaaggagaagacaattttcctgctcaaaatgtgagaatttgaaataatagatgtggagagaaatttaagtaaatatacaattaactcttaacctacaacttcactgaaattctgaggaaatattccaaggctgcataaagtgaatgaagagtttcctaccaaatatttctccctcagtacctaagtaattgtttcttttctgaatcagttgcatacacagaagtagaggtggcactaaagataaagatgcttcgaccttgttctcaccactttttttcctgttggtttccagcagtgtcatgggctttcattacttattcaagaactggctgtgctgaacttccattgctactctgcctgtacccacatatttctgtagcttggaaatttgtctttgagtttatatagtgaggatcttttatctgtcactgtgcggtagctttagcataactgcatttagatttagagattaaggcttataacttaattatgaatccaactacatacgaaagagtttaatttaaatttaatattttgattcagcacagctcaactcatgtgttcttgttaaattgtctctcattgaatttttccttgtcattaccttggacatcagtgcttttccagaattgcaggctgtagcaaaataacaacgcagacttgacttctgtctgagctaatcttcagaaagggcacaggctaatggtgacgtagacatctttacagtttgtctgtaaatgtgttgggtgggtgtgtatgtgtgtgtgtgtgtgttcatgtgcatacacagacatatacacatgaatgtgtcttgctatgctaaggcctgaacaaataaaaataatgtcaaataaatatatttacaaagcctaatctgaaatgataaagtagatgaaatttgagaaggaacatttgtggtctcccaattttatgcctcatgcacatgtaactctatatacatatatagagggaacactattcacacaacacatacaaatatacatgtaacacttataacagtgtagttatgtaagtgtttagatatgagaaactactatttataggaatccttcagcagtatctttcttgcctcctcttcctgctcttcctcctacttctcttcctccttcctctccgccacccccctccccacccccgcataaaaagggaatggtttagtcaggtaaataactaaaaattgttatttttttaaataggctttataaaggtgattttatcccagaaagaagtgtacttacacggctatgggggactgatctatgcatataaagcttttcattatcagtgggaaatttccatttgtaattatgtccatcacaacatcagcagcaagagcatatataatgtttcaaaggttagttaaggagtgtttgtgcattttgtatataattagacaaagaagtaattaatatagacttggataacttgcttgcataaacaacattaaagcaacaataatgaacactttaaaatatacacgaatatcatgttaacgtatcaattgccctacttctacctttccctagttcaaatcctaatttaaataatatttcagtgaatataatttttatacgtaaaatttcttcaatatacaaagaattgtttgttataaatttcagtgtcagaaactttaaactagaaatgcattcccatcgaaatagcgtagttaaaccttctctaccaagtactagtgagatgtttgtgtcgagaagacacagaggctgtgttggggtctgtctgcaaactaacattacacagggtagcttcatttggatgtatttttaaattagatccccactgatggtttcctttgaaataaaatgtttctcttattttaaaatgcttgaaaatcaacattataattgatggttaaatttccagtttaagcatacttttccttgttgtactacacatgaagtactgtgctttggcaatgaaaataatagaaaatgtgccataaaagtaattgaaacctaaacagaattgctgagtgggatttttgtttcatgtcttgagcatgttgcttaaggaaagcagatctaattagggaaagacaggaggcagatacaaagactttggtgggaattgtgagcagagaattggggcattttcaagggctatgagcttgagagagtcgttatatccgatttcactttccatttcctagttgttacttttgctacacctacacttattaatcatcattggggttgtttgggagcttacaagtgagttgaagagctgggtaaagaatagaaatttcctctgagttattagaggagcaaagaaggaaaaaaacaaaagatgggagatgggagaatggtgtgcttttgtgtgttaatgtgcctggggttgaagtagttacttgtgagaagcaaaaggggacaatagatcatatgctattgctcatccttttgtggaagaaacccatcaggtatccattcactcactatttactgaacagaacacattgtaagagcacagtgtattaggcgaagggaggtcactggtgaacaagagcttcctggagctttcagtctactggtatcacaagcatagaccaaagaagcacatatcataagtgctaaaagaggtagagcacagaatgagacctcatgataagggcacttattataatagtcctagatctgagggaacacttctctgagaaaataatgtttgagctgacacctgaatgctgaatgggagttaatttatgtgccgagagatgggaatagttcctgacagaggaattagcaaatattaagctgaggagtttgtgttgtattttataaatataaattaggacctactcttccttttgtctttccttattagtgtgataaaatcatcctcctagttacaaagccaaggactctgacagtaatttttgaccctactttctctgccaccttgcacccccgttacctttactctaataacatccttttgctcaataatttttttctctttctatctctaaatctcttctcctacactcaaccctcaatttaattcaggtctgagccacgtattgctgaactcacagctttctcacttccgctagaattgactttcagaagcatttgatcatgacattttcagtgtaaacctattcagtgacacagccctgcctgtagaataagacgcgtcagctttacatgttctcttgatatgatctggacccctcatctcctaccactttccctgtattcttgccacatgcacctccttgttctcttgaatatagcaggcacttagggccctgagtctctaaacatgccagcgtgccctcccttccctaatcatcagtcacaatttgtatcctctagcctgttgctttccagttatcatactcagaattaattttgcctccttccttgtaatcgtattacttttacctgcctctcccccttttcagcatttactttataactctgtcctatattgtagtgtcataaatcattgctctaactagagtttaagttcagtgaggtccaagaatttgtcttatttatttttatattttatgcttttatcattttccacagttggaaataaaaatttatagtcagacttttagcagcttcctggaactgaggcaatgcaggctggggcagagaagaaagttaaaggatacttggagaaacctgaagaaagtaatttagactattttatggtttatagtctctttttgatcagctgtgggtgccctcacaatattggttgttgagaatgatttgacagaagttatcaaaataaggagattcaaacttagtctatatgagaccaaatactcacattttaaacaatagacatttttagtaatgacatttaagctcctagatagctggatacagagccaatgttattgcatataattcaccaattcaacaaatatcagttgatgactcaccgggatcaggtacagttaaaacttgctctccactttggtcatacttgctttaattcattgctaattgagtcttaaggctcaagcagtgggtcttataaattcactggtctttattgttgaatccttctctaattttggcagtaatcacgcatgtcaatcttgcaatgaggagctatcggattttcaacctttacattcaagctcttgttttttcctgaactggctctttgtacaaataaaaacacactggcaaaataataaatgagaatccttttggacttttcagccaacaataaaatattttttataaaaatggaagtgcacaaaatggcagccatctgttgtttaaaaacaacagaactgtatttaagtcaattattgtgtaaggtctgtgccttgaaagcaagggcaaaatggtttatgttcatctcaatgggagaagattttgtgtgcttctttgtcattgtctatgttgatgtgagactggataactattactaactgaaaatagttaatcatatttaatcatggatgaggttgattgaaaaaatgtcatttttatttatgaactcacatggacatgtctaattggacaattctgattttctctctttattttgagtagctttaaatccagacatactagcctagcaaatccataaagaatctgtcatcatggaaattgctaacagagcctgaactttttcctctttccccccactcaaagtttgaaacataggcagattaatagagataacaattagaataatggtaagaagtttttttttcaaatgaagtacatcctaatgagagttaggtttttgctaaaaagtgtttttcttgatattcaataaaattgatataaataaattgtattgttaattttaatctttttttacttggtaaaaatgctttctatgtcagtcatctatattatgccaattcttgcttcattttcaatgtttattagagggattttataaattaatcttgttttcatttatactattgtataaatagttttcatttatactattgtataaataatagtattcatttatacgatatatattgtataaatagttttcttttatactattgcattttatgagtgaaatatacaatatatattctttggaagacatatcaatatcactattgcaacagatatttttccagaggttaacaagctatggctcacttacacatttcgcttaatctacattgtagtttgaaaacacacagatgtgaacatattaccaatattttgccaatataagagtccacatttctgtcttcttttataaagtatatgaggcaaacacaacatatccagactaggatgtagactgtaatttcaaaatatctaaaataggggagtgccgggggaaaatacgtcattttgaaaagatggctgtgttctctgtgtttatagttgaaactataaacctatttctacctggatgaggggtttataagggcaacattactaattttgagtctccacctctacaatgttagctccatgagcgcaggtattgggtacagctgaatcctccaatctaccgcagtccctgcctggcacataagtgatcaacaaatattttgttaaatgaataaatgaacaccctgtctctttttctttcacctaatcctggtatgtctttgctccaatcctctgccacccagggctactattttattagttgatgccagaaaactctccaatgagaatgtcccatgttcttcactgtcataccttttttagactctttgctatcatgccttaactaccaacagcaaagaagccaaaaattcagacactgagatgtggttcagccagaaatatttacaaatgtagaagtgagaatactaagccaaataacatttctcataataaaatgtagactgtaggataatattaaaacttcaaattgtacaggagagataatttgggggaaagagtgtagcactaagccagtgcttctcaaacttaaaggttcacatgaatcacttgggggtctttttaaaatgcaaatttgtatttggtagatctagaatggatcctgagaatttgcatttataagctctcagatgatgctgatgctgctgatatatggaccacactttgagtacctcgatattaagcaactgtaaactatttgtttgaaaacagccatgatttgaagctatacatgataaaatcgatgggcatttatcaacctgctgaaaaaacttagatgtctacaaatgtccaaatgggagagatacttggagtaagaactttgtagtggtagaatggcagggacctgagatatctgttgcttcaatttacaaactgggattctggaccccaaagatactcaatgacttacataagaacccacagctatgttgatgctgcacccaattggaaccaacgtttatttattcccagacccatgctctttaaaagagatcatgcacatggacataaagaaggaaacaataaacatcaggacctatttgagaggggagggagggaggagaatgaggatcaataaactgcctataggctactatacatattacctaggtgatgaaataacctgtacacccaactcccgtgacacgcaatttaaccatataacaaacctgcccatgtacgccctgaacctaaaataaaagttggagtgaaaaaataataaaaaaataaaacagatcatgctgcctcttggctattgaagttatagtagaattccttcaataaaacacttaggaagttgttgtactataaaatatacttaatttcacttaatattgagtgcttcactaaagtcagtcaaaatgaaaggaagtaatgcattcgcttctcatgagttgcatttcttgtgggtaacatatattaattttattataatttatcttcattagctattgaaaataatgctaaagacatttagaatgccttttagcgggcattactgaatattagatgatgaacagctttgttggaatagtttgtttagttcctaggagaaagtttgatttgacgactaagtaaaaaatttaggggaaaaaagcaacaaaaaagtacccaaaatcaatatcactacgtttgctgacgaagggtgtatttttagctacactgattttttaatttaaaaaaaatctacacggatccccctcaactccaatgtcaagtaagctcaactgacattatcgaaaccatcttcctttttattatcaaaaccatcttcctttttactgtgcatgtgtgtatgtaagtgcaagtgttacaaattcttaaaagaagataaaagaatgatttttcctcattatggtgtaaaacaaaattaaaaattgaaattatctaatctgcataaattagacactttatattacattggcagttttatcatatttgaaacattttgttggtctcaagatttaattagattatgtcaccaaatcagagaccacaaatatccatgggagcttaatagaactttttggattttcatgggatgaaaacagtattttcatgaggcgcagaattcatcatcagcttctcacctccattctaccctcagccttctatttccctgacccacattagtgttatgagagcaacaaatggacgtttcttccaacacaggttgtaagaaagtgctgctatcatgtgaggagtataaagggaaaatcaggcagcataatagctgagctaattaggctcagaccattaaagatcttataacggttatattattgttgttgttaatatcacctgagtattgcctcacagattacagaatgcctcctcatacattattttatatcacagattataaaaggctagcattataaataataatcatattaaagagtgttattttaatattacatgagacattgattttcagtgatgccatgtgtttccatagtgactatgataattaattgctataaaatcacaaacagtatttccttttgagagttgacaacagatgctggcattttaacaaagagtatattaaataatccacagcatgcccagaaaattgaaatgattaccatgaattaaaaaaacccacaaaactcataacaatgcttggtgatacctagaatattctggttatctgtaagttttcaagaaggccaagcaggcctctgtcactgttctttacctgccaatcacaccgataacttctatgagacatttctgtctttgagctaatcatcctctttttaacagcatacgcattccaacaggcatggaaactataatgtattaagccattttatctgcaattctcacttgttgtgatttagtttaatctgttttctttggttccaagtataagccaaaatcaggacacagagaaggggcatcttgttaataaggaaagaggatgaaatggcagaaaagtagtgactccccaggtgcaaataggggaatatcaagatgtgtcaagaaatgaataggcagcccaaaagccagatttgtatggaaccttttctgcctttgtgcctgaataataaccataattcctaaataaatcatatgactacagttgaacagtggtaacttttgtgtgtagaatgctgaacttctaaattatttttatactcttcgtcaaatgcactttaaaattaaatagttgttataatatagtatgccagcaaatcccagattgtcttgcagagtgactcagaactcttgaaaggtcactactttcgaacttcaacatccttaaaatcacttgaaaactgactgctgctggtgtatgtgacttgaaaatatattttgttgagaatatacaatgtttcttgttctgtgtcaattggctacccacattcaaacatttggagacctcccataagcatccatttttcttttaaaaaactgaagatctagcagtattgggtccacgttctgttccagctaagtatcactacctcctttggaagggatttttcctttccagtctcccaggtcttggtaaacctctatcttccttgaatacaatagatctggcacctattggcattcagtgtagaagaaatggcattcctataatttgatcaatgcactgattgattggttgttttagaaagagctgaatgaaacatttcagtttcgttgttgatccatatctatctgtctgtctgtctgtctgtctgtctatctatctatctatctatctatctatctatctatctatctatgtacctacctacctacctacctatataggtaggggaggagagagagagaggcggaacataaatcatggtgtaagttacacttttaaaaaatggaccaatttaccattgtacaattgtaaagactgcgttgaagcaattttaaggataattcagaacatatttttctaagtaaagttctatgtcttatgagagtagaaagcaatgaagaaatatacatacattttgcgtaacctagtggcccttaatgtataaatattgcatgtttaagtgaagagtcatccatcaagaatctaatctataccagaagtatacacttcctcttttatactttgtactaaagatataaatatgacgtgttccctagttctctatccattacagagtctggtggataaaaattaaaaatataatcttaattaaaatggaaggggatgaaggctataagacagtcaggtacacacatactatatggaaaaactgggcagaagtaattctgtctcatatagtctgggaaggtcccatagaagtggtcatttagctgattcttggaaaaataagtagtaatttatctagcaaaggatataggaaaaagcattataatgagaggaaatggcataagcaaagaccttgacatgtgaaagttgattttatatctataaagatctctgactgaggaatattgttggaaatgggggatagtgaaggcagatatatgtggaagataaaatgggttgatcgtgacattttttttttttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgatcgtgacattttaaagagctttcttttccttttcaaagagcttgggcattttattatagacaataggaagtagaaagtggttttacgggaggctatgaaatgatccaaaaggcaactctggctgtagagcagagtcctgattagaggagggaacaaatgaagtcagggagtttattaggaggctttaggaattggccagcgggagaggctgtgagtaagaacgaaagtgattggcaatgggaaggaatcagaagataaataactgaaagatattactgatgaagaaactttccggattggatgtgggcactcagaggatgagatgagttggaggtcggtagtctgggaaaaagtgaagaaatcatgccaaaatcaaaatcataatgtctagaaagggaagtattttccgcagcatggataacagtccctgggtaatgtataaattctctgtcataaaatactatctcccacaaatgttaattaagtatttgaaccaaaagttatttggcattaattgtgatcactgctattattgttattgttgatattatgagaagtagtatttagaaaatgtgagcaatctcatgctgtatatgcacactaggaataatgctaaaatagaaaccaaactaaacaaaaataagtaagaacaaaactccgatttaattcaagaaacatgcagattcatttttgcttggattttctttgttattctaaagaatcatgaaccaatttttttttaagtcctaactattgctatcctggagaacacttcaactacatagagtaaccatttacagaatacagttgaagtctacagctgctctggaggataaatgcctatttcttttaaacgttggctgaggccctctcgaattatatacctcacatgtgctgtatttacatcagaccaccccaaacatgctttccaaattaggttaaaatctgtgtcaccattttcatgtaacatagaaacttaattttatttatagagattttattcattttatcacatagttactatttgccttcctggtttatgattccagtttctttggaattccacttttatgtgactaagtaccctatgtgtttaactctactagatatcccatcactaaaatacaaccataccttgggattattcagttctttggtaccccactatacctcccattaggtgagtttctaatgcaagatactgaccatagtatgatgcattctgaaattgccttggctattcatacacaggtatatgtcttatatttgaaatgtaatagcattttgtatgttataagcatgctaatttgggggcctatttattgtaggagtagcaaaaaataagattgtacttttgaagactatatgtggatacatagtatcatgaatggctgctctattttgtcaaattcagaattaaaataagatttaaataaaaatagaggccttttcagtttatggattttcttattatcttaaaaaaaaaaaacatgatagtgaggtttccagctgagaggaatggttggaaaaacattttgttccagttagttaattcttccctacatgtgctctattcatcgtatccattttaaaagcaaatgaaccatctctatctcctcttgcatttgtggcaaactcttgctgtgccaatttcagattacatgcatcttaggaagaataagatgttctaatcttgattataattttaagttaaaagaataaaattagttcaatactaagacattgatacgttgcagtagtcagactgtcattacctcttttgacaaaatagaaaaacatgtctatacacaggataataagttcctgcattaaaatgcataatactataaatgctactagatttcaacgcaatcaagaaatcagtttatggaagctgaaatttgttaataaatatgctgctacttgagagtttaaccattttgcaaataattatagcaaacttccaacgaaattattttcattatgaatggagatactttccaaatgaggatataagaatagataataaacacatgaaaagatgctcagcaccattcttcatcagggaaatgtaaattaaaaccacaatgaaaaactattatacacatgttagaaaggctaaaatctgaaagactggtcataccaagtgttgtaaggatatggagcaagtagaacacataagcattgctgttggaaatgaaaaatagcataatcacattagaaaatgcttgatagttttttaataaagtttgatagtttttaaaaatataggtcatggacaaatagatgtatgctttacagatgctttatacatctatttacccataacccatagccaacattgtaatcccagatgtgtatcccagagaaataaaaatgtatgtcaacacaaaagacttgttagtgaatattcatggcagctatattcataatattccccaactcgaaatgaataaaacgtgcatcaataggtgaatggatagtggtccaaccatacaacggaacacaatttagcaataaaaagcaacaaactacagatatacataagactatggatgaatttcaaaccattctcttgaacaaaaaggccagacatagaagtacatacacattaatatgaagaccaagctctggtgacagaaaacagaccagtcatcgtctgctcatgggggaatcttctgagataaggggaatattttataccttgtagcttagaagaaatgttatagagccccaaacctgaacatggagaagtttaattttgaattatgagacaatctaagcattcaggcttcagagattttttttaaaaaggcgggcgggggggtggggggaggccacagtgtgggaacattggaaagttaggactagaagtctcttgtgaaaatagaaacaggaatgaatggaaaagcattcattcataccgtcaacaaccgaatagttgttagagtacaaatgatgagccagactgttccaggcattgagggtacagatgaagtacctggcctcatcgaacgtacacttacttagttgctgagacatacagtacacaatgtcaagtaaacatgatgaacacagatcagtaatataaaggaaataagagcacccagacaggaaggatggcacagatccatttttagagaaaccctggggaagggtgtaccaggtagaagaaagagtgaatgcaaaagacagagggtgacagagggtgacagagagctcactctgcttcagatttgtatgataagtgtggaaagcctacagaggcctgtttctgttggagcttgaaggctaccatatggtgtttgcattttaaccaaaataaaatggaaagctattgtggagtttcaagttcgagagttgcattatttatctgtgccttaaaaagatctcttttgtttaatgtgtggattgagggagggagagaggaagaagaagtagcaaataagctcgtaaagtctaataaaaagaaagcagggaggcaagttagggagttattgcaatgtgctggatagcaaatcagggtatcttgactcatcgaggtggcagtagggataaagggaagtggacagtttcaaaatacattttggaggtagacgtggaaggacttactaacaaataagatgtggaggaatgagtgaaacagacaaatcgaggagatccatgggtcttgcctgagattcttgccatttacaaagatggcaaggtctgggtgtataaggcagggatcgggtgaagagagactgtttacaaaggtgcagaaagtgtataaggagaacagcagtgatagtgatgtactcccaggcaagtaccaatgaggggtcattactatccttagaaaataagtagcaaggaaaatgaaccattagggtacttgtacggagaagccttctcctaggagatgaggtcttcagtagaggaacgcagcaagcccacagaaacctgggagaggagcctttgttcttatagctggggaacattctcattgaccaaacccaaccagaacctggagagacagggtgaatgaggggtggtgggaaatggaggatgagggggctggagtacttagagcaaatgagagtaaaactataagggcaaagcaagagacctggcacaatgcccatattctgaattctgtataatttaaaagttcagtaaacttttcctaacaatctaaattacagccaacaacatacaaattttgcaacaacatagaaacttttgttgccaagaagactaatttggaaggctttgctagttctatattagtaatgtgttattttttgaatacctagtagaggaagccagtcccctgaaaagtgtccttgtaagtagtcattatttagttaagaaataacccaccaggaaaaaaggaaagagaaattatgagatgcacaaaacctgaagacaactttagtgttatagaagatcttgagagtactagacagatggaagtggagaatgcatccgtttctttaccattaagaccttgcctaggtgtttttgacattttgagctgagataagagagtcgggttttattccatatgcttaaagtctttactaggtttgtcagtataacttaatgtttttagttaccacatgtcattctgttactacattttgctagaattgcctaacataaacagtatccttatgtttcataatacaagctattcaagggtcatattggctaatacaaactgtttagaaagtttgttttgccagaagtcactattgtcaaagcactgattttaatttttggtgatacccccatttaaaacagatatttaatgcttgcccagtatttgttgctcaatgatactttattgtctgttgctatgcactgattgattactgacagacagtaagtgcattggaagaaaccatgatttaaattgtgtgtgtgtgtgtgtatgtatgtgaatgtataaattattcagtgaagcaatagaatctgcatttattcagaaacaaagaacattcattgattccacaaagatttattgagtgactactatgtaccaggcactcttttagggacgtgtgctacgtcagtgaacaaaagagacctagattctcgtgcttgtagatataatattctagtaaggaaacacagacaacaaataatacatataataaaaataaatcatagtatgttagaaggtgatatatgctaagaaaaaaatacaacatgcacaaaatgaagcaatattcatcaaggtcatgaagcaacattatctgcactctaatctgatctccttgaattcataatggaagctgttgccgttttcatatacatcaattcttttttccctttcattttgtgataattgtacatatgtatggggtacagagtgatattttgatacacatataaaatgtgtaatgaccaagtcagtgtcatccatcaccttgagtatttatcacttctttgtgttatgaacattcaaaatattctcttctagctttttgaaaatatacattcaattatttgtaatcatattcattctacagtgctatagaacagtagaactttttcttactatatagctataaatttgtatttgttaatcaacctctacctatccatacgtcaatacttaaatggtcaaaccaaaatctttatcagaaatcactggtactttcatggttggtatgttaaagtttggatcactaaataaatttagagtaataggctgatcctaaaatttcattgataaacttgtcataattaactgtatttatgacaaagaaagcaaaacagaataatttagataattttataataaactagttcaggatatgtttatcctagctatatattggtgcatcatttgtcttactacatttgcatatgcttaaggcactgaatctggaacacaaaggaaataaatgcgcattgttcgttttttaagaaattctattcacatgggttttaatccacagagatgcctccttttagtcttgaatgcaaaaagaaattatcttttgagtgcgtgtgttagctttgaaaaaatacattcacatgagatttaattcaccttaaagtttcttttctattaaatctcatgaggaattgctgaaggaaagtttcatgatgccaagtcactaagcaaagttctccaatatgacagttgttagaaatgtgaacctagtgcagttgtccccttaagctatgggcaaaattcccagttttgaaccctgaactcattcagccaaaaaatctatattatgctagtgtctattacatgtgacttccttttgaccagctttttctatgtttagactctcacttttattccaaagtacactggaaaatagaaaaaaatcggataattctgttctgggtgatcagtaactttggaaaaattcaatttgtttgttttttttctggcaagagtttgaagtaaaacaagtttcttttcaacacattgaaacaacctattttctccagagcaatagagtttgcatctgatatcagataagtgattcttgtaatttgtctaggctttcaacaaactggtgaaaaaaaaatctcctttcatttactttccatctttcttcatgagtttcttttttttttttttttttatctcaaagtgttcttagagattgggggttgactatctagctcataataagaatctaacagaaaacataccattaagcatttgagcttctcagatcaaaatcaatatttaagaccaaaataatattatgcaagcttttctgatcataaaaagaaagatcgttagtcactttggacagaatgatgatatctttagtcattgaattaaaattcataagtgtaatcctcctgatgaatttttctctgtctggtatttttctatcaggtttataactcatgaggctaaagcaaattagtgtcaacgttttatcatgaccatttactcggtgcctttctgtttctttacgaaaataaagttgctttttaatgttttggtaaatttatataatttctttggaaacatcaccactaggatttaccatgaattacagcaatatacttagtgctgcttagaaaatatttcatccctttccctgttttttgtgtaggtttatgtccttttaatttctgtttaattccccttatttaaagcctaagtctcaaatattcatgattcttattgcgaactataaaatatgtgcttaatgccattatccttttaaaatcatcttgaatctttatagtttaatcacacatcttgcctgtaactaaatttaaaactctctggtaaaacaaaatgcctaaacatcttgtataatgatatgcctttttagcaatggttacacttctggctttataaaactatattacttagctttttaagttacatatgtccattatatgtatctaataaaattaaaccggattttagatattgaacatttttaaagccaacaaccttggtgctatccttggtttttcctctcctactgcctctgatatctaatccatcaattcctattagttttatctcaaaattgaccctgtctctgtccataagtcttctgtcagcctctttattgcaagcttccccactggtctctcattcattctccacacagcagcgaaagccactactttacagtaaatggtgtgaatcattcttctgcttaaaactgctcaatgacttcctggaatcaagtccaaactccttatcatggccgcctaaggccagtatatataactggaccttgcttctttctctgatctcatgtcctgccacttccctttcgggtcgcgtaccaagctcattttcatcttggaaccttgactcttggtcatctctctctactccaaagctctttctctgcatcatggtttctgccttctcatctctaaggtctcggatgccacctccctaaagaaaccatcttgcccgatgtagccccaagtcaatctctcttaaatctctctattctatttattttataccagggagcgccatctgaattacttgtttatttatttgtttgcttctccacctcccccaaccccattacaagtttcaaaagagctcctatctgactcagtgcaatatccaacatcctaagttggatcctggtgtataattcatgctgtttacagatttactgaatgatagtatattaatatgtcaagattcatggcaggtatcaaaaaattaatttattgaagcattcagtctcaaacattttcttttttttctttttatctttttttttttttcagatagagttttgctcttgttgcccaggctggagtgcaatggcgtgatctcggctcactgcaacctctagctcagagttcaagtgattctcctgcctcagcctcccgaggagctgggattacaggcatgaaccaccatgcctggctaattttttgtatttttagtagatatggggtttcaccatgttggtcaggctggtctcgacctcctgacttcaggtgatccacccgccttggcctcccaaagtgctgggattacaggagtgagccaccatgcccagccttcttttttttttttttttttcttttgaggtgagtctcgctctgtctcccaggctggagtgcagtgttgtgatctgagctcactgcaacctctgcctcccaggttcaagcagttcttctgcctcagcctcccaagtaggtgggactacaggcacgcaccaatacgctcagctaatttttgtatttttttgtagagatggggtttcaccatgttggccaggcttgtcttgaactcctggctcaagtgatttgccctcctcggcctcccaaagtgctgagattacaggtgtgagccaccgtgcccagccatgtctcaaacattttcatcttgtgaagctatttaagtttcctgaaaatcacctcactcttcttgtactcctcttccttaaaaccaacccaatggtctcaggcttttctgctcattcaagtcacatttcctcccagtaaacttaattttggtaaaatattcaacagttcaggagagatacataaatcatgcttgaactgccttgcaaatagcaaaggaactgactggccatgtgctatgatttcaagggttttgggaagcatctacctccaactactggtcctcactgagtcttgaaatcccacatttagagttttaatttcttttttttaaattaaacaacagaaatttattttctcacaattatggtggttggaagttcaagatcacagtgttggcagggttggcttcttctgactgctgtcctcattagaattttatttaagttttgactcatgttaagatagaaatactctcggaatgattaatgctttaaacttgtccagccacttagatgtaaggtctgaggatcttaaaaggtattttgggaaggaaaaaagagcaaacgtcagaataccaggaatctaaaatacaggcagaagagccacctggagggtggggaccattcggaaatcctgatctgcttgtaaggccggtgttagtctaacctatagcattctggttcttttctggctcggctcctactgtaaatttaaacatcccatttaatcattatgcaaaaaaaaattaagagatttagctgggtgatctctaaacaattctagatcagtgattctatactccataattttattcacaatcaaccctttctactactcacagatgctagaaaatattagaaagcagatgtaattaaatgttcacaccacaaaaatgagaactatgtgaggtaaggcatttgttaactagttagattgacccttgcacaatgtatatatacttcaaaacatcatgttataaacaattaaaacataattttaaaaagccagtatgatttctacaaatacaataacatgggaccaaacagcaacagacctcgagttcaccacatattttatatatttataatttcacatatactcacagtgtttcattccacatctattcccaaacttgaatgcatgtgcatgcacaaacaacatatacatcacctccttcactgagaaattacagcaccattatttattcaaaggcactaactctgacaagagtgaaacagaaggtacttctctattatatagtgtctattttctgattttctttgttatatttcattgtatttattaatattaggttaagcaagaatgtacaaagccatagcaggttgggaaggttatcaagagaccacctattctttttcttcaattcaatctcttttcagattaatcattcttggctattctgttttttaagtaatttactttttcttttcacttactcacctaattaatctattaacagagtgtcaacaattgctgtttcactaaaccagtaaaagacaactgctttggtgataatgttttattttcaagcaggtcatgattatacttatcacattattacacttactacatttattacttatcatatttattgcaataatcattatcacaaaaatgatccattgattctaactctcaggaggcactcaataaatatttagtcaatgagtgaataaatgcaatattggaattaaaacatactctcaacatttcaaccaaatgctttattacaaagcatgggggaaggaagcatagggttggactttgtgcactgaaacagttatatattttccgtagcactaaatctttttctcattaaaatgcatataatgtgcagctattgctccaggaggacctgctgtatcctgttaaaattaccgtcaccaatctgtggattagctaacagtaggggaggatatggctgatgtttgtctgtgtgtgtgtattttgatgattgaagaaaagaagtaatggggattaacattctgcttttacaagtataattgtaagtttaacacagggacaactttatttttagtgtaatacatctgtgaattatgaattatgatatgttcaggtcatgcttttttgcattcattttttacttttatggagttggagtaaactaacccaatctatgaatgaaattcaaaactgtacttgaaaatgaaggaaaacggcattatttttcaaatattgagtataaattatcacaacttcgttaaaaaaaaagatactttagaagtatacttaacttagtctattacttctccaaatagatgttttaaatgttttaagcatctgctgtaaaaattaacctaggccaatttggatattcagcaattatcacgttattagagcaaagtttggtagaattctacaattagagacaggtggatgattcatggcaaccttttctccataatcttgctaccaggtggtatgctaaaattaaagcaagcctgagattaaatagaccaaattctgtcaaatgtaccaacatttagtcgcaaatagggcacaaaagcagttattgaacttaagccttcaagttctcagtctcaatctgtaggaacttccacaaatacccttccaagagaggttcattatgaggaagatcagccagccttctgagttacatcagggacagaatcttccattaaatcgaatagagggtagaccaaagggagtttagacctagacctagtgtacttacctgatggtattagacttctagccttgatgagtcttatgcctcattcatgataaggctcataaaatctatatagcaactgaacattttgaacaccactcatttcatcaacaagtaatgatttcaagcatgccttttgtgaattaatgaaacctctctgtagattttgataatgatacttgaaattcttgggtggcatttttagagtacagattctggattagggaacataaaattctaaccaccttaggagtaggaatcaaagttaatatacagatacgtaacttacagtgaagtattttaaagtaaattagcacatctgttgcacaatagctttccggataggtttgaactataatgttacatccacattacggagatattaattgaaataagtaatacttcatagatatcctatacatgttatatatctatatctaaatcatctatatctatctattacatatttatcacctatttacctatctctatacacatatcattgtaggagtagaaatcacagaaaatgagatcatttgaaccaatggcctggtttgtgtcatttaaataatcttaaatttcaaccatataaactctcagatactcaaataatgcaaattctgcaggtatctggagtaatcgcttccaacattttttgtttttgagacagggtctcactctgtcacccaggctggagtgtagtggcacaatctcggctcactgtagactcaacctcctgggctcaagtgatcctcccacctcagcctcctgagtaactgagactacaggcacgtgcctccacacccagctaatttttgtatttttagtaaagacgggtttgtgctgtgttgcccaggctggtctcgaactcctggactcaagcgatccacctgcctcagcctcccagagtgctgggattttaggcatgagccgctggggctggcttctttcaacttttaactctgttgactgcatataactttttcatatttaagaaatgtgttggttgttgaagaagaccaagtctgaactcaaactgggttcttagaaagctttgaaaggaaaacagggacaaattaagtgtctgcctctgcccaaaggggaagtccctaaaagagaaaagtttaaagacatcaagaatagttctgatgcttgcctaaaagttaagtctagaagtagagtaataagtaaagtttcttggaaccttttcaatccagctagagagatacattatgaccactgataatggtgtgctttctacctctcagtttaccctttgtaaataactcaaatggtttgctttgaactggcatatttatttattttccctctgggaaaccacctctactcatattcccgaataaactgttttcctataatcagctatgtatgaaggctttagatatcaacagaactttccataatatctcttttaaggtgaaaggttcagaataaatctacctaagattaaatgctccttaggtggaaccactgagcctcatgctacctacatgcctatgacaaacaaatttttatttcatatgcatactctgctgaacaatgacttatatatccaaatacctactagaaatctactcctgaaaatccagcagacaattcaaccacaacattcaaagcaaaaataatggtttcttgcccagcccattcttccccatctcaattaatgtttgcaacacacccactgtgactcaagccagatacctaagagtcattctctatttctctccagcccttatacccaacagccaatctatcatcatttcttgtgagttctacctctgcagctattcttccagtgcaagcctccatcacctctcacctagaatgttgtatttgttatattttaggcctcctttctttctactctagctctgtttctttggtcaacacagcaaatgaatgataattaaaagaaaatgaaaggatcatatcacttccttatttaaaactctcttttagcttctgtctaaacatggaaggatcaaaatccctactaatgccctgcaaatcctgcatctccaatctcagtttctcacatcccatcaatttcctgttcactctggccacacagtctttcctcttgtttcaaatggaaaattgacatagcccaggcttaggagctttgcactcactgttgcctctgcctggaaaactctggcctctgagagtcacctgtgtggttccttgatatccaggtctcagctcaacttttacactactgtgagaacatccttaccaccttttcttaagtagctcagcaatgcccccaggcaggcactctctgcatccttaccaaccttctattttccaggggattttttactaagtaaaagtttcttgtttatttagttgtttggttactgtccttctactctaattataatgtaaattccctaaagtcaaagattttgcttctcttccgttgtactctacttgccttggcacatggcaggagcccaatgtgtttcataaggaaattaagattcctacctggtaaggttattctttcaagaaaaggagaatccaagtgacctttttccaaagtggttgaggtccttggtatcttgctgacttggcagaactgttctgagagcctcagaaattgaaccacgttatttaaattcaactctgaatgtaaagagtcaccaaggggccactaggatgaatcccagcatctctcatttcctcaggccccctcatccttctgtttgttaaatcaatgctggaggaagatgggtggcatcacattcaatgacaaggatgccctgtgataatttgcatcatctccaaagaggattaaaaggggctgggtgcggtggctcacacctgtaatcccagcactttgggaggccaaggtgggcagatcacttgaggtcaggagttcgagactagcctggccaacatggtgaaaccctgtctctaccaaaaacccaaaaattagccagtcgcggtggcacacacctgtaatcccagcttcttgggaggctgaggcaggagaatcacttgaacctgggaagcggaggttgtggggagctgaaatcgtgccactgcactccagcctgggcaacacagcgagactccatctcaaaaacaaaacaaaacaaaacaaaaaccaaagaggactgaaagggatttattaaatctcagcgccccaagccagtggttctcaaagtgtggtccctgggccaggagcatcaacacaactaaagaactttgttagagacacagattatcggggggctcagccctgacttggagtatcagaaactttaaacctgtttgaacaagctcttgctaaaatatgagaactaccatgctaagacaacagtgccaaccttgattgcaccttatgattacctgccaagcttttaaaatttatcaggcctgagcccctctgctacaagttcttagtcggtctgccgtgagtgagatctctgtattatttaatttctactaagtgatgctgatggagctccaaagtttagagtcattgccccagtgtgggagcagggtaacttcaggtttatccaggtactttgtagattttcatcctgaaaagaaatataatttggaattcaaacatggcttgcctctcggttttatagtaggagagaagggaaatgacttggcctaaaacacagcatatggttctaaatgctagtgttgtatagcctcatccaaagcatcaactcatagagaagtacattaaagcagtgtaatgttcaaaaccaagttccatagtaagcatctgctataatagaatgacttattccagaagggaagtttcatttcaggagagcttatcatgacatcaaatatgttttgagttaatgaaaatgcaggaagcaccaagttaatagggcaattttaaaccataaagcctaatttaactgcgctaagaatgacaatataatgctctgcacaaaaggaagtttcacaacctgattgatcaaatggagaattactaggatgctggatcgcatcttccttgaagaagctaagttgactaggagaggcagacttccttagaatgcagttatgtacttcttaattaaacaaagaatgattaaaaagagattttgctttataaggccacagaacagcttgtttgataaaattgttataagcctccagactttcatttctactttaatattgattccattttcagaaatagttaagtagaagttattcaggttcttctttatatatttgcttttttagttgttgttagacgtaagataaatttgaaatgtcaggaaggagaatgtttattttcacaataaaaagcttactctgtgtaatattgaaactatccattctgatataagataatgttttattttggctgcttaatttcaaattgaattatttaatagaacaattaaaagtcaatacaaatgaaacagctacttgtttttctcagtttatggatgttttataaagtgtaaaagcagctgtttcgttatacttttcttgaattgaatagccataagagctttcttaaaatcatatttgatccatagctctttcttttatagcttcttctatataatttacttctaagtaacatttcctttacatataaaaattgattattactgtcttgtgttaagaacttttcctgggtctccttaattcatcagaatgccaatattacgattagcaaaaccaattaggccatttatcgcagagaatattggaaatgtgctatatgcaaagcattgttttacaagtagttcaacattctaattttgaaattagactaagagcataatacatttagaaaatgtggatagttaagtttaaatttaaaataataaaaagtcaagaatattacaattttacttcctcagtcacactaggcacatttcctagactcaataggtgcacgtggctagtggctaccatagtggacagtgaagatacagaacatgactatcatcacagaaagttttgttgggcaggcagtgctgtataggctagttagtgaggaaatacatttttaaaaagcattgttccctggggcattacaggataaatttaagaattctgtttcataaggaaatattatgccacacatggagtctttcttaaaataactgaccctctagaagaggaggcctaagtgtacaacctgttcatttcctatcggagttggttgcctggaaatgttgtacatctcagtttcatagcaaggtcataaatgttttgtaggccgtatcctctgttctatctactatccccacagcacaaagaaataattatgtgcatagagtggacacccaatgaatctttactaaaagcaccaaagtaatatgaggcaaggagatactacacagatttcaacctttgaacttgaacagtagtttgtaactcctggcccagtctagtactagattgtagggtcctgatgaacaactgtaggccaggatctccctctgtttcaggtgccttgtggtaaaatcacatgaccactgaaccctcaaccactccctgaactagatgctaccaacaccaacacagaacccctttccccataattccttccttatccctggtccaggaccagccaacctgaacatagactgacaagcttctcatgattcaattatctaacttaagttaccatatgacttccttcaacaaaagttacccattttaaaatctctgtttctttctgtattataggagactcatatcccaaatacacacacacacacacacacatgcagacacacacacaaacacacacatttatatatatgcagaaaagcaatgataaaatctctcctgccaaattagcaatatagttttgtttcaaaatatttatgcataaatttcataaggtattctgacttttaatttgaaatttaattcaataaagattacattagtcagaaaaaactcatctttggccaggcgcagtggctcacgcctgtaatcccagcactttgggagaccgaggtgggcggatcacctgacgtcaggagttcgagaccagcctgaccaacatggagaaaccccgtctctactaaaaatacaaaaaaaaaaaaaaaaaaaattagccaggcgtggtggtgcatgcctgtaatcccagctactcgggaggctgaggcaggagaattgcttgaacctgggaggcggaggttgtggtgagccaagatggcaccgttgcactccagcctgggcaacaagagcgaaactccgtctcaaaaaaaaaaaaaaaaaaaaaaaaaaaaaaaaaactctccgtctcaaaaaaaaaaaaaaaaaaaaaaaaaaaaaaaaaaactcatcttttaatgttagtttataatttaaagacacaaaaacagcttcgtttctagattcaagcaaggcatgtatttccaaaatatctcttcatgattgccccaaatactggatctcctttcctgttggactgtatgtatctaaaatgtacagagattattgaaaaataagttaggatagggactattaacacaattttgttctgaaaatcttcccttaatacatcacatgggtttttgaggcagatgtttggagggcatgatttttagggcagaaccagcacaagttgcaagcaatgcctggacacctgttgagcccttctgtgccatctgcttaaagggaagtacacataaccttaaaatcgttgctgcttttggaggtcattttatcaggattgagactacatcccccacaacccacaggacttaaaaagagagagatttatctcagaagggcattgtctctaagtgtgatcttcatttttatgagctgagcttgaagtccctgacatttagaaatgatagtgtgttgatgtgaggttctttcgaataatccttctaagttttatcagctttgcaaaatgttactaagtgctagcatttagtttgtgaaatgttttaactattgagaaggtgatgttggtcagtccttaactaagatcgatcaaagtaagttcagtaggtgactgttttacaagtggcatggtggtggtgttcctcaaaggttttggagagatacaaaaggactctctagttgtggttttaagttatatactcagttttatatcctgttaaagtttttataccatattttaaaattgctgtttggaattacaggaaatgtttaattcacaaatcatttatagttacaggaaatataattctattattgatataatgaattgaatggtttttaatacatcgtagttttaaacacttaaatattcacgagtaatatttgggaactttaagaatagcatccaaaaggtctacgtgttcatgtgtatgtctgtgtttgatttggtgggggccattggccaaagtttgatcccactcatttgaacagcttgctcagtatgtgcatcattggggaaaaaaatcggcatggagcgttcggtagctagcctctagtagaattatcagaggaaaactgtgatggtgaaactgagaatttgaaaagccagattgatgttttccaagcttgatttttagatgagaaagtaaaagagtattttgatttaacatttgaaattataatattagtagcaataaaatataccagtgcttctcaaattatctgaggtggcagaccaggtttttaaaaatttcattttgctttaattttcaatctctcaaggaccaatactttggtaaaataccataaatatcaataactagaaacaacgatgttaccaaaaaaaagacatacaaaaatacaagccagggcttttaatattttttttcatttaacagatattatcaaattgctgtgaaatttactaaatgttcactctcagtttctatacttttattgtagaacaacaaaaggaatttgttaactggctgtgctctgtaggctttttaagtagaattgctctatgtcactgtgcattaaattttgtgtttggatgtatcctaagcaagctatgaggtctctgaggaaaaaattatatatatatatatatatatatatatatatatatgtgtgtgtgtatatatatatatatatatgtgtgtatatatatgtatacatatatgtatacatatatgtgtatatacgtgtacatatgtatacatatatgtatatatgtatacatatatatgtgtatatatgtgtacatatatacatatatgtgtacatatgtatgcatatatgtatacatgtgtacatatatacatacatgtgtacatatatatgtatgcatatatacatatgtgtacatatacatgtatgcatatatacatatatgtgtacatatatatgtatgcatgtatacatatatgtgtatatgtatacatgtatacatatatgtatatatgtgtatacatgtatgcatatatgtatatatgtgtatacatgcatacacatatgcatacatatatgtatatatgtatacatatacacacatgtatatatgtatacatatacacacatgtatatatgtatacatatacacacatgtatatatgtatacatatacacacatgtatatatgtatacatatacacacatgtatatatgtatacatgtatacacatatgtatatatgtatacatgtatacacatatgtatatatgtatacatgtatacacatatgtatatatgtgtatatgtgtatatgtgtatatatgtatacatctatgtatatatgtgtgtatatatgtatatatgtatacatatatgtatacatctatgtatacatatgtgtatatatgtatatatgtatatatgtatacatatatgtatatgtgtgtatatatgtatatatgtatacatatatgtatccatatatgtgtgtgtatatatacacgtgtgtatatatgtatatatgtgtatatatatacacgcgtgtatatatatacacacacacaatttatgtgcatgaattgtgtgtttttattttgattataacttttaaaaagtcatacaagtgtattctgcatcacttgactgaccaaaatgtacacttgcataacataagtgctcaagtttgtgtttatgtttacaatgaagtcaacaacaagtagcattactttaaatgtcagggtctgataaataaagaccagaggaagctaaagaaagaacatgatactttgaacaatcctctctattaaatgggaaaattgggctttagatctgagtgttttaatttctactttaatatgcttgattatagttttaagatgaatgcataccagaaatgaattgatttatataaatctttcattttaaagcagattttatcattttacaatgtgtgagaaaagaataaaatcagacccttgattgacactgttctttcaatcagtttatgaaacattttcctctgtgtctaccacttttatttgcataattaaaaattttaatgctaaatcagaaaccaaaaatggaatgtgcataaaatccccttggactatgagtttggagagttggcattttttctggcgtgatctgctataggcttactgttacttagggcccggagaggtgggtcagggaaaacattaaatgtattcagggtatgatccatattctatttttaagttttatgctgtttattttgagggaagagatactgatatagtttggctgtgtccccacccaaatcccaccttgaattgtaataatcctcacctgtcaagggtggggccaggtggagataactgaatcatgggggcagtttcctccattctgtttttgtggtagtgagtaagtctcttgaaatctgatgattttataaatgggagttcccctgcacaagttctcttgcttgctgccctgtaagacatacccttgctctttttctgccttccaccatgattgtgaggcctcctcagccatgtggaagtgtgagtccattaaacctctttcctttataaattacccagtcttgtgtatgtctttattagcagcatgagaacagactaatacagatacaaacatgtaaagtgcagaataaggtcctatatgtcaatgggccaacttgtgtgttttgtaattaaatatactagtttagagaaaaggaagctcaagctcaacatgaactggattcatcagtggtggtctcaccgaggaacatgaccaaacttcagtataaattgtgtttacatctcttcttaaaaaaataattaaatacatgttattattgtttgaaaagttatttaatactgagcatctacacattaatcatgatgaaaaaataatattaaacttttgtatgtcctgctagcttaggaagaatgacactgacaattatttcccttaaccattgtggtaagccaagtattagttcatagcaaatatttcatttgtagatttcagtttttttcactatttctacttttcatacaatatcattcttcaaatgataaaatagtacttagtgaaggatttgggagcatgttaaagttatttagcattaattgcagcattacactgggacacatgtacttctatttctgtaacatatcactcatcatttcactcagataaaggaaatattaaacattttatcagatggggaattcctggggtcacactgtagcagatgagttgggattggtataccttctccaagcttcctattagttacacacgcacacacacacacacatgcacgcacacacacacacactccagtttggaatctgtctagccaagaccacagtgcaagatgttaaaagcactccacttgctttgggcatatgccaggcctgaatgagtctcttaccattgggaaaacgatctatatttaaatttttctagatactatctattaaaattattctatattaccaaagaatggaaatattttccggaaagttcagagtagcaacatattccttaagcatgtttccacttcaaaagataaaaagtttagaagacatctccatgtcctcaaaaagaagtaagaaaacattataattattgattaaaagctgggagccctagaaagaaaccttggagatgaatgacaaggatacaaaaggatttgtcaaaatgagaaaagaagacaaggaaactcaagtacagctagcgatataaaagctgcattgaagtctattatagtcttatatgacagaaaaaggtgaagaaaattgtatataagtaaggaagaaatgtttatagatgaaaaattatatatatataaaatctatagattatatataatatatacaggaagagagagagagagggatggaggcagggagggagggagagaaatagagaatgagaatgtgatgaagggcagagaatagggatcagaaatacagctgattcagttgaaggaaccagaaaatgggagggggcaatatatttgaataaaataattacaaatatgtaataaggataaaaacataagtctttttctgttgctcttgctctatgtacatgtgagcacacgggcacacgtgcgtgcacgcgtgcacacacacacacttagaaagttgaaggctttgtagttaagtagggaatttgtagtatgtagggaatttcaaccttgattcagagtgacaggcaaagatttcaaatggaggtatatgtgtattcttcaatgggaggataaattgaaaacataagtaaggcataaaatgtatctaaaaaattttaaccttactaaattccaatgaaatccaattatgattttcttcctaaacttgacaaagttattcctaagtgcatctgaaaaatatagcaaagaatatgattataattttaaagtaatataggaggacttgccataccagataatattgtcatgggtcaatcatagtctttaaaacaatatagtactaacttcaggtgagcagacaagccaagggacataacagatggccctgaaattgactttatcatataaaaagactagtatttaattttttaaagtatcattaaccagtagggaaataaccatctaaagaatatatatctattagccatttacatatataaccaattaaatatataggtttgactatgtgtctccactcaaatttcatgaggagtcgtaatctccagtgttggaggtggggactggtgggaggtgattggatcgtgggggtggagttctcacaagatctggttgtttacaagtgtgtggcacctcctcctgcacttactcttcctcctgctctgaccatgtaagatgtgcctgcttcccctttgccttctgccatgatagaaagtttcctgaggcctccccagaagcagtcatgcatactgtatagccttcaggaccgtgagccaattaaacctctttactttataaattacccagtctccggtatttatagcagtgcaagaatggcctaatacaatatgtaactatttaaatatatacaaaatcattcaaatatgtatagaaccatttaaatacatatattaaattatatatatataatttttcaatttcacgtaatctagagagtttatattaaaattgaaacatgacaaatgagaaagctattggttaataaatctctagataaagcagaacttttcaagaatttttatttaaaaatgaaagggaaacactgggcatggtggctcacgcctgtaatcccagcactttgggaggctgagacgggcaaatcacctgaggtcaggagattgaaaccagcctggtgaacatggtaaaaccccgtctctcctaaaaaagtaaaaattagccgggcatggtggcatgcacctgtaatcccagctacttggaaagctgaggcagaagagcctcttgaacccgggaggtggaggttgcaatgagccaagattgcgccactgcactccagcctgggcgacagagcaagactctgtctctcaagacaaaaaaaaaaaaaaaaaaaaaaaaaaaatgaaagggaggatccttacaaaaggaaagatgattttgatgcattaaatagaaaacatttttaacaacagcaaaataaataagataaaaagattattggctaattaggtaaaataccttcaacaggtgtgatgcaatttgatttctgatacatgaattcttcaagtcagtttttataaagtagcaaagcgcatgattatgcaattaaataaataataagaacacataaaatagcaaagaaacatatgaaaacatactgaacatcatgagtaattggtaatcaaagaaatgctaaagtaataagatacaatctttcacctgataattttgtcaaaaatattaggtaaaatagtcaccctcatacactgctagtcagaataaactgtttttgcaggacagtttggtaatagctatagggaatcttaggtttaataatttgtaatcttgatctaacaactcaaattctgggagtacatccttaagaaaataattagacttttacaaagatttatataacaagaggtttatcactttgatatttatagtagcaaaaaaattaatttaccaaaatcataaacagtaaagtagttatctatgaccattcaatgaaaaactggcaacccttaaaaatatgcttaatggtaattttttttaagtaagtgaactaatcctgttttttggatttggattgtcttttaaataaggtcttacatataatcttaatctaacacatctaaccacattgtattaaagtaaatgtttccaataataccaatgttttaaaatttatagagttgcaataaggttcagtatgtttgttattaatttccatcaccgctccatgtgtgcttggaaaggttttgtattctgaaattgttgggtacataagatcaagtttcttcattgtgtttctcaaatcttatgtatggtacttattaattttaattttttgcctgttttatctatcagtttgtaagaagagtgttgaaaagctacaactaaggtggtttatttgtatatttctcttcatattctgtcaaatattaatttatacattttaacatatatattatgttcttaagtgaatgattacattttcttggaatatatcttcagtacacctttctggtaaagtgaaactcttacaattatgtggtgactctctatctccaatactactcagtctttaaagtctatttcatgttttattaatatggttaaaccagctttgtttgtattttctatatataaatatttttatatgccagcctgtatagttttaattgaggtgtgcctcttataaatccatttaactggatttgatatttgctttgttcctgtatgacagtctttgcttttcaactggaacttttagttaatttttaattgtaatgactagtgtctgtaatcatgcctaccatattctgctcctgcttttttttttttctttttttttggggggtggggggatacagtttctctcttgtcacccaggctggagtgcaatgttgaaatctcagctcactgcaacctctgcctcccgggttcaagcgattctccagccttgcctcctgagtaactgggattacaggcgctcgccaccatgccaagctaattttttgcatttttttttttttttagtggagacggggtttcaccatgttagccaggatggtctcgatctcctgacctcatgatccgccctcagcctcccaaagtgctgggattacaggcgtgagccaccgtgcccggccgagtttgaacgtttttatacttgatctctattcttttcatgatcctgcagaaaatttgcacatatgcttaacttacgaaatctacttttagctatatctttactcgccttcagaacaatgtaagtacgtaggagactttattcctgtttctctgtattttagtcatctttttttttctaattcacaaacgggacgttatcatcatttctttatgcagtcaatatttgtttaatgtaagccccatgaaggcaagaagtttttattgtggtggttgttcaatgttatactccaaacacataaaacagatcctacacatagttattatgcctagataattattaaataggttgattaaatatacccaagtcgttaacttttttttttttttttgctcatcataccttcctgcatccctctgtgttagttttccttctgcctaaaaagtaattgtttataatttccttcagtaagggtgtgttggtaccaaatactctctgtttatttgttgcctgaaatgttcatattttgctttcattcttgaataatactttgatggttatttagttctaaatttttttaagcagagtgtagtattattccacagatctttacattcattgctgcctgtaagaatttggttgttagttttattgttatgctcttgaaggtactctgtcttttctctcttattttaaaagttttctctttgtgtttaattacatatgatttcactatacatacatagcagcacatttccttttatgtattatttatttatttatttttattttattttatttcattttgagacagtgtctccctctgtcacccaggctggagtgcagtggggagatctcagctcactgcaccctccacctcccaggttcaagcaattctctgcctcagcctcccgagtagctgggattacaggtgtccaccaccacgcctggttaattttttgtatttttagtagagacggggtttcaccatgttggccaggctggtctcgaactcctgacctcgtgatccatcacctcggcctcccaaagtgctgggattacaggggtgagccaccgtacccagcccacatttccttttatttatcctttttcagattcattagtgttcatgaatctggaaatgtctttcactagttctggaaaattcttgcctattattgtttccaatattatgtcagcctcattctctttctcctcttctcatggaattccacttagaaataagatatattttcttattctatcctccatatctccaaccctagtctatattttccttctctttgatttgttcctgcattgtggaccatatctttagatcactgattgtttcttaggtgtttctaatcagctgttaaaatagccatttgttcttatattcaataattatatttttctttctaagacttatagagttttttatttccaagtctgcttaacaattttacatagtcttttgtttcttagtcacataataaaccccttcttttacttcttaaaaataaaaggtacttttaaaacatgcttactttataattaatttcgaatgatttaaatatcccaagactttgttagaatctgctgtctatattctctacttgttcccactcctgcttgtttgcttccttccttccctcctttctcctttctctctttctttgtagtatgctgcacagttaggaaatacagtctaacgtatagtgacaaaagaggggggtcagtgattctcctgttatatgaggtatggggtaagaggaacagagagaagtagaaagaagggtggatatattagcagagttctctagagggacagaactaataggatagatgtaaatatataaaggggagtttattaagtaatattaactcacacaatcacagggtcccacagtaggctatctgcaagctgaggaacaaggaagccagtagaacttggagttcaatgttcgagggcaggaagcatccagcacaggagaaggatgtgggctgggagactaagtcagtctagccttttcacgttttttttttttttctgcctgctttatatttgctggcagctgattagattgtgcccaccggtattaagagtgggtctgccttccctagcccactgactcaaatgttaatctcctttgacaacaccctcacagacacactcaggatcaatatcgcatccttcagtccaatcaagttgacactcagtattaaccatcacaatgggattaccaaagagcacaagaaaacttttggaggtgatgtgcatgtttctgatcttgattatgatgatggtttaacagctgtatacctatttgaaaacttaccaaattatacactttatgcagttaattgtatgttaattatacctcaataaacttgtttttcaaacattggacacatagataaccaaaatctttataattgttagtcttctacatggaaaattcatttataatttcactttcattttttcacttttctgcatgttggtaaaagcacaccctttaacacaggaatttcatttttcagaatctattctcaccaagtcaccagatgaacaatagatcatctacacagttataaatgacaatattgataagaaaaatgtgataagaagaaacgcttagaagcaacttaaatgttgtacagtaaaagtttgatagacagattgtgaaatatatatgctagaatataaaacagtcaacattatctggagaggactttatgatttaaaatgtttcagtcaacaaaatagcacaaaacttttagttgtttacactgtggtaataatttcataaagattcgaagagaatgaaataaggtaagccaaatgattaatgactgttactttggaaaagtagagttgtggataatttttatttccttttttatgcttttcttcatactccaaattctctaccatgaatatgcattacttttctcatcacatttttttgaaaatgactaaaaggaactctcccaaataattttccttttatctttcaacgaaatggcttttaaaagaatcctctcatagaggatttgaagcacgtcaagaaaattgttcagaacggctgagagtcttatggtgaatgtgacaaggttatagtccaagttttgacatgttcatcattaacgttctgctggtccctagcctgtctcagtggatggagatgaattcattagagatgagtaaataaaaaagtgattttctctctaaattaatataacgacacacttttatgatgaattttctaaatcatttcaggttataccttcctctctgtgagttcaattatctttgtcataaaaagcttcttttccatagacaagctttacccatttttcatagcctaatttaactgtaaagctgttaacatcctaatttaagctgatgataaatagtcttttaaccgatttgaaatttttgaaattaggtggtataatattcatagatataaccttaccaattgtgaggtgaaaaaaaattcaaagcataaatatggctttaaccttgaaacctgacaggcgtttgaataggaaagagatgagccatttcctgtatttaaatttctctagactccccgtgccctgtgtgccaccattttgattaatccttcttaaaacttatcttctattaaatgtgtgaaaaacatatgtttctcattgttaacatctcaatgttttactcaagaattggataatctgaggaagtttcattaataaaggaaaatatatatccgggaaatattatgtatgtatgtatgtatttcacacctttctctttgtaggttatcaaaatagtgtgaaaaattagaattaggcttagaacaacactatcttttactctaaagctctctagaaaaggtccctaaaattaatcaaaaatgggcactatgtcttctgttttaaataaataccttaataccttacaatacctcttttacaatgatgtcatcttcttactagccaaatgccaagattctgatgtaagagagtaaataacttgtgaaacaaagtaagagaatctaaaaaaaaatcagtttgcttggggctttatttgtatcattattttctagcattttaccaattcatttgtgtttcaatcatccatgatgcattttcttaatgctggctgctttcattttttattttttaatttttaaaataatttcaacttttattttagatttgggggtacatgtgcagatgtgttacatgggaatactgcatgatgctgaggtttggggtatgattgaacccatcacccaggtagtgagcatagtacccaatacgtagtttttcagactttaccccccttcccccgccctgcatctggtaatctgcagtgtctgttgctctcatatttatatctatatgtactcaatttttagctcccaattataagtgagatcatgcagtatttggttttctgttcctgtattaattttcttaggataatggcctccagctacatgcatgttgcttcaaagaatgattttgttcttatttatggctgtgtagtattccatggtgtgtatgcaccacattttctttatccaatccacccattgatgggaagctaggttgattccatgtctttaccattgttaatagtcctgtgatgaacatacaagtgcaggagtctttttggtagaatgatttattttcctttgggcatatacccagtaatgagatttctgggttgaatggtagttctgtcttaagttatttgacaaatcaccaaactgctttccacattacctgacctaatttactttcccacaaacagtatataagcattcccttgtctctgtagccttaccttttgttttttgactttttaataaagccaatctgactggtgtgaagtggtacctccttgtggttttgatttgcatttctctgatgactagtgttgtgatgcattttttcctgtttcttggctgcacatacgtcttcttttgagagtgtctgttcttatcttttgcccgtttttaatggggtaatatgttttgtgtctattcaattgtttaagttccttatagattctggatattaggcctttgtcagatgcatagtttgcagatattttttcccattctgtaggttgtctgagtactctgttgatagtttcttatgctgtgcaggagcttagtttgattagatcccacttgtcaatttttggttttgttgcaattgctttagaggacttagccaaaaattctttgccaaggccaacgttgaaaagggttatttcctaggttttcttctgggactctaatggtttgagaacttacatttaaatatttaatcctttttcagttaatttttctatatggtgaaaagtagggatccagtttcattcttctgtgtatggatggccagttattccaacaccatttattgaatagggaggcctttcctcattgtttaattttgtcgactttgttgaagatcagatggttgtagggtgtgtggctttatttctgggttatccattctgttccattggtctatgtgtctgttctcgtaccagtactgtgccatttttgttattgtagccttatagtttaaagttgggtaatgtgatacctccagctttgttctttttgcttagaaccgctttggctatttgggctcatttttggttctgtataaattttagaatagtttttttttcctaatcctgtgaaaaatgatgttgatagtttggcaggaataacgctgaatctataaattgctttgggcagtacaaccattttaacagtattgattcttccaatccatgatcatgaaatgtttttccatgtgtttgtgtgatttatgatgtatttcagcagtgttttgtagttgtccttgtagagatctttcatccccttggttaggtgtattcctacatattttatttttgtatgactattgtaaatgggattgcattcttgatatggctctcagcttgaatgctattggtatatagaagtgctattaatttttatatattgattttgtatcctgaaactttaatgaaatcatttatcagttctaaaaggtttttgatagagtctctagggttttctgggtatagaattgtattattggtgaagagagataatgtgacttcttgtttttctatttggatgcctcttatttctttctcttgcctgattgttctggctgagaattcagtattatgttgaataagggtggtgagagtgggcattcttgtcttgttcctgttcttaggatatatgcttccagcttttgcctgttaagtatggtgttggctgtgggtttgtcatagatggctcttatttttagttatgttccctagatgcctagtttgttgaggctttttataattttataaaatccctttgtataagggatgttgggtttcagcaaaagccttttctgtgtctattgaaatgatcatatagtttttgtttttaattttgtttatgtggcaaattgcattgattgatttgtgtatgttgaaccaagcttgcattccagaaataaagcctactaaatacctatatcaagaggttatacaaatctcaaattaatgatctaacatcacacctagagggactagaaaaacaaaaacagtctaaccccaaaggtagcagaagaaaagaaataattaaaatcatagcagaagtgaacaagatagggaatcaaaaattcatacaaaagatcaacaaaatgaaagatgattgtctgaacggataaacaagataaatagactactagttagatcaacaaagaaaaacagagagaagatccaagtaagcccaatcagatattacaaaggtgacattataacaaatcccacagaaatacaaaagatcctcagagactattatgaacacctctatgcacagaaactagaaaatctagaggaaatgcataaattcctggaaacacacaatctcccaagattgaaccaggaagaaatgaaaaccctaaacagagtaatattgagttctgaattgaagcagtaataaaaaacctaccaatgaaaaaaagccctgggccaaatggatttgcagccaaattctaccagaagtacaaagaagagctgctaccatttctactgaaactattccaaaaaaaaaaattgaggagtagggactctccctaactcattctatgaaaccagcataattctgacaccagaatctggtgaagacacaacaaaaaaagaagactataggccaatatctctgatgaacatagatgcaaaaatccaagaaaatacaagcaaactgaatccagcagcacatcaaaaagttaattctccatgaccactctttaaaaatgatatttaatgtgcctcattttccttcctccccccccactgaaatttgcttctatttcatcattcctgttgcatctaacactgagcaagtatcttaggaaacaatacaattttgtaaaagatgttctgcagtagcctctatgtaaatatcgtttatccctctgtcttattaccaagataatggatgtgctttttagctctctctgttatatatatcctctactttatgtgtgtgtatatatatatatatatatctcctctgctctctctcctttagctctaggtttcaatattcattcccaatatagcaggcaaacttttactttgagaaacttaaaactctaatcagacatttcaattcctacatgccatctcaagcctaatttgggaactgtgggagcataataacgcattgtctatttcttcctttctacttttgtacaatagcttttgacttggagggagtttacttctacttgctgcacaattatcccaacatccagctcaatttcaaaggtccatttagctgctttggtggtacactttgacagcctattggccttgtagattttaatgcattttgcattatttatctcagttttccaagtatagtttttctgttgaatttctactcgttaaccaattttctggaaatgtttcccaattgatctgcattgcacctgtagcttattttttttttggttttggcaaaactcagctgaaaggtgtatgaagtacaatgtgatttcttagcacattgatggtactaagttggctctaaatgtgctgatgcatatagtacacttctgcaatgatgtctctctgggaaaccccatttaacttgagttacaataagcaaagataacagcaaagctctcagtactctttgagacaaaggtctcatacaattcattaaaattaagatgattctggctgcaagttatagaaacccagattccgattgattaaaataagaagggatgaatggtctcacttgacaggaagttcagatatgggatgggcttcaaggaatgctcatttagcaatgtcatcaagggtccaggtgtttttctcttcctctgctctgtaattcttagtatcattctatgtgtggtagaaagatggcttacagcagtcccaggcatcatatctatatccaggagacaaaggtaacctattttttcttatgaatatctcatatgagcaaggagatgtccctgtagtccaagatgacttcttattacgctttataggtcaaagtagtgtcacacgctggttctagagtaaaccatgagcaatattcctcttaaaatgatcaggccctccataaaagtgggatgagttctgtttttactgggacatatggatatctggacttgggaggatatctgatcaaaattggagttctaatagtacaataaaagtaaagaaatgaatgttggttgggaaacaatgtccaggttgtgtcatcatcattgaacagtggaaaaaaatgcagagggcagtgagagcccctgtggcccactggctgtgaccagcatgggtttctaaagcactggtgaaggataaaagaagaggacaataagaatgcctatattttggcccgaggcgaaaataatgaatagaattccttagtgggcagatactgtagtttggcccactcaacacccctttcatccctcttctatagagattggaaaggaaagtttttgatttcacagcctctcttgcagcttggcttaatcaaaagcagaatgctggccaatgagatttaggaaaaatttatcaggctgcatttgctgaataaatgtcaaatttgtatttggaagcacgatatctttcttgaaataaggaagataagaagtcacttattaaggacgttggagtaggaagtaagctgtgctctcagtggcatcactgagatgccatttgagtcttggactatatactctcaaaggtctggtcatgtgagaagacgtaaactatagcagtagctgaaagcaatgctatcaaatatagagtgctcaagttagttacataagtttactcatataatattccaattaacttagccttttaattgtttcccaaaggccaaatcagaaaaacttctcaaacagtatatatcacaaatatcttaactagtgcgaacccagaatccacctaatcacactcccagtgccttagcagagacaaccgtggctaattcttcaaggcgtcatttatatggataaatgttacatccacaactcatatctgaaccaaggcaggtttcataaatcagaagtctagtttgagcccccacgtcagccttattataacattcaacgtaacaaaggacggtgtgttataccttatgtaaactgacctttaaattggcctgaaaatattcacatgcatgaatggggctgtattacagcaatgacattgaaaattatattaaagacactttatttagcagcaaatttaatataacatttgaactgctaaaagtcaagtaggaagtagagagtactttcttcatttatttgatgaaaaaaaagcacagactgctttaaaaatataacttttgactacatacaaccagatgaaaaaagacgttaactagagggaaatttgtttcatacccataaatagaaactaacttaaaatgtaccatggtgggggggaaattagttgagaattacaaaatcctcaactgctttaataccacagcttcattccatttgcctctcaactattcctgctggggcttctgctatagtttattaacaagtatcagtgtttccattaccttagaaaaacaaaaccaacaatcatttttcaaaagacattcaaattgtcagtatgtaattattgctaatattaagaattcagtatgttaccacatacaacgcacataccaactatctactcattgagataaacttatatttccgaaatgaaaaaaaagccattataattaagactcaagaaaacttttccagtataaatatactcttaattaaagttgagataaagatatatctgtgagatagtttaccaaaatatttatgttaaacatcaggctctactatatttaagagtgggtttccatcaaaatacctcataattatctagttgcctgcatgtacaacagaaatacaagaactgaactggatgagtacaaaagggctttcaaatgtgtccactaatacagttaaaagaatataagctgctacatgtataaatacaatattatataagtatattatataaacattattttcattttatcttctaacagctttataatctaagtgttatataagtattttatatttatatgatatatacttataaatatatatcaacacttatataaatttatatatacttatataaatatagtataagctactacatgtataatatactgcatgtataaatataatataaaccatatacatggtatacagtttattctcctaagtaacaccaaccattaactttgtagtatatcatatgaaagagatgatatggttaggattcaataatatacagaggtatttgtcactaatagatgtagtcaaaaatcaaagacaataatgctaacattttttatattactgtttttagcagtggaatattttctttaagccacaggttacaaggcagtccaatgtagaacaaagataaaaacagctgcgggttgaagcagagctgactattcagccatggggagcttctcagaaacattagaatcctttatagggtctcaaagagacttgggacctaagtgttttctcctatgtcctaataattatacctattttagcccccctctggggacattttaagtgaccaagaattgttaagaggaaaatgggaaggattctgagctccaaactacatttcatgctggccctcccatcctcctaggacatctgattatttgtataaaggagatgtattagaagtccttggaattttctaattagaagttccagctctgattacttggagtttgagtaatttttcaagtaagtattagagtcaaggcttggacccagatatgactataaaactcatacttttaactaatttttatgtagttttccactgatacactagtggcattctcagccaactaattaagttttctctgctgaatgttttgaattctttgtcttgggtaatctctccctttaaaatgtaaggttgaacctgtagagctccatattgtcacttaattatgacaacatagatgagaaaagtacaaagctttgatgtgtctttggtggagattatatgacatattgaagttttgtgagatggctcagaaagttcagtaatagctgacgttgaaaagaatcaactcttatttatgcaggtgaataataatgtgactaatctggtattgcccattagtaattgatcatttctctctgacttgggaactatcgcctgtaatcccagcattttgggaggccgaggcaggcggatcacgaggtcaggagattgagactaccctggctaacatggtgaaaccccgtctctactaaaaaatacaaaaaattagccgggtgtggtggtgggcacctgtagtcccagctactcgggaggctgaggcaggagaatggcgtgaccccaggaggtggagcttgcagtgagccaagatcacaccactgccctccagcctgggtgacagagcgagactctgtctcaaaaataaaaaataaaataaaaataaaataaaacaacaacaacaaaaaggaaacagattttgaagttacatccttactgaaaactttgttttattttcttcaggtcacttacaagaaaccacttactcataatgaatttcaattatggcatgacctatgtcattatcctgggatttaagggtctagatttaggctgtttttattcacatggctagaactgtatctatttagaaaattaatttaactttaatgtatcaagactattttatatagcattgatgattttctacttcaaaagggaaagctttaagatccaaagacattgatttccaaactgggacaggcataatcctgaaccttaatcattttattcttagtgcttcagctttctattgaattttagtgaaagataacatggctctggacaaactttcgtctcttggagagagcaagttgacacagatctgaagtattttgtacatttgttgaatatgccacccagtcttccacaatgtgggagtgcaacatttaagtatcaaaatgaagcgaagttatcttggtgaccttctgacttctagcttataaaccattcatatggaagccagaaaatacagtcaaagatttaattttccaattgatcttgtatttagcatcatttagaataacaatctggatacttaatctagttttttttttaaatttcaatcagtttgtttgaaatcatgtaaacaaacaaagcctatattgtgaagaaaatacatttaattattaccgcctctaaataaatctagtttaaaacacatgtggtgaatatttgcagaaaagtgcatttaacaagtatgtggcattgtaatattaaagaactaatggaactaacggtgaagatttactaggcataaattatagaagcagataatgaggttattaaaataatatgtatctgtaatttttatataaaagactttaaacatttttttgaacttcttttttgtgtgtttacagatatacactttttttttttgcatgttttggtctacataggcagcatttagatatgctgaaggtagtctagtaaagtcttctgcctgagtaggatattttattaatttaaattacagtataatgttttaaataagaatgtatgtttttgtaagtgagatgggccactcactcatggaatcgacatatatttgttcagtaccaacaggatgctgacatggtgccagacagtgagaaggcaaggattgggttttattcaacgtggcagcctctatagtgtttaaaacattgctttaaaagctgttggtattctgtaaatacttgttgaaataatgaaaaaagaaaggtcctcgactttggagaattaaatatgcaggtaataacaatgtgatactacagtagaaggatggttcctatatttatatagctcagaagaacttatagtggaaggaatggaaagtttccacagaggagaaagatgaggaatttgatatgataataggaaatggtgtggccaaaggcacagcttcagaaaagaataaagtagccatatgtgaagaataaagtgtaaatcaatttaattggacatagtctccaatgtaaaggaaataaacttgggaagattgtgcatgttcttgaatgtggactagggaagtttgatctttgtttgggaggcactggaggcttttgggcatatgcatgataagattaaaggtccttcctgaagattaatctagccgcagtgtgtaagatgggttgtcacaatgggagataaaaatggggaaatccactatgagatgaatttaattggtcacatggaaggtaataaataatagcctgagcagccagatagtgttcctgtatttgagactgacctcgtttttccaagatgcttcaaactgtgagatatttccagaagtctcaagtgtgaaataatcagtgttactctaaaataacattatgcaaagctacctcacttttctggaaatcaggcatccaaaagtgttaaaacactggaacacagatacaaatctgaacttcttgttgagaagactagactattcactttgcggaaactgaaagcatgtatatcttgtttttgtttcattgccagcaccagtgccttgaagagtgaaaactgaagttaggcaattcatgtataagactttctataaaataattagtttctaaagggtcaattcttagaagtacattttagctttctgaaagacatatttccagggtagaactaattcttaaataatgatgaatattgaggtgtcataatttcatatttatggaaacattgtctctccttgtgtataacttaacatgtaatttgagatttaaaaatgaaggaatttgatttcatttgctgttatttaagctccctatgtctgtttaaattttgctctgaagaacagctgctctaaagtacagccaatatttcttcctttgggatagctagttccactgaaaattttgatatcgtcaaaatgtgctgtatgtgtgtctatgtgtagccaatctccctttctcacatccccggatacccatgtccttatgcctgccactggttctcaaactttaaagtacataaatatcaccagaaacaattatttaaactatatgttcctagccctacagtccctggagattcagattccataggcatggggaagcctgagactgttttgataagctccactaggcaattctaatgcatgacttccagagatcataccttaagtggctgtaacttaagctctctctgccttacttgcatcagatgtcatgttcctgactttaagtagcagttattatttaatttaattaatgaataaagtcaaacaatgtggatgtctagaaaatctcctctactgaaagagcctgaaatagggtgtgttgccttactagagtctgatcggtagtagcgtcatcccacattgagagctgcagtttcatgctctcaatcctgagatgttttacagcagggtaaatgatctaatttatagtatgtgctgagatatttctaaagaaagcttgtgtccgagggtagaatgttttatgtgtttaattacacttgagttccaatccaattcgaagccatgtctacaaaggctggcgtttagtcagctaaacatttgaaagcttctttgttcctaagggggaaagcacaagactaatttttctaacaagtaattgcaggtgcaagttatgtttgcaatcttaaaaaaggaagtgtctcagtgaaggggaaattaaatgagagggttaaacgcatgacctagaaaggatgtttgaatcacttgtgtttttccatcttgtacaaaaatccatctttcctatgagatagggctaatttaccagttgtgttccttttaatatgaggaagttgggggctggagggagaaaaaggtaggaagaaattagccaaacacaatcaccagaacatgttttttttttttttaagccaggagggagaaggtgaagatctacacaataaaggagtaaataaaaacacttgtaggggaaaaaaaataatggagtgttttctcatccactaaaacagtaaaattccatctttaggtttttctttgttcagttctctttggaaggaactttctcagctgaaattttatttgctgtttttgtgtcatttttgtcatcagaaaatatttccaagttaagcaatcttacaaagaagtatctcaggactatcaacattagtgagccgggtaccctgaagtgaggtactctttcctcacttcatagtgtggccaccatagccattcttgcctttcttcagtttgctgtctatcggtgtccatcagaaataccttgttggcaaaaatgtcttccctgcccatcttatttggtctattaatgatttcataaacttcaatatgaatctttatgagacctcctactccaaactggaagctctaatcccttttgcctctcctcctttggcaaccagttcctctctttgatgtccctagtttcctttctctagatttcttccagttccatcatgctttccagatatatctccaccaaaaccacctccaaaaagctaaattcttattggctgccgcagctcaacagcggatgctctggtgaaataagcataacaacaatagttgctttgtatgtagcagggatcagcacagttttcctgtaaagaactggataataagtagtttaggctttgtggaccatgtggttttgatcacaactattcaatggtaccagacaatacttaagcaaatatatgtgtaacttattcaaataaaacttttctttgtagaccttagaatcatttcatataattttcacatgccataaactattatccttcttaagattttaaaaatcattttaaaatctaaaaataatttttgtctcacaagctgtacagaaacaaaacaggccagatttggactgctgaatgtagttcgccgactcgggttgagagttttttgttttcacggtgtccctacctatcatctcatctaattctcccccacagtcttgtgagaaagttaataccgctgccattttataaatgtggaagttgagacttggaaaatgtgactgtcttgcccaaagaaagagaactaataacctgtgtttctggaacctaatcctacattgtcatgcgtccaatcctgtgttcttacctccataacacacttcatgctagtgttatatctatgcctgactgacacagttcaaatctccaaaccaaccaaattccattgaggtggccatttctataaaagctgtcctttggaaaaaaaatttatccaaaacatcaggactcaagagtgtaacagaaggagggcttgttaaaccatcagctgctggacataaccccaagaatttctaattcagtggttttggggtgggggccaaaaatttgcttttcattttttaaagttagataaaattcacacaccataaagtttactatttaaagtgttcaattatttatagagttgtgcaagcatcatccattattatctaattccagaacatttgtatcgccacacaaggaaaccctgtacctatttgtggtcacttcctattctcccctccccacctccagcccctggcaaccactgattgactttttatgtctatagatttgactaccctgaacacttcatagaaaaggtatcgtacatgtggttttttgtgtctagcttccttcacttagcataaggttttcaagattattctcattttagtatgcatcagtacctcattcctttttatggatgactaatgttccattgtatggatatactacattttgtttattcattcattaattgatgaatatttgtgttatttcagtggtttggtttttgtgaataatgtctccatgaacatgttttcaattcctttggctatctacctaggagtgaagttgctgagtcatacggtatctctatgttcaactttttgaggaactgccaaactgttttccaaaaccagctgcattatcttacattcccatcaacactgtatgagttccaatttttccacattctcgtcaacacttgttattgtctgtctttttgactactgtcattctagtgggtatggaatagcaactcactgtggttttgattcgcatgtccttaatgactactgatgttgaacgtagttttgcgggttggttgagaatctgtatttgtaacaagctcccaggagatgctgatgctacttgttcctggaccacactttgagaaccactgatctaaaaattaccacttactcctagcaaatagaatatgctgtgtataattgtttttgtaatcatagtcattatggagctgtactttagacattgaatataaaggaagaacttattccacaagatttatcgagaacctgaaaagtgcaaggcactgttataggcatcaggaaataaattttttaacaacagatacaaagtgagagtttacattcaggtgcgtgaagatagacaatagatgataagtgagcacctaacctttcaagtggtgatacatgctatgaacaaaaatgagagagggtgtggctctagagaggggacagtggggaaaggtaaggtgaccagagaaggcctctctgatgaggtgttgtttgatcagggatttggaggcagtgagaaagcaagacctgcagatttaatgcacaagaaggtaaaagcacagtctttgggaccaggccaagctcaatacttagggctggccctccactcgtcctttgacctaaaacaaattacttaaccactctgtgtctcagattcctaatctattcaatgggaataatagtatttccctcataggattgttatgaagattaaatgaggtagtatatgtaaagcatttagagagatgtgtggcacatagtgttacataagacgcggatatatatgaggctaagaaagctaaaactttagtccctctcacttacatgggcctcttctgtggccttctattaaatattgtatacaaagtaccatattcttttctagaaagagagcctccaagttgtctaagctgtaggccctacatagcctagacctgtacctgatattaactgctatttattcatctctgggataaatgattccagacaaagggagcaggagtgtaaaggcccaaaggctgggagaacatcaggaagacattgtaactggacaaaagtcagggaggcacaaagggagaggataaggtgagaccaaaagggacagtacttgggggatgggaatcgtaggcatagagcaggtcttggtaaaatactttgtaattgtgaattagattaggagacactggagagttctgagaagagagtcatgaactgctttgcattttaataggatcattttggctgacctttagagactagatgattaagaaggcaaaattagaaggtggaaaactcatggagaagcagtaatctacagatgagataatggtaccaaggactaaggtagagatggtacgatattgatagtttatgtatatattttgataatggaacagacagaacttgttgatgaatcatatgtgggattgagagaactgttaaggatgattgaaagatttggtgtctgaggaactgacaagtgaggatcaggactggatgtacatgtgcagtggaaattaagagtttgatgttgaacatgttagttttgagatgcctattttatctgtaagattctattttatttctatgatatatagccctgatggacattttttggaatctctacagttagactattttatagttatatgcccatcataaaattctatgcagaatgtaccatatggacttttggtgctataacacagatgacttttatggaaaatcagacaaggtaggtcagagaatttctttatggccagctccaagacaggaaggtggggagagattagagtcctgccggggggaaaaaaagaggaggtgaaaagagggtacgagaaggtcagaaggagagattttttctgaagtctgcttctgaggcctgcagcaccccaacattataaccaaagatggtcttttatctttattgctctgaagcacttccaaagctgcttcaggaaccaagggcaaatggccaaatattttaacaaaaggtatgcttattgttttaaacacttaggaaatgacaagagttatgagccaggaaccatggacaaaaacctacacacacacacacacacacacacacacacacacacacacacacacacacacacacaatgttattacaccctccatggaactatgatggttctgtcctttttatgttacatgacatggaaggtttccatttaaactgtattatctaactagtagataatgctagcaatattagtaaaattattgtgttctctgactgtaaggacttgaggacatgtttcctcatcttcataaactactgcctgcccctatgcttgactatggtaggtgctaaagatgttacatgaatgaaagttacaataatctgtacaagaatgaggtctttcttttgggtattttatttttgtttagaagggatcttatactcattaggcactgactatccataacagcttaatactggacagtgtagtcaaaacacatgactacaagttccaagtccaccaatttttggctttattaatttgacaagtcactaattatctgagcattacttataaaatggaattagtggtattttttctattttacagtgttatacttaggattggataagataatatacagaaaaacatgatctacaaagtaccaaaaattatattaatattttgatctaatctagaaaaattttgattgatagtgtctactgcttaatctgagaataacataccttgctatagtttccaaacacttttcatagaggatgtaaaatggattttcaaaaattacatttcctcaatataaattacaatggtttgatcacttaacatcaactctcattaaaatatgattctctttgtaggctgaattagctctcttttgagattcatatgtagaaaataaccaagtataaaaaggcttgctgcaaatgtcctctgatatttgattttgagtttgacatttcaattcaattattctgaatttaaggtgtcttaaatcattgaatacattttgcggataatatgtccctgtacccttgcatatttttcataacctcttatacattagccaaaattagaaaaagaaataatcctcttccctgccttaagctaaactagaatagttggcacatttaaacaacaaatgatgagaaaaaaatgacattgataaaagtttcactgagtcatcatgaatctcattgggtgagcaattctattgagggagcatatatgaattttcatatactttaacactttaattgtgctaatattttaagtaatatttgttctttaaatatattttcttatttttctgtcatttaccaagtatagattcatcatttaccaattctgactcttttttttttttttttgagacaagagtttcattcttgttgcccaggctggagtgcaatggggcaatctcagctcactgcaacctccgcctcctgggttcaagcgattctcctgcctcagcctcccaagtagctgggattacaggcacccgccaccacgcctggctgatttttttgtatttgttagtacagacggggtttcaccatgttggccagccttgtctcgaactcctggcctcaagtgatccacccatctcggcctcccaaagtgctgggattataggtgtgagccaccgtgcccggcctctcagactctttaaaaaagatagctgaatgggactgaaccaaccagtgcagatccccaagggcaaaatttgggagtaccttgtgtccatgtctctagttatatggggatagagagacaaaattgtgtttaaaggagtttcaggcctcaaggctagaaaaattggcttatccaaataggttctcaaagcaacatgaaatgagatttaggagatgcgttttggaaatggccctaagagctaggaaagaatggagtaaagtataatggttccaaatttgaatttaaaaggaaaattagagacaatgtctctagagactagggactctgtcttgttcacagctgtattctctgtgaatagtgcttagaacataaatatttcttggctggcaaaacaccgtttaccaattgtgtttattacatgcttctgctaaggtattgtgtgagcaaaccagacacaatgaaagggctcaggaaagaaagaacaagatcctggtatcaaaaacaggtatataaagtgtggctcttaccctccagtaaaaggcaattaagtccccccatggaactcagtttcaacaaatcactactcatattgtgtgggagagaaggatctcagaggatgcttataaagtgacctgaagatgagacaggaatggaatcccaggcagaagcaaagcaaaagtatgtgcaaagtcttggagctgtataaaaggatggtttgtttggaaaatctctcgcagtttaatatgaggatcatgagaaatgacactggggaaatagacatgaatcagactataagggttttcgttgttgtgctaagaaatttgggcttggttaagactaagcttcaaatagttaattctaggatattgacatgaaactatagcccagatatgttaatcatgttacaggaaagtttagcttgttagcaaaagtataatactgacctaaaagagcatacttaagtcctgaaagtggagagccttgtctaaggaggagagaaacaaatatatatagtcagaagcagtgataaaacagaaacttttcccctaccaccccaacagtatttagttaaaatatattttatatcagcctctagggccattatgtcccaatatgcatcccctctagttttattatataagtttattaataacctcttatgtatttatgattgtagttaatatacaaagagaactaaatttatggtagttcagttttaggtattgcttatatgattttttccataatgctgtcaacccgtgggacacctgatgacattctttttcaagaaccaacatcacaactaagtttgtatgtgaccttaaagtagcagaaggagctggtcatgagatgaaaagaaatgctattctacttctattagattattctcaaggactgataaatactttggattctaggtatccttggtgcaaatgatttaatgaacatgtgccatgaagaaaaataagattatagagaatgaaattaaatccgtgctctacctgacttaaaagtgtgcatattatttctctcttccaaaatatctagcatccttatataaagaaagaagtccctacataatcattcctttcccaaccatcacattcaaattatcaaatataaactctgttttcagtttggagaaagaagatatagttgctggcaaaatttgggggtgtgagtcgggaattagaggcagaaaaggcaagggatgtaacagaaaagctttatgaatatatctttctgtgccaaaggaaatggaacacatcttgcatgaaacaaaatgtgacttgttaggcagcctaagatcttatcaaaggagtggaaaatatcacccactgctgactggctagtaaaagggaattgtgctcaaatgggtcaagactcacttctcaatgtccacaagctttttttcctccttatttcctctgtaaatgctgtttttttgtttttgtttttttttttttttggcatgcaaagggacacacacacactgaacacactgacacacacaatgttatgcagagagtttcctcccagatctattcatggtttaaagccccccacctccctttacctgtaataaatatctgttggctttgatgttcactgtcagggataaaacaaattcacaaatatttggtacacgctgctcctgtatgtgacattgaacaaaatgttgatcattaataaatggtgggggaaaaactcaaagactaataaatgtcattgtttctgatgaagtagaacacaagaaggtaaatacccacaactacccccctgctaaggtacaaatatcagtaaaaaatgtgtatatttgaagtatttggtctattacaattcttcagatataaaacaagcactataagcattatggtggtgttgattttaaaattccaacttcacaaattcttccagaagtaccttatgaataaaataatgtaatattcagatgacacatatatacacatatgcacacatgcacatgcatgtatgtagtaggtatcaatagatgatagatgggtagatagatattcttctctctaccttgctgcattcaagtggctgtcatataatataaatcgtatttagtatgtatttttttttaacttggggggttctggatattttgacccacattcatatttttaaccacggtgttgaaaattctctaagtgatcttactgttccacaccttattacattaatcccctataaggcactttcccaaggagtccctgaacacttctgggagaattataggcagcccatgctactctgagcacatttaaaacatagaaacttatttacatgggcctaaatctacctctagaacacctgggtttattctacctagggctcacttcagaaatggtatgtttttcaaaaatgacaaatcatgaagtctccagtatgatttatatttcaaatccatctcttgagaaaattctggttaatagtgactgactagagtgttaggaacaattccaaggtgttttcaatctcatcaggaaaaagagctgctgtgatccattagtgatgcctgctatgggcagggtgtaggactagccaagttttgagtctatttcttctttcccataaaactcccttaaacatgtgcaaataggatccatgtttcatctaaggaatgtattctacccaaatctgaactcttttcagctacctcacaacacatgggctggcattctctgtagcctttggcatgatgtagcttgtcctatgaatatccttgtagccatcgcctccaccataaagcacagagctaatctaatctatgtttgcagtaattccatagaaaaatctttatttcaggatcacaagtgaagcttgaatacttcttaaaagttcctctgagctcatatgtatgtgcaattaagtgtactgaaagcaaaacgttatcttgtcatttgactgctaagagagcttgccataaacatcaaaaacagcttaacaatgcattcttattttttattctgcttttaaagggcattgctaaaagtcaactccatggtctggttctaccttgaagattttgtatctttctatgtctctgtggacatagttaaggatataccgatgactctagtagtgagtgcaacagcacagttgacacacacacaaaaactgcttacatttttaaaatggaaatccagtcatagaaatatcacagcacaacctctcaacgctaccccttgccaagaggctgtgaaagaaaaaggattttttttttttttttttttttggaattttgggtgatgctcttttaagagctagtgggacaaagtggaatatgttaccacttttggttctacttgagaccaaattccatgtgccctcatataatgtacttccaggatagccctgcttcaataaatagaacatcaaatattatactttgaattacaaatacatcaatgtaaaatgatttcaattttgaatatcctccattcatgctacatgactggttaagcaaaactgtgctgacatcatgacagacaattccactcacattttagttttgaatttctggtatatttatgattctagcttttcattttatatgctgggttatcttgtatcaacaatgtatataaaactgttcatgtttcctattatgacagctgcaccaagtccatgtctcagagctgtatatcaaagtggcaaacataataacacaacacagatctgttttgacactaatatggatttcatgcttatttcacatccccttggccaaacattcaaaaacattgtagttcccagtaaataacattccagaaacaaaatccagatgctgtgtctattatttcaagcacacattatcagatacaagaatgcacaatgcttttctacaatttacttttcattttgtatcctgtttttagtgctaaagcacttcattccccaaattctaaatattactgaaggtgaaataagagcctttagagggttctcttactttaaaaaaaaactgacatagaaaattacatgtatttatcatgtacaacatgatgttttgaagtatatatacaatgtagcatggttaaatcttgttgaaccattcttacatccctgggatgaatcccacttgatcatggtgagtgatcttttaattgtgctgttgaatttggtttgctagtattttgttgttgacgatttttgcacctatgtttcttgaagataattgcgtgtagttttcttttaatgtgtgttttgtctggttttgatatcaggataatggtggcatcatagaatgaacttggaagtgttccatcctcttacattttttggtatagcttgagacaaattagtattaattattctctaaatgtttggtagaattcaacagtgaacccatcaagtcctgggcttttctctgacgggagacattttactactgattcaatttcctttcttattattggtcagtttaggttttctctttcttcataattcaatcttggttatctgggaatttatccagttcttctaggctatccaacgctttggtgtataattatttataatagtctcttataatacgttgtatttctgtggtatcaattgtaatgtctccttttatctttgattttatttgagtcttctttttttttttttttttttttagttagttagtctaggtaaagggttgttgattttgcttctcttatcaaaatagccagtcttcatttcatggatcttttgtattgtattctagtctttatttatttctgctctgatctttatcattcccttccttaattttgggttgagttttttctttcttttcttctggttccttgaggtccattgttaggttgttgttctttttcaatgtcagcatttattgctaaaaacttttataactgcttttgctgtagcccatagattttggtatgttgtgttttcatttttctttttttttttttttttttctgagacggagtctcactttgtcgccaggctggagtgcagtggcatgatcttggctcaccacaacctccatctcccgggttcaagccattctcctgccccagcctcccgagtagctgggattacaggtgtgcgccaccacacccagctaatttttgtatttttagtagagactaggtttcaccatgttggccagtatggtctcgatctcctgaccttgtcatccgcccgccttggcctcccaaagtgctgggattacaggcatgagccaccgtgcctggcccgtgtttccattttaatttgtctcaagacatttttaaatttttcttttaatgtcttcattgatccatttgttatttgggagcatatggtttgatttccatgtatttttcaggtttccaaagttcctcctgttatggatttctagttttctactattgtggtcataaacgatacttcattctaatacttttaaagcaaaaatataatgattttgtcagcacattgatagatttttttttctagctttctatgtgctgggcacctatttctgcactattgtttaagttttgcaatgaccctattaggtagattatattattactccccgtcaccagtgagaaaaattgaagctcatagaggttaaataatgtggccaagattcaaaatttgtaagagtatagtcagaatttgaacccaggaagtcaggttttagtgcctattgttatcaacatatcatgctgccctgtacataaaaattataatgaaggtgggccaggtgcggtggctcatgcctgtaatcccagcactttgggaggccgaggcaggcagatcacgaggtcaggagatggagaccatcctggctaacacggtgaaaccccatctctactaaaaatacaaaaacaaaattagccaggcgtggtggcgggcacctgtagtcccagctactcaggaggctgaggtggaagaatcgcgtgaacccgggatggggagcttgcattgagccgagttcgcgccactgcactccagcctcagcgatagagactgcatctcaaaaaaaaaaaaaaatatatatatatatatatatatatatatacacacacacacacacacacatatatagacggagagaaggtgaagagttgagtaaattactaaagtttcttaagcccctagtatgtatcaggaattatgacaggcaattaacatcaataatcttacttagtcttcacaacagctttatttgttagaaaccaacattaccccattttgtaaatacaactcataaggttaagcaaacaagcaataaaattaggaaagtaagaagacattagttacacccctggtaagggaaaaagctggatataaactcctatctacttgcatctgaactagactagactttctgtatttatatcatctctattctaaaacagaacctaaccttaataaagtggttgactaaattgacttacctattttctcacttccatgatatttatgtattgaaagtacaagaagctaaaggtctttggatgaaacagaacatagcactgtgtttacaacagctttaagccacattcaaaacactttagcgtcatctcgtgttatttatttatttatattatttttgcaaattgagtggcattgttagcactttgaaaggcagaaaatatagctgcatattatatcataagaatagacaattataaaaagagtgtaagatgaagtacctttacatgagctgtaattgcagctggtaattaaactgaagtgtttcattttctcagtcagctcatcagtgacaccagaaaataaacaatttgaaagtgaaatccttaggggccaacaatagtaattaattgcattttccagggaagaagcgttcctaaagtctgtttggggtgacctcttgagtaatatacacagtgatttacactgtgagcagaagtgtggggttcagaaccaaatctgatttaacttgaatattcatgaagtctccagtatgattcatacttccatttccattgtcaagtttattgtctcctaggttaacaatgaaagcaaatttatattctgaataattcacataacacaatgagatgatcagcatggaaaaactttaccaggccagtaacacataaagtgaggctgctattaatcccttccaacttggaatctcctcaagtatcaagagcattgttttagagatacttgggagctgaaaagaaaatatttatgtgtgtaaatttggatccatatctcataagcctattggattaaaatcataacattcaggcagtctagtttgccactgttcattttcacagagaagagctttgtttgagatttgtgcacatctttttagctattctgatcacagggaacaaactgccatgacttatactctaatttctcttcttgtttttacttatgatatgaacatggcccttggactcagataggcataggtatagaatccagccccacttcttactaacaccttgtgttagttagctcataccagataacaaagaaccttaaaacttgctttaaaacactaaccctttatttagattatcattctacaggaagacaatttggggtgggctcagccaggtggttcttctggtttaggccaggctcatttggtctcagctggggctcaattatacacctgcaggtgactgccagattgggtaggtaggctgatctatggaggcttcagctggcatggcttgcctctgcttcctgtatcttccattttccagcattgcagcctgagcttttccaaatgatggtgtggcagtgatcagtaagagaaggtaaatccaaatatgcaagtctctgctattgttccattggcaaaatggccaagcccagagacagactgaagggtactgtcaagaaataatagtgatactaaaacccatgaaaaaatcgggggccattattacaacaatcaactacatatatgtataagaaactatgagccagtttcttaatccctcaggcccagttgctgctcatctcatagagttgttgtggagattaaaattaactcatatatgtaaaccaatgggtcaatcacctggcacattggagacacataataaatgttggccctcttttctctgacagatatttatgcactcccatttattggttatacaaagcaaatattctaatatgagaacaacctgttaatgatatgtcatcccactgacctctatagttattcagttatccggctagtgaggttagtgtctccttccttaacaatttcatattaatctgctgaagctatgcattaacctggaggatcaacttctgcacagaagtatattcctaaaattacgtattatgcatgtatgtttgcataatatacttccataaaagctgaaacttggctgggcacagtggctcacacctgtaattctagcactttgggaggctcacgcctgtaattccagcactttgggagaggatcacttgaggccaggggttcaagaccaacctggccaacacagggagaatttgtctctacaaaaatattttttttaaaaattagccaaacatggcggtgctgcctgtagttccacctactcagggggctgaggcaggaggatcacttgagcccagaagttcaaggttgcagtgagttgtgatcacgccgcaccactgcactctaacctgggtggcagagtgagcctctgtctcagaaacaaaacaaacaaatgaaaacaaaacaaaaactaaacttttattgagccattgatttagctatttttaaaacttccttacaatgtacaatcagaggcaaatctgtgttaataaagcctatatgttgcactggggggtcgcaggctagaagaggtcataacggtttaaaatttccaaagtgtcgattatggccattgaagaggctgagtcatcttaaagtcggcttgacattacaatcaaataatcagaaaagcccgtaaattgaattctactttggcctgattgtcttaaaagctggctctgatattaacggacggatgttcacatctttaatttggatcagggccactgacacaatagagtagatgagcctccataattttcaagtgaacacatgcttttccccattgatctgtggataatagatcattctattggctcccctgcagcatttaaatacagtctgcctaattcaaaattggtcagtaaatgtaatactaaactgccttgacctgaagacgatagaaatgaaaacccattttaaaaaatcccaggaaatcactgtacttgtcatatctactgcatgaaataaaaaatatatttcaccaaaatacacttctacctctattattttatagattattaaaacagtgcagaacatacaaggattaatataatgtgcaaagagatcttatatatatggccagggtctttcatgactgacagaacctctctgatgtttgctgactttttagccaaaaagaaagagaacatttggttaacacaggctcagagatagatagaattataataatacctgacagccctttgatacttggtagttttatggtgcagggaagggaaagattttgaagacttcattgggatcaaatgttaataaggaacaaggtgaaacatgcctgtaaaaataatattgattatatcacaatattctctatcattccaatgaataatccaataaccaatgaattcctaatagcaacattaatagggtgattaccgttttgtgaacatttattaaagaagaagaattttaaaataaagctatccatgaatttgctgttatgtcttaaaatactacataaacaccacaaggtgtctgaggtgtgccctatattaattttatgtttgtttggtaactccagtcatggtctctatagccaaagtcattcttcaaatatacagttatttgaactactcaattgaagggaaaatctggggtgacagataacaatgctttacagagtacatgtatatttaatcatagaagctcaagtatataggaaaataaaatgttagttacaaaatgtttatttgataattacacatcatgacaaagaatattataggaagtaaattcaaaatttaaatatattcatacagccaagatatgatccatatttattatgttgtcatgttttgctttataatctatcgtctgtttatgtgctagtttgtttaagtaaaaatattatcttcattttaaaaaagctgagcatgtaaaaaggccaaaattcggggttttggctatacttgaatagactgcatttgattttctttttgcaagctatacccttgatgacagttaaactgaacgagcattcattgagcaactatttagtttatagtcactatactagaatatagtgatacaaagatgataaaccatgatccctgtcctcagaaaagatggacgtatacatagcaactgtaatacggtatgtaagaactatacaagcagtatgaattgggttactcagaacaatcgagtgagggattcttctggcgcaggaggaatggaagtggcttcacatagaaggagctgagaatgcagaatgatgtaacagggctttccaaggttacccccaggttcagtgattcactaagaggactaacaggactcagcagatagcatactatggctataatttattacagcaaaaggatacggaacaagatcaacaaagggagaaggtatgtgtgagatgactaccagaggaaaccaggcccacgcttttaagagtcctttcccaggggagtcacacagaatgcacttaatgccttcagcaggaagttgtgacaacatgtgtgaaatgttttctagtaaggaaattcattacagactcagtgcccagagattttactgggggttgttcatgtaaacgccctaaaccatactgtctgcacaaacagtttaggcatagtaaacccatttgttatcagaaaatgctgggaacctttctgatatctaagttttcagaagcataaatattatggcaatgtactcaaaagaactgggcctccattttaggattccagctgaatgctaaccttgcaagcagtcctttctaaggacagcagcctcaggcctgttagattaactcttttctgcacaggtgaatagatctgtccagatatagttggtggagaaatgaattcaggctgtggaaatttcaagaaagggctcggatgtgtggaaaaccgttcaaaacatttcattcagtgagatgtttaatcttaagtgtttctgggactatttggagtgtcaagttcacactcctgaggcctgacatgatttcaggttccctgaacaggccccatcttgtaaagaggattaaaatggcaattgtgttaattcgaaacatttggcctctgttgtgtacttcattcatgtgaagatgtgattctaatttagaatatccagatatttgttttagttcagtgttttgttgtcacagtatataaagtttctgaccataacacctttgaagttgtatagttcaaaggtccctgttacagtgcaacggagacttcagtttcctggaggagagtatgtactttcaaagacgacatttcagagcatagtacattcatacaagtgatcgacacaaaatgtcatttttgtcactagtacttgtggcattaactataagctgtggagttgtgcttttgttttccccccagccagattgacatgcttcagtgcctttcagatcctacacttgtacaacccaaaacagaactatccctgtatttcactaggagaaaaatgaaaactgttaagcttataaatatttcactacagattgctgtatattcgctgctcactgttgaattcagctgctatgaaatgctaataactctctactgagggcttgagaacaacctctatttcgataaatattatggcgtgtactgaattatgagttccgtacattcactgatagacaagatggaatgttagccttattaatgcaactggtgcaatgtactcaaaagaactgggcctccattttagagatttagctggtaaggtacatgaccactgtaacatgcatgggccttagtagtataaaatagatatgaaatattgtacaaataatatctctgctgtggtttggaaatctattggaaaatatatacatttgtcttatcttctgatttgttaattactcttaggacattatgagtgaattttagaactaaaaagtcagtataaaaacagatggttacattttgtgattattagcttcctgtgactgctataagaaattgccacagacttagaggcttaaaacaacacaatttttttatcttatagttgtggaagtcagtccaaaatcagttttacagggctaaaatcaaggcgtaggcagggcttggtcttttctggggactctagaaggtaatttgtttccttgtctttttcagcttctagaggctgcctgtattccttgacacatgactgtttactccatcttcaaagccagcagcatagcaattcaattctctctctttctcacttctctctctctcttcaattctctctctctctctctctctgtgtgtctctctctctcatctctacttccatcatcacatctccttccctgactcggaccattctgcctgcctccatcttataaagatccttatgactggacccacccagatattccaggcttgtctctccatttcaagatccttaatcacatctgcaaagtctcttttgttttgtcaggtaacatagttacaggttccagagattgagattaggacgtggacatgttttggggatcattattttgtctcctacaaccccaataactctattttgtgttataaatactgtgaattattcagcaccaatacatggtattcaatcagattttgaccatgtctgtctatccatccattcagtaaatatgtattgagaacctaatatatgtcaggcaatgttctagatgctgaggtgcagtaattaacaaaggagacaaagtctttgttctcatggaggttgcattctagaagggaacacatataaattaatattggatatgtcctgaatatttggtctataacaaaaaataaggcaggattagatggcatactgtgttagtatatgtatgatgaggggtgccattttatcactaagtatggtcaatgatgtcctctctgaagaagcaatgtgatatgttgaatagtggcccccaaaatataggtccaagtcttaacccccggtacctgtaaatgtgatcttatatggaaatacagtcgaccttcagtatccacaggttttgaatccatggatttagccaactgtggatcaaaaatattctaagaaaaaacaaaacaataaaaacatacaaataaaaacaatgcaatataacaactatttacatagtatttacattgtaataggtattataaataatctagagatgatttaaagtatacaggagaatgtgcataggttatgtgcaaactacataattttatatcggggacttgagcatccttggattttgatatccacagcgagtccaaaaccaatccttcttggatacaaggaacaactgtattgtaagatctttgcagatgtaattcagttaagaatcttgagatgagattattctggatttgggtggagctaaattgaattataagtgtccttataagagacagaacaggagaagccacagagacacacaaagaggaaagccatgtggtgcatttacatgccaacaaatgccaaggattgtgggcaaccaccagaagctaggagagagacatggaaagggttctttctctgagcctccagaagtaacgaatcctatagacagcttgatttcagagttctggcctccagaactgtgacagaatacatttctgttgttttaagccacctagtatgtgtaatttgttgcagcagcgcaaggatactaatacaggcaatgtttgagcaaatacctatttgaaataagaaaacaagccatacagatactgaaaggaaaagcagtataggcagaagacacaataagtgggagactctctgtggtattcaaataacaacaatgggagacagtgtgactagaacccagaaagccagggggaagagtgtttgaagatgattccagaactatagtgctaaccaggtcgggtagggagggttttgtgggccatggtaaggactttgaatttaattctgtttattatatataagctagaataattatgatttactgaaatgtagtgtttctgggcatgacagttttaactgccagaagcaaataatcgtgacacaactgaatattaacacaaaacatgaaggttgaattctggtgagctccattgtgttcccagtaacttaactatcacatttttaataatgttggtcctggcctgaataacaaaatatattggttcctccacccccaacacgcaactactgtattaggccattatcacattgctataaagaaatacctgagagtgggtagtgaaaagacgtttaattggcccacagttctgcaggctgtataggaagcatggtggcatctactcggcttctggggaggcctcaggaaacttacaatcatgcagaaaggcaaaaggtgagcaggcgcgtaacttggcagaaacagcagcaagagagcaaggggggaggtgccacacttttaaacaaccagatcttttgagaactcacttagtatcatgaggacagcaccaagggcatggtgctataccgttcatgagaaacccacccccatgaaccaatcacctcccaccagtccccacttccagcactggggattacatttcacgtgagatttgggcagggacgcacatccaaactaatcaactacttatttctttttgtgtctgcatatataaaatctgttaggtttggctttccgtgcaacactgtttcatgtgttattagtatcgctgttacactctgatactcccacaagataaccctacccatcaatgagaattgaggccagtactgcagaatgaggatcctacacaaaatacagaaaccttacttgttcaccaaaggtgtgaaccagtagtaaaatgaatggatttgtttcccgtccccttgctggtccctgctaactctgactcttaaaagccataacattttagccaaagaggacggaagaaatagactcaaaagttgcttattaaaacttgcaatatgtgtgccaataattgctagaactgtgttagaaataaggacattgtaatgagataggatgttatttttctaacatgatgtctctatgttaagagataaaggtcaagtcctaggaaatgaagggctactttttaatggcgttgaaaccacgtaatgggtaggattgtctctagaagatcagtaatgcactgatacataatcaatggaagtttcttaggagatactttatttcttttagcattggttcctctccctactatgtcaaatataaatatttcacattgtatagccattaatcaaagtaaaactaaccacagtctatatatatatatatacatatatatgtatatatgtatatatatgtatatacacacacacacacacacacgtatatatgtatatgtactctgtatgcatatatacacagtgaattttagcttatgtccctatgggcagggaagagaacaaaagatgcatataataattcatctctgctcattttcccatgctccttcattttgtgtatcatctcacatgcaaattaaaatgttctaaatgacaaaagaaaatctcagttgtgggaaattaagcataaaatgtggactgaatcttgattttgaaatcctaagggttactaaaaatagaacatttcacacccctttcaagggagcacctgctaaattcatttgagtcaaatgtagaaatctctgtaattcgagtagataaggataatctagaaataagaccacgagcagaggaatggtcaatgttttttgtagccaacagctttgaaatatgcttatagaaaacattgcttaaatcaggactattttaattcagaaggaatctacccatggcctactaaattatcatcagagaggtggtcaccacacattggtttagtgaccaagcttgacatcagaaggcctgaattctgcttctgcttttattattagtgagataactgatctcatgcaggtcatttaatttcactgtaattcaagttctttatatttacactgagttgtgtaaaaattttaaaaaacaaaatacagcatcattttaagctgcataaaaggtagaaaatatatcatttttaaatatcaccaatgttatcaaaatcatatatccagacaagggatctaagtaatttatctatatagatggcatagatagactacatacactacttatgttcctcattttgaatgtgaacagattagccatagcagtaaattccatcgctgaagaaagttaaatacctttaagaaaaatacaagcctgtccttccagttgtaattttctttcttaatgtgctttatctttgatttgacataatgaaggtttttatcctgtgcccagaaatacaaaaacatgagatctaaatatcttttttggttacttccccgtgctttttcattttgttttggtttaatatacaaattaaaatgttttagaaaatattgccaaatttgtacattttgaagttttattctggaaatatgatccattctgcttattcttttaaaatactacatattttcattaaaaaatgatctgatgtaataaaaaaaagtttttgcttgagaattgtatcagtagatacaattctcaaatagaagagttcaactctttacagatgatcagaagtatatttcctttaaaaaagtgaaacttaaaaatcacacatttttagatgatgacagtttcttttgtaggagagtgtgtacctttacaagatacaaagagaaagaacatttgttatcacaatcataaatgcaaattgtggactcagcctagaaacttaaaagatctgtgtagaatgatttttctccccttttatttccagtttaattgttttctgtcatagacttttattgaaacaaatacatgctactgattcttccctaatcttacgtggctaaagctaatctttcttactatttgcttagtagaaaaaaagcaaacagcaccacatattttttttcttttccaaaatatagcaaaaaaaaaaaaacatcctattatttcattccaaaagcagtagtccttttcagacttgtgcagagcagcttatcccacagggatttcaaatagtaactcattggatgcaggtgataaggactttctatgaaaggccaaagcaactaaatagttatggtttttgtttgtatttaatattattttgttgtggatgcgttagtcatattttttcaaagggaagcaatcaagtgtgatagaaattatgatggaatgcagactggactactgtcaagagagctgagctctggtctggactctgtcactgacttagtatgtgcctctagtttccatgtttttattttattttgagacagagtctcactctgtcacccaggttggagtgcagtggtgcgatctcggctcactgcaacctatgccttccgggtttcaagcaattttcctgccttagccccccgaatagctgggactacaggtgtgcaccaccatacctggcaaatttttgtgttttcagtagagatggggtttcaccacgttggccaggctagtctcgaactcctacccttaagtgatccacccacctcagactcccaaagtgcgggggttacaggcatgagccaccacaccctgtctccatgtttttaaaataagaacagcaagatttgctcttaccaacctcatgggaataacagcaagaaaaaaaaatgggtaagctaccaaaaaaatcttttatttttaagaagaaatgtagttttctatttttggtatattatcaaattctcccttatgttctgacttacattaaaccattacatgtaaacatgtaaataaatattgatagtctgtcttgaagcctgactctgatacctgaaacctgaaatacagtcctaattctatagactgtatagtctgaaatgtattataaggaagagactcttttaggtgctgggatacctggtgaccaagataacccagttcccctacaagtttgtattctatgaaatagacaggccctatacaatgaaacaagcaaatattttctcaggtattgattagtgctgtaaagaaaagtaaagccagctaactgaatagaaagtgtcagaggaggggggacactttcatgaagattggtaagagaagacctgtctgagatggtgacataagacctgaaacctgaatactgagaacaactgagctatcgaaagctttagagacaaacattccaggcagagggaacaacaggacataaggctcttgaagcctgaagaagcgtgacaagatggaggaacttgaggcttactggcctggacagaaatgaagggggaagagagctttggatcaggtcgaagaggctgccaggggctagatcagacaagatcttgcaaaccgtgaaaaggagtttttattttattctcaataaaaagagaagtcattggaaaaataagcagattgttaaaatgacctcaacatgacagaattgagttggggagggtgtcctcagagtattacccagagaacttggccccaaatcttttacagatttctcttcctctcctcaaactttcccactcttgagtggctaaaatcttaatctctttctctgtctctctcaacaagagtgaacccgatgcactgcttttccttttaacatcttctttggcatttaagggcacctgagtgtagtcccttgggaaagtagattttcttcttcttcaaataaggtcatcacattcttcaaagaagaaaattctggtgagtgaaattcttcctttctgcccaccatctacctacttacttaaaccttagcagtcatctgtcaaggggatcagtgtttatttgtgcatccagtagcactttcttgtcatagccccatgaccctgctccttcagattttctcaaggacctctggagatgtttccaggttaggcatagccatgtgtttcaaaatgcagtccaccagttccaggacccaggacagaaagaactgcctgtgccaaatcttgttgaggcttaattgggaccttaaggacccttcaggacctctaaggcctttccaaagagcaagaacatgtgattcccggatgaaaagcctcatggttcacggctgccacaattgaggtggtgcagaccaccctctcccctgctggagcccgtaaggctcggtgtgggtggcgactgtggaaagcagggcaggaatacattgccttccagaaggaattcaccttattgctgctcgtggggacagtgttagctggtatgctttggcttcaggcagctgtgcctcagttcacccttcagccagtttttatttttcagtcttgagcagcttcacagacagtaacaatgcagcctatattcttccactaaacgcagtctaagattattcaataatatttggctattagttgttcccacaataacttcatctcgaacttcgagccttccaaattcagtgttttgtttcatcctggatagaccttgatgagagttcttcctattctttatgtaaataataccaagaactttctccctttcctttgaggaggtaaagttaggaatttgacatctgaatcccagtatctgtccagattgccatgttcacctttaagtcagtaagaaaatatgccttcaaaactgcattttgattcgtttctaatggaaaaggtggggcagtggcataaacaaaaatcttgaagaccctcatatatacagtctcagtacttctaactttaaaatcatcttgacccatatttctgtatctctctggttgtatttttaaaaccaccaaggctcctgtctgatttatcatgcccctttatctcttaaatcctggagttatgtcagccatgatgaaaatatacaataagctcagctttttatccaagttgtggctggatacctttgggacacaattctgaaaaagtagtcccaaatatcgcccgattatatagtacttcccctcaaaaggctggtaatgcacccatgcaaacaagaacaaattgaataactcaatttccagaaggccactgaaataatgtagagccctgaaggagaatttctataggggatttcaactggtttatcatactgaaattattttcaagaatccttctagacatttattggtttctcaaaattgtcctgtttaaggcagtaaccaaaacatcttgccttttctgtcatgcctacccctttgagttcacttccttcgtttctgtgcagtgatgctctgtcttggcttatctgtacataggtcactctcagacatgcatagacctgggggagctgtaggtccttttctgttctgatggcttttcttgtgggttctatctccttttcccttccccactaccatgcccataattctatcaaagaaaaagaaaaataatagtaaaaacaagaagctgttctttgttgtggctcattggtaagcaaaagattccatttactttaacaaatatatatagattgcctactgaatattatggactgcagcaatcagaatagcaagttattcttaaaacatagtgatgctcttaaagtgttttagctttgaattgagctgtctgctttgattcaaagtcacacagagactgctcttggaaattttcccataggcccaggggccactcctcggatttacagcaatgaaaacgtaaatgaatctgctcacttaagggagaccaagctgtgcagaagtggtgaatgttaagccaacttgccagaaactgatttataaaccagaatgctgattcattaaatgaaatgggagatgaatctggtaagataaccggcatcaatcatttgaacagggtactccctcttaatgaataagctcattgaagaaactaaattgcagatcagaaggatttttggtacagggaattagaagagaaaaaaaaagtgttaaggggcattcccttaaactcagtttactcaatttgttcctccccattttggaagtctttcagtctacgaatctggcagcagacactggaatgatgtcactcttgggcagttcttgcctttcatctaactttgatctcttcttcattcataccaccaaactttttttgggacaacaaagccctaacattgttacacaaatttaggtcagagtttattttgtattcatgacagttagtctcctgtacctttaggagataaactacagaatccagtaaagagatttgggaagtaccttaaactcatcagcaactatctatataaaccatttttttatagtcagttttttcaacagatgaataaccatgtctgtttcagcttaatgcttattagcttcaattttcaagaggtgactattttcctcattcaatttagcagctacttactgagctcctcaagagcaagaaaagtctccagaggaaacaaaaatgagcaaggcaatcctttatgaagtttacagtcagatttgagcaataacaacaataataatgagcacaaataattatggcacagaattaagaaatcatgtaagagagtctgttccagaaaatgaggcaatcacacagctgactgtgagaatcctgtggcttttgacttggaccttctagggcacatggggttttaccaagagagataagaaactgtttcatgcagttgaagagaccttggtgagacacagcatttagagagaaaagccccagacacattcagagaaaataatgggatggaccctatttgaagactgcaaggagtacatgtaaaaactgatctgccaattctattatggctttaaaaaaaaaaaaaaaaaacacggccaggtgcagtggctcacacctataatcccaacacttgggaggctgaggtgggaggtcccttgagcctaggaattcatgaccagcctgtgcaacaaagtggaacccagtctcgaaaaaaagaaaaaaagaaaaaaaaattagccaggcatcatagatcacttgagctcaagaggaggaggctttagtaagccgtgattgcacaaacgcactccagcctgggcaaaagaacaagaccctgtctcataaaaaaacaaaatctaagacacaacaaaacaaaaaacaaaagccctgtctctccttagaaccacaacagatcaagttatctgatgctttttttttctttttttacttttatgggtaacacttgtatttgaaaaagaaaagaatggcaattaaaagttaattattaaggcaataagcataacatttattaaatcgatttagaagcaacttgattataaatcttttttcagtagaattcagtcatcaatcgctgttccatatataaccatctattcctgatggtgtaaaagaaaacatgcaaaattaatataagttctttaatttctgaattttggcaatccctttacgctttgggtgactgattatctgtcattttctattatatgatttcactcagaggagctattttttgtggtgttataattagaggaaaaccaataatcgataagaagatagtttgaactgagcaacaagattgttttgattcaatgtttttaactgattaaaagtgactaacgtattttgttttcatccgtgacatgtaaacaatagaagggaatctcgctgtatctaacttttttccccaaacccctctctcattctccttccaaattttcgaggtacgaaggatgactttctgacttcacataaattgcccctgaaacatttctgtagttagtgacagctgtcttctacttacttccaggagaaagactttattcacacaccgttaaggctctttttactggcttgagcagcttacaaaagagagaaaaatgtaacgttatcaaagactttcttgtggctttcactttatgctgtcttccaataatatatactggtacctaaacactgagcagcatggagaaggagtggcctgacctgggtgaatttaacttacggagacagggctttctaagatgacacaggaaaggtattgatgagataaaagccactgaaggaataaatcattcatatgatattttatttttattaatttctggttcagctaaaagtagagaaatatcagatgaatgctattccacctagtcgtcagaattgacaagccacccaaggtcaggattgggggctggtctggttctggaatcagatggctacatttgaatcccaacttccccttttcactaactgtgactttttgggcaagtgacttaattttatacccttaagttaattttttctcttattcaatggaaatattaataatactttcctggtttagagtaatgattgaattatatggtatatataagacatcagtacaaagcgaggcacagagtaaatcaagcaataaatggcaactattataaaaaatggggccaggcacaacggttcacccatataatcacattttgtgggggccaaggcgggaggatcacttaaggtcaggagttcaaaaccagcctgaccaaatagcacacacacacacacacacacacaaaattaacgggaggtattatttctctataacacctatttaattgttctgggcaggcatttgtatacctctttatgttctatctgtcttcgtaaattatagaacacccatggctgtcactgaaagacaacttaagcagacccttcaccatgcccagtgaagaaacagaaagagaggaatttgggggattagtatccaagccattgaatcattaagacagaattgattgataaaaggatttgtgtttattaccccagatagtgaatttctctcagtagaaagagtgtcttttcatatcagtgtaggaggaaattcattacccattaatttcttaatgagacaaatggtaggcatctactggaattcatctatggaaacatgtttgtgtatgtgcataaacacaagtacagaaactcacatgtacgctcatatgcgcatgcgtgcacacagaacgggagagaaatttgttgactaattcttttatctttaaatatatgccatttttactgagatcacactcactgagtgggaatttgagagttattttagggttatttttggtgtatataattatctcaaggctctagataaagatcctggagttttaagcccatctaccaacattctggtttgaataagttatttgaaccagcatattagagagaagataaagtcttaagatgtgaggttataagattcctttttttcacgagggcagctaatgctggaactgcacgagtggcagaggtagggtaggagttgacttttaaaagcaataataccccttagccccaattttgggttttttttttcaacatgtttcaatatccatatgttaaaatgttgaatatttctacatctaccatattcacctatgcctgcttgtgaatttgttgtggagggttaaagcaagcaggacaatgtctgtctcatgttaactgctcagaaagtggtagctactcttactgtctcagacagtacctgagtctctcagttatccaccatcagtgttattttcttattaccattagctctcaaatggtaattttcaatcttttctacatcaaaaaccccttggggaatttgatgaaagctatgtatcctctattaaagaaaagtgcgtatacctacatgcatataccatgcaccatttccatacatagtttaggagattcacctattccatgaattgagagttttggtacaccagtctaagagctccagcacgagttgagaaactgctctttcatcttttaaggatacattccaagtgacttatatttgattttagaaaatactggtgaacatactccaaactacttccttgaatcttttctcttgggtcttgaggtaaagcctggaatccttgatgctctggaaactcttcagacagactaagattacttaaatccgtcagtacctcctgggagctggtacaagatgcaattcagaatttaaaattattcagaatgtactaagatgagacagtttatatatgcatcatgtattacatagcatccaagagagttcagtggcagcatcacataacgaaacagattaatatttcttcatcaaaacatgtgaatattcatattaagtgtaataaggactgtagatagcctcacagtagtttcttttgctaccaaatgagtaacattaccataaaaacaactttcagttatcagagcttttagaaattcagaattgcaaataaggatttgtggatctgtagctgaattcatgtatccagggaatcactataaaactcacatccctttatatttctcgactatacctaaagggttataaattgtatactacaatcagccttagatatcttgtagtttgccaagatggatagtttataaatttatgaattacacacagactacatgcatataaagtaatatatatgcataagtgtatattgcattacatgtattagtctgtataattcttcttttagcagtattcagcaatgcatccaagtagctctacttaaactagtatatattgcttgcctagcccaataaggacatataaatcattaagaaaagatttgaaaattatagctggaaattagaaaactgtctgcaatggcatagtttcatagaaacagaaaatggattgagtaccatacttgaatctggagcccctctcagcttcacttgaaataattttgcctgaaaattgcataacacgagttcactgataagaaaagcaattaattttaataaaataagtacgtctaaatttaaactatcttttagatttcaaatagcacaagagaaaaacttccacagaagtttaaaacgtactgagaacattaaaggaactgccaaataataataaaacataataataaaacccctaaatttaaactatcttttagatttcaaatagtgcaagaggaaaaaacttccacagaagtttaaaacctactgaaaacattcaaggaactgccaaataataataaaacaaagtaaaccaaatttctatgtctatgtccatatttctaactatcatattgtcttcaagtcactgctaaaataaagtgctatcaatgtaaaaatgctgaagactgcttctcccttcctttcaaagaaaatctgacatttagatatgaagaatgacaccttcttatgcctccttcatctcccatctatctagaataaattgaataccttgcaagggaggcaaaactttatcttcacccttttagggtcttcagctggcctgagaactaaattgatataagacagattgagaggggaaaagcatacaaatttaatatgaattttatttgacacaggagcccttgtaagaaaatgaagaaccaaacaagtggtaaaacctaaatggttttacactagattggacaaagggaggcaattctggaaaagtgactgactaagttgtatgaagaggcaaagagtatgggagacaaagagttattttcacaaggtctgtttgtacagaatctctaggctttgactctccatctctggtgatgagaatgtttattttcttctggtataggaaagacatctttcacttgggagtttcatcgcttgctttcaggaagaaaagggggagatcagaatgttcttcttgtacttgctgttttccaagtgcctttagctcaacataatccttatgccaaagtggcatagttgagggtagcaaattgtgccacccttcaacctcctggtgttccaaattttgctttgtgccttgaaggaatctaacagaagtaccagaaacacccttctatgagaagaatttacagtctatttagaaaagatgacactagggtggtatggatcaatacagcacacaacacacaatacaccgtaaagtgttttgcacatcataaaaactcaatacatatccgttgcttgattatagaacgttcactttcacagtacctctgaccttttatttttcaatttagtctctctgcagttcctaggaccacatatactctggggagtgcaaaagagacttttacattaaaatatatggaagtgccactctgtaagcctgaaaaagcccaatgccagccattttttatggttcattgtggcataagaattgttctagaatatgttaccctaggtcagttactcttttattcatcttctaacctcaatcttggactttttgtattagagcaacagccacctcctacccgcaccatgaatttgttcctaaaatctgtgtatctcaagatcttcccagtgataattgtttaccctggagcttggatattacctggctggacatctggctaataggccttgtgtcagttttcttttccctccagacttgcacatccctgagagagagtgttttgtttttttttaaattttgttccctaggctctttatttgcctcattttagtcctagtcctgcatggcatcacacttgatcatcaaccctgagctgtctgaattcagccatccaaattccactgaaatgttctcactcctaagtgggtatttttcaccctaatcatattacctcctctgcagcattgggcactgtgagtcactctatccttaccaaagctctttcctctgttagcaatcatgaagcagctgccttgcttctctgtacatctgtacttctctaatcccacaattaccacttaccttttgaatctacccaaggcctggtcccctctcttcttttcattttaaattttctctgggcaatctcattctggaatggcttcaactgctaactacatgatgatagctttgtaaaccccatctctagttgaaacttctattctcaactgccatctcaacctggaggtatcacaaaggtcataggctcaactatttatcctcttcaggttttttcttttacagttggtaacaccatccagtcacctaaattaagactttggaatttacctctgatggctctccatagccaatctaccaccaagtattttctttcttttttccctaaagccttcttaaaactgtgtttttcctccccataccttctgcacttgtaatggagatcaccaaaagttacccaaagccctcctcagataacacctctgaatgtgatttttcccttttcacctgagaccagcataagaaccatctagaaactgatgctgtgatagcatgaattattttcatacacctttgtatgtaaataatttccacataaaaatttctatattacttttttatgaaatgtgttaaaaattactgaaataaaatacttctactttgaaccaatttatgaacaatatttctagaagagttatagatattctatacaaaatgagttcaattgtcgttggtttttaccataagacattattgataaaatcctaatgttggaatctaataaatacttacacagaaagggtccttaaaaagacattaaagtgccattgaatgtcttctagaagttacatttaaagataaaatacattgatatgcttttaacttatttgggcattgaataaaagacctttcttataaatgagcataagacgattagtacaagagtggtgaggactgaaaaacaattcaagataggaaatcctgaaattgatgttactttataaactctatttctaacaaagaaaattgaaaaactttgagtttttgaaatgtataattattctaatacattgagaactgtttatcaattatgaccaaggatacttcacaaaggctagtaagcatgtcattctatgtcaaatcaccctcccgataggtattgcttaagaacctgctaggaagagtgatgtgaaaaataatacaaggaacaatgcattgtttttattccaaattagcttataatttagtgtgtcaataaaccatataaataactataatactctagtagcatatgatgcggcttgtaaaagccagtcacagagttaactgatgtgactttttaagttagaattaaatttttttttattatacttgaagttctgggatacatgtgcagaacgtgcaggtttattacataggtatacacgtgctgtggtggtttgctgcacccatcaacctgtcatctaccttaggtatttctcctaatgctatccctcccctatccctccaccccctgacaggcccgtgtgtgatgttccccctctctgtgtccatgtgttctcattgttcagcttccacttacgagtgagaccatgaggtgtttgattttctgttcctgtgttagtttgctgagaatgatggtttccagcttcatccatgtccctgcaaaggacatgaactcatcggtttctatggctgcatagtattccctggtgtatatgtgccacattttctttatccagtctatcattgatgggcatttgggttggctccaagtctttgctattgtgaacagtgccacaataaacatgcatgtgcatgtgtcttgcacaaaatcactctgtcaccttagcacctctttctttttgtttgcctttggaaaattctgttgaaaaccctttctaaattcctgcccacaaaatattataaaaggaggagggagataaagaataggagtaagaggaggagaaagtaatgaactgtggttaaagattaaagctttttcagaaaagcacttatcaaaagtttctaaagagctcaggagttaatgctgtactttttaggcaataatggatgggaattgcttttggaaagcactcttttttcttgaagagtgcaaaaaatgtattcctttgagtgaatgaaaatcaatgttatggtcaaatatagaggaattgaggagaaaacaaggacaagaaatgctctaaagagaagactttgttgcctcttttcttcttcatcttaggaataggatatcaatatttgaatcatccatgggagcttttcaaaacccctattcctgagctctacccccagagaaatgcaatccaaatctctaaggataaaactcaggtgtcagtattttaataaacttcccaggcaattgtgatatgtagtcacagttgagaaccactgctacaacagatctaaaaggcagaagccaagtaatgctttaatgaagaatttgagaggaggaatatacatcaccctcagctactgtcacctaactagctgatcctggtaagactggtagaaatatagcatccaaaataagcaagggataaaagactacaaattgggttcagtgtatactgcttaggtgacgggtgcatcaaaatctcacaactcaccgctaaagaacttcctcatgtaaccaaaataccacctgttcccccaaaaacctatggaaataaaaaataaaataaaaataatgaaataataaactgcatttctcagaggtgcaaaatacccaaaccctaaatttaaaaaaaaaattagtgagaaaaaataaaatttccctagctgttaaatccgtgatgtgatatttcttcttttaatctgaatctaaaatgttcagtcttggtccaataataaacacactcactgaaacacacagtaaagaatctaagcagggtgagggccatggctcatgcctgtaatcccagcacattgggaggccaagatgggaggattgcttgagcccagaagttcgagaccagcttgagcaatgtagcaagaacctgtctctacaaaaaattaaaaaataaaaaaaaattaaccttgtgtggtagagcatgaagttgaggctgcagtgagccatgatcacaccaactgcagtccagcctgggcgacagagcaagaccctgtctcaaaaaaaaaaaaaaaataagaataatctcagcatttgagaagatgataatatggaaagtcaggtgtgaggtcagcatgtgggtgaataatttcaaaagctcttatttcttaatatcagtaaatatattcccctcttacagaattcatgcatggtattttggggtgtgtaaaggtacctctcacttattctcattctgaaagtctttcacttccttggtggatgaaaaggaaagctgcagttggttataaaaacgtgacggatgatttaggtggctgtattcagctgtaagcaataaatgctgagctcggcagaaagtactataggcaaaaacgtgtgatttactagctatccaaagcacatgagatttataatgcatgagaccctcaggcccatcacttctcttcagtaatgggaaacaatattgtgggaaaaaatgacacatttaatttcaactttgtgttgtaaaacaaaaacgcagcctaattttcattttattattattttttttcttttcgtaaagcatctttgcatcttattggaaatacaaatggcttcttaagaagtaggaacaatagagcatgttcaaaacaatatctatcggtagacatttattactggctgcatgtttgtacgtgtttggtgggatgaaaatgagaaacccggagtgctgtgacagactcattgtgttctgatagactctcccgaaaactgattctagaagcttagtgttctttaaggcagatgtttagccaggtgattgccgtggttacctatggataccggataccgaaaagagtcttggcatacttaaaaaaaaaaaaaaaaaaaaggctagagaaaaaaatagtagagacattttttacccactgaactgagggtgaaaaatgtagtcacaaaagaccatgaactcaaatcccaactctgttaatgatatataatgtgaatgccataaactttctgtatctcattatatcatcctgtgaaatactgacctattttgcaattgcaatgtgagagataaatcaaacctcttctaaggtactttgaaaatagattctgcatttcagaataaatattaaacaataataatgatgatggaatagctgacacaatgcaaattttaaatagagcagagtaactttctaattatgagctacattttattctttgtgagtgtaattagaaagcgaccatgttcctttaattagaaagttaattagactgtgacctcttttcctgtcttactgtcttggactacaggccaggagtaaattgcaaatcccctgacctacatgactatagccccccaaaatcagactgtttaaatagaaataacattataaggaataacattgggacttgcaagtcagatggggacttcataggctatagaagggttctctcatgagagaaaagtttatgtggataaataaaaaagggttctctcatgggagaaaagtttatgtggataaataaaaaagatacttttccagatcaagcctatagagtaagttccctaaattgtattcaggatgttggttcctttgtccagtgactctattactttagtatgcatgcaagagaattacctgaaggacttgtttctgggctccacacatacaacttttttttttttctttttttgagacagagtctcactctgtcgctcaggctagagtgcagtggcacaatctcagctcactgtaacctccgcctagcgtattcaagcgattcccctgcctcagcctcccaagtagctgggattacaggcgtgtgccaccatacccagctaatttttgtatttttagtagagacagggtttcaccatgttggtcaggatggtttcaaactcctgacctcgtgatctgcctgcctcggcctcccaaagtgctgggattacaggcgtgagccaccgtgcccagctgcacatacagcttctaattcagtaaatgtgggactcgagaatttacatttctaacaagtttccagatgatcttggtgacattggttgagagaccacactttgagaactactgacttagaatattaatagtgttaggccgaagtattgttttgtgatcaaataagtttggaactttcaatgttgaacaaagttaagcaagtttgttttttgtgtgatacctcaaaacctttgaatgttaatatgctttggaaatctccaagaaggatagactgcattgctcctgaagggggtggcccttacaaatgttttggctctctttatctcggagctacaaacagaggttttgctatttcacatagtgttcttagaatgggttgttagaatgctttgttttttagcattaacagaagaatgtcagaaatgagtttccattggtgtaatttgtggtttccccatgtgtgtactggccaaaatattgtagagacattccctactcttgtatgaagagggtatacaaatctagtaaggtttcaccctttaatgtgagaaatggtactgtacatttgattaccatttttggaagtttcttgattgcctggctcctgatagcctaattagctgaattatttctctgatcttatcatgtttacctcatatgaaattttcatgtaaaatgacatttggaccactttaaagaaatgtgtgacttcatagagtcgactgttttgagctagcttgttcgtaaatgtctaaagaaaaatttgctgtgaaatttgctcacattacaatctagaagcaaaattcctagagcgagaggttaaccctctgccacttctaaccagtggcaattatagatacttatcagaaaagagcataataagttgtgcaagatgagattgcctgaagtcagattaaaacactgcccctgctccccactccaatacttgtttgagtccttgttttcaaaggatttcatgcatccagtgttattcaaaaacacttgcgaaaatgctgtgtgattatttttaacttctcagaacaaaaaagaccgatgtcacaggaaaccaagcagcattagtaaactggtctgtgacatctctattgcactctgtgaaaattccatgaaaagcaaaatgggaatacaagaatcacagagaaacaaacaagtggagaagaggcaatgacttcatgtttatgttcttggtagcaatttcctagggaaataataacttcagagaaatagtcaatttgccttacctggtgtgatatacgttgtatattgtctaaaaaataagtgctctagaataggcaaaaacactttgcctaaaaagttgtgtacgtgaatgatactggaaaattcaatgatagcctttttgtctgttctcattttgtgtagttgagagcaagatgctcacaagtacatattaatattgagtgaaattaagaagtctcatccccagaataatgttgctcacaaaatagatgctcaataaatgcctgtggttgcattgggctcatttctgttcatgtgctgtttttttcttttcttttcttttttttttttttttttttgacagagtcttcctctgtcaaataggctggagtgcagtagtgcgatctccactcactgcaacctgcacctcccacattcaagcaattctcctgcctcagcctcttgagtggctgggattacaggtgcacgccaccacgcctggctaattttttttttttttttttgtatttttagtaaagaaggggtctcaccatgttggtcagactggtctcgaactcctgacctcaagtgatccacccgcctcggcctcccaaagtgctgggattacaggcgtgagccactgtgcccggccacatatgctgttttaatttcaacttattacatggcttagaatatatttttaaaaagatattttgatgacacaatgaccctgatctataggaatgccatttttagccagaattaatatagagcactctgctttgggattagctttgggttcagtttttggccatatcatttaccagctcagtcatgggaaggataccttggaacatttaataattttttggagtttcagcttgattctcccaaaatgtgactgattaaatcttacctaatacgtcattcattcattcaacaaacatttaatgaatgtccagatgtgacaggtgctgctccaggactgggggccaggagtaaattaatgcattagctgctctcatggagcccacatctggttgcacaagacaggaaagaccaccagaaagtacgtagtagaatatcttgggataatgagcaccatgatgagaaataaatcagagtaagggaacagggagaattataaagacgctcttttattaagaatcaggcacagcctttctgataaatggaggtttgcaaagacgaagtggtcttctgtgcacgggacaaaatgagataaagcatacacaaatagattgtgaaatatttgacgtggtgttaggtatgaagcaaaaaaaaatctatttcattgtgattaccattaccatattatcactgatgttgatgtattttcagaaacacctatctcgtgtgcatatttggtagacaaacctgaggaaagaattcctaactaataaaaagcctcataaatcaaatgccacttaacaaagggaccagtcttgttaacattgctgcaacagaactcgagctctcaccactgctttagtgagatcattaatatgatcattgcaatagtttgtgctcctaggattattgatagagaaaatgtgtatgataataactattaaaaatgatatcacccatcaccatcaattactgattcctctgtatgcatcatacaatgtgcatagtgctttatattttctattgctgttagttctcccaacaatcctataaggtagatattcttaagatgttgtcaaataacttgttcaggatcacccgggcaactttgtaatcagacctgggatggaagcctggagcagagtgaaaacaatgcccatggcctattgaccacattcataataaaatatatattggtaaaaaaaaaataaaattacaagactcttaaacttttatatgtttcagttaacattatgaaatagacaactaaacttttgccctgatttggaacccagacttctgtgtgctctttgttttttaatgaaaaatgtgttttaaatacttctgtggtctgaaagtatcccctagaattcctattttgaaaatccctagtgtgatggtattaagaaacggggccttttggaggtgattaagtcataaagatagaaccttcatgaatgggattatcaaccttaaaaaagagatcgaagagagtggcctaggcccttttttgccattccaccacttgaggacacagcattcaaggcaccatcttggcagagaccagtcccttaccagatactgaacctgctgataccttgatcttgcacttcccagccttcagaactttgagaaataaattctcgtttataaatttcccagcccctatagcaacacagactaagacaaataccaaataaacataaaataaactcttggagaacacatttgcacacccaaaacttcctgaagatagcaattcctagaattcgaagcactgagagagtaaacaatttactttaacttttgaaaccatgcagcctcccctcaattccatgttttatccctcatctgtcgatagtgcatggtgctgtaggtcatgatcaaacttccaaatagaatcattcatacaattctaagtcatcattaaggccaattcagaacgtggagattttataatttagttgctgtttgagaaactgaatacctaagacagcttatttgattattgaactttatttagtggaatgacctctggtggcacaaataatagaaactgctttcaaattatcattcagggtagcttgtagttggccatgaatagagagacaattaagtagcaaatttattacaaagcaaattccccagtgacctactgtttttcttttctagtgaggttcctcaacgcataatcctattacttttggcttgaatgagctagtcactgtcttccaagctgaactatgatgttacatggaagtttaattttcatcttatttaatttgaccttaagtgagctggatcatgaaaaggcaacataatctccaattctcgacgttaagcgtcttttaactactctacccagtaatcattcccaagagacattgtgaaattgtttaaaaattggtcacaaatgctaatgctaattttatgcccccagatattttggcatctctttcttcttattgtgccttttacactgtgaggcacccagcaggacattcctatggatggatggacttaaaataataaattccaaccaccattctctctggctaggccccctgctctaatgcttaacacaatgcgtggcacatggttagcactcatttggtgttagttgtctgaatcacgaactcaacgaattaatgaatatacaaatcagctaacaaacagacagcagaatgttgaccttctactttctctcatttgtttgaagtgcaattcaagaccggagaaccaagtggacaaaatactgcatatagatacagcagcaaatgcttaatgacttaaatatcctggaaatatttttatatcttactctgacttttcacaaacattaaaccaaaggaatgcttaactggcaattttaggttctcactgggcaaactcatgggataggcagtgtggagaggggcttgcatatgttttttgcatcatttcaataccccacatctgagagtgtacaatttgggttagatttccactcaaccggttggaatttcaggttttggactacgtcctctctatttcctctttatactttcatatttggaaagcatgatatgagtactgtcttagggagaggatagacaggaaagggaagctactgaaagccttcttttgaaataataatttcttaatctatgcactaacacacaagagtttatatctcctggaattttaaagtaataattgtagtgtgacaaaacaatgttaagtcataagatacatttcaacgttttaaaacacacacagaatacatcagtgcccattatgtgataactgagagattaatttgcaaccaataatatccttggtattttagcgttgtggattgtcaaaggcttgcttattgcaggttaagacattaaagggcccacattcccacttcttattaaagggagactttacgaaaggtaggcactgtctctacacttctgggaagaaagcctggtgatacgtaatgctccccctagcagaaaaatagtggtcaccagaagcatctctccataagataaggtgagacaaatagtgctgggccaaaccttgtgaactatgggcttcaacaaaagctaagagtctcatcatataactctcacctagactcagactatttcaagcaagaattaaggtaatgacatgaacttcttgccacagttatctctttattataaaatgtccttgactacaaggaggtgtaaataataactgccattccatggataatcagggtaagctctatacattgtctgccaattaccatgtactacttgaaaattgttaatttagttgaacttgaaaaaataaacaagtggccctctttggcatagtctagaagagactgcataggaaaaatgggaaattaaggtggaggatgatggatggggttctctgagtacagcagagggggcaagcagaagagttggagcatcatgaatggggtcacagtacattagtatggcttctttggcttgattgtggaaatgtgagagacaactattgtgagattcaaagacagtggtaacatatataagaagtgactgacaagatgacagccactcaggaaaactgcctcagaaggcagccagaaaggatcaattctggaaaatgactggcggaagctattaggcatattgaatgggtctgacttagtggttgatttgacaatgagagcaaaagatagatgttataaaacatcattcagagtcaatgaatctggctattgccaaagacagagaaatgaaagaataaaagggaaggtatggggaagaaaataagaaaaaaattaaatgattatctttagtttctgcattagttcttctgctttggaatctccctagctgcctgcagccaggggcaaagatagtttcacctagagggtcctgattgaggctgaggatacctaggctcaatcacagcagtggcacttcccattcagaggaaggcttaacattaattatgagacatgagatccaggtgctgaactgacaaatctattctctctcccaaggcttcccaaatcacagctccgataggcagttatcctagcttgtattagtcataattccctgtagccagagcttccacttttccttgcgttctgattttgatgctatcttatagattaccctcctaattacaactcactgcttacctggttctccaggaatcatagcatagttttttgagtactctgtctcacttgcctggtcaggacacactacctcactttctattctaaccatttctcaatgccgaggactcatatctcagactcaagacagttatattgttttatttttaaagtcactaagatatacccatatcttggtattccataagcaagaaggaagtgagatgagaaagtggttgcaaccacagtgttaaaaatatggactggaaacttgtctatttgcagatggtattagatttctattgctgctgtaataaattaccacaagtttagtggcctaaaacaacacaaagttctcgtcttacggttcagtaggttagaagtctgacatgggtcttactagaacaaactcaaggtgaggctgaactcaacagggctgaattcctttctgaagctctaggaagagtccatttccttgccttttctaaattttagaggctgcccacattcctcagtgtgtggccccctttttccatcttcaaaaccggcaacgtctaatctctctggcccttttttccatgctgtatctctgatcacagcgggacagattttctgctttaaaggaccaatgtgattagattggacccaccaggaaagtctcccatctcaaagtctataatgttaatcatgcctgcaaagtctcttttctcatggaaggtaacatatgtacaatttctgaggttcagatgtagacatccttgggggaccattattctgccttccacaaagatattttctaaaccattgagaacagatgagagtctcatatccactaacaagagccattttgatatgcaacacagcaacccaattgacaaggaagtcctcagagatagtgtagactgtgatactcttcatctttaattctataggttttacctgcgtagtgtctgacctgaaagtgacaaagtttcccacaccttgctagatattcccacacattcctatttagcccatctagacattagaagggaagctttcctatttatgattcctatttaattggagtgaatggatttctgtcatttcctgttgttccttccatagccttatgattgtgtggtaatttgaaatctagacctttttcttttcttttttttgagatggagtcttgctctgtcacccaggctggagtgcagtggcgctatctctgctcactgcaacctccgcctcccaggttcaagcgattctcctgcctcagcctcccaagtagctgggattagaggtgcccaccaccacgccgggctaattttcatatttttagtagagatgtggtttcgccatgttggccaggctgacttgaactcctgaccttgtgatccgcccgcctcagcctcccaaagtgctgtgattacaaatgtgagccactgtgcccggcccaatctagacctttttctaagttagttataaaattttacatttttccctccttgcaaatttgttcccatttgaagaaccatctgcaagaagaagaatacataccattcaccaaaccttctatccgttgggtctatcagagaattagtattggtggtgtcttctagtcctcttgcagattaacaggttatccacttgacctgattatccatgacatcaatttggtgtatcctaaacttcatcagagcagaatattcctcagaaggaatatcatgtcaggtagcttttcagcactaagcctataaatatcctgcctgtgtaggcacatgggagtcaatcctgagaaagcagctcattgaggcaaaaaggggagatttttagctgaatcagacaattactcaataagtctgctttgtggatgtttgtgtctcccccaaaattcatatgttgaaagctaattcctaatgcaataatattaagaggtgagacctttaggaggtgattaggctctaccctcatgactgggattgatgcatgtataaaagaggcccaagggagtttccaacaagtgctgggctatctgctgttagctagcacttaagatgtcttacctgtaaagtgtctttcactataattagtctttctgactaattgtcagattcagctaacaatctcttctttttgcctcaatgagctgctttctcccatttgcctacacagaacataattgtttcatacactagaattagatcagagtagattcaggctcttcattacaaaatgctcatctctgctggatgttaatatcaaaatcagaattctagttctatcacatattgactgatataagaataagtttagtttaaaataaaaggtgagagaaagaatggaaaagtaataatatggaacatgagcagcgtctcgacttgtttctgcttcctctctttttcttactaattaaaacagataacaacaaagccctttggtcacagcccacacaatcacaagtggttccctttgttgatgtgatgtcactggaggggaaatgagcagttgacaggctgtgcaaccaagaaggcaaaatgagctcaaccatttgaataaaacatagcaggtctcccactccatgtcattgactgacataacccaccagacagtaccctttaaataggctgtctctcttttatgtagcaaataaaaaaaaaaatgtaacatgtaaatatcaggtgattcttcttcagcatctgtggttgccagaaggaatttactgccttttcattgtgtggttcaacttggtcttcaggtggtgtgccccaaaatccacaattagtgggatccagtggtgctgtggatgtttgtgccccccccccaattatatgttgaaagctaatccctaatgcaataatattaaaaagtgagacctttaggagttgattaggctctgccctcatgaatgggattgatgcctgcgtaaaagaggcccaagggagtttgttagaccccccacttccgccctgtgatgacacagcaaaaagtgtaatccgtgaagcagagagctcacgccagacattgaatctgctgtcacattaatcttggacttcctagcctccagaactatgagatataaatttttgttctttataagccaccgactttgtggtattttttgttataacaacttaaatggaccaacacaagtgatgatgtttctagagtctgtgtatgtgcatgtgcctaagtattttgccaatttagcgttaatgagtacagcaatgccaacaatggatccattctttgcctctcctattaccgcaggtctccttttcacagatcagtatagataagggtagtagagataaatattacgaggttatctgttagtgcctgttcaatcaactcttgattttacagtagtcttcctgtgtaccatgacccagacatcttataaaagcaaaacacaaattgcagttttaaaatgctattgctctgcaccattattttcctcttcccactaatttgcttgcgattcaatgtgttttctagcatctctcatgtcttgggttcttggccctcatatttccctttggattgcttcattttggtggattttgggaattcccccttggctaataaaaccttggttattcctttctgttctgctgcctagatgactattccccattccaaactttaaccctgtggaaccccacccccacacaggccatctatagacctttgttcttcctaacattttcaacagggcaatgaagtgtttcataaatatttggggttttatggaaaaaaaatgctctaaggcagcttaaagctattcttcaaaataagaaaagtattctatattttaaacatgtatatagtcatcttctttactggggaattaatggagtactctaagctattgcccctcccactctcttctcttcagctacccaaagtgatgatgtggaacttccagattttctcctgcaagttcatgctttatttattccattatgaggtccacatcaaattatattaccattcctgggattctggagttcagatctttggaaaatcacagtgtcaacagaaattataagataaaggcacttatatatgaggaatgatcccttgccctgcatttacagattcagatcaaaaaccaatgcccacatattttatctctagcttttactaaacagtagagtccgtgacttcattcacagtaggtgattgatacatttcgacaaaagtattttgcaaagacgcttcctgcagcatcaacagtaaaagagatactgaggtaggtgctatatgtatcttctggatacaaatttccaccaaaaaaaatttcatcttagcacatatctttgacttatggtgttcaattttaaatataactggcagttttgataaaatgcattcctttccattgtttctgttacaaagaatgcaattttaaggttttctgtttttgtaaattggagcggtggatacaacagttaccacccccacacatacacttctctaacacatacatatatacacacagttttaacattcccaattctttaaaaaattatctttgatcaaattattgtttatatgatgtaaatgccttggacactactgcctgtcagtgatgcgagtcagttcttctattccttttattggctcctcagagatttctggaagtccatctataatagaatcattatttcataatgataacatattttaaaaactcatggtttcagaaacatgagcaaattgccttgtaaaagcctacattgagggagttgtgcagactttaaaacacctcagcttctcactgcacattggatatggttgagtattgcaaatacagccatatttatccatgctatctagcattagacagtccttatcatcaagtgatctgagggcctccttcatcagcttcccttggaatgcttgctatcaaagtactttcctgagcccgctacagatttaacaaaccagagtctctgtgcacccagagaagggagtttgctccagtgattttcgtgcacactaaggttggagaaccattgtccctcagagccattagaaattcagcttgcatcagtctagagttctacaagaggcaatcacaacaacatgctatctacgaaaatcctatatttccatccctgactcagaatctataaatttcagtttaatttccactaaatgtattatcccgggaaaaagggcaggaagtaattatggaaaaaccattgaaacgtaagcatggtgagcagatagtatgaatatgagtataatctgacacttttaatatctcagagaacagaggaacaatagggaaagcaggtactgaccagccccagttcacgtttgtttctgccctcttgggctgtgcaactgtgtgacttgggcaagttacatgaccttgatagtcaaaatgtgaatgacagtatgtgtatattagtgatgttgtgagaattaaatgactgatataatgtgtccaccaagatagtagacagatagtaggcccccgtgtattagttacctttcttgttttctaccactactacccaagagggaagcttctaaactctgaaggagatctgttgatagagtctaatgtgtcatccagctttgtctctgggtcatatagagatacagtttgtatgccaaaaaaaatgtagtcctctatacagttcagaaaattaccaccaatatgctttatcaaacagcagctacagtgtagtatatgccaacctcagagtgggtctcctcttaaaggttcccaagtatccagtcatgtaaatgaagactgcatctaaggagttagctgtacagagaagagtctctgagaaagcgaaatagggttatagtctcctctagtccttactttcgctttaaggaaggagaaaatagcaaagagtgaagaggcctggaaaattgcagtaaaacagagcaaataggataagagactaataaaataagtggagcacagagaaactaaattgaatgacaacacatgagaaatgtactcaagttttgactcctgatttgtgaaccagaatctgccaataacaactaccaaatagatcagcccaaatatctattagtaacccccaagaacagtgcgatgtagtagagtgacccagcaataaacaaggccccatctctgccttctagtgttttacagactaggaggaagcctccacaaatttggcacagttaatgggtagctaatcagaaaaaattaagcttatatcaatgtacttaagctgtgaagaaaaagcctcatacttcttgttaaaaataaatatagtttgattgctcaaagagatcccagtccacagattaccacagtaaataattgcacgcccatctcttttgcaaagcacaaagcaacctgctccacgcgcctcagatgcctttctgaatcaccacagagggagacttttaatcatttcaacaaccagagcaccagctttgttctcaaacaatgctggaaggtttctcacacctctactatccatagtattataatttttcatttttcataggcaggggttttgttttatttggttggtgttgtcatatcccagaaacgaaacaggcctgcaaaatcaatgccacacgtacaactatgtatatattctcccctgtaaatctccattagcttgattgggactccatagtggctggaggtattgcctgcatctgcctttcattcttagtttgggcaaaatgagtggtgaatgactcttatacctgccttttaaaattggggatctcagatgagccctggctctaccactaattgcatggaactacttggtaagcagcatcactgaggcatcagcatcccatcatatttatttctagggaagatgacaaattatggccaaattagcatcgatatgaacaagtttgtagaagggtcaaaatataaatacaatatacaaataactacagcagtaatgtttttaatcactacattttcaaaaatattctaccgaaaagggtgattaacaaattattattatgttaacctagaaaaagaacataatcagtatataatcactaagaagacattaggcacatttaaataagtaggtgtttgcatgttaatacacacgtactcttagctcaggaacatgatccattaaccgatagaacgagtaagatgttagctaattggtgagttcttgcagtgagaaatgtctaatgtgagtccctggtacctgtgattttcaaaattatttaaacaggaatcaaaactgttttaataatttttgaaagcattcccatgctttagaattttggtttaaggcttagaccaaaatcatcatggaaaaaatgtgtgtctagtgctgaatcactttgacttgtattagaatgtcagctccaagaagacagacatttttgtcaatttttaatcatcaatgtacccacagtgtttacaagagtatctggtacactgtagggttattagcaaatattcacaaaataaacaaataaataatacttacctgtttcattacagtttctctgccagaattgtaatcattggtcaagtttgatagtggacatgggcctctttcttgggaagtaataacaataggaagatatggtactgaatgctagcttatgggaggtgtgggttaagaggtctcagggatgccctgtcttataaagagctctgcacaaacttaagcttaaactaactggaaaattaggacagccatctctgtcatttctctagcgtcttctaccctctattgctttccagatgcaactcaggggactctccttcccattttcctggccctttgctttctttattgggaactagttaccttcaattctccccctttgggtttatatgcattttagattattatggttattcttcttgtaacctcatttgcgtggtagatgcaaaacagaatttgagacattgccatgaacaaaaatggagccaattatttgtatttacatacttttctgaagtctattcatcagattttctgattcttagtgaggacttacttaggattattcagatgtggtcaagacaaaagcaatgaaataatcatctgaggttttgtattatctacagatataattctttatatttgctaaataacaaaaggaaatatttttctcttgttctctctgaatgaagggcaattgtgctgtttttctgtcactgtctataattttacttctaagaaatggcatgaaggtatatcagttacataagagggcttttatttgtcctttttggtattttttagtgtttggtttaatgattaaaatatattgtatctcttagatagttaactatacacttaccatatgacccagcaaccttacttctgggcatttaccaaagagaaatgaaaatctatgctcacacaaaaacctgcacatgaatgtttatagcagccttattcatgattgccaaataacttaaaaaagcagcctacatagagttcattgggtgaatggataaaaaccaactgcgatacagacatacaatggaatagtacacagcagtaaacaccaaagcagactcttgatatgcacacaacatggatagatctcaaagacattaggatgagtgaaacgatctggtctgaaaaggttacacactgtataattccatttatatgacattcaggaaaagataaaactatagtaatagagaacagaacagtggttgcctgggattaggagtagggagagaatgccacttcaaaggaataataggattaagactttgggggtgatgaaactgttctgtaacctgattggggtgttggggtggtagttttatatatgtgtgtgtgtgtgtgtgtgtgtgtgtgtgtgtgtgtgtatatatatatatataatatttgtgtacatgtgtatctgcatgtatttgaacatatatacaactgtataccaagagaaaaaaaggtaatttcccagtatgaaaattttaaaagtaaaatttaaaatatatcaaaaatatcatattgttccttataaatctataagcatagagaaaaagctggaagggtactcaagaaacgttatcatctgtgtggagggacttcaaaataagaatctatttcttttgtctttggaaaaaaaagctatttccgttttaaaaatatcgtgaagtcttttgtttagaattggtaaaggtgcttttctaaaaacgctcattttcttgtagcttttggttaataaaaatactcaaattattactgattatttttatacagtattttttctggcagtattaacagtatttgtatatggtgagtgttatattacttctgccaagcttgaaaacagagatgacaagttccgtaagtgtaaaaaaataaatgaaattaatagtttcgtgcctaagagcctctctttgcatatgagattagtacactgttctcatgcttattttgtattataattcacttcttcagaaagctcactttattccattcagttgcaaagcttggatggttggtatgcctataataaatttagaaaattaagttattactgcagtgaagttttcaaaactccatccactcacaggtatttcagttataattttgataatggagaagatggaaagatagatactatcaatattttttcctttgctacatttattcccttatgccttaaaaacgagggcatgatatgatattccatatgctaacgtgtgtatatgtaaaagaaagagaaaaaggaacttgctctatactttaatttcagaatatggctacctttgcttatgttagaatgtcagcaacagaaaattaaatagcccatataattaatgcttgtcttttattccagagtaagtttctttctgtgttttgcacatagtgtaacacaagtttgttgctgttgcttttttcattgagaaatctttaaaatgatcatgaagtgtgcaagtcaaagtaaaaacaataaaacgaggtattcaagtagatactgagaggtaaatgaattatgttcgttttatggcaacatccaaatattttgtgtttccattttatgtcaaaagttaagctttagctggaataaaaaatttcctctcttggtaaaatcagttgacttagcagttttatgcaagaactgaagtattcaatcaacatttttttttccatcaaacttcccttttgacaggaaattctgtgtctgattctttttttctttaaactgcattcaaaagaataataaaagagcaccacatgtcctctttgctgaaggagtttttaaagagataccacaataattattttcttgcttggaagctacctttattaagaggccaattttatactggaatctactattaaaattatgtgactaatgtttcattatgaatcatgatcacaaacagagtcattatgtatgggagacctgagaaatgttcgccaaccacattcaaaaatagatatttgtgtgtgttccagttacattttatttgaaagatcaccttcctttttttcttccaaatattccctttccccctcccttgtggtcctcctcacatctgagctccttttcttttcacagatggtgatactctttgaggtcaggtacctatgacctggagtgtttcttgaagcacttccaatattcggttctactttttcaatactcatgacagcacgcagtctaaggcaaaacagaagtgagggttgattgatcataaatatagctgacaccaccaagctgtcagggagcaggacactgaattgatcaaattttaaaagtggaggatgtgtggagccaaaaggaggtcgccttattttggagtcatcagctgagggctaagaaaagaaaattctggaattctgctctgtcaggatatgggatgggcttttagaagaaaataaggaaactgatttcattgcaacatgacttttggcagttgttttaccttaccttttgctaaaatgtcatccccgcacccccctcatgaccctttactattctccttctctttatttttaattttgtaaattttaatttttgtggtgacatagtaggtatatatatttgaggggtacatgagatgttttgatacaggcatgcaatgtgaaataagcacatcatggagaatggggtatccatcccctcaaacatttatcctgtgagttacaaacaaacaactcgattacactcttaaaggtattttaagttattttttacctcagaaatctctggttcatattatcagagacttaataatatttattgatcagaatttaacatttgaataatttattcttttcttatatgtacagtagtgattgggtgggaagagggctgagttcaaatatttactctcccacaagctacttggcaacttaggtagttggaacctcatgatccaagctctgaaatctttggaaactacattgtaagagacaattggttctatagagggaaacccttgcaaaagttacatgtgctctactgatatatcaaatgtatgtgtgtatgtgtgtgtgtatagtagaactgatggtagattatttcaattatatagcattaatgacaggtggactcaatttattttctctaagcagctgaaaattctcaccaagaaacagccttcctgtattcaccacctttatttgaagttgagaaataaaatgttgccaagtatatccagggtcatcccatttttctaaacacaagttttctctgcactatgacactcacattactgctgctaacatgacgagcttcagatattatcaggaggcattttgtatagtagttaatagtataagttcgggtactagtcctggattcaaattttgggttggctactatccagcttataatcctggataaattatttaattgctctcagtttcaattcctcatcttccataaactggaataatactagtactgacatccagggttgtgaagagaataatctacatcaaatgtcaacagtcattttctgtaacagaccagacagcaaatattttaggttttacaggccatataatatagtgtctttcacaactactcaactgtgcctttatagtataaaggtggacctatacaatacataaacaagtgggcatggctgtgtttcaataaaactttatttacaaaaacaggcaggaagactgatttagcccactggccctagttggcaaacctctggtctatattaatgcttaacacagttctaaacattaattttaattaatgtaaattaaatgttattagttctgtggcatacatttcaacgtatgccattattcaagaatatgtcacaatcatacaggccatactgtatttctccagaaactaaaattactatatcctaaaggaaactaccatggtttgaagatttgtttgtgagaaattctgcagtagcatctggtgatctggtgagagggacataataatcagtaaatagtttgcagtaccttcttatcaactaaatagatgaacgatgctataaaaatgaaacaaaagtgacttaatgaaatcttcagtaacgtagggtcacacatttattcattcttcaaagtagttatcctttcactataatttccttcctagattttgctaaacatatacaactggtagaagcctaatgtgctgttcctgtaacattatattcctgttccttgacttcctgatataatgaagctgattatattccgtgtttgataatgttcatcctattaggattgggaaatccattgaccaccgagcacaaccttatgttcatgttcttatcattagcaccactccagctatggagctgtcagcattttcagcctaaatgctgctttcaggggcctgcaattcagtcataaaaattagctgcaggcagaaacttgatatatgaagtccagatccaagagagaattttattacatttttaacacagagagagaagtacattagaccattataaaaaaacatacaaattagtgtagtgaacttgctctgcatccttttctgttctgacgtaatttaagattgcattcatatctgcccccttcgttttccatgtatccatgaaggaatcttacggatttccagtgccaggtgactttacgacaagttcccttaaggttacatttaagattggaacagagcagcttgagtctctatttgtcaatgggaaaaagattttccagccttttatgaattcaaaattaattagaataaattttctgccataatgcagcaacacagggtatgacctgcatcaggcttcatgttttatgattgagttttaagaactggcttgtgtgcaaagacttttctttgacgtgagattgaattaaggaaacttaattaacattttctaattaaatactgcattgtgaactcaatcgcattgtactctgcaactatgatgagattgttctgtctttatttaaataaacaagatggctcacagggttgagagcttggttgataaccatccctttctttcctcagttgtcacctctgcttttcagaaatattattagccactcacctaactgcaggaatttggtagacacacatttctcaaaaatgctcaaggatactaaaaatgatacctgatctcatgattgacgagagtagtagtctacccatttaatacctaattccagttcattctattcattcgagacaaaccctatttttattccctttcaccttattttctccatggaatatgtgatgtataacatgtatcatgtaatacacaataggtagcgtataatatgtgatttccagtgaccaccatggtgttcaatttaatagttaatgtgccatcctcatcttacttgccccgagagctgcactggacaaagtacacaccatttctccatgatactcatcttcccatggctcccaggacaccacattctcttagtttccctcccaccattctggtcactccctctcactcttttttgctggttagtcctcttccccctagtctcctaatattgcagtgccccagggcttaatccttggtcatcttctctactctccctactctcattccactgatgagctcatcctatctatatgccagtgcctccttaatgtatatactctgccctgacatttctcaaatcttgcatacctaactgtctatccgtctctgctggaatagacactccaaactccatatgttcaaaatcgagttcctgatcttttcctgcggacctgcaccacccacagccttctctgtctcagggacggtaactccagttgtcagttgctgaggccagaatcttagaaataatccttgactttttattctctcactctttacatccaatctgtcaggaaattttcatgcctctcacttgaaatttatccagcatctaaccacttatcacttctccaactcttatcaacctggtataaggcacttaccacagtttgttgctccaaagctctctgttttacattgtcagcaacagtccttacaatgatctacaaggcccaatctgggtgaattcttcatccccccgtcttagcatgtctcctcctctctgactttcttatgccacaacagccccactggccttcttgctgttcttctgacatgccaagcacacttccttcttagacctttgtactcactgcctgcaatgaatgcctgcaataacacatcctcctggctaactccctcacctccaagttttttctcaaatgtcaccatttcagtgagtcctatttcgatttctatttaaaattgcaaacctattctactgccagcatttctgaggtctaccttttctcctttccccatatatcttatcacctttgaacagattatctaacttttgtctgtctgtctaccccttatcatttgcccaccacattaggatgcaagtcccatgggggcggaaagttttgctttgttctttcgtacatcccaagcactgagagtagtgcctggcacatagaagtaactcagtgaacatcagaactattaaaagcatatacaatcagacgggcatggtggctcatgcctgtaatcccagaactttaggaggctgaggcaggagaatctcttgaggccaggacttcaagaccagcatggacaacatagtgagaccctgtctctacaaaaaatgaaaaaataaaaaaatcagctgagtgtggtggcatgcacccgtagtccgagctactcgggaagctgaggcgggaggttcacttgagcccaggtgttcgaggatgcagggaactatgagttcaccactgcactccagcctaggtgacagagcaagaccctgtctcaaaaaaacgcatatgtaatcattgaagaaaattaaattataactatgaaaattcaagcagtcacaatatagtgcaaaactgaatggtttattaaagatgtttaatttgaaggagattttttacaagtaacatttgttttaaattattcttattaacattttaaaagattgattttgcatgatacaagaaggatggtggcttcctatattacagaagtaatattttagagaagtaatagttccagtcattgccacagagttctaaataaaatttgcacatggaaaattaagcatgtaaagcaattgcatcctcatgatttagctaagaaaatgtccaaaacagttaaggtcagtcgtagatttaactcagtgtttcaaaaccatttgattcattggtaccaaaagcaagcgttttacatttttctccaaatctttggatgttgttatttcttctttaagcaccataaatttttagctatgcatgcttactagaagtaagcaataagcaataacttattccttttcatctgtggcttatagaacctcttgctttgtgcatatgttttgcccctctatttcactccagaggttttgatcatatcaagtttcacttaataaagatgagtagagggcaaaaatcagtagtaactttggggaaaagtagaagttccccttaggcattgaattataatcaagtgaggaaaagctattattgatactcattcagaatttcatattagatcattgaaaatctttaggaataatgattgcggagtcaccgctaataacttaatgacaattgaatatgttaaaggctttgaaaaagataaaatagatgtagatgacaactcctgactcagatgactatagtaatttttcataattaccattcacagaatacaatttagatagaaataagagcaagagttaaatgcaatacggagtagctctaataggacctagacatcagggttaatttgaaaattatagttcctaaagtaattgtgttgcagaagcctatcatacaaaatataaaccatgaaataaaatttttatgaacttcttactaaagctgtttttatacccttgttttgatgatttacatttctaatttcacaactttagcccttagttgagccctaagcaaatttatgaaaacatatttcttattagagtacttgaaatcccctgtatgttactaatcccaaccaatgaataagaatttccattctgcaataaatatcattgctatcccataacctatgtttcacttgtacaagaaaatacttcttcagcacaaagaaggaatgattaattcttaaaatattaagaaaacagcctaataaagtctctcaaattccacttgtaaaagcagaaaaaatattagagtaaaatcgccacagattgtctcctcaaatcataggaacatgaaaattggaaactttcagcaaaatttatttttaacattgttcaactgttttgtatagaacatttaacgttaagaagcaattttgtggtttgaactatttgcatgataatttctggtgtggaagatgccttagagctgtgttgcttcaacttttcacatcagcacagtaacagtggggccaatttggtctctttatgtatatttcaacattaaagttatttttagacaaatctaccattggaagattattgttgcattggtggtggtgagtgagattcagctatgtcaaatctctccatttaaaaaaatgaggctgtcacatatttcaggacttctctgatgaggtgtcacagtattttgatttaacagactttgtataactatgtggatacaatagcaaaagtttattttcatttttttttttgtaaattgttttgagctaggtcagaatgatttctaagcatacacacgctaaaacaatgctaagacatagaaaacagcaaatttttcaggctattggtagatagtttaataagttcgtcctcttttgagaggtctagtcacctgtgtctagtgttggatggaaaggggcttggatccactggttagtcttccttattgtctcagagaaggagaaaagggctttatcgtgaagaaaaatgactgatggagctctatatacacaatagtataatttgaatttaataatcaactaatagtaccaaacaatttataacccccataaactcctaacacccgatcttcattttcactgtaataattctgtcgcaatacaaagtgttcatagttttttcttgtatttgtcaataagatggctcaattttggatgagaatttcaaccactgttgtttacagaagttaggattttttttttaccaccatgttgagctccttgaaaaaattaaaggtaaactttttgaggtgaggtagcctttgtgaataacattgcaactgaggaatttttttttttttttgagacagagtcttgctctgttgcccaggctggagtgcagtggcatgatctcggctcaccgcaacctctgcctcccgggttcaagcaattctcctgcctcagcttcctgagtagctaggattacaggtgcccgccaccacacttggctaatttttgtatttttagtagagatgtggtttcactttgttggttaggctggtctcaaactcctgacctcaggtgattctcccgcctcagcctcccaaagtgctggggttacagatgtaagccaccatgtctggccacaactgaagaatttgaggtcaaaatagtcctaatgaaggctatcattcttcagctctgcctttcatgaccctttcagtgtacatattcatctggttatattttcagtcaatttcttggctcacccaagaaaaaaatgcatatcttgttgaaaaattcctcgccaactattttccatcaaacagtttttcataggtcttcacagggagcgttattttaaatactgagactccaaggcaaatgaaacaaccaattcattatgctataataaaaccataagaaaaataacagaggtaatctgaatcgagtgactggttgttccacagtgtttttaaaagacgcttcttgttagtgttagtaaataaaggtgtctatgtttttcagcttagctacctctttttggctcaaatcagattctactatccagtttttaatcaaattttctcttatctataattaacccttcaaaactaaactttaaagttcaacttgtttcctttttatgactagctgaaaattttttaattgtaaaagaaaaatgcttataattttttctatatgcatatgattgattttaaaatgtcattgcaaaaacgatggcctcatggcatataggttcatgtttttttgtgtgccagacactaaaattgaggctcctttatattattaaattgaaactcatgtttgaaataaactaaatacagcctataaggtttagattcactgcagtttactgctgattggaatacttttggtatcgagtttaatatctgacacaaactttcatcatttgtgatattcccttctaatttatcttgcatatttccaccagtttgaaatttgcacttcaaacttcctatttttattcatgacccatttcaaaatatgatatattaattatcctttactgtaaatatatgtactcaaaggggtttggtaataccctctttgtaataagtatgaaaagaagtgtccaataatatggattgattaaataaatataatccatataatactctgtagctacgggaatgaaaaaaatagagttacttgtactgatagaattttgtgctttttagaagatatatgtgtatgtgcgtccatacatacatgtgtgtatactgtatatgtgcgtatttctatatattcatgtacatatgcatatgtttgtcatgtttgtctattattatacacacgtgttgtttatatatgtagtattagccaagaaacatacagaaaaaactgtttccatggttacctctgagctctggggagtgaaaccaaagcacagaatgtgggtaggagctctttactcttcatcatctatcctttttaactgtttcaattttttttttactatgaccatttgatttagtatgaaatttgttatatatatatacacatacatatgatatacattcatacatgttgtgtacatttatatcatatatatattacattatatatgtatctatatacaatgtagtagctatcttcaaagaagattttttataactaaagataagaatgttaaaagtgaaggaaaacctcaaggcccaaataactttgtttgtagtatttaaattctgctttttctttctattctctcactgtctattcccttcatcacttaaattcattcccactaaaaatgactcacggacatagtttggaactagttgccacatcacctcaaagttaagggcagcagcttctctatttacagctgggaaaacttgtaactaagagggaggccatagctttagttaaatcggcatccaaggaaacaaaataccagaaattaacaatggttgcaaaatggagtcctagcctaatccctctcctttctaattactccctaattgtttcttaaccatgtgccgccaggctgcagtggttggggtatggagagtgaagaactttttgaataaggcaattcttactctggaaggactaacgaagaacctgattgtaactaaaatgagggaacagttcctactatttccatcaaattcattctgcccaaggaaaaagatgatgatttgattttaattatgctaacagcatttcaatagcctccggagaaaatgcctgctttccaaaatgcagatcactaaattatactgtgcctcctagcaactcctactactgagaattcaaagcttatctcaactttactttgttttaaccatcctaagatttcagtccacagctttcccataggctctacctgccttttagtgtctagaacacactctcacggcatctgggtcttcaaacccacacagttcctgtgagctattcaagataggtcaggttccagctgaggtcaggcattgtgatcactcaagttaaccctcctctaaaccctacctctagtgtcctaaatttgctttttgtctcagcagataaaacccagaggttcccaaacctgctgtgcatctgagtcatgaggaaagtttgtgaaatagattcttggtttctcagctacactaatacacggcaaggcttgctatcctttcttccagttcactgcttctgggtcctgcatgctggagcaccaccagtgctgcctcacctctggcctcctcctgacaaaggggtctctacactctgcactctgtcatctgtaaccagccttcttaggcacaagctgccttctattttttaactcccagtttcgtttttatgaactattcaaatcaaataattaagaataacatcaatgatgccagcaccagtagaataaggcacacctttgctttaggtcagatttccttgttcctctgtttcctgatgaaggcctatgcttctggactttcccttgattcaagatgagtgttctgcttttccaaatggccatcagcagggactaatggtggtcactattagtcttcactgacaggctttttagtccaaacttggagacatggctattgagcccagagttctcctcacaggcactgaggcacaggattctatgagcctcctctaataggtttcattcacagggataatgacatggatggatatggttatattcatgtaggttttagcaagaaagatgctgtccactgagagctacctgaaagattatgatacacactcttggaaaagaataagaggagcagattaaaataaaaatctttgcttaacagtttgagttggatggcttgatgaattgcaacacctaggaaaagaaatcttcctaggttatcttacagttatgatttttttaagtataaaggagatgagaacaataccaatgtaattcatcttaaaagactttaacctgtactaaagatttgtgaaattcttcattaattatgattgactattaataccatctcaaagattttgctagacctagaaaggctttgttaaataattttccatgtaccccatactctcacagatttaaaacctaacactgggagatagtctatcaggcaaaattatgaacttatatattgatgtaggcatagttgctcataggttccaaaagttaatatatacatttccaaaagttaaatataacattgtggttttgattacatatcacgttttcctttcccgctcaaatgaagttttaacatgattgcctagatttggtttcaaatttacctgccttagaaactgtcactcaaatgtacaattactttttcaatgttaagaagaatatgttatgataagaggttcctaaagaaagcatttcatagttctctggcattgaattttttttatttgttaccttgtttacttgtgtgtgaacgagcataaagtgaaccctcagaggacaagaaaaaatatcaggtatttctttatggatttaatctctgaaaattttccatcatcactaatgatgtcccaggagtccttgaagctaaaataacaagatatacaatttacacatttttatttagatgcactcattgtttgcaaataactttgcaatctgataaagaggcaaaaagataaactataggtataataaacttgaataaatggatagaatttagaatgtatctgggggatatatcaagggtctgtttggcaacttgggaagatgattggagaaaaggacagaaatacttgaggaaatctttctgcatggactggatcaagtctaaattccaaaatactgtccagccatggaatggcaggttagatgacagcttagagcgaggattggaaatgggaaacaatgtgaggatggcaaaagagggtatgtctcaagatgagattcaccagagcagagcaaagcagtgaagagccttcacttcattggacagcacttgctctttctccctttacatagattaaccttgagtttagcaatgcttatggagactgctagagaatgaagggaaacaagacacaatctgttaagtaaagaagcctagaaacattgggtatgtggaaatataacatgatggtgctaacagtcattatggtgactctcatttgtagaagactagttctgtttcattaagagataggtttcagcttgtcacctagtagatcttatcttaatcatggctgtgtatgttgactcacataccatttttactagtatgcacatccaccgtttactgagctgttgctctgtgctaacttacagtgtgctaagagctttatatactgtattcatacagttaatccctataacgaacctaggagtgaaatttttcacacccagttttgcaaatgagaaaattaaaatatcagaataagtgacataactttcttaaggtcaaggagataataaaagataggcttctattttgacatagatttagctgtctcaggggcctaaattcgagccaccgcatttatgttttagaatagcgattgcaaattgttgactggagcaccaaaatcagcctggggacctgctttactgattctacatactatgttttcagacaatctgaatgtgcatttttatggaggggagtgttaactggagtcaccgtgcatcattgttttaaatcatcttgacgtttaagatttcagtttttcatttaaggttacaggttgaataatatttctccctactttatcaaaatatatatcatatatatgtataaaataaactagcacaacagttatttaaagacagttcaattgtttgtactgagatatacaaacagaaacatttgggagaaatattacaatattcgtaaagaagccagggacattggttttgcaatattgaggtgacaagtttccaaaaattaattctatactgatttcagatcctattttccatgaatagacacagccagagggattcccttctgtaatcctcatccgtatgcctctaccaaccaattaattgctcattactgcatcaacataagtgtgaatttgttgacagagagacatttaagaaagaggttgtaaatatgtcccaatggtcctacgtactctggaatgtgggggaaaccataatcacagttaattcaatgtcaaatttcttattcaaatatgtatttccagttacggtgataatttttcattcatgctcgattgtgatgatttttgcttttattttatgttattctccattacggaacttcattttgttttacacaaaatagttaatataatacttcgcagtaagggcattttgaaagaacagtggcttaaaaacaaaatttatctttgtgtttcctacgaggtggtaagccagttagtattcaacaagtgtttataaaattatttcattttcttaaaagcctataataaagatattaactggagaaagaacgttgaaaattcagatgagatgaccagtggttttaatacagaagagacagttttcatatttttagcacatagaaaaaattgtaaaatgtgtttgctaaattccatctgaacattatcgtaagaaaacctcacaaatattttaatttcttaagtaaaatagcttatttcatttatgccctttactactttattttcactagataaatcatcaacgttttacttactttttcaaaaatcccagtagaacaatcatgtttgttttgacaaactctagaaggtttttatttctattaatttaaatagacaaaaagaagacacttgaaagcagcacgaaatccccagcacctttttacgagattataacttgtgtataaaagtaattaacattttctagtatcatattttaaccagatcagagattcttaacccaggattcttggatctacaaattaattttaaatggccttaaaattgtacacacaaaaaatattttcatggggtggggaagggggacaagggctctaccattcatctgttcttttttttatttttgagacggagtcttgctctaccacccaggctggagtgcagtggcatgatctcagctcactgcaacctctgcctcccaggttcaagcaattctcctgtcagcctcctgagtagctaggactacaggcacccacaatgcccggctaatttttgtattttcagtagagacggggtttcaccatattggccaggctggtctcgaactcctgacctcaggtgatccacccacctcggcctcccaaagtgctgggattacaggagtgagccaccgcgcccggccccattcatctgttctttaagagcgtttgtaactaaaaaattttaagtcagatttggaggaagaaaattagaggttttggggaggataagtcttgttcactgaagagtccctttcacataatttaaataagagctattgtgtatgaagctgggcacagtggctcatgcctgtaatcccaacactttgggaggctgaggcgggtggatcactttaggtcaggagttcaagaccagcctggccaacatggtgaaacctcatctatactaaaaatacaaaaattagccggggtgtggtggcacatgcctgtaatcccagctacttgggaggctgaggcaggagaattgcttggaggtggaggttgcagtgagcaagatcgcaccactgcaccactgcactgcagcctgggctaccgagcgagactccgtctcaaagaaaaaaagctattgtatacgaattgggctgctattatttattctcagtatttaatagtgaagaaatgtcttttctaatcatgcttatttatccattcactttctgataagcatttattgagtgcttaatgaatgctagatattgtttaccaagataggaactcagaaggttgagcaatctggggagaaatatgactaatcaaattgctgacacattgagtgtgagatgcttgtgggatatccaaatggagatgtccatggagggcagaggtccaagccaaagacttagatttgaaggtcagtaaatatgggtggtaaagtcattaaagtgtttgatgtaggtaagcccattcttgcatgtatagtgtgagtagaggatgaatgagagaaacagccaacattccctaggtgcgtggagggagtaccttccagagaggctggaaagtggttgtaaaaaaagccagcagagaaagacttccaaaatgagggaagagtaagctataccaagaatgtagaaagatctagtaaaataaagacataaccattcaaactgggaatcaattttagtggaaggctatcagtggacgtcagactgcagttagtagatgggaaacgactttcagtgtgctgtatgtttaaggaaatgattgattgggagataaagtcagaaaggacctcattacttagcacctggtatgtgatattttataaataccaagttaatggctttaactgggaaataataaaatcattttcctcctaatcccagaagacaatccactgagagaatgggatacttaaccaggggagaagacagtgataactttggcataacgtgtatcattcagagttcaaccagagaagtagagcagtagggtattatatatgtatcctattaggtgtgtgcatgtgtggagtttgtgtgtatacacatacatatagatagatacacatatattttacagagaatcggtttacaccattatagatctggctaagcagtctccacaaagctgtctcttcatctaatatcagagcctgaagttcacaggcaggcagtcaggtgggaagatcacaagcaggcttgaattccactaggatagactgaaacctgtgttttttgttgttagttgttgttgcctctgaccacggcagtaagaatgagcacacatacctctggcccagaaatcagacactgaaggaagatccaggggggaagagagcaatcccaggtccaaatgatgctttatgtcaatgaggcaagtcagcataccagcagcagtatgcatgtgtgcacacacatatgcatgcacatacacacatactgcaaaatggcaactgccttcctaacatcctccaactagtgtgaaagaatttatcgtgtagcctaccctaactggacacatgcaagaaaatggaattctggtaaatgtagtttgacctagcaagttggcacattacagagccaatacaatgcgtactttcagagatggcaagccttagaggctactagagtaggggttctgggtaatcattgtgcttcatgaaggtcctgtcacttggtagataagtgaaggaagttatgtagaaatctgagggtgggaccatgaagatcagcttgtttatcctctcagttgttctaagggcattgctgccatccctgttaacaaggggattaggaaataactgattcaatttgcctctctactacttccaccattcttaataataaaaagaaatgaccagtttctatttatttttttttcaggcaatatttttataagatgaatgatcttgattattacagtgaaaataaaatgatctctcagaatgttctgaaaacagttgtacaagtggaagttacagtgttggcttaaagaagagaacataaatactattcacacttctttagctgtactaaaagagctatagaatgtagccttatttattgttatgtaaaccagtaaaacttatccagcaagtgacaggaccttcatcctgtaccaaatccctgtttttggagtaagatgccaatggaaatagtggagctagtttaaaatcaaacatcagttcaaccaaactgatttaacattttcatttgtgttggggaagctcacggtctttaaatatcgatgagaaaggtgtctcttctaatacttgcttatgtgctgttaatgctgtactcccaaagatgatcgctaatctataatctaatctatacaactacacttttcaaaggatgtttagagtcacagacctgaacctgacttagggaaaggtgtttctccaagagcttttctgtgactacagattgttggagaaaacaggtagtgaaggaagatggcgcatgatctgctgcgctaccatgaagtagaatatatggtgatattttaaggctatatgtttacttttgcctaaattataaaagcaatatttttatattataaaaatttaaatgttgggaaataaagactcatataaaaaagataacaaagaagtaactgagatatgtcacaagttctttaaagcttcatccgtggaatcttaagaggctctctcctacttcagatgagaaagtcaggaagcatatcgtttgactaaacagtgatataaaaaatactaattaagtgacatttcagaattgcagttttgaaatgatttgctgttctgctcacaagaatcgtagttatgtttactaactttattcattttgtcttaatatttgctatagctgccgtgggcatggccacggcaaatgtaagctatcagactgaccaggttgatcacatcaatgaggaatattttcattaatccaagatggtgtttgattcagaatgcgcatcgtatcagcaacacttgccatcgaccattaaatgtgaggaattccaacagttagttagcaccaaggagttaacgatatgaaacatcatccagaactgaacaaatggctttactccttcctgtatcttgggctgtgtggaagttgtcagggtttcctggaaaagagttagatatgcttatatagattaaatatactaaagggcattccccgtaacagtcaagtaagtgttgggtaaaaggcaagtttattcatgtaactacagatagaatacgaatagtgtgaatgattccgtaagtattttagggaaagtattcatctttatgcaatgaaatatataaagtggtcattttcctaaagacaagaagacagttattttaattgacttccacaacttcccacttagagagttgctagtattaaaaaataaataaaatatcactgccatgaagattaagagtgatagtcagaaaatggacttcagaaaatgatacactttctttaggtaggaaagcagtaaagctattctcaagtgataaccttttattagatgctggcaagtctgaaatgctccttgacaatctcttttattgaacgaatcttgaggactataaacctagatcagtgccttataatccttgcataaggctgttgtgattaaaaaccaagtgaaaaacttcccaatagctcacagaagagtaatcagtctgtcttagtatttattagggtgtgtgtgtgtgtgtgtgttttaatgggatactgcttaagtatacaggccaggagtaaaggtaacaccatgagggagggtaaaggcatggaaagtcagattgggaactccaaaaagaaagaaagaattttgagggttgtcagagcttctcaagagatcacacgtttagagacaattcaaatacttttaaacaataataacaaaaaaatctactgagcctttagtttcatgatcagaatgggggatcaaagtcagaataccaggattagtttcaagtgattttaaagacaccaatattagaatggactgagacaggagatacaggttgcaaagagaaataaataacaagtcttcctcaagaatgaaaagaactctgagagacgtagctttggtcatagactagaaatgagaataacagtgaataattttttttttttttttgagatggagtctcactctgtcgcccaggctggagtgcagtggcgcgatctcggctcactgcagcctccccctcctgggttcaaatgattctcccacctcagcctcccgagttgctgggattacaggcgcctgccaccacgcctggctaatttttgtatttttagtagagacagggtttctccatgttggccaggttggtctcgaactcctgacctcaagtgatccacccacctcaacctcccaaagcgctgggattacaggcgtgagccaccacacccggccaacagtgaattttttaaatactgaaaatatctatgaatgctaccaaattctgaaactcttcctgattaactcagcacagaaaattccctctcattttgagcttcagttgttcaaactgcttccatggcagttcaaactgctatgtctccctctatcaaatggggacaacaaagccaggcttcatggtatattttaggctcagaagctgtcagaagcattttactgagccagtatggagaagagacaagcagagcaaacttctgcctgaaaaacaagcagttaacactgagtacttctaatataatggcgactaacaaaaatccttctaggcagaaaaggagaaaacacaaaacagtgagttcactgttacatcttaaataataaacaacatgcattagccatcatgatttcctgcacttgccacgttataagcttataaagcttcctaaaaatatttcattagctttgaaaactaataaatctaatgattacaatttatatttttaaaaacataagaaaagcaggtttgtgcctaagaccttgagtgtcaagaaagtttagagaggataactcattaaagtgtacagcgaatcataaaattcaatttgaattgaaccttccattttggcccaacctatccatgtaaaaaccagcaaaacaaatcattctaagtcacaagctgctgtatgtgttttagaacagatactatttactatattacccctaaataaaccaaggtctaagtaaatggtttctagcttttctctagttaagctaagttctttcttaaaaggaaactcgttctaattcatatttttcttctcgaagagggagcttatatttttctgtttctgcactttgaacatgagtattgtgggaaagtattaggggattagcaggagataaacgtggtttttgtcttcaccactaagtggatcaaattagtgggtatatggccatgattttattctgccacactatgacctgtgagacaaggtggaaaaagtagattctagaggcactgatggatacaggctaagctgggtaacaaggataccccaaaatgtaatgtctttgatcaaattgaagtatattatttctctcgataaataaaccaatagctagcagccccagaccagtcaggtgattccattcaattaagtcattcagggactcaagtcccttatatgttgttgctccccatttttttcctcgtatttctggtggaagccagttcactgatacatctgctttccagtctgcaggaaagggaaaaataaactccagggcatgcagctttatcataaaggaaatgaccaggaaattgcacacatcacttcttcatacatctcgttgacccggtctcaggcacatggccacatgtagctgcaagagaagctaagaaatgtggtctacaactgggtagccacgtgcttacctaaaattctagggactatactactaaaaggaagaaaggactaatagacactgggacacatttagtggtctctgcctcaagaggtatcagccagggtttggagatgacgtattcagcacaaaaaagataaggcagtgtttggacagggttacatgtaagttgtgattctcttgaacagacccctagtggtcactgacatttgaataaactgctaggggtatttcactttcaccaccactaatattctttactttcctcctcctttcatttttctttccgtcttgctcctccttttcatattccaattttccccccatatttttcctttttgtttcaactgctcatgatactgaggtctaaagaatttactgagtaatgagcacagatgtatgctttctttatgcatttttaatggctgatttaaatatacttggaggctaaaaatgcaataatttgctttaaatgtgtaggactctggaaagatgagaaagcactgtaagagttaaataaatcaagaaaggatttggaatagtgactatgtaattaaaagagcagaaataaaggatgtgccttatcaagatgtaatcacaaatattggaggataaaaagacctctgtattaaaacctaaagatatctgcattacaaaaaatgttcactttgtggatgacttgaaaaactttcgaaatgagtacaattataagcagatctgatgtttttgtcagaaagcaaatcacgaggtacttcttccatccactcaactcaagggtaacaatggctgtactttctgcccttcatcatcaccaggagtttctgagtagccttttagagcaaatcaatttcctggcaggtgagtaatttctactgtatagtcatcattttcccgcatcatttatctaagacccatcttctcaacactcaggtgcaacatcacaccttcccaggggtgaggtcatcaagggcatctgggtgttaaatgtttgatgttaacaagagggacaccccctcttctggctggtgtccaccgattgttctagacaccatgaacttttgtttcatgcaggtagaaaacagccatcaagagctaaaatttgagcccttacaagaatctttttactacccagcacaatgtggtaataatattcccacttctcaggcccttttccttcaagtgaataagatttcctctctattctagaggagccatgctactgcctctcttcatttgattactgtgggaaatcccccagcagcttattccaagttcactgcgcagccctctgattcctgaaaggcataatttggcctaacttgatatatatactatatatcatcacttacagtaatgtttgtcccataatagtaatactactactaataataataataattgctaacagtgagtgagcactcaccatgggtactataaatttatattaacttaattaactccaagttatttgttgttacttaaattctcttataatctattgatcaaacaattgagttgctttgttcctaaaagctacaaaaatatatagtaatgtagtataaaatctattttcataaagaaatctgacactacagctgaattatggttagcaaatttaaaattcataccttgttttcctcttgtgattttgtctccttgaaatttgagcagatgttgttatatctttcagcaatcacatcctcaactatgagcttaatataacgtacccctttcattacttttcctttcttttagaattcttagataaatctctgatttccaaagaactatctgtgctttgatattggcaactattatctgctgtaggtcctagtacttatttaggtaaaagatcttaatgaagttccaacgaacttcatttgtctccgtgtgtgtgtgtgtgtgtgtgtgtgagagagagagagagagagagacaaagaaattcttctcttttttcatttctgaataaagctttctagaagagccattcagtgtaactaatgacaaaagataaatatgttttgtaaaccactttgcttttatcttaaatggggagtcttcggcaaaacatttatctttaccatgaccgtagagtaattttaatatacatgattaatggtgcaaatgaaattaaaatccccctactattcaacatcttagttaagaacaaaatgctcactgtttcctaattgcaaagagtaaaatgtctggatgttgatgctttttaattagaggagaattttctttttaattaaaaaaagagagcttttttatttttcagtaagttagagagtgtcctctagtggagagagactctgatctcatagttttagaaatggctatatgatacccagttagaactgtgctccacttagctgattggaatctactggttgaagggaaaaagtattgtttttcctctaagacccctcaaatcatggcctagttaaaaggctgcagtgtgacaagcattgttctcattttagataggaatgattttttatgatcaattttagcatgcttccttctgaacctgttgaggttgagctgactgtgcacctttctgccaaaaaggaggcagaagcatttagtgcaatttactgtggcttttacaggtatcaactggaggcagcaagaataccattgtcttcaggactgcagacctggctgactgatatatttgatgtgtgcagatccctaggccatagcttaaatttgtttcttttattatttgaaggaaaacaaagaaacaaaattgagagacaaattaaataaaggtctctcttctccttaacttgtcgaattctaatgctaatttcctgtatttctggttaaatgtgctaagcagtcttagctctatcacttgtgtatcagagatgagaggtggaggagttttttcgatatctaaatggaagagggtacggaagagctgtggtggttggctctctgaatcacatactagaattgccttatcagaaattgcttattacagcaaattagagactgaaagaaaagaacgatagttgctcttgataacaagctaaatagcttggacttaaataaagataaaaattttattgctgattctttttttaattttaattttttaagttctgggatacatgtgcagaatgtgcaggtttgttacataggtatacatgtgccatggtggtttgctgcacccatcaacccgtcatctaggttttaagccccgcatgcattaggtatttatcctaatgctctccctccctttgcccccaaccccgacaggccccagtgtgtgatgttcccctccctattccatgtgttctcatttttcagctcacacttatcagtgagaacatgcagtgtttggttttctgttcctgtgttagtttgctgaggatgatggcttccagcttcatccatgtccctgcaaaggacatgatctcattccttttttatggctgcatagtattccatggtgtatctgtgccacattttctttttccagtctatcattgatgggcatttgggttgcttccaagtctttgctattgtaaatagtgctgcaatacacatacgtgtgcatgcatctttatagtagaatgatttataatcctttgggtgtatacccagtaatgggattgctgggtcaagcggtatttctggttctagatccttgaggaatcgccacactgtcttccacaatggttgaactaatttacactcccaccaacagagtgaaagcattcctatttctccacagcctagccagcatctattgtttcctgactacttaataatcgccattctgaatggtgtgagatggtatctcattgtggttttgatttgcatttctctaatgatcagtgataatgagcttttttcatatgtttgttgactgcataaatgtcttcttttgagaagtgtctgttcatatcctttgcccactttttgatggggttttttttttcttgtaaatttgtttaagttccttgtagattctggatattagacctttgtcagatgggtagattgaactttctcccattctgtaggttgcctgttcactctaatactagtttcttttgttgtgcagaagctctttagtttaattagatcccatttgtcaattttggctttttttgcaattgctttggtgttttagtcatgaagtctttgcccatgcctatgtcctgaatggtattgcctaggttttcttttagggtttttatggttttaggtctaacatttaagtctttctttaatccgtcttgagttgatttttgtataaaggtgtaaggaaggggtccagattcagttttctgcatatggctagccagttttcctagcaccatttattgaacagggaatcctttccccattgcttgttgctgattcttatatttgaaaaaaagggggataaggagagtgttcataaaatccttcagtaatccaacaaatgtcagagccataatgaacaataaggcaaatatattcccttttatagataattttcagaaacatgtatagtcgtgactcccacacagatggaagaatgaatacatgttaaaaaattttttgctgatgtgatatgaggggaccaagcagatgttatgaccagttcaaaggaaatatcaaagcagcagatttacacagattaaagaaatgttgagatgaattgtaaatggagacaaaattgtttttttccccaggttataggggggataggagaggtgagtcaattaaatcactatcagacaggagagaatttgtacccctatcagtgtcctacattttacagagtcaaaatatagttcaaagacagtaaaaaagcctttgggaggccgaggcaggtggatcacgaggtcaggagatcgagaccatcctggctaacacggtgaaaccccatctctactaaaatacaaacaatcagccgggcgtcgtggcgggctcctgtagtcccagctactcgggaggctgagacaggagaatggcgtgaacccgggaggcggagcttgcagtgagcccagatcgcgccactgcactccagcctgggtgatagagcgagactctgtctcaaaaaaacaaacaaacaacaaaaaaaaaaacataaaaaagcaggaatccaataatctggaagggtgtgccatagaccaatgagtagttttccaatgaaagatatttctttctacataactttgtaaatatatatatatatatatatatatatatatatatatatatatatatatatatatatatatatttctgtagcctggttgggttgccagtgacccagttttatatcctactttcttgtctacaccagctacttctctacctacaactgccattattgtgaaccctctttctctttcctcttctccagcctccctgtccttgcttcctgcttacaggacctgccctaatatttttcaattttgttgcttttctgagccccagttccactttaaacaaattccaaggtaaaaacaaattgttctggacagttaactgtaatcacttgcatgaaaaaatcacctgagggtgcttgttaaaaattcaaatccctggaactctccagacttgacttgctgaatctaaatctggtggggggtggaggtaaattttttgacaataaatttggaactcactgacttaagtaaaataagaaaaaaatgtaacatctaagccatatgactctaagctaaatgacattgtagaatatatgggagtataaaataaaaactgatatgaaagttagtggaaatatgcaagaaaaagcaaagttaatggtagcattagtaattgctagtaataactttccctaaagttcctatcacaatctatctagcactaattattttcaagttgaatatctggaatgtcaatctattaattttttaatgtccattctagatgctatgctaagtgagttttaaaattatttttcctttttaattgaaagcatacccagacacacattaaataaacacaaaaaataaaaattcataatcattctgttttttctttgtatcactttccattctactgaattttactaattataaatttaaatcttttaatcttgcacttttttgttatttctagacttcaattttaagaaattatttttcctccacatatttataaaatatatactttctcctatatagtatatttatttcatagtaatatttaactctaataaatcccacatttatttttctatattatatgaaactaatttttgtttttagaaaataatgcaattctgataactcattgcctggagttaaatctggtaccatatctgagcactacaattgatttcaaagagttgtaccactgcctgcgggataaacatgatgttgtttttttataattgttttaaaatacattttgctctttgtttagaccaacaacgtaatgtccagatctatcatcattacacttctttaggatagttgttgacaatatctacctacttaaatttctaaataaatatagattttgttgagttctacatcttattggacttttattagcattagcattacatctaaaatgtaacttgggaatggatttgtttaattgtttattgctagtataaataggatctcttctattttctaattagtaactgtagaaatcatggatgataatgatttctaaatatcatagaccataactaactacagagtttcttcttaaggctggcaaaactatgataaaaatcagtgtctcttagagaataagattaaaaaaatttaaatcacattaactatagctaaactgtaagtacattaaatttattgctacaaatcatgtagtttaaaaaaaacccctcaaatttgccagatttacaaacttaccccactatggaaaactggctttcttctgaattgccttcatcaattatttattgctgcagggttgcaataggctgaggtagatgctcttatggagtatctaatatttcatattaggcagatagtgtttcatttttaaatttcaagccttgtgcctgtaatcacagctactcaggagaggggaagaccgcttgagcccaggagttcaagaccaggctgggtaacatagcaagaccccatttcaaaaatatatatatatatatatataagcaaacttttttaataattttagaatctatgctcttaagacccacattctctcttggttttattttgcatattctcttttgagtttcttaagggtatttttgtctggacctaaagttctatccaaatatattgaaaaaaatgggtagcccctcctttgagaattaccacatagactccatttgatctataggatagtgagtcttatttttacgtgattatattttgtttaaaataactcaaactatagagaattttatattttggaataccaatacaaaagaatgttatatcaaaaggacaaatttttaaattttgctagtaagtgattacaatatatgtcttagatttgaatatttaaaataactttttaaaaagtcaaaatatagggctttttaattggttaagtatgcaatcaggttatcttcaaacaatgtttttattgaaattggttcaatatatgaagcctttatttggcaattttcatctttatgcactttccaaatgttagctagttaatctgcttaacaatattccattaaacagttgtacacattttatgttcatacactcctataaactttaacaataataataataatgatgcttttatcagctttttaaaacatctcattgctttgttatatcctattgtattagtaaaacttctaaaacattatcatattaaaagaatgctggccaggtgcagtggctcatgcctgtaatcccagcactttgggaggccaaggtgggaggattacttaagcccagaagtttgagactagcctgggcaacatagggagaccctgtctctatttaaaaataaaataaaaaattagctaggcacaccaacctgggtgacaaagctagaccctgtctcaaaaaattagccaggcatggttacacatgcctatagttccagctacccaggaggatgaggtgagaggattgcttgagctcgggaggttgaagctgcagtgaaccgtgattgtttcactgcactccagcctgagcaacagagtgagaccctatctcaaaacaaacaaacaaacaaaaaactgaaaagaatgctagtaggcacatttctatataccaacaacatccaagctgagtgccaaatcaagaatgcaatcccattcacaatagccacaaaaaataaaataaaatgcctagaaatacagctagccaggagggtgaaatatctctacaataaaaattacaaaacactgctgaaagaaatcagtgatgacacaaacaaatggaaaaacattccacactcatagataaaaataatcaatattgttaaaatggccatactgcccaaaacagtttaaagtttcagtgctatgattaaaaagtcaaaacataacagatgctggcaaggttgtgaagaaaagggaacgcttatatactgctggtgggaatgtaaattagttcagccactgtggaaagcagtttgatttctcaaagaacttagagctaccattggacccagcatcccatttttgggtatatacccaaaggaatataaatttgtttttaccataaagacacatgcatgcgtacgttcattgcagcactattcacaatagcagacatggaatcaacctagatgcacatcaatggtagactagataaagaaaacatggtttatatacaccatggaatactatgcagccatcaaaaagaatgatatcatgtcctttgcagcaacatggatggagcgagagaccattattgtaaatgaagggaaagaaaaccaaataccacatgttctcacttataagtggaagctaaacattgagtacacaatacaggtatacttgagggtggagggtagagggtgagaggaggctgagaacggaaaaactacctaccagataccatgcttataacctgggtgatgaaataatctgtacaccaaacccctgtgacatataatttacctatataacaaacctgcacatgtacccctgaaagtaaaaatttaaaaaaaaaaataatgcttgtaggcatatttctattgaatttaaaggagatgatactgtgagtcccattgtatattcttgtttaacatatgtttacttttaaatatttggaatggaatattttcagtatttcttaataaagcaagcctacaataatttatttagttcctaaaacttgccaagtaaaaatatagtctgattttataatcatacattttataaatcattttataaattcattatagtgtttataacacaaaagtaggtaaataaaaagcattttagatatgatgttgacaattgcatgctacgatccaatgagaagcctttttatcttgatgttttcataattttgaacagtactggtgattagcaaaatagctatatttaataataaaattttggtttaatatgaatgttagggaccacaaagagatcctacttcactctcactaggatggctataatcaaagcgacagatgctaagaagtgttgacaagcctgtggagaaactggaaccctcatacattgctggcaggaatgtaaaatggcacagccactttgaaaaccaatttgttatttcttcaaatatttaaacataagattctcttatggcctagcaacatcactcctaggtatgtacccaagaaaaatgaaaacataatgtccacacaaaaacttagcagcagtattcacaatagccaaaaagtggaaacaacccaaatgttcatcagctgatgaatggataaacaaaatcaacatatgggatatattcacacaatgggatattactgatacatgctatataacatgaataaaccttgaaaacattaaactaagcaaaagaaaccagacataaaaggcaataatattgtatgactacatttataccagatgtccatagagacagaaagtagaagtagattcgtagttgctaggggctaaaatggggagtggctgccacttggtacagggttcctttttggggtgataaaagtgtcctaaaattgattgtggttctgattgtacaattctgtgcatatacagaaaaccatggaattgtacaaattcatgctatgtgaattgtatctcagtaaagctattaaaatatgcatactatgtatgtaaaaaataattttatagacagtagcatctggtaaatgtttaacacttggctctaaatgtagttctgccaagaatacagttcatatttttgtttacattagctaataaaacaatggaggtgcatatcagaactttactcactcatcagtgatgtaaatgagttctttgcggaatcatattttagtaggagaatattttcttgatgtttgtgctattcccaatatggcagctatagacacgacatacttttaatttaacctgcattattaacattttccctgtcacattttaagtacagtcagtcaacaaaacaataaatcatagcctgatttgtagcatttgccaatgtatggagtaaatactccccctatcgtctttttcaagctaccaacataatgtcattaaacatatagttgagaagagatgtgcagtagtacactattgtatagtatttccaccatacggatactatagctgtaaacaatctcaaaagatgagtgaatgaatggtaaaatgtagcaaaataatttggaagttttgagtatctattatttttgtttttaattttttttgtatttctataatttaattttcaatgactgtgcttaacagcctgctcacagaatttctgaaaatgtggtaactgacttttgcaagctggtgtggaataataccactgaaataatacctgaatgaggaggctctgtacttacttacaatgtgaagcctagtttacacgataaatttgggctgtggagacatgtagacatgtagcctttaattaatgaagctttaaaaaaagggaaacaaggtaaaatgaaagttcaaaggatattaagcaggttattcattaatttgagattatgtattgagttcttaatatattcaagatgctgtaatgggtcctggtaatacgaaggtaaataaagatataatttctgcctttggggaatgcatagtcaagttgctgggctagatatgtgagcaaagcagatactgaaaggactatattatgataaaacagaaatatgttccaaagtctatggagaaaggagaagagaaggaggaagaaaaattaaatgagtattttttgaaagcgcaggcctgcattttggaagaagtttcatttgaattggatttaatggatgaagcgtgtattaggtgaaaatgagaatttaaagcaaagaatataggcttaaataaaatcaagagactataaaatggaatatgaatgggtgactcccaaaattcagatgctaaaaacctgttgtgtaattggcatatcctagttcattggccaaaggtacaaacacagtcccatcatttattactttcataactactatttatcctttttaatccttatttgcccttatttggtggacatacatcacttattcctaagctccaccctgctccatgaatttctatcaagtcctggttcttattgagattcagaggaaaggataatagtccttcattcccactttcaaacacaaggtaatacagttgggttccaacgtcacagctctctgacacaggtgtgattaattactttttcccaataaatagtacctggtgaatccagcttttctccacaacactaaggcccctggttagagactcaggtgtgagcttgacctcacctggcctgctctcagaattgactccattggactcctagtgtctaggctgtgagcagagcaatgcataagaagtgaagtggtaactttgcttagccgcacaaatttgtacaattaagagaaaccactgaaaagcctcttcacagaacaaagcactgctcaaattgactttctgttctgcctatattgagaagcaactggcagttcccagatctctttctctgtgtgggtgacacagtgatacacacacacacatatatacacatatatgtatacatatataaacacacatatatatacatatatatagagagaaaaatatatatattttctgccttaacaggattcctacttaatgtctggtttaagaggttccctattatcacattgataaaaagcagagtgttctgtaattactgctaccacctatgctttatcactttaagaaattatgtggaaataatctgatctttgcagtgcttattccttatgtgatcccagagtattgtaacattctcaatccttgattctgtctgatccaatctcaggtttgaaaatacagtaagattgttctctttagaatagagatgtgattgcgtcagtctcctatttgaaatcttccctcaacttcccattgccctgaaatggaagtctcacattttccacatgccatacatagaacagcgctgctcctgctcttgcgtcatcagggtccattcgtctcctaatcttccctctacttgcccctcgtctacactttagcttcagccccttcaaaactattttattttccccaaagctcccaggctttttctcactcatgctctttcctctctgtccagagtgtttttctattcttctctccaccgtcttctattccttccttgaatttcactgtcttacccacagcaagcccatctcaagactggttagagttctcctaggtgtccccatagcactgtagatacactcagtactggagccccaggcagggtggggtagtcaaagaacaggtgagccaagatggctgagaaagcagattgcttcttacatgggtgcaggagccattttttaggtgtggcagcacaaggcctgcaggtaaaagaaaagaaatgaattataaaattatgaaaaataaaagtgaataaaaatgaatttcacagttgatgtcggaaagaaaggagggtgatgtgagacagtaattcaggttccaatgaggaggtcaatcggcctctctgctaaggaatgtcagattccttatttatgatttttaaggtcccatatttactaaaattgtaatggaaaattaggcaacacctggagatttctatttatgagttccaggcattaagtcccacctaaaaacttaaacttggtcttataaaagacagtataaattattaatatatacatttttaaaactgtaatacatcttgattccattggcatataatgttaatcatcatactaggtagtattttgagacttattattgaattcgtgactaccttggcactataacagatagtcctggtacaaaaaaaaacaaaaacaaaaacaaaaacagtgctcttataaaaatgtaaacacaaagaatatttgatttgaaactgttttgtaatgttggttgacacttgccgtagaaatctgcaattgatttccaatcaatggaattgacatttattcattttgtaatgtaaatattctctaaaggagagggaattttatactaaaatatttctgtacaaagattaataataaagaaacctccttggagcctcagtttgcctcttaaaagtttgtagatattttctggacttgccttatctggtcatcagtgatgactatcacataaaaaatccggctggacgtggtggctcacgcctgtaatcctagcactttgggaggccaaggcgggcagatcacgaggtcagtagttcaagaccggcctggccaacatggtgaaaccccgtctctactaaaaacacaaaaataaattagtcgggcgtggtggcacgtgcctgtaatcccagctactccagaggctgagcaggagaattgcttaaacccgggaggcagaggctgcagtgagccaagatcgcatccctgcatcttagcctgggcgacagaggaagactctgtctctgggtttaggggcgggggaggaatccaagtctgtgaggaatctcttggagaacatgcagacataagctaaaatagagaaggctatatcatgccatattagaaatattagaagagcaataattttcatgaattattcttaaacaacgaacataagagaatacgattttatcctataaaaatgttgtcattgtggaacttgtagaattaagttacagatactcatgccctagtttagaaagattacatgtaagtgcattctgcttttctctgtgtttatgctgtagaatctctcataagcaaaatttcaagaaatacgtactatcaactcatagcttagccctgaggcttccagtacttaagaaacctccttccttgctccttaggatcgcagagttctcagggccctctggtaatattctttttttttttttttttttgcatttaatttttatttttattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacgtatgagtgagaatatgtggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatagctgggtcaaatggtatttctagttctagatccctgaggaatcgccacactgacttccacaaaggaaacaacaggtgctggagaggatgtggagaaataggaacacttttacactgttggtgggactggtaatattcttaagtatctatggctaccacaaattgagagtttgcttacttcaaatgccagcaaaggtgttgctttttcattttcagcccctcacgtggtgcccatccctgagagttcctttgccccaatccagacttacaagaccccatcttatccctcaatttctggttccatttagcggtagcaagatcttaaaactagtatctactggaatatgtcagttctgtaatgctgactgaagcttgagtaaaccaggtgcttgtaaagtggcatgaaatatccagaaataaactttactttctacgggcattaaatttacttccaccttttagaaagagacttcaatttaccttattaaataactgaccaatctgtattcaccactaaaacattctaagtagcgtattgaaataagctaatctttacagtagtataactgattttatctgtgatgaaaatcccaaatatttattgtcacgatttttgttttttaatgtgtttttctacctatgtgttagcttctttaattcgaatgttattctctatgaattaaaaatattttaatagcattctcttaggatcttgcgtttatggttcctttttctttgcagccaaagattttctatctcccacattcgagactgagaaacaccttctatctgccctataaaatcttataatcagcaacgttatgtaccctttgatatcatgcttcgagaagggcatatcacctctgtggtatccttcgcaatcattcatgacctcaatctaatcatgagaaaacatcaggcaaaccgaacgggaaaaatgttctgtacaatagccgaccagtcctcttggaaattttacaagtaactcacattccattaaacaagccatgttgtcgaaagcacacattctatcaatttgacaaagattgaaaatccctgaaaaattattcttttagaaagatattttattaaatcaatgaaaagtgatcaaaatgttacctgtcagtttgcctaaaataagtgtgaacaaatagttttataacacttttccatcacttctctctgcaggtgactctgctaatctaacctgcagagctttctttgggtacagcggagatgtcagtcctttaatttactggatgaaaggagaaaaatttattgaagatctggatgaaaatcgagtttgggaaagtgacattaggtaattttttttccttttaacctgtatagtcaagattaacatttactccattagtgaatagaaagtaagctgaaaggatttttttttgttttactagtatcataataaaaatactacaatatttaatgataaagaagcaaaacactgttaacagacttactatggaattgcaaaacatgaatgccatttgcaaagaatttaagaaaaataacgaagattgttcattaagccacatactgagtgcggctgggggtggtggctctcgcctgtaatcccagcactttgggaggtcagattgggcggattgcttgaggccaagagtttgagactagcttggccaacatggagaaacgttgtctctactaaaaatacaaaaattagccaggcatggtggtgcgtgcctattgtccgggctactcgggaggctgaggcatgagaatcacttgaacctgggaggcagaggctgcagtgagccaagattctgccactgcactccagcctgaacaacagagtgagactctgtctccaaaaaaaaaaaaaaaaaaaaaatatatatatatatatatatatatatagtgagatcaaaataccataaaatatagaaaatgttagtgtactttttgtatatgagaccttttttttaaaaaaaaaaaaaaaaaatgttctttgggaggccgaggtgggcggatcacctgaggtcaagagtttgagaccagcctggccaacatggtgaaccccgtctctactgaaaatacaaaattagccgggcatggtggtgggcgcctgtagtcccagctactcgggaggctgaggcaggagaatcacctgaacctgggaggtggaggttgcagtgagccgagatcgcaccattgcactgcagcctgggcaacaagagcgaaactctgtctcaaaaaaaaaaaaaaaaaaaaattttcacaggaaacattaacaaggtacagggactcaagcaaacacaatctctgtcatttcctgctacgtatttttacatatttgagccaccaagtggaatataagcttttgatggtagtgataaggatacacaaaatgtgtttatcgcctttcttagtctgactttaaggtcgaaatatttgtatagtgggaatgataacatgaaaatatttgaaggcataatgcctaagccccttttttgttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagccaccgaggcaaacagcacagtagatgggtgagtaactcagtctctaaaatcaaatttgaaatccttgcttttctttaataccaactgtgtaactttgggcaaaacatttaacttccctaagctttagttatctgataaatagaatggggaaaataatagtatcaacccttcagtatgttgtcagaataaaataagacaaaaaaatgtgaagggcttgacagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgcgccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaatgtctgttgtgctaactctgcctctacagcaccccatcaccttttgcatagggttaagtgcatttaaatgtatattgaattgtttgaaataagtgacaactgtaaaatgtgagccattcctgttagtaaaattgtttgtgtatattacaagagaaaaataatttttctacattatgctaagttaaaactttctactctttggaacaagcacacttgatgttctcttactcagcaaatttacaacgattttaatttcaaagcccgtgtttaatcctagactctttgaggtttgaaaagaaagagaacattgaaggctgttcccccttctttattgggcaatagattccctttgaataatattactgaatgctgttaaaatagacacctctgttgtcaaggtgactatggtactaaaatagtctaccttttagggatgtgagtcaaggagaaaggtatgcagcagctaacaatatgattgtatctttctatagtttagtatatagccaatcaaggaagagattttagtagaaatatcatacatatacaaggacagaagtagcttctcatagttaaaagcaacttaagtgttgtgtaattgaacttcttatcctgccataacatcttctgaagtgatctatcagcttatactggatcacattcccttctcaaggaagtccattttatctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaaatgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttgatcattgagtctctaaaaagtcaaatgtctgtcatgctaacaattatgtaattatcaggtgagttgctatattactcagaatactaaggcttagataaggaactggaagctttcactattaattgtatttttctgccacttactcataaattccttaacttataagccttcacagtcttcccttttaaaacctccctagagagacatgttcaaacatttgttgaatactgatcttgtataccacaagctgtcattgcttctgacaggtaaaccttccaggacattcctttgccaaaattatctaagcaatttttccttcactgttaccttttgttcattatcattgacataataaaatgatttcagagccctccaatgggtggtatggattctttgaaacattgcttccttgtatcaaatgtgtcttccttaatgccaaggggatactataataaataattcagctacatttgagctaggctatgttctgggtcagccttttatctgcgtaaaagaatcataattccatgaaagcctgcagaaaatctaccaagaaatttgaccatagaaaaatcttgctcgagaatatccaaagttgccaattcctgcagccagaaaaggtattaggttcatcagaatctcatcagacatgcaatatagatatatttcacttactatacagagcactagaatatgcagcaagagaaagacagagaatgaaacggcaaggcccatgggccatattggtttatgactgccctgctccttactcttcactcctgccagaagcttctattcaatcctctttgccagactctggcctggcaagcttgagcattagatcctggcttcaaaaataataatcaaagtaaagcgctgacaaattagatattgggttacttcttgttcttgttattgctcatacttgattgaattccacatctgagtctttgaatcttttacccagatacacttgctactgcctgtccaacacacactgaacactgaccttcagttctcctccaaagctctgatctgtcctattctctccattttttacattttccatttctctgacacaaacaatagtccaggtagatacctagaagtattgtgctctgacctcaggcctagacactcttgtacccatcaagctgtctcagattccttcttcactctctgtgccttctgtctatactctcattttgaatgacctcacagtgtagacatgtttattatcttaatggttaagagcatggacttaggagtagggctggctgtgttcaaaacccaactctgttcttactagctgtgctatctggggcaaattacttaatcactttgagcctcaaatttctcttctataaaatgggaataataataagacctctcacatagagcagctgtgaggattcaatgaactcgtatgtgtaaatacttatcacagtgtctgacacatacttagcacccaaaaaatgttaagctattacaagatttccttgctctaactatgtgatactctggctaatgaaggatgcagcaattgtgtgttccattaaaaattccctgaattctaattcatctttcattaaaatcatcagctttagctccagcaattttgttctgtcaattctgaatttgactttataatagatatactgtggtttgaatgtactgtcctaaaggataattttgtttatttattcatgcatttaatgatgactaagaacctactatgtgcctggcatttgtgctggccaaagttacaggcatgaaaattaaaattaaatgaacaggaaataaggactaatataatttggaatgccatccactactttttaaattacagtgatattaaacattcctaatgtatgattgtgcttcctagtgaatgtttcactttgaaactgtcacattggggatgttcattagcaatcttactctgaagggttatgtttccttatatggattacaaaaatatggcaattcattaatcaaaatttagtttgggaactggcaaagtatctatctgagagactcagcactagttaataatgataaacatctaggttttctttatttcccatctaacccattttacttcttgtgtgcactctctttatcccttcaaagaatgtaatcgatagaaattagacctgctcaataaactccctagacctaaaagtatctttagtaatgtaattaagtgcacatcatttaggatgcattgttttaaagccagatgaatttaaacccagtggactcctttaacccttcttgtaacgaatcatccttgtaatatgtgccccatccttgttagtatttgcctagtgaatttatttactgagagttacagtaaggtcataaaacggtgcaaacttcttttggggctggccatttgacgtctttgaccattgatttcagaatatgttaaagccaaacttcgttcagaaatcaaaacctcctacctctctttatggcagcatttccctagaaagacaatgacccattaaaagctgagctaatgtcaatgaaatggatacttttactgagtcttagcttatgcagtgccaaaatattaaggaattttagtaatgttgctgcagcatctccaaataaaagtcaacaagtttaacaaattctctccttggataagatttgacattttatagtcaaaattttcttctgtcccgtaactgtttttttttttttttttttttttttttttttttgctggggggggcttctctgctcatttgtataagacgtctaatagcacaaattatccaatactaatgattttgtacctctgcacttcttttattatttatgtttatttttacagacaaggcctcattctgttgcccaggctagagtgcagtggtgtaatcatggctcaccgcaacctcgaattcctgggttcaagcaatcctctggcctcagcctcccttgtggctaggactacaggtgcatgccactacacctggctatttaaaaaaaaaaaattgtagagacagggtctccctatgtttcccaggctggtcttgaactcctcggcttaagcgatcctcctgtctcagtctcccaaagtggtgggattacaggcatgagccactgtgcccaactccctgtgtgcttcttgatacggatattccaacaaggctattgattgccaccaaagttgcagacatgactattaaccacttgagctatttccttagacttagaatatattatttaaatgagattaatcccaagttagttatttttttgcctcaaccgtgaaatgttttgaaggcttttttttttttttgagacggagtctcgctctatcgcacaggctggagtgcagtggtgtgatctcagctcactgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatgcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgttgtgggggctgtcctgtgcattgtagaccgtttagcagtactcctagcctctgcccactacatgtcaatacaaccttcctcagttatgaaaatcagaaatgtctccagacattgccagatgtccccaggggtcaaaattgctcctggtgacaagcactgctctacagtatagatataaaaaactcagtcttcctggaaatgatttcaacacttaagctgctcaatgtagggaaattcaaaatagaaggacaagtattttaatcttgaaaaccttccaagattataccaaatgtgactagaaggtcaacagaatggctgttcttacaccataggaattgacaaaagttaggtttcttctatttccatgcttagagagtcagctaaaagcccctagaccagtgcttcacaaactttacagtatgcacaaatcacctgggaactttgttaaaaagcaattcattagcctggggtaggactcaagattccaatttcaatcgagttccttattggtgttgccactattggtctgtggaccgcagctggcataccaaagcccttgcctagacaatagatctttctaattagcttggtagcctctaataggtaaagagaaactagttatcttgagctcactgtctccatgagaaaggaaccaaagctgagtagagccagtcagtaggactgtttttaattaattgcctcattctttttacatggtcaacacctttgaacctatttgaacagtggttcattgccctcacactctactcttaatgaggttacttgtttcacctattcaatgaattgtgctatataacatacttgctactcagagagatgtctgacagggcattttcttcaagtattcaaataattaacctcttaaatgaagagggccctcactgttggacccatttcctatttatctcattttttaaaaaggaaataaacttaggaatgtctcaacgacatatatatggatatacacatatgttttagcctatgcaaataggttgaatctcagcctatgcaaataacatatggaggaacacgatgtatggtgaacacgaaatactgctgattttctgttttgaacacttacttgtattcagctaactctcaattaagtgtggtaagaaaggatggaaatggtatggaaattgaactgccacatattattggtcaatgatatgcttcaaaagcaggagggagggagggagggagggagagaagggaagagaagggaagggagggaaggaaggagaggaaagaaggaaagaccatagaccatagcaacacagactggttaaaaccatctctccgagttcaaaagtttaattcattttaaaaggcatctgtctagcatctaacagaggctataaaacacaagtatttttacagctgaagcaactaaactagtgtgtgtatagtcaacagtacacaatgtatttgaatactgccaatttttatgtgaccactgagctgccagtggcagcagtctactcaagtgagggcagaaggaatccactggaactcatatcgatgtattagaaaatgataaacaggcagtgtagaaaaaataattaagtttaaaacatttgcaggaagcccacagaaattatctagcacacagcaaaattccacttgtgtaatcagagattccaaacaagatagtatattcctagccaccacctaccaacaaccaacccctcactcctccttctcagaaccaccttcatattttcattatttctgggtcaaaacaacctgttgattgacaatacttcataatcccactacaaatctcacttcactgcaggctgcttaaaagagataattcatataatgctgttgtttgaaaaagcgacaaatcattctaattcaacaaatatgtattgagtgccagctatgggcaaagcactgggttaggcatccttactagtggactgactgaccgctgccagaaggatatctaccaccatcctggagcattaaaacagcatttttgggaagagggagatagctgtgcatttttatggctgcaaattcctgcatttggtagagaaatggcacaactgggtcataaaatgcaaggtataacttttaataagtagttcctgtacgttgaacttttgacaaccaggtcagtaaagtgagaaattagacatgacgcatacaaaaatgctaactactatctcgggtcatatagtagggagaaaacgtgttgatttccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaatttaccactattttcctcagcatgtttatgaattcagaagtgttcataaacattcaacatagagaataaatatatttttctgttattcccactgggggaaatgaaccaacatatgatttttgctttaatgctttgtaactctggaatcaccaagattttgcatgaaacttgtctcaagagataaactattaccaacaaattttgccacacacattttcttctaatgctttcagtaagtcagaaatccattaaacccctaaagaaacaatattaaaataataacataaaattctgaagtttattaatgtatcccatttgtatattgcaatacaatcagtttatatgtgtgtacaatattttctaaatgtagttccatcaattaaatatactataaatcatcatactatatttgtttagaagagttcaatatttctgtagaaaacatggcttcttctattggttatctaggcagtccagatgttctgggttctttggccaatccaaagcattcccaatggaagaccaaattgttctaactatgacaatataccctcttgaggaaaattgctttcaggataaacatcacatcccttaacaaggagtaaaatggcaatgccaccttcactctgacagttttctctcaagagatgttttgtaacattccatctgtgcctgtctgtttgtatgacatgttaagaaggaaattcctagtagagggaaagcaatacttttctaaggtattttcttttaggcatcagtgaagtttgacaccttgatatacaatagccctgtcttctaagctggtcacctgaggccctttttgtttgttattataacagtatcttccttctttgtctgtcttctccccatcatacttaatcttatgagatctgagataaaggaagccccatctgaatactttgtacctgtatgtgtgtgcaaacacacataatggtctgtgtacatctcacattatagtctttagatagaaatatttcaaacactgcctttataatctaaaggggaaaggttttctgcaataaagctctgtctgtgttagtaacttcacagtatacattttgaaaatatatggcaatttttcccaagggagaatcattgtcctattgtactgacctaactttgcgaaacctggtttaatgggttccatgaatccgcaaacaaatatttattgaaaaggtacatgctatttgctttgaaaataaaaaaagataacatattctagctgagaaatcaaagcatgagtttgcctaccttcacctatcacatcacacattcattttcccagtgctccagaccaaactacttgccaaaatcctttgcagctacctttgcattgtgtcattctgtgtctgacccctgtctctaaaatactcctacagaaacacacacacatacaaataccccaactgaatttctcatctggcttataattgtgatacttataatgtagcatttcttatataaaaggggtctagcacagtgacacttaagtgctcaataaatatcagctcttattattattatttattattatctgcttacatgtctgactctgaaactagacatgagcacctttaacgcaaaaacatatttcatccatcactttcactttatcactagaactcaaaagcactgtacctggtacagagaaggcacttataaaacaaatagaaaatgtatgtattagtaagaaaatttgaatagcagtatcaaagatgtgaagcagtacatgattgatttccaaatgtcaagtgaatacaaacattcttagttctgtaagtctatacaagactgtattgtcattagctttgtgaatgaaaaaaagaacagaaaccaaacaccacatgttctcactcataagtgggagtagaacaatgagaacacagggacacagggaggggaacatcacacaccggggcctgtctcagggtgggggcctaggggagggatagcattaggagaaatacctcatgtagatgacaggttgatgggtgcagcaaaccaccatgccacgtgtatacctatgtaacaaacctgcgcgttctgcacatgtaccccagaacttataataaaagaaaatggaacaataatttttaaatctatactatgaagttgatcatttttctatatattaaaagtttattcctaacttaatggactgaatattaatgctataattataccttatcagttgcttgaaccttaggatacattgactagatacacagacatattcttggaattttagaatagaaacacataaaacctagctttttattcaaaattgggtttgttcttaatcatctaatcagtcattcattttcactgaatatctttaatgtgtcagatagttagcaaggtatttgggataagtagtgaaagatatagacaaaatagacaaaaaaaaaaaaaaaagagagagaagacaaaaaacttgtcctgatggaatttaaatcccagtggaagacaaataataaacaataatacatttattgataagcaaatgaaatattatgttatatagtgatgaatactataaaaaataaagacaagtagatgcaaaatgcagccacaggtttgtgacttggaacgagtggtcagtgtatccaattgagaaggtgccgtatgagcagagacttgaagaagcaaagagagaggcatgtagaaatctaggggaaatactctctagtcagagggaagccagagcaaaggtcctaagataaagtcattgcttacaatgtaaaacaataaacaaaactaactctgatataattcaatatggtaaatgaaaaaaaaaaggaacaggaaatacatgttctaaagaggaaaaaaatcacgtttagttggaaaagttatattggaagtgcaagatcctaacctttccttgaaggactggttgggttttggtaaatgaagaacttctggtttggaacaaaaaactcatgtcaaatttaatttacattagaaggatgattatggctaaaggttagttagctgcttcaattaaaggaataaagaaacttaaatgcccacataaggggtttagactttgttccatgggcaatgtaaatcagctaagagatcctgcagaaaattccagggtgaagacatgatctgggaagatgaaattgaaggctttgtgcagattcgtgtacaatagctgtaaataacagaattttaatacaaaggtaatcaacctgaagtacactctaattacaataacacttgcaattattatcttacaatttgaccttttattttttaactttctattttggaatacaaaaactgcagatattatagaaaattacaagaacagtgcaataaattttcatatatcttctccacctagatttaccaattaatagatttgccacatttaccttatctctcttcctacatataggtaggtaaaaagagctgcactacatatacacacacacacacaacatatcattgctaaaccccatgagagcacattgcagacactgaaactaaattcttcaatgtgaatcccctaaaaacaagaattttttatgtaaccaggatacatttatcaaattcaggaaaattcaaaattacaaaatgccattgcctatgatatagtctatattcaaatttcaaaaattgtcccagtacataccctttacaccatatttaccatctaggataatgcactgcatttaactgccaattctctttagtctcctttaatctggtatggttcctcagcttttcttcgtctttgataacactgacatttcgaagagtagaagctagatggttttattttttatagttgtccctcagtttggattggctggacatttccttattttttttggatgtttatgtgtttctggctataatactacttaaatgatattgtgccctcttattgcagtacaccgggggtgggggggatgatatcaagttgtcccgttattggtgatgttaaatttggtcacttccttaaaatgatgtccatttttccccagtgaggaggtactatgagacggtgtgaatatcctgcctcaccaatctttcaaccaataattttaacgtctattgataatttttgcctgaatcaattattattatgatggctgaaaaatggtcatttctaactatatcgttcatttcatatttaccggttgacattctgctcttagggagagctttcccttcttgttggtttatttgtaactaatatgaacacatggatttgtgctttattcagttactgccattattcattttaactcatcttttaaaacataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgcttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacactgatgtattgtagaactgagttgagtatctttgtaggctgagcataattatcctcctgccaggaacaaataagttatactgctccagagaaataaatatgcatatgaatttatgtggatggataaattcttataaactttagctctttataacacaatgagagaaaaagaaatgtacctggtgaggctaatgaataaactgggatcattataatgtctgtcatgcattttccccacaaacttgcattttactgcatataaatgagggaagaacacttcaaaagactttttataatgaacgaaccaactttaggataaactacacaaaagtaagccatctaaaatcttcagttataccttctggcaaaattctatatatataggaacacacacacacacacacacacacacacacacacacacacagatcaaatagagatactgactaaaaactgcaagtcaagagttcaaaaatacatatgaacttttacttactttgttaaaagctttaccttttcgaagatttctagcagaaaatgtttgcaaacaataacaccaggtacaggccaagaaaagaacatagtttcccatagtatactaggtaattgcagcaagatcagtggaaaccaaatgcatttattatttgcaatgtaattcaatatactaagagatggcacgcactttattttaattagctgtttcttttaaggggttgcttgctcccactgtcttgataagaaaaaattgtagtcattgctcaaaatgcttgtagcaaatctagttttaaattgaaacaatttattccaaagcagtctactactgcagcaataatcaatgtgttttcccttagcctgtactggagctttcctaggactattgttaattgcctgtaactaaatgatcgctggggcccttaaatgcaactctttggcacttgttcatttgttgtttttaaccaaatgccagttttccctaggttttgcctagcaattttgctttacaattttcaatattcagtctcagtcccttaaagggggcagagtctatcattttaacaaaatacacaaaggctaaacagattttaaaaggtctgcatttctccttctgtcctcagatgttgaattgtgctgaaatgatatctttttattttttaaatgctgccactccaggcaacttgaactagagctgaaaagtagatcccatttcaaagggaaaatgacatttgctggggcaacaccatttacattgtaatgtaaagataaaatacagcagtgggcccaaatgatttctcttaactgtgacagaatttaatccttagtaattttgtataacccaaaggataagcaataataggtagcgcatgtattaatgaatctgtctggcttggagcaaaagaatacagaggctaaatctaatgcacaattttctttgaaagggttttcatatgctatataaaccagtgtgacttaaatagaaaaaaaatttaacttgcatacatgtataatgtgtaggcttgtatattacactcctgcatagaaatattgtaataactgaggggcaggcactgtgcaccatggggaaagacacatttccattttgttcctgacctctttataaggacattataagaacactatgcttctgcaatgtaatactacagaagtctctgggggaaagtctgtgatgctctcaggatctcaggataaattagctccttgtaaattctgtttctttagacttgtttttggtattcctattattagtaaatgactatctatggcccagaagaattattcttgcttattgctcattctctaagcatatataacttttcatatgtttgtaccctaaaggagtttttcatgtgacacaagactgtttctgtaactgctaagctacatcaaccctgctctctttttcttattatattttaaacaacactattgattggctatgtagagtattctaagtaatgtatatcatttcttaaatggctcgtgacatgtagcaatgggagtaactcctatctgggtaattactttgctaaaaataagaaggacttattttcatacaatttttctctaatttacctgtattcaatttctcaaaattaaaaaagtatgtagagaccagtattataaataccatctggagaaaatgagagttctgtttattagattgatcagattatatttcaggcaaatattttttattatttccaaagctcctcgactatctatgggcacttaaggcatgccacatgcccagcccctgtgtagtgcctccagatataaagaatgtgcttgggggcaccgtaaaagaatcattccctgcctgggcccttatctacagcagagcagctttcctgactcccagctttcttcccacacttctccccacataggcctttggttagaacttacgtttttcttaaaaaaagaaaaatcaaaatgttaaagaattgaaatatgattcacataatataaagcgtgtagctctaagtgtttggctaaatgagttccgacaaatataaacacttgtgtatccacaccataaacctatttcctttaccccagaaagtttcctcttgctccattccaacaagtttcccttcactcatcatcaatgaatctattttctgatttatgtcactatggatcatgttggtctgttcttgagtgtaatttaaatagaatcatacagtaggtattatttcttgtctggcttcctttttctaacataattttgtgagagtcatgcatgttttgcgtatcagtagtttactacttttattgctgagtatattctatcatatgaacatacaatagtttgttcatcatttcctgttaatggacatttaagttgtctctatttgtggctgctgtgaataaataagactattctgagcattctcatacaactcttcttgcagatatctgcttatatttctcttggacaaatacctaggagtggaactgctattgatatggtagatttttatttaattttattagaaattaccccaaagtttacaatgtggtaatatcactgggtactctcactagcaatgtttgggagtggaagctaagtgttcttgattctttttccatttctttttttgtacaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttgttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggatttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagtctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaagaataacattattttacagctttaatttcagaaatgtttatatttaattgtagttaaggaaactagtacttttcaaggtagttgtcaactgcagggaacaatggctacccatcagtaacaacatttgggctgtgatgattaccgacaacgcttaaagtgagtttcaaaaatctatgcatgatggcttactatttaaataccaatatccttatttttgttacaatgtccatggttctaaagaaggaaaaaataacaaaaaattttatctccaagttttcctgataagttttgatctaaggtagatattcagtagaaaaaggagaatttgtatacagtgagtgtcaagaaaattccttttttggatagaacgtagtaacatgcctggtaaaaggggaagcaaaaatcttaaaaagtaaacggttgaatgaaaataaaacaccaccaacatattcatatactgtcccatccactaggaggcctacttcttacacccaaaaagcattcagcctccaagattatggtagaccaccttggtatcactgtattcaggaagatacagcagaggagctattgctcctggcaggagtcagcagacagcattcattagatagtcttcccaacattctatgcaacaatccacagtgctctcctgaaactgtgttgtttgacctctcacctttctttggcccccaacccacaggtgacagctcaagtgagagggatcaagattctcattgggagaggccaaaagtcatcctggcttaaaagcttcatatccacaggaatcagtatttattttatcaaccccataagcatagcttccgggatctccacaagtgatacatttatataagagagttatggtactctgttaaacccaatattatagtttccaatcagatatttacaattctcttaatccaaatgcaagctaccaaccaaggttcatttttaccacaagcaatgttgcttagcaacatggttgtcacataccaccttatctagttaccaaggaaacagagctagaaagttatcaaaaggtcaaattctcatgcaaaaaggaaaggggttgtgtcaacccgttaacccacatctgatctcatccaggaaaatgtgaaatcaaactgagtttaatttatgattttggatgtgaataccatataattccccattgtggttttttctttctagagctaatgtacacagtggaacttgctggaggccttggtgctatactcttgctgcttgtatgtttggtgaccatctacaagtgttacaagatagaaatcatgctcttctacaggaatcattttggagctgaagagctcgatggaggtaggatgttacctcttttattgttctttctgaatgttctaatttctttcttgtctttgttttattaaggggaaaaaaattacgtgcataatcaatggcagcagctcgtatattctttcagtgctcagtttgtaaatttctcttttgtaaggaaatgtgtgatgctttatagccaatactgtaggtattttcctctgaaagttgtaaagcaacacctatccattttagaattgtattccaaacacttacaaattacaaacactgattgcaatgccatcagagtgttccttttctctcaccttgtaatcaggactgaaaggccagttttacttttttttaggtaaggagtgtctcttttaattgtgttttctagcccagtagtttgaagcgaatctcaatttgctcctgtttagactgatccgttataataaactgtactgagtattttaaattcatccagcagtcttttcaatcttgtttatttagctatatttagatagcctaatttttattccaagtgtggaccaacagaaaaatgcacaagcacattaatttcatagtaatgcatctcatatttttactgtacgtagacaaataaatattgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccattttactgataaggcaactgagactttcagaggttaaataacttactcaagaagataacacaaatactgtaagtgtccaagatgggatttgaaaataagtctattcccaaagcctttatcttatcggatactctctattatttgtattttttttaaatttagtatgttcagtatcatctaaagatctactgttgtttgcacaattagcacagtacatggtatttgaaaaagcacattacctaaacaagtctccccttttctattaaccctgttttgaatatgtttattttgtgttctgaatgagatgaatcattttaccaaactatcaatttctagggcagtaatctgtcattttctgaatgtagaaaattctggaatataatgaaaatgaattaatcatacgcagtggaactttcagtgattcgaagtttcgtttagtgggtcctgctaattgtaaacacttcagtgactgacttgggtagccttaccatatttcattgctgttctgaagctgctgggttctcagttttttaaaaaatgttttaagtaagaaaacaaagcagacagacactaacaaacagtattctaacagatgagaaggttctcttggaaagcaatttagttaataaatcctttagcgattcttagaactctgtctctgaggccatcttaagcacaatcgagggtctaactattagggcttttcttgaaatgccactgaaaatgaattagacccaaagaaaaccaagataacaaacttaactgtcatctggaatatgttaatgtacaagttattcccctaaaaagcggggggcagggggaagcaaagactgtcaaggcagtgattgttcaaatggttttatgggaagaaattattactagaaccgcaatcacatgttcagcctccctatattaaagcagacccgttcctgctgaaatggtggtcagggccccactcttaactcgtatctcccgctgcatcacacctaacctctagaacttccagacactgttttatcagaaccatacagcagtactaataattatatagcaagtttaaaatctatatcttaacaaaagttagaagtgtataattgcaactttctttaattctctagtgctctaaaaccattcagcttggctctcaagttcccatttctactgagaaaaaactcataaccttgcttctccaagattactccgtcacttctggtttggaattcagcttcttgtgggttaacactcagttgaaaattggaatattccatttcccttcttctcttttactcttgtttaaacctgtttccagggaactcatatgtagctttctggtaaaggaaaaagtcacctggtgcatatgccatcccttcctcacttgagatactaccacctggtctttggacatgttgagcactgacttctgaaggcgtagatccttgtcatggcctccagtcacaagtttcacacacttgcccagatgtttctcccttgggaatttcagacattcttacctgtgtttctagtcccataaactcggctacacgcatacccaccttcccattaaaaaaaaaaaagtaatcatcttcttcatcctttgcctctttcatatacggtttccacattgagtgcaggatttctctatgaagtttacagtttcccaagattttccctgggaaacttgacacaaatcctcgcccttctcagattctgcctcaaaccatatgaagttctgttatcctcttctcctctctgtggccctgagggcccccttctcagaaacccatgcaggctgtaaaccttagtcacagccccttagagcctcctatacatgcttttatggtcaaagaatggtctactcttccaatagtgaaaaacttctctgacatcatcaaatccccatgcttcctagctctgcaagctttttcctcttccaaagaagagatggctattcaacaaaacccaaggctttgtaaattcttgtcttttaaaaaatgtaatttagagtcaaacctgagtattgccttctttattcatggctatcatatttaccttccctgaaggggtaatttataaaatacttttgaaagtaagataaggcaaaaagtgtgaaaaataaccagggaaaaatgtttaataatatcctactatagcaatatgataataatagattcaatggccatttattgaataacaagtgatgtgttgactactttatcaataatcagagaatcacacaattagaaagacagaatttaagctccggtctaaatggctctaaattccaagatatacagccattttatcagacttgcagatggagtttctggcatcagggacacattcactcagttcctttggagtcattacaaaaggcattacctggctatatcagttctttatcagaaggattatgattgatatagaaggattctaatattttttaaagatagaacatattgatgcttttctctctcagttcgttcacatcactccttgttcccctctatataaccttacattttattatctcccctgcattcagtccttagcatttccaattccacaacactccccgcccatactcattctttgtcatcctccattttacacctcagttcctggtatcaccttctatctcattggccacactttcccctcatatgccatttctaattagtcatcaatatcagtcaattgcacctctcaaaaatagatattttccttacccttaattgcaactgctttgtccaagcctcctacaccaccctcttgttttcattctctacttctctatcttatccttcacattctaacagaattatctaagtacaaatttactgttccattttttaaaatgcctccattttgcctgctagaacagtctagacttagctcagaaagcaattgccatcaaagggtgacccaccttacttttgtagcattgccacccccatgggatctcaacatgcagagttctagttagaataagatgttagtctttgtaataacacagctattgagaatgaacctaagacaatgtaatcttgcataattctctgaggtttttggggaaaatgaagtaaccacaatggttaaggggaggagaagatacgctatccccctaccactttgattccacaataaaaggaaagaaagtttggataaattctgccagaaaaatatttattagcagacagccttatcactcaacttataaatcagaagaagttccaattctgttgtatatgtgtgtgtttgtgtgcatgtatgaatctgcatgtgtgcatgcttttcagaaaccttgcaagaaattttctcccaaggcaaatgtggcaatactccagtggtaggattgaactcaccttctgttgacatccaagaataattttcatcaagaccattttggaattaagcctagaagatcttctccaagggggcagaccactggccctgctagatttttgtaagggtgggaatgtgtttctaaattgtgttaagtaattcatatgtcttgattaacactgattttaccatggaaataccatttccaagacccattgtacacagtaaaaagccactatctttagcaatgaaacttgatttctaatatccattgtgttaattgatgaagcatctacttttgatcagaaatatagtttaagtgcttgtagtgaccgcctctggagtgttgcctcattttagttaaatgcttgctgaccatcctaataagggcaagctactgtctttagagtagaacttatactaacaaagtaccaccaccatttatgctggaaagattttaaaaaacaatacagacatcacaacagtgttagactcctttgctcctccatgtctctgaatggagtgtcccttcaagttttgtttaaagttataatcctactttatatatttttttcagagtgtaaaatggtttttgttgttgttttcagctttttttccttctctgactatgaagtatgtggggcatgcttactcataatgacgccagggcaagcttataagaacactgtaatcactaacacgaatcctattttaaagatgaagaaagagatctcctagtcctacgttgggagttattacaggcattgaacaaaattagttagagcaattttttataatctccacctccatctcagaaaatgtgaacatctgttccatttcaggcatattaagcacattggcatctatgaaatcttaggccatagaatttctttttctttctctttcaatgacaaggtcactcactattcatagtttcaggaattattgtcctcatgtccatcagtgaaacatagtacctctgcaaatcatttaaaaaccttatagggattttttttggtgtttttttttttttttggtgggggggtgggtggtggtggtagttagaccatttacatacacaggaataatctttagaagctagaacaagtttttggatcccagaaggagagatgtagagttgttctgggtatatgacttgcctcaaatcattaactgttaaatggtaggaaccgaggcttcttatcccaaatcttgtgctccctttgctattctgctactttttaatccccttaagacttctgaatctatgttgcctgctgccctcttagggatacaagagaaggaaataaatatctatagaatgactcctttggaccaggcattttgctatatgatggggtctcatttaattttagacatcttcaggaaggtgctattttatagatcaggaaatatagtcccaaatgagttatataaaaagttatggcaatcaagatttgagctaagcttctgggtgtttttttcactactttataccacagatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttttcattcctgaacataatgccattttttccttcttcatcaagagttcttaatattttaaattcatattttttatttgttaacgccacagagtccaaacttccttctttcctctcaaaaatgtttttataaaacatcaaagcttttagttaattcaatttaagaagaaatatctgctggacttgttgattgacttcaagtaaccaaacaactagttgaatgattggatcttgttttttgtttgtttggtggagcatatctgccggggtcttttgaaagtcataagaaagagtaacttaatgactacattgcagattataaagaattactacaaagagtgtgtataccagctgtttttcatctctgctgtgaacagaattatagttgatgcttaaattgcagaggattttgagaataaagctcagaataagaaatagactcttgtaccaacctataactacttttaagctgtttataaatgaaagttgaatttaaattatcctagccctatcctttaaaaatattagcataattttgtttttcatggttataaagatgtcagcttttcaaagtttcaccagtcacatgaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccattggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatcatggagccgagggggcaaggtttagtttttatgatgttgtggtcaaatacctggcagataactgcagttgtttggtgtcattgagacctctgcatgcctatatcctgttctagaacagagtttattgaagtgtggtccctcaatcagcagcagcatctcttgagagtttgctataaatataaattctaggaacctactcttcacctactgaatgagaaactctagaggtggggctcagccctccaaatgatggtcattcatgctcaagtctgaaaaccactttcctagaggcatttacacagatcctaaggccttttttttttttttctttttttttgagacagagtctcgctctgtcacccaggctggagtgcagtggtgcagtctcggctcactgcaagctccgcctcccgggttcacgccattctcctgcctcagcctcccgagtagctgggactacaggcgcccgcaaccacgcctggctaaatttttttgtatttttagtagagacgaggtttcaccgtgttagccaggatggtctcgatctcctgaccttgtgatctgcctgcctcggcctcccaaagtcctgggattacaggcgtgagccaccacacctggccaaccctaatgtcttttcatgaatcacagtaagaagctacagttcaagagtattccaaaggagccttgctaaactctgaaccacagctcctagtaattccttgagaagtcagagcagcatggagtctacatctccaaagcagtctctcctgagaaatgatccgagtcttgagaaaaatctcaaaattagctatcgggtgtgagtcatgtgataccaaaatgaaaggccattcgttcatttcatcaactgataaacttgagcatctactaagccccagtcacatacctgagctaaggatctcatagtctaagagagaagataagatataagcaaaatcatataatacatgggaaaaatcatcacttccaactgagggaaatcaggctaaccttcaaggaaaacaagctaaaaatgcagctgctgattatttagacaataagtagccacagatattttttaagccaccataacacatgatcagtggtaaggtctgggaaggtaaatttggtgactctcttctccagaaggagaaggaaatggaaagggaagaccactcaaatataattataacagctgagatatgagtagggcctaacctagaatggaaatagaatccaatagatttgtaccaatgaatggcgatgagattattagtaaagataagggataggtggaacgcgcatctgaagttttgacattaaagaaatgagatttttatgttactaaaattaaaatgaaataaaagatgaagaacacagcttgagatgggaagcttgttacgttgtgagcatgtgaagtgtgaggtgcatgatgaagatgcaaattaaagtgttcaggttacaggtaggagtgggggactgtcataattcaggagaaatagaacaggatcatgcatccaaattgaggaggcatctacacagaagtgatgttatggaagttgatgttatggaaggaaaggatatttttaagggaaagtgggctgaaagaaaaatgaagtggaccgcagaaaacatcttgcagaaagacggtatttatgggttggaagagaggtttccatgaaagaagcaggggaatcagagacataatgttatataagcaaaggcgatatttatctgaaatttaccagtatgggtggaccagttgtttacatctcgtctgatttctgaatgctccgttcttactggtgttcatatgttgatatggctttaaaataatcttaagcctagagaagatatgaggcaatgaatgaggatctaattattacacaaccccagttgaggggagtttcaacactttgcactactttgtggcaaactggaaaagaacagattaccagaaagaaaatagcatatgcccaaaataatactacaatccacaatctggcctgaggagtccttccattattagcctgtgactcctgaactacccttagtaatacatttatctcttaggaatgtactatttatttgtctgcatctcctgctaggctagaaactaatgaccaatattgtaaagaaagtttaatatctcataggtaatgcatgtgaatagttaatgaatattttaattaattattaaccgatattatgtactgactttattgtgtgctttcatgatttcttactcaactaaagtgtttacatcaatgagtggtacaattatagattgtactggcctatgggcatatagcttttctatagcaaatataataattatttttggagaaaactagattttgttttttaaaatgtacaactatatgctggctaaagaataaaggaaatgccaaaatatgacacatttggtatgattgtttttcttaaacttttttgccctaaaagctgctgtttaaaaaactcttctatagctgaagtttttattccaagtatcctatagtgaagttgttagtgccttatatacctgtgttaactttacatgtagcaaacacttttctgagtttgccctgaaaagttataatcatagaatgatttctagatggctcaaaattatcagactactagaattaacacacatgtatatatctcaggaagtgaattttagtgtccttgaagtcaaaaggattgtcccaaagccacccagaacaatggtgaagaatgtccctctatcgttgatgtttcatagcccaaatattttaagttctatgcttaatgcagagttcattttattctgaaatttatgagtgtttcaatttaacttgatctaatcatcaagtaatacactgcctatcatcagggaagtgcaatagagagctaaagacattgatattggtagactcagcatatcaacagtatttaaaatttaagtgaactatgaatcttgatatcttagtcgaaaaaggaaattgaccaaagaaagactatccggaagataaatgatttcttattcttagaaacaacaagtgagaaatctgagatggtatattagaaaaattaagataaagataacaaatgattgatagtagtcctcaaatatttaaaattttctcatgtaaaaagggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcattcacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctgggtgtggtgacgtgcacctataatcccagctactcgggaggttgaggcaggagaatggcttgagcctgggaggtggaggttgcagtgagccaagatcacgccactgcactccagcctggacaactgagcaagactgtgtcccaaaaaaaaaaaaaaaaaaaaaaaaaaaaggaagtctgcatttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgc

SEQ ID NO: 2288 - DNA, 1200828 bp, Homo sapiens
tgtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcaggtaatgtccactcgcagagctggagagttgactggcaagggccaggggagaacgcgctgcgctctcagttggcagcggggcaggccgcagccaatggaggctttatctttcctgcagctctggtctccgcgcctggaaatttgccagttggctttctcttcctttagccttcccagaaagtttagggaatagagctccgaaggccaggggctcttcgcctgggaggagcgtgcgccgtccttcaggtgcccgcgagcccaagcgttgcgtttccgcggcgggatcttcatgctctctgcggctggcgcgcgggctctgcagcctggaaggcaatttccaactgggcgcttctgactgcccacatttctgccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcctggcattggagcaaacagcttgatctgtcaccatcagacgtttaagaaaaatgctttggcaaggagaccctggcaagggaaatgtgtattataacaaatgtctgcttcaggggtttctcctggtccctgcagccatcccctctccatctgtgccgcccaaggacttagagacattagtaaacaagtattcaagattttccccttgccacccacaaaagttgtgactgcacagaagtattggaaaagtacttctcagttgaaagctactctagagcctatcacaggtgttttttttagggggagtctatttaggagtatcttgtccccgaatgaggaagcgggacctgcccaccaccactaccttcaatcgaatgtgtagacctccaagaaggaatcctcctttcttttcctggccaggggaatcaagctgtagattattaaacatgcggcatagctgggaacagaccccaaggaagtaagggagggagggaggaaaggacacttctctgagcctgcaagttcagcacgggcgtcctacagttcaggaagactacctcagtgacagagtccctgggaatgaaggagttaagtttttgggacaagtgtctgggactggggtccattttcccactgacatcctcatctcccaccccaccgcagcagccgacccaaggttttggcttcatctctgagccgacccgtacggtgtgaactctctaatttgcgggccgccctgggctagatagcccacaattacccgccgtggaagcagattatttggggcactagtatccatgcattgttgtaccactgggctctttgccagcagggtctcggatacttaggcttccaccccttcttgccgcacagaacgcgttcttctccatgcttccggcttccccaaagatagcaattgggcaactaccctgggacttagggagggtgaaattcccaagtattcctgagccgaggcttcagcagaagtgcctatcttcgccacttgcatcccttctactcctctcctccgtggagcaacccctgctctatggccagtacagtcgcaccgtgaggctgctggacccgatgcggagactccagtttgaaaccacctgcttacagttagctctccaatttgagggctgccctggggtagacagcctgcaattactgaggtggaagcagctgatttaaatagcgtttaaatgtggataaagggctgtggcatcaaaggctcctggcttgcccactctaacctcagctggtctgaaggagaggcaagttgcgaccaaagctgcctccgtgaacagacagctgcagccgcttctgcttctgccctataggtcaaggccagacctttggagcagtagggttgaggatttaaatccggctttgtggaatagcctctgcttccctctctgatatctggccagtcttaggttgagcaattggccatttttagtttctgcggggcttctaccactttgacctctctgtgcagaggctaaaggtactggtcaggggtggtggatagcagggtgcccctggactgtggcatttacaggtaaaatcaagtctgaatcttgatttacccattcatttcctgagaaatagttcctcaatgttgtagaacattcttgtttgccaataactggcaatagagtccatacacacatatgctgcttattagggtgaactgatggtgagataacctggagaacagccccttataaccatctggaacatgtctccacagctgcaaagcccattgaaattttatttagctttaaaaagacatgctgtaaagaatctgaccatataaaaaagatgaattatgaagtgactatttcagttttgtttaaaagaataaacttcactttatcaaatacactggcttccatagtttattgaagtgtctcagtgcaaacatttgctatttgggaagaaggggaaagattgggaaggtgaaatgagttaaaatatggttgaaatgatcgtatactttggtaaaacagaactttgtgttcacatctgtgccttaaataaaatcatcacgatgtgatgtgaggccctgagtagattctgtgacaggttgtagcactatgatgaaaccaaaggggaacatatatttatcctttgtatttggaaatttcctgtaactgcagcagtaatgattacagctgggactgttggaagacaaatgtacacactgccttcttcgtttgagaagtaccataacctcctttgtgaaaatgcactgtaatcaagtggaagagataaaaagtcccaagtttgaggtcttcactaataatatataaaagaaaaatcattgccaaacctcgagatgtagactaacagggttttttcaaggctggtttctagctgtagtcagaaactcacaccttttaatctctgagaactgtcccttgatcctaggtcagaaagctgtgattggagccaacttggtagagaaaggtaaatgtggaatgtgcaatatgtgctttaattatcctgagctaggacttgaaaataagcctctcattatctttagacttggagctgcaagtgccaaggaatttgccaaaataaaatgtgtctgtccaggctgggcatggtggctcacatctgtaacaatcccagcactttgggaggctgaggcgggaggatcacttgagcccaggagtttgagattagtctgggcaacatagtgacaccccacctctattttaaaaatgtgtctaatgtaaggcctgatgcaaggatgtaacacatggatacatctggccaaagctaccgctatttgggctggttcactttgagttatctcctaatgacatcagaggcactagagtgagtccactgtggggcagtttcttttgggcttccccagccacagacatggttccaaatcttttgtcaaatgatctaaatacatattccctgtgccaagaagcctagatttagtagccttcttgctttatttttcccattaatctcacagcttcgtgtagctataccttggcttctctcttgagtttcaaaatgctttttagctggtttgctttattcctgtatttgggtgttctgttgtcatgaaaatgtattaagacactgacttgacattttccccaagcaaacttttgttttttttttttatcccttccttttaatgaggtccttattctctaaccctagcacctctgatctcattcatctgtgactgctcctgtgtgcctcatccatcactacctcgtgcatcctgtcttttattaaatgccctgaattctgtctctagaataggttttctcctttgcatttgtactgccaccacttgcagttaggtcttctagattcttgatctggcctgctacaaaagccttttcttgctgtctttgatctgctctctaattcagtatatcctacatgttaggattaatcttcctgtagctcatgtagttctttatttaaaagtgttacttagtgagtggttgttaagtcatacagattgttattgaatctaaaataatctctaaccatttgagttgcctgatgcattaaataagttgcattgtaaccttaggaagtgatatggtttggctgcgtccccacccaaatcttaccttgaattgtaatagtccccacgtatcaaggatggggccaggtggagataattgaatcatggggatggtttccccactactgttcttgtggtagtgaataaatctcacaagatctgatggttttataaatgggaattctcctgaacaagctctcttgcctgccgccatgtaagacatgcttttgcttctcctttgccttctaccatgattgtgaggcctccccagccatgcggaactgtgagtccactaaacctctttcttttataaattacccagtcttgggtatgtctttattagcagtatgagaacaaactaatacaggaagttctctaacattgcaggtgagtacacagcacggccaaccatttggtgggaactcaaacatcagatttgggacatttgttgcctaacccagagagtccatatcatcctttcaatatccagggacccaaatagtgtgttgtttcctatcagttggcctgctgaaattacaccttttaaaaattattagaactgtgttttatagtcttttgtttgttaacagtctattgctatgcccaaataggtcattttgctctggcttacttgggtgtgcatcactctaggaatcatctagatcattgtattatgttatgaatttttaacatttatgttgtgcttgctttatactttggggaatgcccttcccctttctttaccttgcttaatatttataattatttgtgaggcaggtggtctgtccaaattgggaaactttgttttattggtatcacaaagctattattgctctggggtcctggctcagatagcactagactaaagggattttattctctcctcattagctgtaaaactaagtccaaattctttagccagaagtttaaggctctttaatatttagcctcagtgtacctagtaagccatatttcttactaccttcctgttcacataatctagccagactggatcactcaccattatccagttataacctttgttatatatcttttgtgcccttgcttatgccattcttttccctgaagtatttttcctcccaatttccatctctacttctctgcctgttgaaaacaaaccatattcaagaaacagcttaatgcaactctccctaatttatctctcatacctcatagctaaaataatctgtcccttttctttttctttcttttcttttagacagggcctcactctgccacccaggctggagtgcagtggtgtgatcacagctcactgtagtcttgacctcacaggctcaagcaatcctctcacctcagcctcccgcccccagtagctgggactacaggtgcatgccaccatgcccggctaatttttgtatttttttttgtagagatatggttttgtcatgttgcccacgctggtcttgaactctgggctcaagccatctgcctgccttggcttcccaaagtgccgcggttacaggtgtgaaccgctgtgctcagcaatctctcccttttcataactctcttggcacattgttgatcccccttttatgatatttaccttgttctgcaaacattattgttatttgtgtatcactctatctcctctactaaattttaaacttttggaaggctgtcttttgttctgcagagtgccaagggtataggaagcatctgttacatacttatttaattgagctgcctttgagatctcagtattagccttagcattttactatgtaaatgatagtttcaggttaagtaggaaattgccaaatctattatttgccaataatgtcatgaagcagtataatagggcactgatttttttaaaacagctatgctctagaagtgctctattcaataaatatgcagttgtataaatttaaactgattacaattaaataagactaaaaatttcggttcctcagtcacctagccacatttcaagtacttgatagccacatgtggtcagtgaataccatattggaaagtacagctatagagtattcccatcaccagagtaagttctactggacagcactattatacaacaatggttctcaacacttgtttccaccaaaaacacgttcacaaaggtgactgctttcatgggtttatgcagaattcccagtgccatagtgctgccacttttcttccttctcagaacacaaattagtaacattacaggaatcatcttgactctgtttgggagacaaattagatatttatgtcatatcaaacaccagaataaattccagataaaactctgaagaagaaaaaattataaagaacttgatctatcacgtataacttatattggaaattataatgattaaaatactatggtacttgtgtaggatcagacacattactataacagaacagtgtccaaagaaataatcttaagtatattatggattttaagaaatgacaaagatttcaaattcatgcgtttgagggaaaagatagatttttcagtaaatgtgattaggacaacagctggtcattgaggggaaatttaataaagctacatctatacccactatttaaaccaaagttaattccagctttctcaaagatttaaatgtaaaaaaaactataaagacactcaaagatattttagattatttgaaaatctatataattacaatttaacattttattttatgatatgtttatagtcttgagatggagaaggtttttctaattatgaagactgaaggcttaaaggaaaagattgatacatttaaccttcaaaaaagtctttatggtaaaaaataccataatcaaggttaattaaaaaactaggaaaaatatctgtgacacataacaatgggtagttattcttaacataaaagaacttccacatattaattacaaaataaatctcatagaaaaaatggggaaaattcatgaatagaatactcaccaaaaaaggaataccaaactcactttgcaaataaaaactaatagttttcacatatcagattaagaaggcttcaaaaccaacataaaacatggttttggcaaacctgtgaggatatggatgatccaacgtactgtttaaattggtccatttccaaagattgcattggcaatctgtataaaaatgtaaaataccttctatgacttagcaatttcactaagtatttattctaagaagataaatgcaagtactaaaacatgtatacacaaggatgttcattaatgtttcatttatactggcaaagctttgaaaacaatataagtggctctaatagtgtattgactaggtcaattgggatgtatcattttaatcagttacttggacacattaaagacaaagcagacctacatttattgatatggaaatatatccataaatataatttaatggaaaaggtagcttacaaagaaacacaattcaattttttcacttgtttatgtatttgtgtacatctatgtgtgcatataagcatatgaaatgtatagaaagtttttcaccaaaatgttaattataggtgaaaagactgaattttctttaaaaaatcagcctgtgcttttgtttatttacagtgagaataatacaagcatatattttataatgcatttaaaatgcttatggtactcaatactctgcttaaagcacagtggcagttattatgcttatataatttataagataagctagtcaaagttaaatgtgaacttcagaaggattcaagtgttaaatgtaaaaaaaggaaagtatataataactaaaatataataaaagtaacctgggagcaggactttctaataataataaaagaagaaatcagaaaaatcaatagagcattttacataaacatagaaaatgtatatggataaacatataataataaagataaattggaacaaacaaacaattgtaatatttgatatgtaaaggtttatattagctcaaaaatataactttccatcagctaaccacccacaaataataaggtgttatttggactcttattttttatattataaacatattgtatatatcctataaatatatagagttattgaagtattttacatgctagctctggtaacacttgcagtgattctagaggaatatggattggggaatatggggaaaggaccatgtagtgtaattttctgctctaactagacaaggataaagcctcataagatagtggcagatgctgcatatcttggcatgaacttacctgctccattgttctctatagatttacagctgccagtgccactatcggtacagggaatggtcttgccagtgccactatctatacagggaatggtcttgccagatccaaaaatacagctgactttttcccctatacaccattagttttttaatattcagcatctatgtcaccatatttccatttaaggggatgtttagaactaacagctctcctggttcttgaaccaaactcagaatcaaaaaggtcacatcctcatctgaggaaagaaaaccagatcagggcccagatatcctttagtgaaatatctgctttaaactttctagaaaatggaaaaatcaatttccctaacgtctatttcctaggtcttatttaatgcccctaataatgggtagttgtgacacagaatttagactaagggctatgaccacaaataatgatagctaacattcagtggagactaattatattctgggttctattcttagtacagctttatatgtattaaatcatttcatattaataattattttactgggaggtaggtggtatttttattacaatttttagatgaggaaactgagacacgagttcagtaatttgcctagtcacaaagctattgaaatggctgttctggggtgagaacccagccagtctcgctctaaaatccatgcatttaaacgtgacacaaaagtatgtatactaagagtagtaacagatactatttagctcagttatgtagctttcaaattttctacaattaagatatgttacttctataatcacaaaatatatgatattaaaaattaaagcttcagatggagccatagacatagccctctcaactcttcaattttgtctttatattcttttttacaaaagtatcctaaggcgttgtaccataggatatatcatttaaaaagcctacttaatatttggaggtggtaattgcaatctgttgaccaaagataattgcattttgcaaccagaagggatgatggggtaaaacctctgaaacttttgcttcagagtctaaaatgtacaattatttcccaattgaacctaataactgctttataatatcatttcctttgttatccagcctaaactttgtagtattgtccttttgctaatatcttcatctgattctagactcattatcttgtcactaaatctgcctacaacacctccctctccgtttttggatcaatctaaccaccactttctctgttccaacatctctatggctgaactctagagaagttcatacctgtgccagaaacagtacatggtctaaaacctcatttgggccctgcagaggtgctaggaagaccttttacatgtacatattcagctttctttcccatctgtttcccatggtagttatttcaaacacccactgctcatctcagactacatttttccattcaggcagttgttcttgcctttgactttactttcagacttgactttctaactccattcattctcttgcctcctccccttccgttcccatactcacccaattccctagtgttttgttcaaagtgagtaattccattggatcctgtgtttaagagttccatgtcctcagttatcctctgttttctctgggaagtagcagtagttgggaaggaagtctgaatagccaattggagcattggagcttgggggaaagaggtcattaataaatgcagaagaatatttaggtaagagtgagagttccaatgaggttagggatcatgactttataagtgaaaatagtctacacagctgtgcagttttttcaagctctgctcaggtgtaagaatggaggaagtggacagttgtgttgatccagaactgagttttgccaggatccatcacagggacaaaagaatgagaaggtgaagatattagtacaagttgtggaagtgatggattatgaattgaaactgtatagggaaggaagcatcagggactgataagtaaggtaaaaactggttgtgaggtgggaagaaagtacaagggtggtcggggactgataattaaggtaaaaactggttgtgaggtgggaagaaagcacaagggtggtcggggtctgtatgaggaggacacaagagcagggtgatgatgcagcccagcagtggctagggcttatgtcaggagagtatatgagggatggtagccttgcaggggtcaggactcatacagagtggggtggcagtctggcaaggccggatagttgactacatgctgggagaatgagcaaataaatatattaagagtaataggagtgggcttctcactgtcatagaaggcagttacaaatatggaaaggcgggaggctagaagggactctgtggttttgaattggaattatcagagtcattcatggctatttctgtctccatctatgtatatatttatgtttctatttgtctatgtaaatgattatatatcttacacatatgtatatttcctaactttgtccactgagagggccaggaatagcaacacattagtagtgataaacataacaaacacccacatcttagtttgtcaatagtaatcttcactaaaagtaatcagagttctttgaagaaattgcttatctcaggcctggggcagagaagcaaaaagatgagggtgggcacatcttgtgctgccagaaagtaagaagtgctcaaacaatgataggggcatgtgaaaagacagaaagagagtttgaaggggctcctactagtgctatctccaagaatagagagaatgctaaagctgaatggcatgagcctcaaagaggcagaggtttttacatgaaggcagtgatagaagtggcagtgtgaagacaccttacacatttcctgatcctgagctggatctaccagagagggccgaagggggttcttttaatgttgaatcagtcccaaggcagagatcacgtgcagaatggtggtaagggatctggaagggcacacagaggggatccagcacagtagtaaagagatacaggcaacagggaatacaacaaagataagaggtgaagagaaactctagcatttcagttgtgcaaataggtcaagggaacaacttattgagattttcagcaggaagagagagggctccaggagggatgttccaggaaaattattttcatgagtttttaatgatctgttggaaagtttgggggcacttggttatagagatatagaaaaatgagtcacgtgaaaatgagacaattttcatattataactgcaggaaaaacaaaaagttcaagaaaggaaatgaaatcataatatactatttggctcacaacttaatattcataataatgtaaaattatcacatagctatatttgaataattgagagaggacaactggttattatcttctgtattaggaactcaatagataatatgtaatattgactaagaagcagaaatatgaacatattgtttataaacatggagatacataacagatgaaatagcttaaaaagttgaagttgtctttaagaaaaaggacttggggtaggggcagagaactgctgttttatatgtattatagaattatgtataaagatacatgtcaaaaagttatggtgcagagaaatcaaagacctaaaagcaaaaataccattcaactcagcaattccattactgggtacatgcccaaagaaatataaatcactctatcataatgacatgcatatgtatgttcattgcagcactattcacaatagcaaagacatggaatcaacctaaatgcccatccgtggaagattggataaagaaaatgtagtacatatataccatggaatactatgcagccataaaaaagaatgaaatcatgtcctttgcaccaacacagatggacctggaggccattatcctaagcaaactaatgcaagctaatgcaggaacagaaaataaaatcccacatcttctcacttataagtgggagctaaacaacgagaacacatggacacaaagaggcgagcaacacccgctggggcctacttgagggtggagggtgggagaggatcagaaaaaaatactcatcaggcactagccttagtacctgggtgacaaaataatctgtatacgaaacccctgtaacacatagtttacctatataacaaacatgcacatgtatccctgaagctaaaataaaagttagaaaagaaacttagggcaagaccaaagtgaggaggactattttaaaaacagaacaatctactggggagttttgaaggggggagccaaaggagcaagaggaaaaaatatgcatgtcaaaatctattttaaccacttttctcaaactagagctcactctgtgctgccctcagcactatttatattagaatcttccccacccctatccccacacaaacatccattgatgtgcaggactcctaattaattgcccaaattacctgattctactcttctgccacagtttcagttacattctacagcacttagagccacaaaataccaagaggaaaacaaagcaaaacatgtttatattacctctcactatattcaggattgatgtattgattaaacctctctgtcacttccatagtgaaaggttgtcctgccattggtccattgtattattttcttcccccagtactttctggcttcttacattgcaaatactcactgtcatccttctcccactatgtcaccttctatatagacatctgtgttctgtcacagcttttacatttgaacaactattcattttatagacattacaagtaaaatacattgtcctgcaaggaatattacagttgtacttcaggcacgcctgctttacaatgtcaacaagagggatccattaatttatagttttgtgtttggtaggggaaccatataatattctacatatatttagttctccagaatgtagcttaatcaatatggcacctcaggcaacctgaaatactgaaggcaacataagattgtcagaccaagaaattttatgtctgctgatgggggtttaactcttttggaggctgcagaaggtatatatatttagaagattatagtaaagtcgatgataggaaagaatcaaactgatgtgtataaaaggtactgagggagagagaagtctgtatttaggaccccaaggcagaaacttccaggttctaatccttgcctgccaaccttgagcactgtagaggtttcaataatattttctatctctgagtgtcattagacatttataaagggaatgcctcatgtaggaaaacctgcagtaccaccttgagccaaccactgacctctatgcctgagtttggcacctgccaagtgagatgggcagttgaactatgtgcctttaggtgcctttgaatcctgtggttctatgattttagtaccatgctctgcttatctcaaagagctattctgaggctcaaatgaaatacttgacatgcaaatgccacaaaagtttcaagtgctatacgaatgaatgtaaaagtgttttaaattatgcatctctaaatataaccaacaacttgcacatgctctcccaaacaaagcaaatgggcttctgggcttcgattttcaattagtctcaaaacatatgattttacttgttccaattttcagaagcaaaaggagcaaaagattcaaattatgatctttattaagaaggtactaagccacttagaaatgctgggcacattatgtggctcggccaactttttcactgttgtattgtgtgggtctcccaaatagcttttactgtgaagactaataaaaatgataggaaagttaaaactgagcagaattagattaaatctcaatctgtattctgcaagggtttttatttgtgtgtgcatacttttctatatgcttctaatctcttcatatggtttatagatcagctattagttaataggttctgacatgtgattaatatgtaggtatttgaaaattcatgtggtgcatgcctatgtctatggagcaaggtgctgaatctgcacattcacctcaggaacattggggatggaaagtcaagcccagaattatcttttgcatgaaggatgctagctagggcctttctaggtccccaagggagacactgaagatcttttttcattaaataaacatccactaagaacccgataggcttcatatactatactattcgctgggaacttctgacctcaagtgatttgcctgcctcagcctcccaaagtgctgggattataggtgtgagccaccatgcttggcccagctttttctttcagataaaaattttttctttcagaaaaaaaattgctccttccttaaaagttcatcatgaattctcaaagagagacacaatggtcagctcctatgacactaaaatttagataccagaataaagaatggaaggtaaaaactgcccaaactctttctggggtggtggtcaggaggatcagtccctgagaagacagagaacttaaaggatatacttgaaatttttatttaatgcaaagtataacactttctgcctaaatactgctgcattagaagcattttattgtaaaatctctttccaggcacatacactccgctgctatgtacacaactacaaaaacaggcaaggccaagagcagtcacaccagctactatggtttgttagtggacagaagtgcttgaatttgattaaagcaaatgcaacaaaggtttacatactgtgagtaaaaaaaatgcttcagagcacccaactagcaaacaggatgtgcacacctcaggcctacctgaaatggagagcaaacagtgatgtaaagtgtgtttgcatgaaaaaaagactgctaaaaccggcattaggctgattttcaatttatattaagggttggtatacttttttctaacttggtgaacagtcaacaagtaatcatacagctttttcttttctctctctctctctctctttctttctttttctttccttctttccttccttcctccccttcctcctttctcctctttctttctttttctttctttctttctttttctttctttctttctttctttctttctttctttctttctttctctctttctttctttcttttttttcttttttctttctctttctttctttctttctctctctctcctttatttctttctttctctctctctcccttccttccttccttccttctttctttctttcttttttctttctctctctctttctttctttccctctctctctttctctcctttctttctctttctttctttctttctttctttctttctttctttctttctttctttttcttttcttttcttttctttcctttcttattgagatgatggagtattactctgttgcccaggctggagcacactggtgtgatatcggctcactgcagcttcgacctccaggttcaagtgattctcctgcctcagcctccctagtagctgagattacaagcatgtgccaccatgcctggctaatttttgtatttttagtagagtcggggtttcaccatgttggtcaggctggtctaaaacttctgacctcaagtgatctgcctgcctcagcctcccaaagtgctgggattattggtgtgagccaccatgcttggcccaggtttttctttcagatagacatgcatatacacatatattatcattattgaggtacaatttacataacataaatttatccatttaaagtgtataattcaatattttttagtatattcacagagtcatgcaaccatcaccacagttttagatatttttatcatctcaaaaaggaacccaataccaattagcagttacactccatttacccaacatgatgcctcaagcccagacttacgcaaccattaatcaacttactgcctctatagatttgcctattctaagcaattcgtataaatggaatcatacactatgtggcattttgcatctagctcccttcgctctggcatgatgttttcaaagtgcatccattttgtagcaggtgtattttattcctttttaattgacagataatatttcatagtatctatatatcacaatttgtttaccattcatcaattggtagacatttaggttgtttccacttttttgctatcatgagtagtcttacagcttcttacatcagtttctaattagcatgcacatcactaagcactgatccagatattaaaagatactagtcttcataagctggccatcccccaattccttgccaaatcaccaaaatcagttaaacatatttggaaaactagacaataggtataggcagataataggcacttaatgtttcctgactcaggaattaatggatgagaaaaatcattccttcagttctaattctccttacaataacatccctaccagtgccacctggatattgtgtcaaggtatgctagagctggaatgaacgtggagtcccgggttcctcaaagtgtgggtcaagaaccacatgtgtcagatccaccaggggagcttattaaaaatacctatttctgtacccccaccccagagaatctgattcaataaatctcggggtgaggccataggaagctgcctttgtaataagcaccccagataatacaaatgcatgttagagtttgagaatcattgatttagtccaacctccctactctataggagaagaagtttaggacttgggtggggaagggacatgctcaaggttacagggcatggtaaagataatgcaacagggagttgaggttatgaatcctgatatagcactttccattaccttgggtactcttctttatcacatctccttcttttcctggtgaatacatgcctccctcacagacttgctccataagtgtcagtgtctgacataccctaagtgctcaataaatagtttttttttttttaagcttagtcctgtgtgaactgaatgactaaaggatctccttttggggcagtgtttgctaaaagtataaagtaacaagtataaggcttaagaaaagaataccagacccaggagggagatctcagtggttcctgacccaaatgttgaaaagctcctaagtgaaaaactgttcaaccatgggtttttggtgaacccatgaagctatgtagtgacatttcctatccaaggtccttaaaccactctatacacccactgtgatctatttaaaggagccaggtctttttagaaaacagtttctgccaagttttctatcagaggaaaatcataaagtaggtgagctacagccatgactaaaaggtagtggaaatttttctaactgaaagttgttatgcctgtcaaaaagatagactcagtaaaaacccattactgtgcagcagaggaaaaaatcatgggagctattttaaaattttttcttttatagttttttaaattacaaaagtagtgatttgttgtaccgaatcaaacaaaacaggagtgaataaagaaacattcagttatcttttctttttccttctggtcttcctctttaaaatggattcatttggaatcaatccttccacactttctctatctttatataaaccatacataacatatgcacaaaaagacatatatacacacacacatatatatacacacatatgtatatatacacacatacacacatgtatatgtattatatatacacatatatgtatatatgtgtatatatataatatatgatatataatatatatataatatattatatatattatataatatattatatattatatattatataatatatattatatataatatatattatatattatatatattatatatattatatatattatatataatatatattatatataatatataatatatatataatatatatataaatgaaatcatgcccccttcagttctctgcaccttttaagttcaggggtacatgtgcaggtttgctacgtaggtaaacttgtgccatggaggtttgttgtacagattatttcatcacccaggtgttaaacctagtacccatcagttatttttctcatcttctccctctttccaccctacaccctttgataggccccagtgtgtgttgtttccctctatgtgaccgtgtgttctcatcatttagctcctacttataagtgaaaacgtgttatttgtttttctgttcctgcattagtttactaagaataatggcctccagctccatccatgttgctgcaaaggacacgatttcattctttttttatggctgcatagtattccatggtgtatatgtactacattttctttatccaatcttccattgatgggcatttaggttgattccatgtctttgctattgtgaatagtggtgcaatgaacatgcgtatgaatgtgcctttgtgatagagtggtttatattcctttgagtgtgtacgcagtaatgggattgccgtgttgagtggtatttctgtttttaggtctttgaggaattgccacactgttttccacaatggttgaacacatttacactaccaccaacagtgtataagcatttctttttctccacaacctcaccaacatctgttattttaaaactttttattaatagccattctgactagcgtgagatggtatctcattgtgggttctgatttgcatttctctaatgatcagtgatgttgagcttttttttcatatgcttgttggccacatgtatgtcttcttttgaaaagtgtctgtttgtgtcctttgcccactttttaatggggtttgatttttgctttaaaatttgtttaatccttatagattctggatattagacctttgtcacatgcatagtttgcaaatattttcatttattctgtaggttttcctgttttttctgttgatagtttctttggctttgcagaagctccttagtttaattagatcctatgtttcaataaacaagattttcaggccaatattttgagagatgttgcttaaattcatctaaattcactttgtctatggctccacccagctcttaaataattgctaccaaactaaactgctacttggactgtgaaattttatttcctgcagtagccagctgtcagatcacaagcaactttactgaacacccacaagaattttctttgggttgtaaagtcaagcatcttagttatcatgtaagcattaatttttaatgctttaatttgaccaaaagcattgtgttgtttgtgaaaggcctcccacttcttttgctgtggaaaaaatctggagtctgagtccaagcttttttcctttcttaattagaaaagcaattttctcaccttattttctttctcctgagaaggactgaaagtgtttgactaagaaccttgtgcacctcttctttttttagttgctttttgttttattcattggctcaatccttcttaggttgctgaaaaacagctcctcaattctgaacccagtgaagggaagggcagcatcattctgggatctgtaagccttgcaatttgggaggatcagagtacttttaagatgtaggtgccctaaaataaatttctaggacaggggtactgaaccagcttcacagagcatcaccacttactagctctgcagctctgggtaagttgcttaacttctttgaccttgtcccagttattatacatgtacaatgaagacagtaatgatacctacctcaaagaattgtgtggggaataaatgaggtgaagcgtataaaggatttagggcagtgcttgctttgctattatcacattatttgtcttctgcaaccaccaccacagatggccaggcctgccctcagaagacatcttgacatagtagtcctggaactgtggcacaggcatgtgcattctaagaaatctccttggggattctgatcactatagacagtgattctcaaactttaatgtatattggaatcaccccactcttagaaattgtgctactttagttctggaagtgggggcccaagaatgtgcatcctttgggaaacactgctatagaggaatcgcatgagcacccctccttctctactgtatatatctattgtgataatcttttaagactgctgacatattgttggaatagacataccacacaggtaatgctgccaactcactttcagtgggacaaaaggcataaactacagagtgttttctttttcaatcatagtaataaattagcacagatacacatcctctatctcctgaacaaaggcatgtagttgcaaagtgactgcatggggtatagttgtatagccagtttaccatgtgggaagatcacctttgacaatagaaataataactttgaccattatcgatagccagccagcagccacaagtaactgtaggaagaagggagcaggattgcttagagtttatgttaggtattcattatgtaactggtgcttaatgggcctggtgattttttttgttttagtggaaaaatgttttatctgatttgtttgaaatatttttccattctgtcacacctgaaaagagaaaaatgagggctttgaggaattttgaaccctcatttgttcttagcccatgctgcgtatcacctgcctctctactcattgtagaaatggaacttttcattcagtaattttctagatttctatagcattttgaaaacccactaaccactaagttgtgcgtgacttaatgactgcactcccctccccgcccctccacacactcactcatttaagtttatcatctctacttcttgagccctgttccttttcaagtcaacagtaccacccctgaactttctgagcagcatgtacaaggcaggagtttctggaggtatttatcccccacttgcacattcttatgattcaagtcatatctaggatcatcccctggctgtgttggtgctaagaattgaaaatagggaaagaacattcttgaaagttcatctttttgaaacttagtagaaatctccagtcttaaacttacttctagaacttagaaaaccaaattatcttaatgcccattaagtgttgtttactctcagattttccaagtgttgcaaaaaaaaaaattgtttagaggtttggagaattaactcttgcttttaaaggatgatctgttttgaatagtataccaagcaaagtttaataaagtaagtgagattaatgaaggatagtctcctgaatataagcaaacaagttgcttgtttatacagatctctatatttcttaagtccagtggaaaacttgacttctgaataatcttcactgtggctttcacagatagcagcaaaccttgctttctcagtgcctgaatgtttgctttggggcaatcatgtttcttgaagtatgcatgcaatttgagttttaagaggtgaaaaaaagattatgtccaagacatggtttatataaatagaaaagattggttgtttagtttcttcatttttgtaatggtatgaaatatagctgtccaaccatcttgtttttggaggttgtatcagtcagggttctgactgggatagaattaatttatctatgacggaggttgcaaatttttttgtgtgaaaaatcagactttggcgatgaccttgagcagcaggatataaataactcctacaagtttagcattccaataatggaacactaggcaaaaatggattaataggctctgcatataaaggggagttcattaagcagtattaactcacatgatcacaaggtcccacaataggccatccgcaagtttagaagcaaggaagccagtccaagtcccaaagctgaagaatgtggagtctgatgttcgagggcaggaagcatccagcacaggagaaagatgtaggccgggaggctaagccagtctatccttttcacgtttttctgcctgctttatattctggctgtggtggccgctgattaggtggtgcccacccagattaagggtgagtctgcctttcccagcccactgactcaaatgttaatctttggcaacaccctcacagacacacccaggatcaatactttgcatccttcaatccaatcaagttgacactcagtattaaccatcacagtggtattgagaaaacactttgaggttaattatatatttttgcgacatgtaggcataaccttatctcttaataccatttgattttatgatgtctttttttcactttgtgacatggggaggggatttgtataattgttagtagccgatgttatgtgtaaagactcaaaaggggctaacctgacacattttgtgtcagcactttgttttgagaaagcgaaccacatgtttgccttagtaagaccctctaatttgagaccagttatcagattgaccctttgttcctagagtgaaataaaagactcagtgaaattttaacaagttagcatttgctcacttacactgaagaaggcaggaggctttagttgaaacaaattgttagcattgacaataggaagaaaagaaaattctaattaatataatagttaccctttctaccatccatagtagcctaagttgggttttttgtttgtttgttgtttgtttgagacagagtcttactctgtcgcccaggctggagtgcagtgacatgatctcagctcactgccacctctgcctcccgggttcaagtgattctcctgtcctggcctcccgagtagttgggattacaggcgtgcgccaccatgcccagctaatttttgtatttttagtagagacagggtttagccatgttggtcaggctggtcttgaactcctgacctcaggtgatccatgtgtctcgatctctcaaaatgctgggattacaggtatgagccactgtgcctggcctaagttggctctttatccttgacacacttatcagactagttttgaatattttatcacatgatttttgatgacattcttttgaaaaatcacagtttcttgaatgaatgaacctattgttcttatctagatggaacattctcaaaaagatgatgggcactctaaatcatagtctttcttcccctatctaaatagaatccaaactggtaccaacaacactcaggaaagaaacatctgcatgtgactttcttgtgtgtttttatcaaagtgcagcacctatcaagagagacaagctgtgatctgcatcttaccagtaaccagaggtgctgggctatgggtcaggaggtttgtgttctaggctggcctttgctgctgacctcctgtgtgacttatcacagatcatttttggcctcggttttctgacttgttttcaaaaagaaagattgttttagatgactacttaggtccctcacagtactaaaagcctatagtctgtacttttaatcacaatctatgagatgattcgattgtcttaatttgttcatactctcttcctttaatcccactgagtgtccttaacatacaggtaatggaacacattgacctttatttttgaagttagtcccagatcaggaaatttctcataatgccaatgatttcttagaatacaggactcttctgcatcccattaccagtaaaggtacacatacacaggcaaggaaaataagtatattcttcaggctatgggggcaagtgtctgaaattattctgatctacctagaaactatcttactttttttccttctctgctttatgagttgagagagcctggttgatctgcttcctttcgtttgactttgtaattattgttcaggcaaatataaatagtactagtattggactagtaggtagccaagaaagagaaactggaacagctatatgtgcccacctccccactccccactcccataaccaacagaaagtatagcaacaaaaaaaggaacaagcactacagtggatttccatgccccgctagcatgcatgtgtaatatactatagcctatcagatggtttccacatttgtcctagctgtaagtcacaaggcattttgatacaaataatacttgcgaataagctgtataaaatactcaccaagcaacactgaagctgtccctggaagtgacagtttgcagtcatgaatgatgaaatatcctttgtgtataaggcaattgtgttggttatagaaaaagaaatgagacttcctaggtttcttccttctgtggcttttttttttttttttggaaacaggaaagcttcctatacaatgatgttaggacctatatttcatttcatttcaactttcatttacagttgttgttgtaaagggaaaacattttaatcagtttctgcatgaaggtcagataacactgtgaacaaaagtaatttctttatgataatatcaaaacaaaagcattgctacacttaaattatgaagcatgtttcccttatctgcagtacaattgtatgacttaatagaatctgggagcgtatctcatttatgctactggtaaactcaagaaattctcttccttttaaggtctgaagttgtgatatcgcctaagaatgagaccagataatattatgtcctgggtataaattaagttactttgaaaaggcatgagaattattttaggtatttgtttgtttgtttgtttgtttgtttttgtaaactgaagcagtgttgacattttctatccttttgtggcttagaagatgccatatgattttttttaatgcccgtatatgtgtgtgtgtgtgtgtgtgtgtgtgtgtgtgtgtgtgtgtgtgtgtgttattggaggtaatgaagtggggcagaggtattcataataaagtcacttttatctggttttggagtgcaaaaagattcacatttagtagatacacacaaacacgcatatcctgaacttctgcctgtacacgtcttcttcccaacctccttctacattgtgcttatcagttgcctgcaaaggaaaatttgagactgtctactccaagatcgtggagaaattgattagagttgcaaatgcagactattgcctgaagtaccttcaggaacatggtatagagctaggtgatgtatagtgataatacaacatatgcatccacccacccacatccatactttcacattctccaatatcctttctggtccatcattttaagaagttccataaatttaggctgcagtctaaagcacaagaagagttttaacagtcgcacaggatgtcacaaaaattgtggtacttctaagaatttaatccaggagaattattccatcccattcttaaactgtaaccacaaggcatttccccagaccctcaaattcttatccatatctttatggcaccatatatgtttctagaagtaagaaacatagccggttccattttggaagtcttcttaagcattgtgacttcatattttactagtgagaatgctggggaaaagtaacatttcatctttcatgaacatttctaggattatgtagagaggaaagaatatttgaaatgttttctagccactgaaaagtactgtaacactcagacaaatcccatctcccatgatatctaaaagtgatccagagacttattacagtaattttagatggggtctctgaaccacattgatcagaaagaaagattatctagtaacataggcaaaacaaattagctgtccttaatatctagttgaaatccttaaaaaggagaattactgtctttcagtatctgcagggctgctaacattggaaattataatggtgactatatacatctttataatattatatcaccaggtccctgggctactctatcactgagcttcttaatctcctttgaccaaatagcaatttaaaagggaattggtagcattcaggcatctgctaccctgtagaaatattttaaagcattttcatcttgccttcaaggatccaatgtaatgacttaaaaaaatattttggggagaaaccattgctagaaagagcactaaacttcaacttcagaaaacctggattccatcaataagcagttgagtaaccttgagaaaatcacctagaaatttgaacttcaatttctttatctgtaaaactgagtaactaaaactaggtgagttattgtgataaccttctaattgaactgtctgcttctgggctcagccccatcccctattttgcatccctgttgtcaaaaataacatacaagtctgaccatttcatctcttccaaggactgttacaaatttctccccatccttctttcacttccagttttatttcctaccacacccatttttgttttatgctacagttataccaaaaaaattgaaattttcttagtttaacatgctgctttacctttccatgcatctgcacatgtgttattccacctgcgtggatgacccttcaacagtgtcctacactctggtattcccaataaatttcctttagtctttgaaatcccagctcagattgatgctccctagcgaagccttttctatctaccaaagaccctactgtggactatctttgtgattttttcacatttctattattgtatttatcccaaaatgttgtaacatatttatttcttatctgtcttctctttaatattttttcagccagggcttatgcctgctttcttgcctgccttccccccaacaaatacttatagaaggcttacttttgccagacagtgttgtcagcccagagggatacaacagtgaacaaagcagacaagaatacctgtcattatggagcttctgtgtcttattcaggtctgtatccctagaacctagcacagagactagcatttagtatgtaaacaagcaataattttggtttgaagccaagaaatcagaattatggttacattggaaactcccatatctttctctttcttactgcctacactatgcatttagtgttctacttgtacatacattaatatttagttataatagttaatcagtgtgtcttacttgcctaagtttctatataactttgtttccattggtgctgtctgtcaaacaccattgtctgtcaatcagcttctgggggtgctatgctctcttagttgttcagacccaacacactaaaaggggtgccctttcattcatttattcaatcaataaatatttattgaacatctactattatgtcaaataagacatatgtgctcctgcccttttagaacttacagtctattgagcaagacaagcaatgaacaagtaaataaataaatatgttattacaacatatgattgttgctatggaggtaatgaccatgaagctgtgatagagagtaatggggacagctaccaactttagagtaattgaggaaggcctctcagaagaagtgacatgtaggtcaccccaaaggatgaaaagtatccaaccatgtaaaaggttaagggacagcatcaggggacaaagggacagtaggtgcaaagctcctgaggtggcaaagagcttagtgaattggttttggggaaaagagcagtgtagctggagtttagatagtgagaagatgattaaattagagaagtagcaggtggcttcgtatggcatgttgaggcacttagagtgtatcctaatgggaatgacaaaccgtcgaatgaatgattttaagctggagagtaacaatcaaatttatgttttgaaaatcccattctgaagactgtgtagagaatggactgtgtgtgaggatgcagggacagcagtatggacctgctgcagtggtccaggagagagatggtagtcacctcaatgagtgtgaatccaggagagatgaagagaaatgtcagatttgggagacattaattagacttacaatcgtatttaatgttgaggtgggaaggggaaggagtcaaagattatgcctaggctctggcttgagctagtagctggctggaggtgctatgaactgagatagggtttatggcggggtgcaggagacaagttgggtggatagaaaatgcattttaatgatgacaaacatggtggtggcaatgatggtggtagtggtggtgatgttggatttactatagttggaggaaagatttaaaaatcttgcaattgtcaataactttctttagtgtgttggagaaagtccagtatatgtaatgtatttaaattttgcaagtcttctggatgcttgacctagaaaatatgcctttgtcctgtcctttatcccttcccaaagtgactaggattacattttctctaaatataccattaggaattaaaagatctcttacaattcaggaagctatgagaatatttaagacacaaggaatagagagagtaattcttaaaaggtaacaacttttcatttgttttcatcttgtgcaaatggtttattttctcaaagttaggtaacatttttaggccagtctctatcaaagtaatatccaaggatctcttacataaaaatcacctagggatgctggttcaaagtgaagatccttgtctacacaactaatcagaatctctagggttggggcccaggaaccttttttatttttttttttcaggctgacatttaaaaagcattgcttgagacaaggtattcttaacctttttggtgccccagtctctttggtagtctggtgaactctgtggatcccttctcagaaaactgcttaaacatgcattcaataaaatacaaggaaaacaagtatattgaaatataatgatcaaatattttaaaaacaaattttatataatattttacatacttttaattaacatattaataatgagatctaatactgggtctaatactaccataatttgaagtaataggtgaacataaatagtattttaactcatttgccacaattctaatgtgatatgaaattatctgtaatttctattagtgacaaagttacaggttcagctaaaaccactgtgatttgttgcctagattcataatggaaggaaatgctaaatttcagtcagaagtgaatgaaaataatggtataatgtttttcccatccaagttcacagataccaggcttagaatccttggctttgagattgtgaccaactagtacagagactagtgagggtatagtgaagacaaactggaatccagatgctagtcaacagaacaaaactcagggatgaagtcagtgagcctcaatatttggtattattaatttaaataattaaaagaagattcagggaccaaaaaaattgtccctgcattgtttggcttttaattggttggtttggctgttttgcctgagtgtacctggagaggcttgtctgtatactcttgttattgtccccttctcttgaaccctggctctttcagagggtagctatggagaaaagtttagattttgaccattttggggtgtttaattaagaacgttttccagaatggagagagacattcaaggatgaggaagtaacatgcgcagtaatgacagagtcaggaacaggctagtattagaaaacagaaggaagttcaaagtagctgaggcatacagtgggtgagtgagagagaggcaggagatgaagctggagagatggattagcctaagtccaaagagggccttcagacttcatgtacatgtacgagtttgggtatcatgatagagtcagcaggaagccaaaggagaactatatgctgaaaagagacatgataggccaggcatggtgtctcacgcctgcaatcctgtaatcctagcacttttggaggctgaggcaggtggattgcctgagttcaggagttcaagaccagcctgggcaacacagtgaaaccccatctctaccaaaatacaaaaaattagctggatgtggcagtgtgcacctgtagtcccagctactcaggaagctgaggcaggagaattgcttgaacctgggaggtggaggttgcagtgagccgagatcaggccactgcacgccagcctggggcaacagagtgagactccatctcttaaaaaaaaaaaaaaaaaagagagagacatgataaagtgtattatttcttaggaaaataaatctgatggcaaaatgagggatgggttagaggaaggcagaccacttttgaggctttggtaagaatgcaattgagaaaagtatggttctctgaagtaaggctatggtcatgagacagaagagggaacagctatgagagatgttaatgactgatttggatatatgccatgaagaagaagagtttgggatgactttgaagcttctagcttgagacttcaggtaaatggaagcaccattaacagaggataccaatcatgagaggcacagcaggtttttgggggaaggtttttagttccttcccctaaagaagaagaataagagtttgggatgactttgaagtttctagcttgagacttcaggcaaatggaagcaccatgaacagaggtgccaatcatgagaggcacagcaggttttttggggaaggtttttagttcagttttggataagctgagttttaagtacctattgaacatcaaatgagaaatgcatggagtttccattttaaccatttttcatagtaatcttttaatgtaggtaaatgatgtgagatattctttttgtctataaattgactgactgaaaattgtggggcagttatgtttcagaaatatgtaggattgggtattatattgtctttttattctaattttgatgaaatgtcaaccaatggctgtcctccaaagagttatagttgtatagttaattcttctggattaaagaaattcttcgtatacttatggtaattaattctagcaacatggaatatcagtaggcttgccttcttatgtctggagtttagactttttttgtgtgtgttttgtattacacattttttgttgttcttcacttggctttctatcatgactgctggaaggcagagggttgtaggtaggatgggagcaagaagcagtggaagtgtttgtgcagtcattttttgtaacagctccatggcatgaaaactactctcagcaactggtgtgaacacaaagggaaccggctagtcgcagccatctccatattcattggccttttaggttttggggcctagaatgaggggagaatttcactgtgaatgcaggatgttgaaatgcaaaattggcttttaacaaaattatgagggaagagatatttatctttgtgttccttttacctctgcctcactattctgaatccctgtacctgatgcctctgtgttaggttctggttggatcatgggccacactttagcatcttgcttagacttgttctctctaacagccattgttcctttgacctttctctttttgtgataaaatttcttgttcctatttatatttgataaattattctatatgaatatctgtggttacttacggcttaaaatatgctataccttccaagtagcaactacattttaagaggggtcctgggacaatgctttaacctagagttactctaatggtagggacagtacttatcatagttggggtccacaggtcttccctaatattttaaaaataatattgatagcatacacatgtgaaagacatttaacaaatacagaagaaaatgtcttcatttataaaggctgaggtaatagtgagtaaaagtagatataccaggcagaagtcatttgtagaagcttgactgaagtagatgagttatttttgaggatagtgatagaaatggggtgaagtgggataaggagaaattgcagattttcactgaaatgactttgagggcagggaccatgcctttatatttatgtcctccataggacctggaagaatgatctgtatatagtgtgtagtaatggttagtttaaatgaatgagcaaatccatgtggggaactattgattttaaatttttttaaataattaatttatttttttgagacagggttacccaggctgaagtgcaatggcgtgatcatggctcactctagcctccacttcctgggctcaagtgatcctcccatctcagcctcctgagtatctgagactatacgtgcatgccacatgctcagctaatttttaaatttttttgtagagacaaggtctcactatatttctgaggctgatctcgaactcctgggctcaagtgatcctcccacctcagcctttcaaagtgctgggatcacaagcatgagtcaccatgcctggttgatttttttttaaagaaaccttctgcatgtttatttttcccttaagaatatcctaaacccagatcgaatttagaaaggaaaaggaaacttttgatggatttagcacacacacacacacacacacacacacacacacacacacacacacgtaatcatttaaaaaggttggtggagatatgaaacgacttaggcaaaaatgaaaacccatttattcatcaatgaactccaggttgaagaaagttctatgactcataacaagttgtgctgacgagggagtctttaagttgtccattcatccctttgtgagatgtgagttttttttgtgtgtgttttatttggctttttaaatgttgacaagtctcaggtgtatgttaatagaaattctgtgatcataggtccattagaacagcatctgggaaggaaaactgatgctaagaaatcagcagtaagagggaataaaaatgcaaccaaaaccctttcgttgatatgcagcacaagctggttggaagcaaagggagtgatgcgatgatggaaatcctcattaaaattaaaagccatagaaagcggggaatagtatcaaaagcaatgcaacataaatcattatctacagggataaataaaatacaaaagaattagtgtttccagtttatgctttatgttgaaaataaaaatttgtttcttagaggtatctttgacatgtaacctaacaatggcaaactgccattgagagtccaggccttgttttaatgagtacctcataactgtacagaactagaagctacagagctctccagagtattagtaaatccagttttatgctatgaaaatagaaagtgaaagcacgttcactgtacctattcaaaagtaggaacaatattaatattctatttcattacagaatttcagttaacctaggttttagatatgatatgcaaaccacagagcaattttctatattgctatttttaattttttttcaactttttttttttagattaaggggatacatgtgcagatttgttacatgagtaaattgtgtgatgttgagatttgggtaaagaatgatcctgtcaccaagatactgagcatagtacccaatagtttttcaacacttgccccattccctctgccttctagtagtccccagtgtctattgctgccatcttgatatccatgcgtactcattggttagcttccaattataagtgagaacaagtggcatttggttttctgttcctgcattaatttgtttaggataatggctccagctccacccatattgctgcaaaggacatgatttcattattttttatggctgcatgatatcccgtggtgtatatgtatcacattttctttgtccagtccaccattgatgggcacttaggttgattccatgtttttgctattgtgcatagtgctgcaatgaacatgtgaattcatgtgtctttttggtagaaaaatttgttttcttttgcatatatacccagtaatgggttattagtaaataacccattatttattagtaaatccagttttatgctatgaaaatatttagatatgatatgcaaaccatggagcaattttctttttttttattatactttaagttttagggtacatgtgcacaacgtgcaggtttgttacatatgtatacatgtgccacgttggtgtgctgcacccattaactcgtcatttacattaggtatatctcctaatgctatcctccccctccccctaccccacaacaggcccccgtgtgtgatgttccccttcctgtgtccatgtgtttccattgttcaattcccacctattagtgagaacatgtggtgtttggttttttgtccttgcgatagtttgctatattgctatttttaatttttcttcaacttttgttttagattcagggggtacatgtgcaggtttgttacatgtgtaaattgtgtgatgttgagatttgggtaaagaatgatcctgtcacacagatcaccatttgacctaggtcaaatggcagttctcttttaacttctttgagaaatctccaaactgttttccacagtggctgaactaatttgcattcctaccagtagtatgtaagggttcccttttctctgcagcatcaccagcatctgttgttttttgactttttaaaatcactattctatggctattattaagccacattatgaaaaagttaagaaacaacaggttgcagagaaaacagaatgcttatacactgttggtgagaatgcaaattagttcagccattgtggaaagcagtgtggcaattctgcaaagaacttaaaacagaattaccatctgacccagcaaatacattattgggtagatccctaaaagaatataaatcattctaccataaagatacatgtgtccatatgtttgttacagcactatttataatagcaaagacatgtaatcaacctaaatacccaccaacagtagattggataaagaaaatgtggtagggatttcctggcaagatggccaaataggaacagctccggtctgcagctcccagtgagattgacacagagacgggtgatttctgcatttccaactgaggtaccccattcatctcattgggactggttggacagtggttgcagcccatggagggtgagccgaagcagggtgaggcgttgcctcacctaggaagtgcaagaggttggggaattttctcccctacccaagggaagccgtgagggactgagcctgaggaactctggcccagatactgcactcataccatggtattcacaacccgcaaaccaggagattccctctggtgcccaccccaccagggccctgggtttcaagcacaaaactggttgaccatttgggcagacaccaaagtagctgcaggagttctttttctccataccccaatggcacctggaacaccagtgagacagaatcaattactcccctggaaaagggtgctgaagccagggagccaagtggtctgactcggcgggtcccaccctcacggagcccagcaaactaagatccactggcttgaaattctcactgccagcacagcagcagtctgagatcgacccaggacattcgagcttgttcgggggaggggagtccgccattgctgaggcttgagtaggcagtattacgctcacagtgtaaacaaagccactgggaagtttgaactgggcagagcccactgcagctcagcaatgctgctgtggccagactgccagatttctctactctgggcaggcatctctgaaaaaaaggcagcagccccagtcagggacttatagataaaattcccatctccctgggacagagcacctggggaaaggggcagttgtgggcgaagcttcagcagacttaaatgcccctgcctgacagctctaaagagagcagtggacctcccagcacagtgttcaagctctgataagggtcagactacctcctcaagtggatccctgaaccgcatgtatcatgactggaagacacctcccagatggggcagacagacacctcatacaggagagctctggctgacatctggcaggtgaccctctgggaggaagcttccagaggaaagatcaggcagcaatctttgctgttctgcagcctccactggtgatacccaggaaaacaggattgggagtggacctccagcaaactccagcagaccggcagcagaggggtctgtcagaaggaaaactaacagaaaggaatagcacgtccactcaaagaccccatcttaaggtcaccaacatcaaagaccaaaggtagataaatccacaaagatggggagaaaccagtgcaaaatggctgaaaattccaaaaaccagaacgcctcttctcctccaaaggatcacaactcctcaccagcaagagaacaaaactggacagagaatgagtttgatgaattgacagaagtaggcttcagaagatgggtaataacaaacttctccaagctaaaggagcatgttctaacccaatgcaaggaagttaagaaccttgaaaaaaggttagaggaatggctaactagaataaccagtgtagagaataacacaaatgacctgatggagctgaaaaacacagcaagagaacttcgtgaaacatacacaagcttcaatagctgattcgatcaagcggaagaaaggatatcagtgattgaagatcaacctaatgaaataaagagaaaagacaaggttagagaaaaaagaatgaaaaggaatgagcaaagcatccaaataaatatgggactatgtgaaaagaccaaatctacatatgattggtatacctggaagtgatgaggagaatggaatgaagttggaaaatactcttcaggatactatccaggagaacttccccaacctagcaagacagaccaacattcaaattcaggatatacagagaacaccacaaagatactccttgagaagagcaaccccaagacacataatcatcagattcaccaaggttgaaatgagggaaagaatgttaagggcagccagagagaaaggtctggttacccacaaagggaagcccatcagactaacagcagattgctctgcagaaaccctacaagccagaagagagtgggggccaatattcaacattcttaaagaaaataaatttcaacccagaatttcatatgcagccaaactgagcttcataaatgaaggagaaataaagtccgttacagacaagcaaatgctgagagatttcatcaccaccaggcctgccttacaagagctcctgaaggaagcactaaacatggaaaagaacaaccagtaccagccactgcaaaaacataccaaattgtaaagaccatcaacactatgaagaaactgcatcaactaatggtcaaaacaaccagctagtatcataattacaggatcaaattcacacataaccatatttaccataaatgtaaatgggctaagtgctccagttaaaagacacagactggcatattggataaagagtcaagacccatcagtgtgctgtattcagaagacccatctcatgtgcaaagacacacataggctcaaaataaagggatggaggaatatttactgaggaaatgcatagcaaaaaaaaaaaaaaaaaaaaaagcaggagctgcaatcctagtctctgataaaacagactttaaacctacaaagatcaaaagagacaaagaaggccattacataatggtaaagggatcaatgcagcaaaataactaactatcctatatatacatgcacctaatacaggagcacccagattcatgaagcaagttcttagagaattacaaagagacttagacccacacaataataatgggagtctttaacaccccactgtcaatattagacagatcaaagagacagaaaattaacaaggatatacaggacttgaactcagctctggaccaagcagacctaatagacatctacagaactctccaccccaaatcaacagaatatacattcttctcagcaccacatcacacttattcaaaaactgactgcataattggaagtaaaacactcctaagcaaatgtaaaagaacagaaatcataacaaagtgtctctcagaccacagtgcaatcaaattagaactcaagattaagaaactcactcaaaaccacacaactatatgaaaactgaacaacgtgctcctgaatgactactgggtaaataatgaaatgaagggagaaataaagatgttctgtgagacaaatgagaacaaagacacaatgtaccagaatctctgggacacatttaaagaagtgtgtagagagaaatttatggcactaaatgtccacaagagaaatcaggaaagatctaaaattgacaccctaaaatcacaattaaaagaactagagaagcaagaacaaacaaattcaaaagctagcagaagacaagaaataactaagatcagagtggaactgaaggagatatagacatgaaaaacccttcaaaacatccatgaatccaggagctggttctgtgaaaagatcaacaaaatagatagactgctagccagactaataaagaagaaaagagagaagaatcaaatagatgcaataaagagtgatataggggatatcaccaatgttcccacagaaatgcaaactaccattagagaatactataaacacctctatgcaaataaaatagaaaatctagaagaaatggataaattcctggacacatacacccttccaaatctaaaccaggaagaagtcaaatccctgaatagatgaataacaaattctgaaattgaggcagcaattaatagcctaccaaccaaaaaaagcccaggaccagatggattcacagccaaattctaccagaggtacaaaaggaagctgataccattccttctgaaactattccaatcaatagaaaaagagggagtcctccctaactcatttgatgaggccagcatcatcctgataccaaaacctggcagagacaacaataaaaaaagaaaatttcaggccaatatccctgatgaacatcgatgtgaaaatcctcaataaaatactggcaaaccaaatccagcagcacatcaaaaagcttatccaacatgttcaagtgggcttcattcctgggatgcaagtctggttcaacatatgcaaatcaataaacataatccatcacataaatagaaccaatgacaaaaccacatgattatatcaatagatgcagaaaaggccttcaacaaaattcaacaccccttcatgctaaaaactctcaataaatgaggtatcagtggaacatatcacaaaataataagagctatttatgacaaacccacagccaataccatactgaatgggcaaaaagtggaagcattccctttgaaaaccagcacaagacaaggatgccctctctcaccactcttattcaacatagtactggaagttctggccagggcaatcaggcaagagaaagaaataaaagtattcaaataggaagggaggaattcaaattgtctctgtttacagatgacatgattgtatatttagaaaaccccatcgtctcagcccaaaatctccttaagctgataagcaacttcagcaaagtctcaggatacaaaaatcacaagtattcctatacaccgataacagagagtcacatcatgagtgaactcccattcacaattcctacaaagagaataaaatacctaggaatccaacttacaagggatgtgaaggacctctttaaggagaactacaaaccactgctcaatgaaataaaagaggaaacaaacaaatggaaaaacattccatactcattgctacccccatcaagctaccactgactttcttaatagaattggaaaaaaactactttaaatttcatatggaaccaaaaaagagcccgcatagccaagacaatcctgggcaagaagaataaagttggaggcatcactctacctgacttcaaactatactacaaagctaccataatcaaaacagcatggtgctggtaccaaaacagacctatagaccaatggaacagaacagaggcctcgggaacaacaccacacatctacaaccatctgatctttgacaaacctgacacaaaccagcaatggggaaaatattccctatttaataaatggtgttgggaaaactggctagccagacacagaaaactgaaactggaccccttccttacaccttatgcaaaaatcaactcaagatgggttaaagacttaaatgtaagaaccaggaccataaaaatcctcgaagaaaacctgggcagtaccattcaggacataggcatgcacaaagacttcatgtctaaaacaccaaaagtaatggcaacaaaagccaaaattgacgtgggatctgattaaattaaagagcttctgcacagcaaaataaattgtcattagagtgaataggcaacctagagaatgggagcaaaattttgcaatctatacatctgaaaaacgctaatatccagaatctacaaagaatttaaacaaatttacaagaataaaacaaccccatcaaaaagtcggcaaagaatatgaacatacacttctctaaagaagacatttatgcagccaacaaacatacgaaaaaatgctcatcatcactggtcatcagagaaatgcaaatcaaaaccacagtgagataccatctcacgccagttaggcaatcatcaaaaagtcaggaaaaaaaagatgctggagaggatgtggagaaatagggatgcttttacactgttggtgggagtgtaaattagttcaaccattgtggaagacagtgtggaaattcctcaaggatctagaactagaaataccatttgacccagcaatcccattactgggtatacacccaaacgattataaatcatgctagtatacagacacatgcacacgtatgtttattgtggcacagttcacaatagcaaagacttgtaaccaacccaaatgtccatcaatgatagactggataaagaaaatgtggcacatatacaccatggaatactatgcagccataaaaaaggatgagttcatgtcctttgcagggacattgatgaagcagaaaaccatcattctcagcaaactatcgcaaggacagaaaaccaaacaccacatgttttcactcgtaagtgggagttgaacaatgagaacacatggacacgtggaggggaacatcacacactgggccagtcagggggtggggggctgtgggagggatagcattagcagaaatacctaatgtaagtcatgggttgatggttgcagcaaaccaccatggcatgtctatacctatgtaacaaaactgcacgttgtgtctgcttggtccagagctgagttcaagtcctggaatcccttgttaactttctgtctcgttgatctgtctaatgttgacaatggggtgttaaagtttcccattattattgtgtgggagtctaagtctctttgtagttctctaagaacttactttatgaatctgggtgctcctgtattgggtgcatatatatttaggatagttagctcttgttgttgaattgatccctttaccattatgtaatgaacttctttgtctcttttgatctttgttgttttaaagtctgtttttttagagactaggattgcaacccctgcttttttttttttttttttttttgctttccatttacttggtagatcttccctccatccctttattttgagcctgtgtgtatctttgcacatgagatgggtctcctgaatacagcacactgatgggtcttgactctttatccaatttgccagtctgtgtctttcaattggggcatttagcccatttacatttaaggttgatattgttatgtgtgtgaatttggtcctgtcattatgatgctagctggttgttttgcctgttagttgatgcagtttcttcattgcatctatggtctttacaatttggcatgtttttgcagtggctggtaccggttgttcctttccatgtttagtgcttccttcaggagctcttgtaaggcaggcctggtggtgatgaaatctctcagcatttgcttgtctgtaacggattttatttctccttcacttatgaagcttagtttggctggatatgaaattctaggttgaaaattctttcctttaagaatgttgaatattggcccccactctcttctggcttgcagggtttctgcagagtgatctgctgttagtctgatgggcttccctttgtgggtaactcgacctttctctctggctgcccttaacatttttttccttcatttcaaccttggtgaatctgatgattatgtgtcttggggttgctcttcttgaggagaacgtttgtggtgttctctgtatatcctgaatttgaatgttggtctgtcttgctaggttgggaaagttctagataatatcttgaagagtgttttctaactggttccattctcctcatcacttccaggtacaccaatcaaatgtagatttggtctcttcacatagtcccatattttttggatgctttgctcattgcttttcattcttttttctccaaccttgtcttctctctttatttcattaagttgatcttcaattactgatatccttttttccgcttgatcgaatcagcttttgaagcttgtacatgcttcacgaagttctcatgctgtgtttttcagccccatcaggtcatttgtgttattctctacactggttattctagttagccattcctctaaccttttttcaaggttttagcttccttgccatgggttagaacatgctcctttagcttggagaagtttgttattacccaccttctgaagcctacttctgtcaactcatcaaactcattctccgtccagttttgttcccttgctggagaggagttgtgatcctttggaggagaagaggcattctgttttttggaattttcagccattttgtgctggtttctccccatctttgtggatttatctacctttggtgtttgatgttggtgacctacggatggagttttgttgtggatgtcctttgtgttgatgttgattttattcatttttgtttgttagttttctttcttttttcttttttttaggtattgatgggacgtatctcaaaataataagagctatctatgacaaacccacagccaatatcatactgaatgggcaaaaactggaagcattccctttgaaaatgggcacaagaccgggatgccctctctcaccactcctattcaacatagtgttggaagttctggccagggtaatcaggcaggagaaggaaataaagggtattcaattaggagaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacactaataataggcagacagccaaatcatgagtgaactcctattcacaattgcttcaaagagaataaaatacttaggaatccaacttacaaaggatgtgaaggacctcttgaaggagaactacaaaccactgctcaatgaaataaaagaggacacaaacaaatggaagaacattccatgctcatgggcaggaagaatcaatatcttgaaaatggccatactgcccaaggtaatttatagattcaatgcgatccccatcaagctaccaatgactttcttcacagaattggagaaaactactttaaatttcatatggaaccaaaaaagagcccgcatcgccaagtcaatcctaagccaaaagaacaaagatggaggcatcacgctacctaacttcaaactatactacaagactacagttttctttctaacaggcccctcagcagcaggtctgttggagtttgctggaggtccactccagaccctgtttgcctcagtatcaccaatggaggctgtagaacagcaaatattgctgcctgatccttcctctggaagctttgtcctagaggggcaccttccagatgccagccagagctctcctgtatggggtgtctgtcagtccctactgggaggtatctctaagtcagggtatacggggttcaggcacccacttgaggaggcagtctgtccattatcagagcttgaacactatgctgggagaaacattgctctcttcagagctgtcaggctgggatgtttaagtcttcagaagctgtgcccacagagcaccttcccccaggtgctctgtcccagggagatgagggttttgtctacaagtccctgattggggctgctgccttttgttcagatatgcccttcccacagaggtggactctagaggcagttggccttgctgagctgtggtgggctcttccctgcttgaacttcctggcagctttctttacactgcaagcataaaaccgcctactcaagcctcagcagtggtggacgcccctcccgtctccaagctccagcatcccaggttgatttcagactgctgcactagcagcaagaatttcaagccgggcacggtggctcacacctgtaatctcagcactttgggaggctgaggcggacagatcacaaggtcaggagatccagaccatcctggctaacacggtgaaaccccgtctctactaaaaatacaaaaaattagccaggcatgatggcaggcgcctgtagtcccagctaatcgggaggctgaggcaggagaatggcgtgaacccaggaggtggagcttgcagtgagccaagatcgcgccactgcactccagcctgggcgacagagcgagactccatctcaaaaaaaaaaaaaaaaaaaaaaaaagaatttcaagccaatggatcttagcttgctggggttcatgggcatgggacccattgagccaggcaccagagggaatctcctgggatgcagaccattttaaaatgtttcttggccacttgtatgtcttatgagaaggatcttttcatgtctttgcccagtttttaatgaggttgtttgttttttgattgttcatttgtttaagttgcttatagattctggatattgaaccttcattgggtgtatagtttacaaatattttctcccaataggtaggtcgtctgtttattctgttgataggttcttgctgtgcagaagctgtttagtttaattcagtcccacttgtcaatttttgtttttgtcgaaattgcttttgaggacttagtcataaattctttcccaaagccaatgtccagagtggtgttgcctaggttttctttcaggattcctataatctcaggtcttatatttcaatctttaatctaaagttaatttttgtatatgatgaaagataggggtccagtttcattcttctgcatatggatagccacttatcccagcacaatttattgaatagggagtcctttccccattgtttatttttgttcactttgtcaaagatcagatttggtgcgcagccttatttctacgttctgtattctgttccattggtttatgggtctgtttttgtaccagtaccatgctgttttggttgctatagccttatagtacagtttgaagccaggtcatgtgatgcctccagctttctttttgtttaggattgctttgggtagtcaatctcttttttgtttccatttgaatttttgaatagtttttttttctagttctgtgaaaaatgacattggtagtttgataggaatagcattgaatctgtagattgctttaggcagtatggctattttaatgatattgattcttccaatcaatgagcatggaatggttttccatttgtttgtatctataatttatttcatcggtgttttatagctgtcctagagatctttctcctccatggttagctgtattcactggtattttaattttttttgtggctactgtaaatgagattaccttcttgatttgtctctcagcttgaatgatatttgtgtatagaaatgctacttatttttgtatattaatttagtcttctgaaattttactgaagtcatctatcagttccacgaatattttgacagagtctttagggttttctaggtatagaattatatcatccatgaagggaaatagtttgacaccttcttttccaagctggatgtcttttatatctttctcttgtctgattgatatggctaggactataatgaatgggagaggtaagagtgggcatctgtgtcttattccagttgtcaaggggaatgcttccagtttttgtcctttcagtataatgttggctgtgggtttgtcataggtggctcttattattttgaggtatgttcctttggtgcctagttattgagggtttttaacatcatgagtagatgttgaattttattgaaaactttttctgtgtttattgagatgatcatatggtttttgtttttaattctgtttatctggtgaattatgtttattgatttgcatatgttgaaccaaccttccatcccaggaatgaagcctacttgatcatggtgaattaacttattgatgtgctgttggatttggtttgctagtatgttgttgaggatatttgagtcaaagttcatcagggatacttgtctgtagttttttgttgttgttgttgtgcctttgccagattttgggatcagaatgatgctggctttgtagaatgagttatgggggattcctccctcctctatgttttggaaccatttcagtagaatttgtatccaccgtgatttgtatgcctggcagaatttggatgtaaatccatcaggtccagggcatgtttttttttttttttttttttggttggtaggtttttattttgattactaactcaatttcagaactcgctattggtctgttcagagtttcaatttcttcctgattcaatcttgggagagtgtgtgtttccaggaatttatcagttttctctagattttctagtttgtgtgcatagaggtttttcataatagcctctaattatcttttatatttttatgggttggttgtaattttacctttgttgtttctgattttgcttatttggaccttctctcttttttcctttgctaatctagctagcaggctattgatcttgtttatcctttcaaagaaacagacttttggttttgttgattcttcatatggatttttacatctcaatttccttcagttcgtctctggttttacttattttctgctagctttggcggtaatttgttattgtttttctagttcctctgggtatgatgttagatcattaatttgagttctttctaactttttgaggtaggtgtcttctatgtaattatgtggttttatgagatcttcttgatattaatttccatttgtatttcattgtattccaagagtatgattttattttttgaagttattgagacttgctttatggccaagcatgtggtcaatcttggagtatgttctgagtgcatatgagaagaatgtatattctgaggttgatgggtggaatattctgtagatgcctatgaggtccaactgatcaaatgttgagttcaagtccaggatttctttgttagttttctgccttgatgatctgtctagtggtgtcagtggggtgttgaagttccacactattattgtgtggctaagtcttttgtaggtttagaagtacttgttttatgaatttgggtgctctaatgttgggtgtgtacatatttaggatattttagtcttcttgttgaattgaaccctttatcaatactgttgttggtttaaattctgttttatctgacataagaatcatgacccctgctcttttttggtttccatttgtctgatagatctttctctaatcctttatgggtgtcattacatttatatgtgagatgggtctcttaagacagcaatggatttctctcattttttaatccacttaccactctgggccttttagatggggcatttaggccatttgcattcaagattaatattgatataggaggttttgatcatatcatgaagtttttagctggttgttttgtagtttgtattgtgtggttgctttatagggtctgtgggctatgtactcaagtgtgtctttgtcgtagtaggtatcattcttttgtttccatgtttagaaatcccttaaggatctcttttaagactggtctagtggtaaaaaaatttcccttagcacttacttgtctggaaaatattttaattttaattttaagttctgaggtacatgtacaggatgtgtaggtttgttacataggtaaacatgtgccatggtgttttgctgcacctatcaacccatcacctaggtattaagcctagcatgcattagctatttttcctaatactctccctcccccaaccccaccccccaacaggccccagtgtgtgttgttcccctctctgtgtccacgtgttctcattgttcagctcccacttataagtgagaacatgaagtgtttagttttctgttcctgaattagtttgctgacagtaatggcttccagctccatccatgtccctgcagaggacatgatctcattccttttgatggctgcatattattccatggtgtacattaccacattttctttatccagtctatcattgatgtgcatttaggttgattccatgtatttgctattgtgaatagtgctgcaatgaacaattgtgtgcatatatctttgtaatagaatgatttatattcctttgggtatatacccagtaataagactgctgggtcaaatggtatttctggttctagatctttgagaaatcaccacaccatcttccacaatggttgaattaatttacattcccacaaatggcataaaagtgttcttatttctctgcaacctcaccagcatctgttgtttcttgactttttaatgatcaccattctgagtggcatgggatggtatctcattgtggttttgatttgcatttctctaatgatcagtgatgttgagctttttttcatatgtttgttggccacatgaatgtcttcttttgagaaatgtctgttcaggtcctttgcctacttttaatggggttgcttttttaaaaaaatttgtttaagttccttgtagattctggatactagacctttgtcaaatggatagattgcaaaaattttctccgctctgtatgttccctgttcactctgatgatagttgtttttctgttgttgttttgttttgttttgtttttgctgtgcagaatctctttagtttaattatgaaactgcctttgcaacattatgatggagacagtgaaatagatctaacttaatcaactccatgttgcttctaacctccaagctgtccttgttcattcatgggtataggctgaattaactttgggagaagcttacttcatagtttatagtttaatatgaagacaataacagccctttcccaaagcagacctccttcatgcctgggaattagattgcctttgtaggactaacattagccacaagattagaaattatggtttgaaagtcatgcggctggaggctacaagtttctgacccttcctaaactgctcctaagatcagtgcttgaaatattttgcagaccctgcacttgatggatcagctggcactacccaggttgataagttgtctcatctaatcatctaatcttgtggcccccacccaggtactgactcagtacaggaagatagcttcgactccctgtgatttcatttctgaccaatcaatgcttctggctcactggcttccctcaaaccaccaagttgtccttaaaaactctcctccctgaatgctcggagacactgatttgagtaataaaactctggtgtcccgcacagccggctctgcgtgaattaccctttccctattgcagttcccctgtcttgagaaatcagctatgtctagtcggtgggaaaggtgaacccattgggtggatataattagatacaatttgtcaaattttgtttttgttgcaattacttttggtgatttcatcatgaaatctttgcctatgccaatgtcctgaatggtattgcctagattcccttctagggtttttatagtttggggttttacatttaagtctttaatccatcttgagttaacttgaagcttaggttggtgggatatgaaattcttggttggaatttcttttctttaagaatgttgaaaataggcccagaatctctcttggcttttaaggcttctgctgagaagtctgttgttagcctgatggggttccctttgcaagtgacctgtctcttctctagccatctttaagattttttctttagcattgactttggatagtctggtgactgcatgccttggtgatgtttcttttgtatagaatcttccaggtgttctttggatttcttctatctggatgtctatctctagcacgattagggaaattttcttgaattattccctcaaatatgttttccaggctgtttactttttcttccctctcaggaatgccaataatttgtaagttacatcactttagataatcccatattccttgaagactttgttcttgtatttattttatttttgtctgggttagtttgaaagaccatcttcaagctctgaaattttttattctgcttggttcaatctgttgataaagatttcagttatattctgaagttccttaactgagtttttcaatttcagaagctctgattgatttctttttaaaatgtttatctcttccttcatttcctggattgatttagaagtgtcttcgtgttgattttcaaccttgtcttgggtctcagtgagcttccttacaatccattctttgacttctttatctgtcatttctgagtttccactttggttagggaccatttctggagagctagtgtgatcctttgatcatgtcactacattcagattttttatggtgccagaattcttgcactgtttctgtctcatctggagacactggcacttctaattttttaattattttcatgcaggtaggatttcttcttattttttccctgtaatattattgtttttcttttcctttcccttccctgcagggggtacaactgtagagaatgctgggtaggatattttggcttcactttcatagccctatgcacttttggggggcaggttttatattgggctgtgtagtttgacctataaggtagttgatggtacttacaggtaagagctggctgtggccaatgcagtggggtatgtacttgatccttgttcactggcacaggctctctgttgcctcaggcaatgggttgactcatggaatgcacagtggtctgagctccctgctcaggccggggacagggaagcccaatgggtggggccagaccaggcaggtccacttacaggttctctgatggcaggcataagcactgagggtgaatctagtgggtggccaccagacacccagaggtgtgcctacgtatggagctgagaaacctccttagccccaggttctttgcacagggatggtgggtagctcatgctcctattccagaggaatgggtgctccagatacctggagatctacctgagtgtggagcagagggacccctgcaccaatatttctgcaaaggaggggtgggggtgactcaggctgctaaaccaggaatgcaggtgctctaaatgcctggagctctgcctgggtgtgtagcagagagggcccttctgtaccaggttctctgcacaggaagtgtgtggtgactcaggctgctgatccaagcaagctggttctctgaatgcctggagttctgcctggacatggagtgcagggggccttgctataccaggatctatgcccatgaagggtcaggaagctcaggctgttggtccaggcaagtgggtggtccaaatgtctggatttctgcttaggggtataccagagagtgcccttgagtgatacaccatctcaagggggaaagctggagcacccagcaatggcacacacagactggtttccagtcatcaagctggccttggctgcaagtgtcactgtccaggagaaactgcagctgtagcagctctcctcctgcctgaggcttgcaatggaggagagcagaattccagtgcctacttctgaaaccctttccacagttctggctgtggatgtccttatcccagtccagggcaggcactctagaggtctggtctgagacggcaatgcctgtgtggtcatgctgccaggttgccacagaatggctgactttgtatgtgcccagattaaaaatgatatcctgctctcagtcccacatctgggaaaatgcctgcaacttttcctggtgtctttcccttgcagagtctctaagcctctcctcaacttacctccaggtcttgggagaaacaaagtgttctcccttggtcttggttgctcagattcccagtggaaaggtaagtcacagagggaggctctctgcttctctcacatgctggagcttcactcacttaatagctaaatgctgtcacgggggctgtttgccagtgttctccacaggaccagggatatctttcatgattctagtggattcccattttcctccttgaattaaactgcacagagtttatatttatgcactgtcttgctacttccgagtggctgaggcatgctaaaagcccctaatccaccatcttggaaaatgaaactgtattgctactgaagacgtgggatgtccaatatggcattgcaaataagcatatatctatagaccaacatttatgtatataatactgtgttaaatactacagggaaaatattaaaaaataagcaaagatagacattgaagaaatatttacaagcatgctgagtgttatcatggagaagtacaggtgcaatggaaatgttaaagtgagggatcttgtcaactctgcaaatcagaggaaacgctctggaggaattgtctacttaaatgagacttaatagatgagaatgttaaccaggtgaggaagtactagcattctagggagagaggaagcatgtatggggccctggagatgagagagaaaatggcatattctaggaaccttaaaaagcgcagtatggctgaagagtaggaaaccattaggagtttggctggaagtaagattggagagtaagttagaagtcacattgtgagggacaatgggaaactataaaaggttttaagaacagaaaatgaccggtgagaagtgcattaaaagatgtggtgtaattgggcacagtgtacactgctcaggtaacaggtgcaccaaaatctcagacacccccactatagaacttctccatgtaaccaaaaaccacctgttcccccaaaactattgaaatacaatttttttttttttaaagagatggtggctgggcgtggtggctcacgcctgtaatcccagcactttgggaggccgaggcgggcggatcacagggtcaggagatcgagaccatcctggctgacatggtgaaaacccgtctctactaaaaaatacaaaagattagcggggcatggtggcgggtgcctgtagtcccagctactcgggaggctgaggcaggagaatggtgtgagcctgggaggcagagcttgcagtgagccgagttcgcaccactgcattccagcctgggtgacagagcgagagtctgtctcaaaaaaaaaaaaaaaaaaaaaaaaaaaaaaagagatggtatactcttgggtgaggccatcttggaagacagtaataggtagttggttattttttgttagtcagtttagtacccatacttggctcttggactgtgcttattagaccttgatatggagtagtccatttgtgttccatgaaacttttgaaaccagctgattgtcaaatgtcaagcatctcaagagattctgcctgggttggctttatggttccatttatatgtatgttctatataatatataaattctataatttatataataatataatatataaattctataatttatataataatataatataataacatatacattctataattctagtacctactgctgacatgtaatattatatagatataactgctgatctgtaatatatataattcctgacatgtattatatattacaatgtaatatatattagatgtaacatatattacatctcataatgtatacctctcatacattatatatatattacaaggtctaattagagaagtctaactagagaaatcacatcaaggtctaattagagaagtatgtacatctcagcagttatatatatatataatattacatctagaattatattacaatagaatatacatatatatgtgtgcatatatataatattacatctcagcagtaggcattaaaattctgctctcccccattgcaagcctggggtaggaggagagctggcatccaggaccagcttggtgacctgcatccagtctgtgtgccattgctgggtgctgcagcctgctcccctgagaaagtggtgcagcagggtgctctctctgccgtacccccagggtgctctctctgccatacccccaagcagaaatccaggcatttggagcacccacttgcctagaccagcagcctgagctgccccacccattatggacataggtcctggtacaacagggccctctccactccacacccagactgaggccgatctccagtttatatatgtattaggagatgttggtaatgatttggagtggttattagccaatcaggagacaaattgataatttttttctcccaaaatagaagaaagacaggagagaaatgaagagagaggaaaggtagagctatataacccagtagcaagatggactatgaacagtactcagtagctttctcatatgctgtcaatggatggagtgtggttcaggaggtttggattcagttatattattttcatatgacttaccattttaacttccttagggaatcacttaaattagtcatgccttagttcttttcatgtaaagacattctggctcagaaccaaccattgtgcagtttcacttgatgaaatcatgtcatttagagcatcttgaactccagagagaggtatctcatgcgagaagtttttattacaattgttatcttctgcttgtttgcacctcagttccttagaaaagaaacacattttgaagaaattcctttaataaggacttggcaatgtaggcagactgccttgtgatattcacacttttctaactgcaatattgagtgtgtgtctttgatgggtctcttatggcaggtgtactgactttttttcccctcctggtgtcggtgtaatatttttacagaacggcagagggtatatgaatagatcctgatgtaaggtgtgaacaaggaagaaagatgtttgctctggctttggcttatcttctagcaaagttgcctagaatgtggttgtaaatgactgtcatgtagtaaactctgcctaccttccctgtctcttctctaagctaaaataactagcactgttttgttcatttatgcaaacttgtgctttttttttttaatatgtagagagatgatgctaagtcatcagcagcattgtggctctgacttgtttttactagtagatgggttgcatctgagcttttcacttgccttacttcactgaggaccaatatagtgtctctgggggacaatggtcaaggtgaggcttttcgtctgtggctgtgatatagagtgagtctcattggcttacacaggatataactgcaattttgacctcagtgctatgctcaatttagttgagtgaggttgcttatggggtaccaatgaatcccagagggcagaactcactctcaaaaatgtaacttgtctattagtcagtggacaaacatataactgaagagtatgcagatgtttcccattgaaatgagaaaataaattttaataacttttttttgtatcttttaaggaagagcctggaattctccattcagttgccacccatagtgtgtctcattgttttctgttattgtaggtttctaggtcagatgctgatcacgaaattatttgtcataaccttctgtttgaaactgaagcatttttttttaaaaaaagttttgtctcataatgtctagaaactgcctttacattataaagttgcttgtatttatccacagcctggaataatctattgatggtattttacttctaaacagtaagaaagatatgctgtaatctgttgggaagactgtattctttgtacttatctaggttaaaggaaacagtagtagcttgacctctagatatttggcttcatatgccttggctgcttggtagaagtcatcccatattgaatatacattgtttccaaaggacatttctgcttctggagtagctccaaacacacactgctatgcttataaaacagggctgagggaagtagtttgctggaaccagtttgctcttgctagttaagagtcgattgtgtacatttcttttcaacactgtgttgaatgacataacattggtagattgaaacaggtcatgatgggagtattcacaccacaggaataggcaaaggctacccatcaggggtccctctccccttggagagtcagttgttgaatacttaacaacacaccactggttggaggttgttatcccagccattgaggcctaccccagagtagacttgacatattccattttattcctggaattgggactgactcaggcctccccaggttttgggggaactattctaaaggaataagccaattcaaatccacacttttgaaactgggtgagaaagagccaagtcatctgaaggatgaaggtccagaatggggctgaattaccattcagtttatcgcattcagagcaatgttgtctaacagactgattccaggtgctagccatttactgtaaataagaaatatgaactattttgtcactggaacaatttaccaaacaagtaccttcctgtcaattcatggtaaagtaatgagagaaacaagagaagtcctcaacttgagtatactttgtaagtggtttagcttcctggcaggcactgatgtatttcatgtgtatccatctcatccctgcagattctcttagcttaatgattgtcaaaacactgtaaatagtcggtgatattgaagatggcaatttccataaactatttattctttctttttgacaaaaaatgacttcctatttttttaagaatgcctcaaacacctgggttttggtgctttcatttttagaatgaacattcctcctacttggcagttaatattttcgactttcagaacacttttggaatacggcttgactttaaaacttttaccattaaaatatttacaacgcatgtaataggtatagggatactttcattacaaatcattaaaaaaaatctgaacacctgaatgaaaacttggacaaaagatatgagcaaagctatctacagaaaaaaggaaatacaagtagtcaataaatatatgaaaagatgatctatctaattcatattgaaaatgtaaatgcaaatgaaaacaccatatcaatgttggttgagaatatgaagtaaataagccatctcatatactattggtgggagtatacattggtattaggtttattggagaaaataaggcaatattttcaaaaggtaagatgcatttagttttgggcccactgtccttacttccagaatttatcttacaaaaatatttgtgtatgaacattacatatacatatacatacacatggctattcattataaaattgttttaatagcataaaaactgagaagtatccatcattagggatgatctaactaattagttaaattaatatggaaacaccaggcagtggtgtactttgtattcactagaaagtatgaggtagatctacttacactagcatagaaagatgttcactaaatatagatggcacttggtgaaaaaaatattgtccaataatatgtcttgtattacctcactttcatttaaaaattatatatcactcttcactatatatacttctgtagaattgaatatttgaaaataagcaggcattactcttgtgtttaaaatctattggaaaatacttttgtttttatactgttctgtaagcttgttctcctctattaacaacatactttgaacttatccctccctcactcttcccaactgacgtgcaacatcataccccatggataagccatcctccatccatccatgcatccatccacatattcatctatccacatacctgtgcaccaaattatttcttacttacttatttaaacaatttctttttccagttatagaagcaatgcttacccttggccaaaacaaaacaaaaaatgaacaagcaaaaacaataacaaaatggtacagttagagaagggtacataaaaaaatacagcttggactcattctccagaggcaaccactttaagagtttttgttctagtggttacttttttgccattaaataatgtacttattataataatgtaagtatttatatcaacattatattataatattagtaatatgcttatatctccatttgttgtcttctttttcttcttctcttctctgctctcttctcctttccttgtctatctgtgtcaggctcagaagaaagccataatcaggatatctctaaccctggcatagttcatgccttgggatatttgaccaagatgggaagaaccagagaggaaaatggatataatcatagaggggtggaccagtaaagaaatgtggcccctcgtctgtgccagttccttacctgaaaccagagaaggctagattgcagttggtgttttagctgtggataaaactttaacccagagttcctgggactcttaatggtatgacgaaatggagaaaaacatggcttttgagtccaaaagactggattttgaatccccactctaccactttctagctgtataatcttcaggcaacttgtttaactcctttgggctctagcatccttatctgtaaactgacagtattttactcaatattatactgtggaagttagatgatgataataactagcatttgcttattactatgcatcagatatgattctaagtgctagattgggtctctgattacaatgtatatctccttctcatgcttactataattatgattaaataatttattgtttaatgtgtgtctctcccaatgaatgttagtttcatgagggcaaggatcatgtctgtcttcctcacagtactgtatttttagtacctgctaagtatatatattgattctcagtatttattgactaaattaagagatatctgggttgtgactgtctcatgcgtgtgtgtgtgtgcgtgtgtgtgtgtgtgtgtttgtgcgtgtcagacttttatgaccctgaggcataattcggtatttgacttcaaagtgagatgaccagatggtttgttttttattttaccaatgtcctaacagtcctttggtagccccaaataaatatgaaatatagagttgaaaatatttgggattaataattccttataaaaataattctgcattgatggtcaccaagtagtaatacatgcccagaacttggctgttttattaaagtttatttaaggaatagggaaatttggtaggaaatacagatcagtgtgctcaataaaaaatcctgccaacttttctatctgtaaagtgtatctttaggctataactcataaaaaaaaaagtaatgttttaattgcagatgacatatcagtttctaccagtttgttgttatataggtaatgcaattgattaagctcaattggaccagatcattcttttactgaatctttgttccaattgtagtgttttgtagataacttttttttttttttgagacagagtctcactctgtctcccaggctggagtgcagtggtacaatctcagttctgtagcctctgcctcccaggttcaagcagttctcctgcctcagcctcctgagtagctgagactacaggcacgcaccaacacacccggttaatttttgtatttttagtagagacgtggtttcaccattttggccaggatggtctccatctcctgacctcatgatccgcccgcctcggccttctaaagtgctgggattacaggcatgagccaccaggatatctttgctcaactgggttggacagtcgagaactgattttaattttattgagggaagcattggcttgaatttgtctctttaaaacatcaatctcattgttcaattcccacctatgagtaagaacatgcagtgtttggttttttgtccttgcgatagtttgctgagaatgatgatttccacatggacacaggaagggtaatatcacactccggggcctgttgtggggtggggggaggggggagggaaagcattaggagatatacctaatgtaaatgacgagttaatgggtgcagcacaccaacatggcacatgtatacatatgtaacaaacctgcacattgtgcacatgtaccctaaaacttaaagtataataataataaaataaatcaatctatgtttctattttaacaccaaataattatgttaacaaagaccacagacagcagttgcttttgcttatccttaatcacttccctaagtataaagattttggtaattcaactttaaggctatctattcctattgtgaaaaaggaccccctccccacatattcccatgtgtcaatgagggaacataaggctgatgtggtaaagactatgatgacctggtacatttcaagatgttttatggtacttaaaaccaaagggatctgaaaagggagcctggtgatagaggaggtttaaaccaaaaagactctgggttgaacgtgaccagtaattgctcaacctgcctggtatgtctaaaaggaataacacacttggtatataatctagaactgtgattttgatgtgtgaacatatcattgaaaagaaaaaaaaatctatcaactgatctattatgatgttaaattacttatttgaccaattttaaataacgttaagatgaaatttacatatacttcaatgatttaaaggatagaactaaataattttatatttatttacttttcatgatacataatatttttacatatgtatggggtacatgtgatattttgttacatgcatagaatatgtaatgatcaagtcaggatatttagggtatccatccctcaaacattcatcatttctctgtgttgggaacatttcaagttctcctttctggctattttgaaatatataatatattgttgttaattatagtcaccctactctgctatagaatattataactcattttttcatctagctatatatctgttcccattaaccaacctctctctgttccccctcccctaacacccacccttcctagcctctggtatctatcattctactccctacctcagtaagatgaacttttttaacttccacatatgagtgaggacatgcaatgtttgtatttctgtgcctggcttatttaacttaatgacctcacattccatccatgttgctgcaaataacattattttattctttttttatggctgaatagtattccattgagtatatataacactttttctttgggaataaagctgcaataaatatggaggtccaggtatctatttagtgtactgattccttttcctgtggataaacacccagtagtggatggctggattgtatggtagttttatttttagatatttgagaaatctccatactgttttccacagtggctgtagtaatttatgttcccaccaagggtataagagttctgttttctctgcgtcctcaccaggaattctttttgtatgaatctatactacagcaatccaaatggttatgcataaaaatatgtgcacatacaaggatagccaatgcagtatgcgttgtgatggtgaaaatctggtaacagactaaatacattttcatgggtggtggtggtacattcatactatggaatactatacaaccattaaagagatggagatagacgggtatggatagaaatgggtagatctacaagatatatgaaaaacagatatgattccacatataatggaaaaatctatctatgcatgcataagaatgtgtgtatatctgtatggaaatctatagaaaaaggtttggaatttttaacattactataactcttaggaggggagtggttaaagtctatggttgaagggtaaatttcacttttgtcattttaataataaccattctgactggagtaagatgatatctcattgtggttttgatttgcatttccatgatgattaatggtgttgagcagtttttttcatatacctgttggctatttgtatgtcttcttttgagaaatgtctatttagagcttttgcctatttttaatgagattgtttctttctttgtgaggttgaattgtttgagctccttgtgtattctgtatattagtctcttgttagggaatagtttgtaaatattttctcccatttgacgggttgtcctttcactctgtttcttgtttcctttgctgtccagaagctttttagtttataatggtttcatttgtctatttttgtttttgttgcttatacttttgaggtcttagccataaattattttcctaggccaatgtcttgaagtgtttcctctgttttattccagtagttttattgtttgggattttacatttaagtctttaatccattttgagttgatctttatatatggtgagagatagggatccagtttcattcttctgcatatggttatccaattttcccagcaccatatattgaagagtgtcctttccccaatgtgtgttcttagagcctttattgacaataagttgactgtaaatatatgaatttacttctgggttctgtattctatttcattggtctatgtgtctgtttttataccaataacgtgctattttggttactatagtgttgtaatatattttgaaatcaggtagtgtgatgcctcaagccttgttcttttttttgtttgtttgtttttgagatggaatctcgctctgtcacccaggctggagtgcagtggtgtgatctcggctcactgcaacctccacctccctggttcaagcaattcccctgcctcagcctccatagtagctgggattacaggtgcatgccaccacacctggataatttttttttttttttgagacgtagtctcactctgtcaccagggctggagtacagtggcgcgatctcggctcactgcaatctccgcctcctgggttcaagcgattctcctgcctcagccccctgagtagctgagattacaggcgcccaccactatgcccagctaattttttgtatttttagtagagacggactttcaccatgttggtcaagctgctctcgaactcctgacctaatgattaacctgcctcggcctcccaaagtgctgggattataggtgtgggccactgcgcccggcaggctgatttttttgtattttttttttttttcagtagagatggggtttcaccatgttggccagactggtctcgaacttctgacctcaggcaatccacctgccttggcctcccaaagtactgggattacaggcctgagccactgtgcctggccactttgttctttttatttaagattgctgtggctattcaggccattttttggtttcatgcaaattgtaggattgtgttttctatttcagtaaaaatgacattggtattttgataggcactgcatcaaatctgtagattgctttgggtactgtggtcattttaacaatgttaattattcctatgcatgagcatagaatattgtttcatttgtttgtctcattcattagtgttttttttttcaagcttcttttttttattatactttaagttttagggtacatgggcacaacgtgcaggttagttacatatgtatacatgtgccatgttggtgtgctggacccagtaactcgtcatttaacattaggtatatctcctaatgctatcctacccccctcccacaccccacaacaggccccagtgtgtgatgttcccctacctgtgtccatgtgttctcattcttcaattcccacctatgagtgagaatatgcggtgtttggttttttgtccttgtgatagtttgctgagaatgatggtttccagtttcatccatgtccctagaaagaacatgaactcatccttttttatggctgcatagtattccatggtgtatatgtgccacattttcttgatccagtctatcattgttggacatttggctttgttcccagtctttcctattgtgaatagtaccaaaataaacatatgtgtgcatgtgtctttatagaagcatgatttataatcctttgggtatatacccagtaatgggatggctgggtcaaatgatatttctagttctagatacctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttacatttctctgatggccagtgatgatgagcattttttcatgtgtcttttggctgtataaatgtcttcttctgcgaagtgtctgctcatatcctttgcccatttgttgatggggttgtttgtttttttcttgtaaatttgtttgagttcattgtagattctggatattctgaccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcatgaattaatttttgtataaggtgtaaggaagggatccagtttcagctttctacatatggctagccagttttcccagcaccatttattaaataggggattgtttccccatttcttgtttttgtcaggtttgtcaaagatcagatggttgtagatatgtggcattatttctgagggctctgttctgttccattggtctatatctctgttttggtaccagtaccatgctgttttgcttaccatagccttgtagtatagtttgaagtcaggtagctcgatgcctccagctttgttcttttggcttaggattgacttggcgatgcgggctcttttttggttccatatgaactttaaagtagttttttccaattctgcgaagaaagtcattggtagcttgatggggatggcattgaatctataaattaccttggacagtgtggccattttcacgatattgattcttcctacccatgagcatggaatgttcttccatttatttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatatacaatcatgtcatctgcaaacagggaatttgacttcctcttttcctatttgaataccctttatttccttctcctgcctgattgccctggccagaacttccaacactatgttgaataggagtgttgagagagggcatccctgtcttgtgcccgttttcaaagggaatgcttccagtttttgcccattcggtatgatattggctgtgggtttgtcatagatagttcttattattttgagatacgtcccatcaatacctaatttattgagagtttttagcatgaagggttgttgaattttgtcaaaggccttttctgcatctagtgagataatcgtatggtttttgtctttggttctgtttatatgctggattatgtttattgttttgcatatgttgaaccagccttgcatcccagggatgaagtccacttgatcatggtggataagctttttgatatgctgctggattcggtttgccagtattttattgaggatttttgcatcgatgttcatcagggatattggtctaaaattctctttttttgttgtctctctgccaggctttggtatcaggatgatactggcctcataaaatgagttagggaggattccctctttttctattgattggaatagtttcagaaggaatggtaccagctcctccttgtccctctggtagaattcagctgtgaatccatcaggtcctggactttttttggttggtaagctgttaattattgcctcaatttcagagcctgttatttgtctgttcagagattcagcttcttcctggtttagtcttgggagggtatatgtgtcaaggaatttatctatttcttctagattttctagtttatttgcatagaggtgtttatagtattctctgatggtagcttgtatttctgtgggatcggtggtgatatcccctttatcattttttattgcgtctatttgattcttctctcttttcttctttattagtcttgctagcggtctatcaattgtgttgatagtttcaaaaaaccagcccctggattcattgatttttttgaagggtttttttgtgtctctatttccttcagttctgctctggtcttagttatttcttgccttctgctagcttttgaatgtgtttgctcttgcttttctagttcttttaattgtgatgttagggtgtcaattttgggtctttcctgctttctcttttgggcatttagtgctataaatttccctctacacactgctttgaatgtgtcccagagattctggtatgttgtgtctttgttctcgttggtttcaaagaacatctttattactgccttcatttcgttatgtagccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagtggtttacttccaactgtgtggtccattttggaataagtgcggtgtggtgctgaaaagaatgtatattctgttgatttggggtggagagttctgtagatgtctattaggtccacttggtgcagagctgagttcaattcctggatatccttgttaactttctgtctctttgatctgtctaatgttgacagtggggtattaaagtctcccattattattgtgtgggaatctatgtctctttgtaggtctctaaggacttgttttatgaatctgggtgctcctgtgctgggtgcatatatatttaggatagttagctcttcttgttgaattgatccctttaccattatggaatggccttctttgtctcttttgatctttgttggtttaaagtttgttttatcagagcctgggattgcaacccctgcctttttttgttttccatttgcttggtagatattcctccatccctttattttgagcctatgtgtgtctctgcacatgagatggatttcctaaatacagcccactgatgggtcttgactctatccaatttgccagtctgtgtcttttaattggagcattcagcccatttacatttaaggttaatattattatttgtgaatttgatcctgtcattatgatgttagctggttattttgcttgttagttgatgcagttccttcctagccttgatggtctttacaatttggcatgtttttgcagtggctggtactgactgttcctttccatgtttagtgctttcttcaggagctcttttagggcaggcctggtggtgacaaaatctctcagcatttgcttgtctgtaaaggattttatttctccttcacttatgaagcttaatttggctggatatgaaattctgggttgaaaattcttttctttaagaatgttgaatattggcccccactctcttctggcttatagagtttctgctgagagatccactgttagtctgatgggcttccctttgtgggcaacccgacctttctctctggctgcccttaaccttttttccttcatttcaactttggtgaatctgacaattttgtgtcttggagttgctcttctcgaggagtatctttgtggcgttctctgtatttcctgaatctgaacgttggcctgccttgctagattggggaagttctcctggataatatcctgcagagtgttttccaacttggttccattctccctgtcactttcaggtacgccaatcagacgtagatttaatcttttcacatagtcccatgtttcttggaggctttgtttgtttctttttattcttttttctctaaacttctcttgtcacttcatttcattcatttgatcttccatcactgataccctttcttccagttgatcgcatcggctactgaggcttgtgcatttgtcatgtagttctcgttccgtggttttcagctccatcagctcctttaaggacttctctgcattggttattctagttagctgttcatctaagtttttttcaaggtttttaacttctttgccatgggttcgaacttcctcctttagctcggagtagtttgatcgtctgaagccttcttctctcaactcgtcaaagtcattctccgtccagctttgttccattgctggtgaggagctgcattcctttggaggaggagaggcactctgatttttagagtttccagtttttctgctctgttttttccccatctttgtgtttttatctacctttggtctttgatgatggtgatgtacagatggggttttggtgtggatatcctttctgtttgttagttttccttctaacagtcaggaccctcagctgcaagtctgttggaattttctggaggtccactccagaccctgtttgcctgggtatcagcagcggaggctgcagaacagtggatattggtgaacagcaaatgttgctgcctggtcgttcctctggaagttttgtctcagaggagtacccgggcatgtgaggtgtcagtctgcccctactggagggtgcctcccagttaggctactcaggggtcagggacccacttgaggaggcagtctgtccattcttagatctccagctgcgtgctgggagaaccactactctcttcaaagctgccagacagggacatttaagtctgcagaggtttctgctgcattttgttttgcagtgccctgcccccagaggtggagtctacagatgcaggcaggtctccttgagctgcggtggactccacccagttcaagcttcctggccactttgtttgcctactcaagccttggcaatggcgggcacccctcccccagccttgctgccaccttgcagtttgatttcagactggtgttctagcagtgagtgaggcttcgtgggcgtaggaccctccaagccatgcatgggatataatctcctggtgtgccgtttgctaagaccattggaaaagcacagtattagggtggtagtgacccgattttccaggtaccgtctgtcacccctttctttgactaggaaagggaattcactgaccccttgtgcttcccaggtgaggcgatgcctcgccctgctttggctcatgctcagtgtgctgcacccactgtcctgcacccactttctgacactccctagtgagatgaacccggtacctcagttggaaatgcagaaatctcccctcttctgcgtcgctcactctgggagctgtagactggagctcttcctattcggccatcttggctccacccatctcattagtgttttatagttttccttgtagcaatcctccacctcataggttaaatttgttcctaggtagtttgggattttttttttttttgtagctattgtaagtggaactaacatttttgtttctttcttggctggatcatgattggtgtatagaaacattgctgatttttgtacactgattttgtattctgcaactttactgaatttatttatcagatctgatagttttttggtagagtctttagttttttctagatcatggcatcagaaaagagggactatttgacttcctctgttccaatttggatgcatttttatttctttctcttacctgactgttctggctagtacttccagtaccatcttgaataggagtggtgaaagtgggcatccttgttccagttcccagaggaagactttcagtttttccccattcaatataatgttagctgtgaacttttgatatatagcctttattatgttgaggtatgtttcttctgtacctggtttgttgagagttttttttttttatcatgaagggatgttgaattttatcaaatgctttgtctgcatctattgagatgattgtatgtttttttcgttcatgtgctatatcacccttattgatttgtgtatgctgaaccatccttgcaaccctggaataaatctcacttgacgatgatgtattatcttcttgatgtgttattggattccatttactagcatttcgttgaggacttctgcatctatgttcctcagggatattggcctgtagtttttgtgtatgtgtgtgtgtgtgtgtgtgtgtctgtgtgtgtgtgtgtgtgtgtctgtgtgtctgtgtgtgtgattatatggttttggtatcagagtaatgctggccttgtggaatgagttagggagtattccttcctctttaattttgttggaatcatttcaggataattggtggttttctttagaagtttggtagaacttggcagtaaagccatctggtcttggatgtttcttttttgggagactttttattactgattcaatctcattacccattattggtctattctcattttctgtttcttcctgattcaatcttggtaagttgcatgtgtccaggaacttatccattttctccaggttttccagtttgttaacatataggtattcttaatagtctctgatcatcttttgtatttctgtagtatcagttgaaatgtttttttttcatttctgattttattcattgggtgttctatcttttttgttggttagtccagctagtggcttattaattttatcttttcaaaaaagccaacttttcattctattggtcctgtatccttggtattattcttttagtctctatttcatttagttctgctctgatctttatttttttctgctgattttgagtttggtttgtactttcttttctagttacttgaggtgcactattaaattatttatttgaaagctttctactttttcagtgtaggcatttattactataaacttcttagcattacatttgctgtatcccacaagttttaggatgatgtgtttccattttcatttatttcaagacattttttgatttacatcttaatttcttcatctacccaataatcattcaggagcatgtggtttaatatccatgtatttgtatagtttccaaagttcttgtttgtattgatttctggttttattccattgtgttctgagaaagatacttgatataatttcacttttaaaaacaatatgttgagatttgttttgtggcctaacatatggtctattctggagaatgtttcatgtactatggaaaagaatatgtattctgaagttgctggacagaatgttctgtaaatgtatattaggtcaatttggtccaaagtccagtttaaatataatgtttctctggtttttctgtttagctgttaggtctaatgctgagaatgggatgttgaagtcccccactcttcattgcagtctatctttctttttagatttagtaatatttgctttatgaatctgggtaccccaatgttaggtctatacatgttcataatagttatattttcttgctagattgatacctttgtcattatataatgaacttttttgtcttttttttaactacttttgatttcaagtctgtttgatataagtatggctactcctgccagcagtggactgggtgggtgggttcttaggcccctgaatagcaggcatgacataagttatgtcagtagtacatggctttttatttccatttttgtggaatgtctttttccattcctttactttcagtctatgtgcatctttactggtaaggtgagtttcttgtaggaagcatatagttggattatttaaaaagcccatttaactattctatatcatttaactggaaagcttcattcttttatattcaagattattattgatctgtgaggcttttctcctgtcacattgttaattgttttcaggttgttttatatattctttgttcttttatttttctgttattttttggcattgtggtttggtagatttctgtagttgtaccatttgcatcctttcttttcattctttgtgtgattgctttaccagtgagttttatactttcatgtgtcttcatgatggtaaaagtccttttgttcccgggtttaggactcccttaagtatttcttgtgggtttcatctaatggtaatgaatttacccagaatttacttgtctgggagagactttatttctccttcatttatgaaggatacttttgctggacatgttattctttgctggcagtttttttctttcagcactttgaatatgtcatcccattcgctaaatctgctcttagtctaatgggggaattttcttataaatgactagatgcttttattttgttgtttttagaattctccccttttctttgagttttggcagtttcactataatgtgctatggagaagacctttttgaattgtatctgacgggatggctgagcttcctgtatctgaatgtctaaatcccttcctagacttgggaagttttcagctattattttgttacataggttttctatctttcttttttttcaccttttgggaacactgaaaattcaaacatttggttgctttgttgtatcccatatgtcatgtaggctgtgttcattcttttaaattactttttctttatttttatctgactgggctatttcaaaacacctgtattcaacttctgaaattctttctgctgcttgacctagtctattattgaagctttcaaatgtatttttttatttcatgtgttgaattcttcagttccagaatttctgactggttcctttttatgatatgtatctctttggtaaagttctcattcatatcctgaattggtttttggatttctttgtattgtgtatctgagttgtattgtacctcactaagcttctttaatatcattatttaaaattatttttccatgatttcataaatttctttttcattggaatctgttgctggagaataattatgtttctttgtaggtgtcatatttccttgcttttttgtgttccttttgtccttatgttgatgtatgtacatctggtataatagtcacttcttccaattctttttgaatttgctttcataggggagtactttttcctgaagatgtatctatgatgctggttggggaggactctttggctttgatctgagttcatgcagtagtgtagtaatctccatatgatttcttctgctatatagcatcgttaatgcctgtgatttccttagtagcttagggtatgattgttaatggagactgtggtgaagttgtgctggggactgagatgacaaatgggccagtcttcaggccctggtggtggcagtggcaggccaagtatgcctgtccttgggccccatggctgtgtatgctggcatctgtgttgacaatttctggcaggtcagttcttgggccttcaggtggcttgctcagatgccagctgtgtcagcagtgactgggtaggtgggttcttaggcccctgagccacagacaaggcatgggtaatgtcagtagcagtgatgtgatgattctttgtctcccaagaggtgtacattgatgttggtagtggctgtggtgggctgggttggttacgcttcaggcctgcaggtggcacttgcaggtagatgccagctgaggtggtagtggctaggagtttaggcccaatattatgcctttgggaggagtgctcaggtgcccacggtggtagactgggttgggtaatccccaggatcccaggctacgtactctgccttggggttgggaatggcaaaactagtctgggtaagctgctgcttaggccccctaatggtgagagatggtaccacctgtggtgagtagaggtgtagtgatcctcagtccccaggtggagtgctcaggtgagggatgatagcggctgtgccgagtccctgccactggagagggtgggactgtctttagtggctataacctgggctggtgggtgaagaatgtgtattccttttatattctggtcccactggggcttggctcccagacttgccagtagtagcctatgtctagatcatgcccccaccccagatgcaggagtccccactcagctggcaaccaagtcccagtggaaactgatgccttacccacatcccattctttatcccagcagtgctcacttcccaagaccggcagctgcagcccacacctgcatgccttattagtcctggttgtggaatgctcccagcttgctcctcagtcacagcactgacagcctgatagcccaagtttccataatgccccagttccagtgctgttgggctccaggactgtgttcattctgccaaaaactatgcttgaaaatgatgcctttttgtagctgcttaggtctcagaaatggtgtggcacccagcacagactcactccctggaacacttccctcccgtggtctcctggcagctccatatgttagtttcagggtttggcagggggtcaaggggttctcccatagccaagattgcatgattccacagtgtggatatgggtcactggaagtctctcatttaccctttccctcaattggaaagtcgctcccagctgccactcaatcctggccaggcagcctacttctctccctctcctttctccacttttgatgtttcttgtcacttctctgttgaattccagtattctctcttggataatgtattttaagtgtgactgtccatacactattttcgttcttctaagtggaggaagaggacatgaaatacttctaatcagccatcttgaagctcctcccttaattgttaatgatggtgtaatattccaccatatgggtatgccataatttatttaacaatctattattggacatttacattattttcaactttggtagtgtaagtattgttgagatggacataatagtgcataaatctttagttacatttgggattcttttctttttttttttgacggagttttactcttgttgcccaggctggagtccaatggcacgatctcggctcactgcaacctccacctcccaggtccaagcaacttttctgcctcagcctcctgagtagctggagttacaggcacccgccaccacacccagctaattttttgtattttttagtagagacagggtttcactatgttggccaggctggcctcaaactcctgatcttgtggtctgccaacctcggcctcccaaagtgctgggattacaggcatgagccaccacacctggctggattattttcttaagatatactgggtaaaaaggtttgaattttgtttttgcctgaaattttgcattaagatagaatcatgcttcatcatagagacacactgtacctgacataacccttgctgtattttcgggtatcttttagttttgttattaggaatgttagaataacatccgtgtacatgagtctgactgtattttctgagataggtaatttttaaaggttattatataaacttaacagctaatttgttctccagaaaaatgaatgacaatttatattctcattgccagtatatgagagtgttttgctgcaggctttctaacattgagttaggttgttacttttaaaccattgctagtttgatagatgctaccaatgttgatcagcaaaagggggatcaaaaaataggatatcagttgggagaaagaggtaaattttttgaaggctttaagaaacaattagtatgatcccagggtgtagttacatatttgcacggacttttatgcctgtattgaaaagatatgtgaacaccagtgatctggaaataagatatccaggctagtaatcgttacgattatggctattattataaaaagacctactgttcatttattgagttaatccctagaagactaaattaaaatacatatcactgaggattagttttttaactttctcccattggttcattttcaaaaacaattatgtgtggtgaaccagttgctacctggggccttaaagaggttaaaacagaagttttaaaggggaaaatatcatttttttcacaaagaagtgaagtaggagtgcccaattgaaggaggcagcagattcctggtttcctgatttgtgctgaatatgagttgtagggcagcaggataaattttactcaattctgaaaatggagggaggggagagagatacttgcacttttcttttgcctaagtgtaacttcagagtattatggttattgatcagtgaggagaaaatattaaatcattaatattaatgatccctaataggaaagaaactttataaaatgtgaattaattgatttgcctccaattgattccttgctgtagtaaaattacttagctcactaagcctccgtttctctgtattttacacaagggtaatgaggttggtccacttcttaaaatactataaaacctcaattagctggagtgtggaaaagggaaagtgtaaggattaaaggggttagaaaagttttttggcatggtggtaaacagagaagatgccctttcagctattgccacgcaattcttgttgaaaacattttttttaaagtttattttattattgttatactttaagttttagggtacatgtgcacaatatgcaggttagttacatatgtatacatattaaagtcatagaaaaaatgcaaataaagaatattagatgtatttaatgactcaattggaaacaaagcaaaaacaaaaacttggcctccagaaatttgaatcagtgaacttaacattcaatgctaaaaaaatcctagaatgaactacttaactattgagaagatatatgcctcctcaaacctccaactcttccttttctacagataaacttgccagctgtttcacagaaaatgtagaagccacaagatggcaactccccaccataaaacacttacctgcaccatcatctgtaatttctgccttcctcccattttcaattgaagatcagaaaatcctcccgtgtatgtcaaattcttccacttgagctccagaaacctttttttaatctgttttttttaagtgtccttactccatacaataaccttgtgttttctttcttttcgaccattcccccttttctggcttctttccctaatcatttagagcttgttcaagtccctcctattcactaaagaaaaaaaagtctgatggtattcccccaaaccagtaaattcagtctaatcatgaggcaaacatcaattaaaaaattattctctaaccttctgccatatgcttaccctatctctctctttcctatcacagctaatctttgtgaatattgtctccactcagtgttctacttccttaccttcagtttactcttcaatctatacagtctgattctaaccccgctacaccactgatctgtttctgacaatcttcttttggttaacagcctttttacttggctaaatataaaggacacttttgagcctctgactcacttgatcacccagcgtttaacatagttgtcattcttgaaatatgctattcccttggtgttcctcctggttttctttgtacctttcttgttacctttttctcagtctcttttgtaggctactctgaaccttcccaactcaaatgttggtgtttctcagtactttatccttcgctaccttcttattttgcctctatcttttggtagttcatctactcctgtgacatgaagtaccatctctgagcttaagactacaaaatatttataccaattctgtttccttaacttctattagtatcctcaatttttcactaacatctattcttagatgtactataggcaactcaatctgtacatgatcttaacccctgatcacctcaccagtgtcaactgtctctattcctcctatctattaataacactctgtgattctgccatattgaactcattctacttcaatgaacattccatgccctctcagctccaggcctatgtccaggctattacctctttttagaacgatctttcctatcgcactctaggtttcaacttagaagtcactttctccagacacctttgtctttctcataaacatgagtttgatttcttctctctttcctttcaaaacactccatatttctcctcttattacatttaaaatacttcattgttgttgtctgtggttttttcttttctactagactgtgatcacacaaaaagtagatacaatacctatcatgttcccattgtattcctatcataggcatacattaagtttattgaataaataaattaatggatcttaggagcaaatcagactaaacaaagttattattttcctttggtaaaactgttagaatgatatatcactatgaaagcctagtctatcacatgcatgatctctcatgacaagatgtgccaatatggtctagttaaatggattttagtatagttaaatgattcataccaaattggtcaaccagattaatggattaatgctgacatgtagagagatctatggtggtaggccacagatctctgttatatgtcatatcttattcagaattttaaaaattattgacttgattgaaggcagagaaagcaagcttatgaaatattcagatgacacaaaagtaggtgggagagttaataaaatgaataaaagccttatgctttgaaatggtcttcatgatttggaataatagaataaaactaacataatgacatttcatagggattaatataaatctataggtttaggataaacattttaaaatccatttaatattcaagaagaatggattgcatacctactgtgttctagtcaatggtgctggggatgcaaaaaaaaaaaaaaagcatagcctctgcccttgaaatagttaaattttgacgatgatattgaatctagatcatggtacataataggctcattgcactttgtattttctacatagagaatgttgtatgctgttgtaggtatcatattaattttacaatatatgcagaaagtatactatttagtttaaaatttaaacatttcaatggtatcagtcggaataatttagattatgctattgtaataatccccaactcttggtggtttgtaaaaacaaagttttatttttcacttatgtaatgtgttggctagaagctctgctctgtgactcttcattctgtggcccagggtgatggagcaaccaccatcataaatattaccagtcactgtggcagaaggaaagatagctgtggaaggcgtcacattgacaaataaatgctctggcctggaagtgacatgcaactgtgagcaatgacttctggtcacaaataattggccagaaccagatgcatcactccatcaatcacaatggggccaggaagtgcggtcatatcatgtgaccgaaggcaaagaggtgttaagtattttgagaacagagttaatgatcaccattactatattgagtaaaaagtgaaaattacccttcaaccttagactttatccactcccctcctaaggattatagtagtgtcaaaaattccaaactttttttttttaagagatctgaagtgattttacctttatttccttcactttaagccagtgatgaaatttcacagtgatttctgggataggggcagaaggaaggtggtgttaagaatcatcagggctgtggcctagtcagcctgcagaggtgcaggcagggtgggcccccactgggacagctggaggaggcaggtaggtgatgttctcagagctgagagctggtatgtgatgtcctctgcagcttccagcacgctcagctcgatcaggccgtcccctgcggtggccagtgagttggggatcagcttggcttccatggagtcaccctcagcagagatgatggctgctattttctgctgctcagccttttccaccacaaatctggccctctctgcttcctgctgatccacctctttggcttccactgcttctgtgaactccttcccgaaggtgggatgtgtcaaggacacatcgtccaggatgagcccaaaggtggctgctcactccgtaagattgtcactcacctgcctggagagcagctctctctgggtgattagttctccagcatcaaagtgagacaccaccgacttgaggatcttggtagtgatggatggcagcacacgctcatcatagtcctctctgatgctggtgaagatgcaaggaagctggctagcgacaggccaggagaggatgtgcagtgtgatgttgacattctgtaagtctttgctaccagtgatgactggtacattaagtggtcgagaatggcagtcaaagataattggtttctgtacccatgggataggaaagtgagtcccttcccctaccacaatgtcctgtactccacagaatcggtcaaagatgacagctctgtgaccagcatccacattatataaggcagagttcagcatgcttcctacaacagctaaggccaggccaaacttgccaatggacacaaacactttggcagccatgttttcttctgctggaccctctcacacctgcttccactctgacctccacatgaattccccagccacacatccaaacctcttcctacagatttccatacacatacacacacattctcaggcatgcatacatacatagatttttccattatatgtggaatcatatctatttttcatatatcttgtagatctacccatgtctatccatacctctttatctcagtctctttaatggttgtatagtattccatttatgaatgtatcacccctacccatgacaaggtatttagtctgttatcagattttcaccatcacaatgcatactgcattgaccatccttgtatgtgcatatatttttatgcataatcatttggattgctgtagtatagattcatacaaaagcaattcttgagcactttaatttttgccaaatactaacaaattgccttgtaaaatgctgtcctaatttataatgtcataaacagaatatgaatgtgtacattaaattttgagaagactattgacaaacacttttattgatggaagaaaatgttagatgatgagggatttagacaccacatcaaaaattgagtaagactcattgatcaatgagtgtgattgaagactttttgtctaaactgcttgtaacaccttatacctactacttctaggtttcctggctggagaaaccctgaaaaagactagtccctgtaacacataacacttttgattttatcttaatggtcagaactcaagattatatcttaatgatcagaactcaatacctttccatatccagctgctagggaggctgtgaaatgaaattttcatttttgtggactatgtatggagcccaaagctggggactatgatcactacagaaatcaaaaagaaaccctatagttacttatgccagtttttttctttatacttgcttctccttgcattctctcctgagatagtcccttctgctgtctctcaatgtttcatcactcactattcctcttatctattccccttttttgctatgtcaactttttgagtctccacttctaattttttctctctctgcttcttcatgttttttctctttctcctctacgatttttttccctccctttctgtgtcctatccacctgactctatcttttgctatctctgttttcttacttgtgtgcctttggctatgttggtttcagtctctgtgtctctttatttctacctctgattctaatggttagggctaacaacagacttggctgccactttatgcagttattttcaaatgacagaagtgcttgagaataggctagatataggaatgctgtaaaaaggatttcttgattggttgaaagttggactaggtaactattgaggtcctttccaaatttgagtttgagagccatatttccctccatagtagatagaatctagttaacattattgcatctctgttttctgattgaatagctaataggacctcagggccatctctatgtgaataccagacttcattgcaaattactatagaattataaaatgtaagagatagagataaatgtgtgttgactaaagaactgtctttctctgtatatatgtatgtacgtgtctgattttatacatatatatacatatatgaaaaccttgtgaagatatcaaaattttctttgattgcaaaaatgtaacaagaaatgattataattgtgtgctatttgaaactagctgatattttagattgggtctattaactgtgtccaaatgtatccataagttaaatgtgttttggtttctagagtcaagagtttgccatataggtactgttaaaaattagcatgaaccagaaacctgacatatctggtactttaagggaggaagggaataaagtgaaaaaggtaatttgcaaactatacttgaaagtcattgaagcataacatcattacaattatctgtcaaaagatttagttcaattacagttttaaagctctctcttcaatatggcattactcatatcaggatttgatactccaatgagaggaatactaatgccttcattagccattgtcttagcagcttcattctttagaattcattacgtggccttttgggatttttatatactaaccctagggaatcagtaaacacaaatctctcaggggaatatgaacttcagaaataagaaccattgcatatttatagccatggcaggggggaagactctttttaggaaaaaaagtaattttgaaataattgaataacagtataattgccatgatagtaggtattatacatgctcctgtacactttcttcacacagcagtaagttggttgtaaaatcaccaacaggaaaaagttataatgtaataaacctaaatttcagtgtaaggtttccaggagtaactcgagctgcttctgaaacttttactattgaaacagatgtgtgggaaccatatgttgggagcccagtggtcactgttgtaagacattccttgatcaatgatgatatttcaggccgactgatgctgtagatgaacactgctactagattgattacactggcctttctctttgactatttgaattgaggcagtttgacagattttccctttcaatgggaaatctgaatcacctactgaacatgctaaaaaaaaccacttattttactaggtattcccttagcacttaacaaatataggttgctcttcattgtcctgcacttgactaagtactctactatgcatgtatcgccacagtgaggttatagttccttgaagaaaagaagctacattttataatcttagacttggtttatgactcccatagcatctaacttctagggcaaaaatcgttcagtagtggttaagagattggggtttgttgtcacacagacctacattcaaatcctttttccataatttattaatgtcatgaacttgggtaagtcacaaatgtcagtttcctgaaaagtaaaatggagattatagtaactcataagattgttgagaggataaaatgacatataacagtttagcacaatgtctggcccacacaaagtgctcaataaattattatcatcataaagtataatcattgttcagcaaaatttgttgaattaattgactcttctgtggaaatgggattggtaaatatatggacttaaaaactttatatgctcactttttctaattctgactgattttaactgacaggaaaagtagcatatgaaataattctgtagttaaattgtacagttccaatgattatttccctattcacagtcaaacattaactattttatttcacaaagaatagggaggggtgaattaaatagggaagtagaaatatttctgcatcagttattttccacataaaatatctctgaatatcagttataaaatctagttcatgtttttggtgaatatgatcacataatgtccacttggcaaacagagtttttaaagggctttctcaaatcaactttttttgccaccatttataaaatatcagaattataaaaatgatatttgattttagcaagttatggtccctacacactgtcagctttcagacagaaatcgtgaaggtacaatcatagatagaataggtttgcggtaaggagagcttggcagactcctaaaatctaaccagtatggttgagttggtaactaagtgaatatatatagcaggaagagctatagcagagatgagccaatgttcttaacaaagtcactggcgttatataagttctaaattggggggtaagacagaggagctagaatgggcacgttgttcaagaaaattttgaatcataagccttcctttgaaagttcagagcctacataatcatctggagatctggcagataaggtctatggaaaacaaagaatcctgtggagtacttaatggtcttttcagtcttggtttggggtctccaaaaagcagaactctaaggatttgaatgtaggtagtttatttgggaggtgatcccaggaagtactgcaaggaagtggcaaagtcagactggaagggaggtaaagcaaataagcaggttgccactcaatattactggaacataccaaagggtgagggagctagggtatttattcatgaactttcacaattgattgagaatcatttagtgaatattaacaacctggcacttctagtcatctcctatactggccaagctgcttttgcagttaaagaagcccctctggcagagaaacataggaagacttctgcagatgacttttagaatgggtcaaagaagacatgggcagggcaccaacagtgtttatgacagcaggaaatatggtacctctcagatctggataatcccatgttagacaagagatgttctatttcaaacaaatgagtaacttgaaaaaacactaaaagtttccactcatttgcattatttaaacatttgataagatgttatctacatagattttgttcttttattcattaaaaatatttattaattagttatgtgtcaggctctatgctaggtgatgagaataaaacagttagtgaccaagtggctgccctcatgaagtttacattctagtgggcaaggagtaggcaaagacaaccaagctaataaatttaaccgattcattaagtgtttcaactcattggagtataaacttgaaatggtattatttttccactaattgctatttactgtgttctgttgtatttaccctcttccactgagagattaggacaatgataaacatttcaatctgattgtataactttttagctgctttcagatattaggagagtctcatgctgattttaaagctttggcttgcttactccaagcccctatctgatgaaaatgcttctcttcctttttcttcaaacagatgggacatatggctctagcggctaggagtttggggacatgtatggtagcctttcatacatctcttcttatttcttccctttcccctgtgcctgttttgttattgctttgggaggagagttgctggggaaaagggagaggaaaaagacagatgcttgtgactgtgtgtgtcttctccttggttggtcacaattgctcttctagctgtctatgggcactatataaacaggtagttataacagcctgctgatgggaggcttctccaagcatctcctctggacattggaaatcccttgcaagattattacatcttctgttagaccttcagctggtgccatcagatcactttattttcacatgcattcatcttgccccatgttgcaaagcctctggcaagaattatgcagttacctagtccagcttggacctttgggcatatgccaaattcattttccatgtctcttgggacccatatatggctgtgtgttgggagtaggtgagaattagtctcggtcctcttgtcatctggaaatctccaatatcccacctctcccgagggttctttatcctagctccagtggtgcagggaaagttcagcatgtctaatggtaagtatatggttaactgggaaagaaaaagcctgttttccttgtcaaaacgtagccttctcctcctttccaggttcctttgtttattgatggagttggggtgaggtgatatggaactagctgcattggttcattgtgctggtggcttcagacatcaaactggaagttttctgaatttaggatatcaggtagatctttgaggtcaattctgggaaaagaggatcctaccaagcacttgatatcaccctgttactcttatattctgggtaaggctctatacctttaggtacgaactaattatttttaaaaatctttacatagaatactggacctttacatgtcatccagaggctattgcctttccaggttttcttccattcattatttcagtgattgctgtagtttcaccctcatacctcccattgccatttttgtatcttgaatttatcatgagcccaaagtacttcagtggtacttatattccgattattttaaaggaccctagctgaaccaccatataggtaaccaatttactgatttttttaactcaatagggacaaaaacttaaagataatttcccccccacccccaatgtctactggtggcactttacaaactcctttccctgttattggatgtggagatttaataacagcttggttcaattccttacccttttcagttatttttgattttggaagagtttcattctaagtgcttgagactcaatactgttcatttaaaaatgaactcaaagtagtgtaaaaactcttcctatcacataaacaactgtaaatgctgatcagtcttatgaataaaacaaacaaagaggtgagctagagattgacagagttcagattgggtagttgagaaaggcctttttgtgggactcagacatgtaggatgttaagaaactgagtgaacagtggagagtatctcaggaggaagacaaagtgcaaacaccgtggggaaaaaaaaatgccttggcacattccaggaacagaaaaaatgaccatcatggctggagcataggcagcaaggaggagagctttgtgaaataagatcaaagaggcacctgggggctccacctataggcctttgaaagtctaatgatttgaaattaggtacagtggtacctccagctttgttctttttgcttaggattgtcttggcaatgtgggctcttttttagttccatatgaattttaaagtagttttttccaattccgtgaagaaagtcattggtaggttgatgaggatggcattgaatctataaattaccttgggcagtatggccattttcacgatattgattcttcctatccatgaggacaggatgttcttcttccatttgtttgtgccctcttttaattcgttgagcagtggtttgtagttcttgaagagatccctcacatcccttgtaagttggattcctaggtattttattctctttgtagcaattttgaatgggagtccactcatgatttggctctctgtttgtctgttattggtgtataggaatgtttgtgatttttgtacattgattttgtgtcctgagactttgctgaagttgcttatcagcttaaggagattttgggctgagatgatggggttttctaaatgtacaatcatgtcatctgcaaacagggacaatttgacttcctcttttcctaattgaataccctttatttctttctcctgcctgattgccctggccagaatttccaacgctatgtcgaataggagtggtgagagagggcatccctgttgtgccagttttcaaagggaatgcttccagtttttgcccattcagtatgatattggctgtgggtttgtcataaatggctcttattattttgagatatattccatcaatacctagtttattgagagtttttagcatgaaggggtgttcaattttgttgaaggcctcttctgcatctattgagataaacatgtggtttttgtcattggttctgtttatgtgatggattacatttattgatttgcatattttgaaccagccttgcatcccagggatgaagcccacttgatcatggtggataagtttttgatgtgctgttggattcagtttgccagtattttattgaggatttccacattaatgttcatcagggatattggtctaaaattctcttttttttgttgtgtctctgccaggctttggtatcaggatgatgctggcctcataaaatgagttagggaggattccctctttttctattgctaggaacagtttccaaaggaatggtaccagctcctctttgtacctctggtagaatttggctgtgaatccatcaggtcctggactttttttggttggtaggctattaattattgcctcaatttcagagcctgttgttggtctattcagagattcagcttcttcctggtttagtctttggagggtgtatgtgtcgaggaatttatccatttcttctagattttctagttaatttgcgtagaggtgtttatagtattctctgatggtagtttgtatttctgtgggatcggtggtgacattccctttatcatatttttattgcatctatttgattcttctctattttcttctttattaatcttgctagtggtctatcaatttttttgatcttttcaaaaaaccaacccctggattcattgattttattgaagggtttttcctgtctctatctcctttagttcttctctgttcttagttatttcttgtcttttgctagcttttgaatttgtttgttcttgcttctccagttcttttaattgtgatgttagggtgtcaattttagatctttcctgctttctcttgtgggcatttagtgctataaatttccctctacacactgctttaaatgtgtcccagagattctggtacattgtatctttgttctcactggtttcaaagaacatctttatttctgccttcatttcgttatttacccagtaatcattcaggagcatgttgttcagtttccatgtagttctgcagttttgagttagtttcttaatcctgagttctaatttgattgcactgtggtctgagagactttttgttgtgatttctgttcttttatatttgctgaggagtgctttacttccaactatgtggtcggttttggaataagtgcaatgtggtgcagataagaatgtatattctgttgatttggggtgtagagttctttagatttctattaggtccacttggtgcagagctgagttcaaatcctgaatattcttgttaattttttgtctcattgatctgtctaatattgacagtggggtgttaaagtctcccattattattgcatggcagtctacgtctctttgtaggtctctaaggacttgttttatgaatctgggtgctcctgtattgggtgcatatatatttaggatggttagctcttcttgttgaattgatccctttaccattacgtaatggccttctttgtctcttttgatctttgtaggtttaaagtctgttttatcagagactaggattgcaacccctgctttttttttgttttccatttgcttggtagatcttcctccatccctttattttgagcctatgtgcatctttgaatgtgagatgggtctcctgaatacagcacactgattggtcttgactctttatccaatttgccagttggtgtcttttaattggagcatttagtccatttacatttaaggttaatattgttatttgtgaatttgatcctgtcattatgatgttacaaggctatagtaacaaaagcagcatggtactggtacgaaaacagagatatagatcaatggaacagaacagaggcctcagaaataacaccacacatctacaaccatctgatctttgacaaacctgacaaaaacaagaaatggggaaaggattacctatttaataaatagtgctgggaaaactggctagccatatgtagaaagttgaaactggatcccttctttacaacttatacacaaattaatttaagatggattaaagacttaaatgttagacctaaaaccataaaaaccctagaagaaaccctaggcaataccattcagaacacaggcatgggcaaggacttcatgactaaaatgccaaaagcaatggcaacaaagccaaaattgacaaaggggatctaattaaactaaagagcttctgcacagcaaaagaaactaccatcagagtgaacaggcaacctacagaataggagaaaatttttgtaatctacctgtttaacaaagggctaatgtccagaatctacaaagagctcaaacaaatttacaagaaaaaaaaacccatcaaaaagtggacaaaggatatgaacagagacttctcaaaataagacatttatgcagccaacagacatatgaaaaaatgctcatcatcactggtcatcagagaaatgcaaatcaaaaccacaatgagataccatctcacaccagttagaatggcattcattaaaaagttaggaaacaacagatgctggagaggatgtggagaaataggaaagcttttacaccattggtgggagtgtaaactagttcaaccattgtggaagacagtgtggcgattcctcaaggatctagaactagaaatagaatttgacccagcaatcccattactgggtatataaccaaaggattataaatcatgctactataaagacacatgcacacgtatgtttatcatggcactgttcacaatagcagacttggaaccaacccaaatgtctgtcaatgataggctggattaagaatatttggcacatatacaccatggaatactgtgcagccatataaaaggatgagtttatgtcctttgtagggacatggatgaagctggaaaccatcattctgagcaaactatcacaaggacagaaaaccaaataatgcatgttctcactcatagttgggaattgaacaatgagaacacttggacacagggcagggatcatcacaaaccagggcttctggtggggtgggaggcagggggaggaatagaattaggagaaaaaacttctataaatgacaagttaatggatgcagcaaaccaacatggcacatgtatacctatgtgacaaacctgcacgttgtgcacatgtacactagaacttaaagtataataaaaaaatacaaaaaaattgaaaaagaaagtctaatggaaggagttcagatttcactctaaatccagtgggaagccactgaaaagttttaagcagggaacctgacatggtttaactgtgaactttcatgttttcttctatttgcaaaaaataaagccagaagaccccagattgtcattgtttctctaatggagttttgaaaaatgtaaaattataggtgtggttttgttgaggccaagatctgtggttcaaactttatatccttttttttgacttttcagctgtcaagaaaagtgaaggatgaagccaccatttcttttggcccttgtggtctgttctgtagtcagcacaaatctgaagatggtgtcaaagagaaattctggtaagttgctggcaacttgccactatttggtcaaaaatgtacagttttgtgagcacccagagggcacctgtgcctttaactatgaatgtctttaaatagaagcactcgtattccagttatgttggaaagtagccaaaataaaaatgatgtttaatcctaccactgagaaattgttgggaaatcagtggaattttgttaaacttcaatgaccagtatactctcagtggacaatgaaatgttaagggcctacttagagttggttacatttgctagtgaataaatacctgggagcaaacatttacaaatgagaaggtaagaaacctttaaaaatatacatcctttgcctcctaattgagtgtgtagcattgcaatttaaagactttgataaatatctgagttttagttccttatagttgtacccagttgctaacaggcaggggtctacagcctccaagttcagaattattagctaattgcccgaagaggaatttctcgagaagaaaaatctattcctagaacatgttggtctggcaggcagccatgactgtactaagagattagctgtagccagtacatagtccagtcaaagcttaatcattgtttaataatacttggatatatatgtctttcagttttgattatacattctagctgtaattacaaactttgcatgagattttaagaattgattttctgtctgtaatcattccagtaagacattgaggaatgtgttattatatggaaacaaaagattgtgttgagactttctactggcttctaattcatttatttctgagaattaaatgtatttgctttactttctcattaagtatcaaatctagtcaatgaaatgcatgcttacttttcaaagcaaaaaatgcggattggggggaggtgcttggagtttggctaatgtttgtttcctgagataagaatacttactaattgaaatacctaacaaatagttttgtcttcaattgatagcatattaataaatgtttccaaaagtgagagatttatcacagactataaaatagagtaacactgctgaagtccaaaggatcctggagtgataaagatagggcaatatattgtctttttctcttcttatagattcaggtctatatttaaattacttttgtatgttgtgactctctttcagctgaatttgtgtttaatattttacctattatctctccagctcagcatatcattcatggctgcctttccttgctttacctttgaagtcccattttactttcaatcttggttcaaattgatagttgctgaaataaaatatttagagagattgcttaacagcaaacataacctgttgaaccagattgcattttccttactcggtcatgtcataatgtctggagcagatccgaaaggaaaaaaagaaacgagggtttaaaaagtcatctgtattatggtagcttaattgaagtaaaatccaaactgaaaaaaaataagttgctgtcaatgtattctgtcttataccttggtttgcttattatataagagaagagaggctgttaaaatatatatatattttatatatatttatatatataaaatatataaatatatatatacacacaaatatatatgtgtatgtatagacacacacacacacacacacatacacatatagctgggctattacaggtggctcacacctgtaatcccagcatttgggaggccaaggtgggtggattgcttgtgctaaggagtttgagaccagcctgggtaacatggtgaaaccctatttctacaaaaatgtaaaaattagctgacattgtggtgcacacctgtagtcctagctaatcaggaggctgaggtgagagtatggcttcagcctgtgaagcagaggttggtgagccgagatcatgccactgcactccagcctgggtgacagaaccagaccctgtctatatatatatatatatacacacacacacacacacatacacacacacatatagaaggttatcattaatgcacagatgtcattaaaagatcaacttttcaatgctttgcctctttatttttgcttgttaagcgtgaggctatttgtggcttactagggtttcttagctttgttttcttagtgtggacaaatggtatcatatctgcagtcagcttcattgaagaaacattacccaaaaagatatttcacttacagtcaaagtgttagaatggtttcagtctctgcttctccttccctttatgctgcactccccctccatccctgccaggacaatagcaattgtaatattggaacaaaacttcttacaggtctgtgcagttgaaatcatttgaatgcacagctggttcttttattttatgccttactgcttctgtttatggtgtatacggagtaggcagaaaagactaataggttagtgttggtttgtgcttgtctctgtgtgttttttgtttgtatgtttgtttattgtttcataatgcaaaaaagatagggcatgggatgaataaaagacatcttaagttgctgatgaaaacgaggatactttggagcagttcttttcaactctacctttctgtttagccacccccatcataaccccctctccagccctatacctctgttaatattattattttatgtagaaaatataattatttgcactttcattatcatagtgctatttgagttaccttatcttttgaagaacattaaaaatgctttggcaaatctgcagtacaaatttttgcttcatgtagcttgtgaagtcctttgctcattgccaatcaaagagatccaggtttaagctcgcatggatgttcatcatggaatcactaacggaactcgtaacttttatttttttcccctcttcccttccctcaagtcaagaaatgaaaaacgattgcaccctttattcattaacatttatgactgtttagtgtctgatgtgaagatagttataatgatttctatgcagttcattgtagacacaaatccctttcactgagatccctacaactgctgttgctaatggccacccttatgcacaagacagagagaggaccaagggtggaagttttttcttctgtacttgtcaaacatggaaaagaacttagtaacagatgtgagttaggtttttggttttggaggttggtttgtttgttttaatctactctgggcacatattggagcaaacctgcttttgggtggtgtacaatttttagaggtgatagcacaggctatgtttccatgtaatgcccattcacactgggcaagtccaacaatcaaccctggcttgggaaacagcaaagatggctctgagactgcatctagggcctgattgctttagaacatattaaaatgcacagcatttaattttaaggactatagctgattattcaagtgtaagtttttggtcttcttcacataacactccttcagtattcactttttataaatttaggactggatagataaaagtcatttggaaagcctactctatcaaaaacaagtttacttaaaggtgtcattctttatgtcaggaaattggctaatatcttgatgatcaatagcagaaatggccatttctttttcctgtagaggacacaggtacctaaaactaatttttaatagggtgggtgggagaaattactcttcctcaagaagtcactcaagaccttctatttagctattttttaacctgaaaaacgtcctcagaatatacatgaactttattatttgggacattaaatcatccccttaactttcttttggcttttgctgctgctgctcctgcatgaaaatgtgagccatgttatgcagttgttggcattcagttcttccagcatggacctctgtatcagagaaagcatcagtctgatgagtgggtatgttaatattcaacccaaattgggtcatcttacagtcagttcatctggaggatgatctagcacaaaaacttctcagtgttgggaggaaaattgcagagctacctgcatatctcaatcagctagaaaatgtagtccccagtggtaagaagaatgtgaagacttgctggcacacagtgggtatttaaagatatattttggatggacttgaaagaaccactcagttccacgtaatgagagaatggctttatttggggctttggtttataaaattatgatattttctgattgttgatgaggaaataacagcttgttttcactaaaatacatttgttttagaatttccagttagataactgaggacgaccataaaggcaaaagtagaggttatatgagcttacatttctggccaaagctagaaagggactcttataccacttccaagtaaaaagaaaataacttcttttgtgaaatttattgttatataattaaaaataaaaggaaccatgctttgaaccctcaaaggaaacaataaaatgttttatttaaaaatgctggttagaagtaatgttgctctgtggatattcacactgtgcttttagctgtagagtgtaagaacactagaagttagaaaatcaacaatgtgatattgagatctcatctcctaaatgtattctaatgagctaagatcaaggaggaaaatacttccctatgatttgttctttaattgaaagggacaatctgagacatggtacttttatctctttaattagggtgacttctctggaggaaaatggatctttgaaggaagggaaagtggtactagaagaattggttaggtcattggaagtgatataggacaatgtttggagtataagacaaagtttacagcaactagataataggcagggatgagagatatcggtcagaaagaatgtgtggccagaattgagctgagtgaaacacagttattgaataagttgaaggggaaataattttacagttcttatcattgaatttgatatggccaaaggcatacttgttgaactgttactgtatgtgcaatattccactagtcctgaggtggggctgacggggagggaaaataaatcaaaactcccttgtttaaaatacttaatatcattgagatcaatgaatggctaagcaaataatggttttagggttagggagggtggagtgtaggtcctgttctctggaatgttccattctctaaaggtagaacatttctggagttttagctggatgcccagatgttaacaagatattccctagcactgctaatcctttaatatcttcttccattatcaactctgtagtggtcgttccgcaatgataagcctttggcagtcttttccagggcatgttcagtccagttctcaatcagggatccatagaggacctccacatagatctcatgggctcccctctgggaagctctctccttttactgggagttccagccattttaaatgccttgaactctgatctctgtagctccagctcaataatactactgggctctgttaggactctaactcaccaagccatagttggggaattgtccccagtcggagagctgggttgattgtggggctcacaccattagtcctccttttctccgagatcacagcttaacacttcctgaatattattgctttacacatttcttccacttttgttgttgcttactgtgggagagttagtctagtttcagttacttcctgttaccttcgataccccatcattctttgggtgctttctgtcataaagaagttgtgctagggttaccttgatactgattctttttagtggaaaatgaatttagaaaccttctttttcttttaaattgttatttcattgagatacttccaattcaaatccagcatcacagggctcttccttacctttctccattccatatttgtatttcctttttccacagtgagaaccctcattctcatcaacatcaatatatttacttgttttgtcctataagttatacaaaatagttttagaatgtctacaccaaaaccactacaagcaacaaacttactaaagtacaagatattttataattctttttgtctttagaattcatcccactaaagttgtacagtcagagtgatatgttcaaaagttgcttgaattaatttctttttctctgtggtcatgttattaattcaatatataaataagttaatttgtgtttctatgcaatttgcttttttatccttttggattaaattttatttttgaatacataaaatttttacatcattggaaattcaaaattatagaaaaaataataaatccaagaagtctcactcccatgcctatcccttctacctggtctcacacatgtcctagttgtaactaattcctttagtttctgatatttcctttctttttcttttttgcacaaatcaatgtgtatatttttagttccacttgtttcatagtagcaaaaaataattatccatttaattttttggttcttgattttttcactaatgtatcttggaagtcaagcattttggattctgttaatatttttttcttattacaattgtgtatcatgcttaatgaaatttaaaataatattaaaatagaaaactctcttgtttatatccctagagttaactcatgattgaattttttatagattcttccagatagtttctttggatatatatgtatatagatgatttatgtatcctaaatcatatgcatttttcaaacttggaatcatactgtacgtactattctccaacctgatgttacttcacatgatatttatatctgtaacttctaattcttgacactatataactaaatcatatttttaaatactgtgaaatattccattgtgtggacttataataaaattaaaaccagtgctctgtttatggaaattagagttttatccctaggttttgctattgcaaaacaatgctgcgaggagtgccctattacatagatcttagtacactagaagagtaaacatttttgtaggctagattcctagaagtggaaatgttggataaagtttttatttaaattttgaaatgatactgacaaattgcccaccaatgtcactgtgccaattttgccaatctaaatccaaatgaaaaacatttcattgtttactaaaatccccaggttggctactatgagtatgttctttggattcaaataaccttaaaagtgtgtgtgtgtgtgtgtgtgtgtctgagacatagagagagagagagatcagcagcaaaacaatccatacagtgaaaatctctgcctattccattaagtttggcaacaaagaatggcagagaagagaatgtgagttaacaactaagttcattattattttggttgttctacaacatcaacatctgatatgattgaaatattaaagttccttatgacactggttctctttaaatgaaaaggtgtggataattaagctaattatttaatgaaagctggaaagtccgaaaacaattccatgggggatttcatccagctctgtagcatcttccaaatacagaagtcaccgagcttggtatcatgttggatttgttactgtccataaggttaaaggatgagagagaaggaagaataattgagccttctattaattttgatattgggatttatcccatccataagtacagccaagaactgcagtgaatgagctcctttctactctgttgttttggaatgaaaagatattttatctgccagagtggagacatgctttgaatgtctgttatttctgccaggtgagtttctatcataacccaactcatgtaggcacatcagtctaaagtgcatcccttgtggctttgctgacttctacaggtgtaatttgccctaaacgaagtatgtgctctgcaaaagcacacccttaatgcctactgtagtttggtccctggagaaagctagcacccagagatttcttagaatatgcatgactttcctagtctatgagaaggacactgaatatgcagttttaaacttccattcatattcctattcttgcctcatatttgcttccatatatttatttgagactgtcatagagaagcatgatattttgtgaggcttgcaccaggactattttctaaaagaaatgctttgacattcaatgaccttcccccaggctaagaagagtcaggccctgcctctctctgtgggtgtgagttatgagagctgtattgtaagtgtgctctccctaaatggttacagacaagaaacacatggttttaagaggcacccattaaacccttaagatgaatggcatgtatttggcatctctactttgtggagaaacaagacagtggtttcctgaaatcaaattctgccaaggattgtcttagaaatagggcatttattaattcaccaaacatgcaagcaaactaaatgcaagcaagcaaaataaaatgtcttatgatgggtccctctcagtgattcagaaattgaccagacatgcttttagccccccaagaaacaagtaaatcatagggggaagggagaaactaacatgcatcgagtgctcctatatgccaggcactttacatacattgtctcctaatacaaagacactgaggtaggtaggtccaactcttgttctccatatagggaaactgaggcttagagtagctaaataatttgaccactctcttacatagctagtaattggcaaagccaggatttaaacccagatttgtctgaccccagagtcctgctcttaatcactcgtccatgttgtgcctttgtgtggacatcattagcctcattttaaagatgagaaaactgaagctcagggagggtgagtttatctgaggtccccaaccattaagtggaaaatttaggtttcagatgatcgactgattccaaagtttatgctctttccacaacaccatggatatgtcttatttacaactcttataaaaggcataatataataagagtcatataagaggcatggatatagttcatatcaaggagatattattttcagctgggtgtgagggtgattagggaaggcttcatgggacaggcatcatttgacattgactgtgaagactggattgggcagactggattgggaatagtgacgggggatggtattctgagcagaggttaaaataagagcaaatatgtggatgcataaagtgcaggatatttttgaatatcaagtggcctaaattgactggaggatagtataagattcaggtagttaggaaacatatttgttgagaaacaagtagctagacagatggtgttttgaatacctccacaattttaaaattataggatatatattgaatccagaaaggaaatgttggttaaggcgctttagattggaaggcagggggcaaggttgctgagacattctagctctgtgctagtgtttcttttttatttttatttttatttttttattattattatactttaatttttagggtacatgtgcacaatgtgcaggttagttacatatgtatacatgtgccatgctggtgtgctgcacccattaactcgtcatttagcattaggtatatctcctaatgctatccctcccccctccccccaccgcacaacagtccccagagtgtgatgctcgtgtttctgttcacatgctttacatttgctataataggaaggttcaatcaaagctttgttttcaattatgaaaatgttttgaatttaaaaaaaactgagtaaggcattaaccttaattaaaaatcagaataaagcttatttgtatcttcagcttcagggaattaatgatttttttttttttacagtaaaggaacttgtttctggtcttaacattaccagcgggtggcactgtaatacattccttctgcatctctgaagtagcgttttaccatctcatggctgtcttcagagtctgaaattagaaggaataacagctttatagtcaccatagtgtgattggtctaatctttgaacacatttactaagcaccacccccacaaccacgattcttcagtttttgagagctattctgcttaggttctcaccaaactacctctgaatcttttcatttttttcccaagaaggtgactgtgaggcatagctctcgttacttttcaagtagttcttcaaagttaggtattcaaaagccaaaggcaggagaagttatgagactggcaaattttacctttggcactccccctggctactttgcttttaatatctttgcttgtttcttgtgcatttcgccctccccaaggctaaagagaattcaaatgattcacaattttcttgacctttactcagaactttcctattctttgataggtgacagctagtttaatctttaaaccaatccagactgatacactgaaacactactgagcattcggtgttattggacacacctcttcctttttgacactctcttcttctgctctagtgacatcattttatcttggtcctatctgtatctttctggccattttttcccggtctccatcattatctcattttcctctctgtctcttaaaagtcgcttttctccagcattttctccttgttactcttttaacaaaccactccatacgtttccaaagtttctactcccttggtattaactatctaccctcttggtgcttctcagcagtgtctgcatattggaaccacccagggagcttttaaaccatattcctgtgcaagtaccactcccagagttactgatttatttgggctggggcctcggaatctgttggttttttgttcatctatttgttttaactacaaggtgattctaatgtacagccagggatgagaacccctgacctattgaggtttctagcaatccagtctttatgtctcctctgagttacatgcattattttccttctagacatcttcccttggctgtcccacaggcactttgaacttcaaaactcaatttttaatctatttaaattccacccttcttgtgtaccccatcttagttaaaattacattatcattctatttgggccagaatatatggtgtgactctcaaatctactgcaagtttccatattcagtaatcaccaagttctgcagtttgaattctcaaatatcttctaaactacctgtattagtcagagttttccagagggaaagaactaataggatagatgtatatatgaaagggagtctattaaggagaattgactcacacgatcacaaagtgaagtcccacgataggccatctgcaagctgaggaggaagtcagtagtggctcagtccaagtccaaaagcctcaaaagcaagaaagccaacagtgcggccttcagtctgtggctgaaggcctgagagcctccagcaaatcactggtgtaagtccaagagtgcaaagtccaaagaacctggagtctgacgtccaagagtgggaagcatccagcaagggaaaaagatgaaagccagaagactcagcaagccagcttattccaccttcttccacctgctttgttctagttctgctggcagttgattggatggtgcccacccatactgagggtggatctgcctgtcaagtccactgactcaaatgttatctcctctggcaacaccctcaaagacacacccagaaacaagtactttaccagccatctggcgtccttcaatccaacaagttgatacctaatattaaccatcacaccactccagtcatgttttttttaaacaaattttgacttttattttagattcgggggtatacacgtgcaggtttgttacctaggtgtattgtgtgatgctaaggtttgtggtatatatggtcctgtcacccaggtagtgagcgtagtacctaataggtagtcaccccacacttcttcatcctatctgttgctgacctagttcagcctttcataatttcttccagcccttctacattactgcccattttccataatacttgcaaatggtgtttttacttgtttgcttgtttttagttatagatgtacagcaatttcaagcatttattccattgtctaatgaacatttgtagatcaactgctagatgcaagacctctacttatgaaataaaactcctttgactccctattgcatacaggataaaggtaaaatgccttgtagcatataatatatggcatacaagacccttaatttattccttagttcacttattcattcaatacttaaatattcaatggcctgtaataggtactatgctaatttttatataaatataaaaacacgtgtgctattatatatgtatgtataggtatatacatatgcatgtgtatacacacacacacacacgcacacacacaaacacacaattcatttaggctccaggcttctcagtcctatttttgtgcccctcagtcctatttttgtaccccttgccacacacctcttcacacaagagccatcctgagttatttatcattctgaaaaaagaactgttcatattcccagctctgagcattttatcttatgcttttcttcacatgtgaatcacttcccaccttctctgacttttgatactattcatctttgaagaaccatttcaaatgtcattttctctgtgtacctttcgttggattgcccccatcgacccacctcttccaggcagaattaattgtccttcctctgtgctcctgtagcattttgtttagacttctatactggaactggtcatattgtgatttagttatttgtacgtctgtcttttccaccatacctgggagctttttgaaggcaaaaattgtttcctcgattctctatacctggtagactgccttgtacataatagttgatctacgaatgtttattagataattgaatagatgcttgtggattactggcaccctagcagtctttaggagcagaacacatgtgattgaaagtcattaaacaaccttgaaaaactgagtatgccacctatcacagtttggaattgtggccagagcacagcctgcctactctcaggttttgctgttttgacaaggaggatttatcagtgcaatcagggcctttgaaactctatcctcatctgcagagcccacattcacatagactttatagtttataatgagattttaatgtctgaacaccacccacctcagtggtcagtgacttggcttatttaggattcatgtggtatgaactagctaagaacagagagcatggtgggctgggaaagggcaggccaattgctttctttcttttttttttatactttaagttttagggtacatgtgcacattgtgcaggttagttacatgttacatatgtatacatgtgacatgctggtgcactgcacccactaactcgtcatctagcgttaggtataactcccaatgctatccctcccccacccataacagtccccagagtgtgatattccccttcctgtgtccatgtgatctcattgttcagttcccacctatgagtgagaatatgcggtgtttggttttttgttcttgtgatagtttactgagaatgatgttttccaatttcatccatgtccataaaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatgcctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatgaccagtgatgacgagcattttttcatgtgtcttttggctgcataaatgtcttcttttgagaagtgtctgttcatgtccttcgcccactttttgataggattgtttgtttttttcttgtaaatttgtttgagttcattgtagattctggatattagccctttgtcagatgagtaggttgcaaaaattttctcccattttgtaggttgcctgttcactctgatggtcatttcttttgctgtgcagaagctctttagcttaattagatcccatttgtcaattttggcttttgttgacattgcttttggtgttttagacatgaagtccttgcccatgcctatgtcctgaatggtaatgcctaggttttcttctagggtttttatggttttaggtctaacgtttaagtctttaatccatgttgaactgatttttgtataaggtgtaatgaagggatccagtttcagctttgtacatatggctagccagttttcccagcaccatttattaaatagggaatcctttccccattgcttgtttttctcagttttgtcaaagatcagatagttgtagatatgcggcgttatttctgagggctctgttctgttctattgatctatatctctgttttggtacaagtaccatgctgttttggttactgtagccttgtagtatagtttgaagtcaggtagtgtgatgcctccagctttgttcttttggcttaggattgatttggcgatgtgggctcttttttggttccatatgaactttaaagtagttttttccaattctgtgaagaaaggctttggtagcttgatggggatggtattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaggcaattgtgaatgggagttcactcatgatttggctctctgtttgtctgttattggtgtataagaatgcttgtgatttttgtacattgattttgtatcctgagagtttgctgaagttgcttatcagcttaaggagattttgggctgagacagtggggttttctagatatacaatcatgtcatctgcaaacagggacaatttgacttcctcttttcctaattaaataccctttatttctttctcctgcctaattgccctggccagaacttccaacactatgttgaagaggagtgttgagagagggcatccctgtcttgtgccagttttcaaagggaatgcttccagtttttgcccattcagtatgatatcggctgtgggtttgtcatagatagctcttattattttgaaatacgtcccatcattacctaatttcttgagagtttttagcatgaagggttgttgaattttgtcaaaggctttttctgcatctattgagataatcatgtggtttttgtctttggctctgtttatatgctagattatttattgatttgcgtatattgaaccagccttgcatcccagggatgaagcccacttgatcatggtggataagctttttgatgtgcttctggattcgttttgccagtattttattgaggatttttgcttcaatattcatcaaggatattggtctaaaattctctttttttattgtgtctctgcctggctttggtatcagaattatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagttttgggagagtgtatgtgtcaaggaatttatccatttcttcatagattttctagtttatttgcgtagaggtgtttgtagtattctctgatggtagtttgtatttctgtgggatcggtggtgatatcccctttataattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctctgttcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcatttcgttatgtacccagtggtcattcaggagcaggttgttcagtttccatgtagttgagcggttttgattgagattcttaatcctgagttctagtttgattgcactgtggtctgagagatagtttgttataatttctgttcttttacatttgctgaggagagctttacttccaagtatgtggtcaattttggtataggtgtggtgtggtgctgaaaaaaatgtatattctgtttatttggggtggagagttctgtagatgtctattaggtccacttggtgcagagctgagttcaattcctgggtatccttgttgactttctgtctctttgatctgtctaatgttgacagtggggtgttaaagtctcccattattattgtgtgggagtctaagtctctttgtaggtcactcaggacttgctttatgaatcttggtgctcctgtattgggtgcatatatatgtaggatagttagctcttcttgttgaattgatccctttaccattatgtaatggccttctttgtctctttcgatctctgttggtttaaagtctgttttatcagagactaggattgcaacccctgcctttttttgttttccatttgcttggtagatcttcctccatccttttattttgagtctatgtgtgtctctgcacgtgagatgggtttcctgaattcagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctggatgatctttacattttggcatgattttgcagtggctggtaccagttgttcctttccatgtttagtgcttccttcaggagctcttttagggcagggctggtggtgacaaaatctctcagcctttgcttgtctgtaaaggattttatttctccttcacttatgaagcttagtttggctggatatgaaattctgggttgaaaattcttttctttaagaatgttgaatattggcccccactctcttctggcttatagagtttctgctgagagatccactgttagtctgatgggcttccctttgtgggcaacccgacctttctctctggctgcccttaacattttttccttcatttcaactttggtgaatctgacaattatgtgtcttggagtttatcttctcgaggagtatctttgtagcgttttctgtatttcctgaatctgaacattggcctgccttgctagattggggaagttctcctggataatatcctgcagagtgttttccaacttggttccattctccccgtcactttcagatacaccaatcagacgtagatttggtcttttcacatagtcccatatttcttggaggctttgctcatttctttttattcttttttctctaaacttctcttctctcttcatttcattcattttatcttccatcgctgataccctttcttccagttgatcacatcggctcttgaggcttctgcattcttcacgtagttctcgagccttggttttcagctccatcagctcctttaagcacttctctgtattggttattctagttatatattcaaaatttttttcaaagttttcaacttctttgcctttggtttgaatgtcctcccatagctcggagaaatttgatcatctgaagccttcttctctcagctcgtcaaagtcattctctgtccagctttgttccgttgctggtgaggaattgcgttcctttggaggaggagaggtgctctgctttttagagttcccagttttcctgttctgttttttccccatctttgtggttttatatacttttgatctttgatgatggtgatgtacagatgggtttttggtgtggatgtcctttctgtttgttagttttccttctaacagaccggaccctcagctgcaggtctgttggaataccctgccgtgtgaggtgtcactgtgcccctgctggggggtgcctcccagttagggtgctcagggttcaggggtcagggacccacttgaggaggcagtctgccggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgtgctgtggtgggctctgcccagttcgagcttcatggctgctttgtttacctaatcaagcctaggcaatggcgggcgcccctcccccagcctcgctgccgccttgcagtttgatctcagactgctgtgccagcagtcagcgagactccgtggggtaggaccctccatgccagttgtgggatttaatctcgtggtgcgccgttttttaagctcgtcggaaaagcgcggtattcgggtgggagtgacccgattttccaggtgccctccgtcacccctttctttgactcggaaagggaactccctgaccccttgcgcttccccagtgaggcaatgcctcaccctgcttcggctcgcgcatggtgcgcgcacccactgacctgcgcccactgtctggcactccctagtgagatgaacccggtacctcagatggaaatgcagaaatcaccatcttctgcgttgctcacgctgacagctgtagaccagagctgttcctattcggccatcttggctcctccccccaaaattgctttctttttattaagagaaaatatcatctatacagcatggaattacaaaaagccttaagaaaatgctgtgtaaatgaacagccaaagtaccttcctgcaatctagaccgtgggatcccatatttaaacttatgcctgtgcaacaaaatattagacaaaacaataccagagggagaatggtggtgaacagtttttaaacctatgtagagtaaatatttgtggtagtgttttcctttacacagcatatgcagtagaatgacaatataaaggaagtagaaccccatttgtcaggggagtaggaaggcctgatttttatcagcatgcttctattggctacgtctaagttagcctttttatagagccactgcatctcatccttcctttttacttttgttcaaagtcgagtctcccagctctttgagctcttcctcagtcactctaatttctgctttgatagtagatcctagacttcttttacctctttccattttattcagtccctaagtgtcattcgcacatcctctgtgcttcacctaactacaacttggccaaagctgttgctactaatttcagtttacttagaattagttcaattgttcaattcccacttatgagtgagaacacatggacacaaggagaacaaggagaaaacatggacacagggaggggaacatcacccatggggcctgttgggggatgaggggcgagaggagggataacattaggtgaaacacctaatgtagatgacaggtcgatgggtgcagcaaaccaccatggcacgtgtatacctatgtaacaaacctgcatgttctgcacatgtatgtcagaacttaaagtttaataataaaaaaagaattcaattttcttaaagagctgatcaatttgtgcggagatgtataaaatctgattttgaactaaagaaacttaccttacatcctgattagatctttaatgtcataaaaatgtaaactgtacagtgaaggggcccttagcacacaattgtttaaaatccactacccgttgtgtacttttgtcccttccttttctagttgttccttcaagatatggactggagcccatgaatgacactaaaatgtggctcacctactcatcctgctgattaaaaaaataaacaggaaacacatcacttctggtgaatgtcatgaccaggatgttagataaaaacacccttaggggccttaacaatttgtggccagaatgacctttgtttttgcagttgtttttcagtctgcaaggggcctttccatttcctcttagaaggtatgaacactgaccacagcattttgaggcccaggctgtgcggcttaactctcttgcatacaagaacaaggaagagaataaacagttccgtttcctgggtaatcttaccttcctctttcctaatgttgttttaggatttttatctttgcacttttattccttgaattttatgatggggattgtcatattctctgacttttcatggattttattagaaatcacttgtatcatcaggcttcttggatctaccactttggatttggtgccctttttgctgctcttggtaagagctttgtctgccattttcacattcttgattatttatgctgctttgaatgtccgtttgagaaagtaatcagatttttttccctctgagaaagcaggggaatgatcttttgcatcactttgcataaaattaacatgttgattttctataaacccataggttcaggttaatttacataaacctggcattcaggaagctcaacctttacattgtcaaggaaaatgaaataaatcaggacagctgaaattaagtatattcaagccatcagaaaatggggtgggcaaagaggcgctatggggtagaaaatttcatagttccttatagttacactcacaaaatcttaatgtgttaagggaccagacaggtttttcaatccagccttttcccagtgtaggaatcccattgagagcacaccatgcaagtgatggtccagctgacagttacacttgcaaaacaaagtgcctagtaaagcagactctttactttggaatgcctttaattgttaggaaactaaaatctgttcttttgtgaactcctattaatgggtcttagctctgcctcctggaatcaatctaatccagtggttcttaatttggaatccctggacaaggcttaaatgagtccacaacccccctgaaactgtatgcaaaattgtatgtgtgggcatgtgtgagtgtatgcatgtatcgatagctttcataaaattttcaaagggacatatgatcctcaatcagggataactttataagcatacaatttgtgcagctgcactaagccccacacttaaaaggaatttgtacttggattaatgcttttctgttgccatcctgaaattcttaataatttttaaacatagagcccgaattttcattttgctctgggccctgcagattataggggaactacccccaaagacatgaagttattaaaaaaaaacactaaaatttctataaaatgaatcattggatagttctactttcaggaggcctgtaccatccttctgtttaccttctgaccttcttgtgtttccaaacattatcttcttgatttagaatgaaatgagggcagtctacttcctctttaaattctttccaatttcttccctgccctatatgaaagattcttaacttggaatattaacttggattcataacttggaatccatgcccattattttattttacaacttatctaatttatctatatagtatttcaaactttgaaaccaatttaacacaacaactgtattgtgtctgaagaaaattaaccatttttattaacactgggacagttcttatctttttatccttgggtatctgaaattagagcacagcgagttctgtcagagcaaaaaatatacttttaaagcaaatcattcagatgtatccaattcaattttactaacttctgtcttgcttcatatgaaagcttttaaattgatctctttctttgattgatcagggtctttccccctcacatataatactctcaataaatttaatacactgaaatgtatattctcataccaaataattcacttaatttataacatcaaatacagaaaaacttaatttaaaattttaattgcatattttatgtcagcatgttattaaaacgaagttcataacacattagtaattttattggagaagtacaagttcccctgagggtcaataggtaaatgtgttattactctttggtgaccttggactctgctgtgggaagaatgcaaatcatagccactctgaacaacgtgagaaagagaaagaaaataagctctaggacgaaagtttaaaagtactgcaattatttttccttggaataaagaagtctaaggataacctgaaacaaatgaggtatttttgatgaagaagagttgtcttctatattcaagagaaatagatgatttgagatttaggttgacatttgaagaaattttcttttaaactaatagaatcatgtcctgtgtaggttagagacttacttacctaaggcaaaggcttcagccagatgatatcttgaggttccttcaaattctaagtttccacccttgggcttaaaattccacttctgtgatacaccaaggctggcatggactcttttgctgatttgcctttcatcttggactcttcattttcattcttaattatgtgttgaacacatgtccctcctggggaagaatgagtttggaagtaatgaagttaatttgttgaatggctagaatgaccacccataaatatctaagtgaggattgtctctttcaccttcatcatctgggaggccaaaactgaaatatagttatttcaattttgttgtcattactcaaatgtttttgcatctattatttgagaactcccttcagaacccatggcataatctgggtaactccagtttggacctaacctttgagtgtgatttgcttctttaagatagccaacaacaacaaaataaccaacatacatttgcacccatatcttactaagtaggtcagtgtggtaatatattttctgtgaaaatcatgttataactgtaaggtaatagagggtttctttggcttgcaaacaaattggatatgaaggcacaattaggacagaaatttcaaaaaattacaatagatcctaaaactgtgctagttggtagactatatggctggtgactaacataggtgactgctttgttaactaaaggaaaatattcatcccaaatttaaaaatcaaaatagtctcattatatcatacatatacagccaatcaacagaatagaatcagagaataatggaatattagcttttgaaatctcttggagatcattttgtctaatgtcttcacctccacctctgtgattctcacattcgtgtttcagctgaagtttcattctgggaagactgtcagtggactcccaagaatagcttagattccttagtgcctgagtcagggcctaataaataatagctactcaataaatattcattgaatgaatgagtatatgaacatatttagaggtttggaagaagctagaagaagctggaagttacagtgtcttgaagttattatcataaatgttaataattattcaaaacagctaggggagaagaagtaatccggttgtatgagcattctgattgttgcaattctagttaaatgagatttttctataaacatatatgtaaagattgtcctatctcctcagatattaaaaagggttttatttttttaaggctatgtttggaatttgaaccaaattcgaatgtgactgcttcttgctcttataactgctaattgccaagcactgtatagaatcgtttggcctgacattgcttctgaaaggagctaaccatgctctggtaagaagggaccggatctatggaaaagaaatgctctgctgtatacctagctttcacctgatatacacttcacttcttgggatgtacacttgctgtatactgccctactgcacaatcttcctcacttttctccctgcctggcatagttgtacccatagaacagagacctgatctacttcagccacatgtaaagaatccatatggatcaagtgctggatgaagattctgtacaccttgattctagtcctgggaatatcactctatctatagcactgtggttaagtactttctgagccttagcattctcatgaaaaaaataatgaggggtttgggcttcatccaaattgttctcaaattgtcttctgtgcattcctaggggttcattggaggcacttctggggctaatacagaggtcagagaaagaagcagaatgacggggactttgggctcacccactccacttcaaccacagcagcttcacttttgtttgatatgcttctgtgaaatattttgtttgaaaaccatatgcactgacatggtgagagtgcataatagatataatttagtcattcaggtaggtgaaatgattccaccgactgtttcatgatccaatattatggctttttgtgttgctgattgaactgaatgatcatgcaacaatctgatcaattgctgtaagcagctatcttcttggccacctggctgcatctattcatgtcaactcagcagtagctttagattaaagatgtgaaaattatgagcccaggaatagaagagtctggctttccttctcatggagattgaggtgggggtatgtgaatagttctgggcaggactatatggagttctattaatagaccctccacctcacctacttttccttccctagacctggagctggactttctataaatgattgcctgcttatatactaaaagctaaattgatccaagtaagagtcacacccagggtacattttatcattttattatctctcatcctttcaaactcaatcgattgtttactataagaagcacgattagtgctcctaataggctgacaggaagacataaagtaccctagagatggaccagaaaagggggaaatacatttggtctgaaatatgagttttattttcaggtatccactgatctgtggttcaaagtgtgatgatttctcaatgggaatgacctgatttttttcttggattttgttactatttagcattgattgtgtgtagcattttccatttacctaatggctagaggtcatgcaaccagtcaccactctcattccagcgtcacagatgaggagccagaaacccaaggagaaactagtaagttggctctagctcatatgctaaattgatgcagaggtgcagggaaccaacatcaattttctaaaacccctaatgtacatctccttactggttccaatctcctcctgcagggacaccatacagtacaaataaacccttccactaagctagttggaggccttgattataaaatgtcagagtggggcttgtgccttgccctgatctttagggtcatctgaagagcttgcgctgtggcttgaccttatgggaataaagcagcaaatgctttaggcttcttgttgaaaacctgcaggagaagatgattggcagtacaattgttgtgacattgttcatttatgaagcatcagaagtgggtgtgtaggcatggcagagacactcaccaaaaattatttggttttgctggaataaagtgcatcttggattgcttataggaggattgtattcagggttcgtttgacaatctaacttccacactctgatttgcccaaaaagctgtggcagcactgtgtttggagttatggattatcagttttgtcagccaagatagcttctgttttcctcttcaactcaagggtcagcattctttgctcaaaaatatttaaatccattttaaagtgagcagaatgagggagcagaaggaaggcaaattgagacagagacaggaagggagtgggtagattatacgtagagttaatagttgctatgtgaaattcaagcttctaggtttatttgttcaataaatataaattaaacactcacttgtttgccagatgcatgcaagaggtaaaagattattaccttttgattctcttaactgacagaaacagtaaccttgaaagtccactcaggcattacccctatcctcttctttcaagacttccatgactaattgagcagtaggaaattgttcctgttccatttcaacttaattgtgaaaatttgttctcttcttgctgtaagatatgcttttatctatttgcacctgctcaatatacatgcattatttctgtgtaatgtgggtacctgttcggccaagttagataactaagaaagaggtaattgagggggccttgctctggagctgtacctacttagatttaaatctgatatatgcaataggtgactacctatgaaaccctgagcacattgctgaatcatcagtacttcttctctacagtgaagttatctactgggcaagagtcactgtaagaactagagaaaacatgtagaaagaataacctggggtgggggaagggggaagggaaagcattaggagatatacctaatgtaaatgacgagctagtgggtgcagcacaccaacatggcacatgtatacatatgtaacaaacctgcacgttgtgcacatgtaccctagaacttcaagtgtaataaaaaaaaattagccaggcgtggtggtgggcgcttgtagtaccagctactcgggaggctgaggcaggagaatggcgggaactcgagaggtggagcttgcagtgagctaagattgcgccactgcactccagcctgggcaacagagtgagactctgtctcaaaataaataaataataaataaataaataaataaataataaaaacttaaaaaaaaagaacatccacataggccttgctatatgacataatgctcaatagatggcagttgttttgttgttgtcatattctttagatcaacatttccttagttaccgtaaacaaaatcagaatgtgagagtagtcccaaagaggggtctttagttctgcttttctggtcagagagaacattttgtgtatttaagtttaaagggtaccaccagacagtaggttttattatttctcttatttcacttttccacttttccataactagcagtcatctgtagttttctttagtgcttaaggtgttatgaaatattcatatcattttatgaaaggctatttacacagaggaaccagatgtaaccgagtgtacatacaaatactggccttatttttcacgcttggtaagtagcgcataacttgaaagctaagagaagatactttttgttttggcaccaataattccagaagaagggcatcctattaaaaaaatctattgatctaagagggactagaaatttggctgaatattttagaaattgtttgtttgccctgagcttcaaaaactcatggcttagagtttcctgggaagggtagaatcactgaatagatagggtccagctagctaagtttcctggtcagcccctgaagaaagtttcattgcataaaaagcgtagatttgtcttcaaagttttccccaacactttatctctgaggttttctctattcatcttgagaataaagccctgttggtgaacataaatacactcccagagttgcttatcaggcaagacagaattgagcagttgggcctgaactctcccaccgtttaaaccaacgttctcaaggagttgttagagcaatttatgcttcccacatctgttcctagatgttatgacttgtttatggaagcaatgtaaataccaattctaacaacagctacaactaatactcaatgtttactccatgccagatcctgtgctgagcacttgacatgtaagacttccttcagtgcttgcaacaaccgtacaataggtgctacacgaaacagaagattctatggtcaaaaaaagctctagagcagtgggtagaaaaagttgaaggtgtttctctactataggatttaccaaggacttggagtgtgcagcttttccaagtgtattggagcatggaggcattttttctcctgtcttagtccatttgtatggctataaaggaataactgaggctgggtaatttataaagaaaaagaagtttatttggctcagggttctggagggcgttcaggaagcatggtgccaacatctgcttctggtgaggacatcaggcagcttccagtcatggcagaaggtgaatgggagttggcacgtgcacatcacacagccagagaggagaaaggagtggggggaggtgccaggctcttttttaacaatcagttcttgtgggaactaatagagtgagaactcactgattacctcaaggatggcaccaagccatttacgaggaatctgccctcatgatctaaacacctcccaccaggccccacctttgacactggagatcaaatttcaacatgagatttggtggggacaaatatccaaactatatcattccccaagggccatctggagagatggaacaccatttgggacatgctatcctatgagtttcttatggaacccatgcttattaactttggaaattggatcaaatttcaaaaatttctgtctttgccctggccttatcttgtccttaaataacccatactacctaatcttaaaacaacttataagtttatatatgtgtcctggagaactggatctatgttgcttatctaccaagtccaagccaccatcatccctcagctagactattacagtcacctcatactcattttcctgcttccattcttatcttcttgtaaactcctatctatgctgcagccaggttcgttctaaataacaaagaaacaacaaaaaaccaaaactgtgccacactactattttgcggcaaacctttgaagacttaccatcacattcaggatttgaacactgtaccatcacctacacaactatgcatgacctgaaccatgcccatctctccccgccaggctcctgctgctgtagccaaactgtcagttcttctagtgtttcagactaattcctgctcgaggcatattctaattccctctgtctgaaatattctgtcacccgtctttctattcctactcgtcctttgtttctttgcttaaatgctgttttctcagagaggttgtcactaaccacccccaaaattaggtgtacccagtttttgtgttcaataaagttaaagggattttttttacagtaggacttatcagggcctttgatatgttaacatgtattatgaatttcaagagggacatggagtatcctgcttttttttccttcagatcacttatcacaatgtttatttgtttaatggctatctccccactagactctgggttctatgagggcagaaatcatgcctctctactgatcctacacccccaacgcttaatgcagtacctggcacatggtaggggataagtgtatgtttgttgaatgaatgaggaaatgaatgtgattcttcctgctgctggactgcctttttacagtggggctgccatggaatgatttaatatttttcatataacctcttcctactaagattttcacctctcttgtttaacccaagtcacttttggaggaaaaactagaattatattcagcactgattggtaacagttgaggattaatgagagcaatacctggctcttatatttttaaatattaatcttttaaaattattgaatattttattaactattttaacttttttaatatttaaaatgatttccaattaatggaattctttaaaacagctttttaaattttaaaagttctagttcagagcaaaataacaaagtaagataatgcattacaactgttgtttcccaattagccatatctatgggaagcaatccttaggccatgaagtctaagcccaatgtgcgcctagtaccatctgaccttcaaagttggtccagagaccctgagagaaggaaatgcctttatgagtgctgagtctgcaaatccaaaaaccaacgtataagtacacgctaaatatgtgttggtagatttttatgtaagaccttggtggtgttatatatattctttcatctgatctttcttgttacttatgtaacacattttcattgctaccaagcaggattacaagttcaattgtgacctatggaacaaaatgactgactagaccttgtgatattttaaaccatgacgtggggtgcattaactgggtcctgcaaccaaatgaggcacatgcttacctaattttcagggtcctctgggccactttgagagggctagtgcaggtagagccagcaggataacagaacagtgtacagcccagaaggtcactttctggtagttggaaagggcaagctgtccagtgttagttctttgacaagagctgcccctaggtcagtgtacacacacataaaatgtgtgtgaaaagatgtagacaaaaggaattctctgggaggttattagtgtcagttacttgtcagttacatccaagggccacagcactgctggtatagcttccgttgagtttctgtgccatattttggttttacgggcaagcagccttcaccaggatatgctaaagagtcatcaatggattagtatcactaacaaaaggaagattcaacttaatgagagaaagtgtgcctcattaatggttgggaaattaagcagtcagtttctaatcaatgctaagtgatagaacttcagtggaggctaaagctcattagtagaatacacatagatggtaatgacctcaaaggtatttaaaatataggtgaaaagaactacattaataaggcaaatctattccacctgtccatgacttggctcactgttcccctgtgttatctgtatgtcatttggtacatttatttatgagaataaatttgcatttgtgtggcgcaattggttggtatgcttggctccaactctggagaataaatttgcctgataaaatatatggttttcaaatttctacatagataatggattatgagcaacacaataatttgctttcatgaaaaaagtctataggaagaattgacttataataagggctttgtttattcagtaactcatttattcaagaataattgccttgagggaaaaatggatagcaaacctaatgcaataaatgtttatttggaattgtatttaactatttcttccttttcttccttgtgaaatgctttctcaaatgtgatctgttaataaattatgccaatatcgccaagggccttgctgaagatgttcatattgaaatgttccaaaaatatgccttagtttccctggcagaaagccaatggtgacatcagagatggcatgactatacttcaaacaggacaatgcatatgacagccaacttactagctctattcttatcccacgcttgccaagctactgcaaaagcctcaagtggtaatgcataggtaatttgtaagtcttgtatctcctttctttcacctggccaatctgtcctccttaagaggcaacttgaagactacaacgaggagttttaataaaatcgtactctcctatcttctcttcctcttgcctatcctttaaaatttccttttcttgttcattcttctcagaaatcctcagttggttctggcatctttagtgaaaacagccagatgaggtgtttatcaattcctagggctccttttgttttcatttagataagaaactccccaagggtaagacctttatttcttgtttggcgaagtgcaacatttgttcacagctctctatccccgataaatggaattaggaaatatgtcttgaagtagagccaagcactgatacaaaggcatccagcctgctttccataccctttgcttaggagagtggtgctgtgacaataaatggcccctggtcatttgtaattggttaatgtccaggggtagagcaatttaaaagtctagagagcaaagtgtaagaatgattttggctcttttgaatatttccccaaccaagatcatcggtagattgtaagatctgcaatcagtagaggttccagatatttgcaggcttttaattaataaggctaaagaatggaatcaaccattttaggagctctgcaatggttaccatgtgtatcacattgcttaaagcagatgctgcctcttgtcacgtcagggcctagcttctccctgaagccttcttcccctcatcctgtctctgttagtttttcttctctgtcatcctctaccactttcatacttaccaggctctgggatttctttaaaggtctaccatgttggatgctcactgtcacctcagttgtgaaaacagactcatttatacctcaggacatatggctgttttggttaaactccaagggccttggtctatttatttgttggaatctttctagtttgttattaaatgacagacaagacaaatgaataccacctctgggtaaatttacaaattttaatgacatttctctccattaagttttgaccttaataagacagcagggaccttcatataataaagtagttcatgcattttgtttagctttatagacagaggaacaccagaagcattttctcttgaaaccaaaatgagctgtaagcaactgtactgagtctctagaaaggaattagttttgccagcgagagttgaaacaaggacgctactgctatgttctgagaccctgaattctgttccaaaatagataagactggatcttggcatctgactttttgttttttcagtggtagtctgttttgagtcacctatatctgtatggtaacgatagagtgaggagccataagtattcatccagacagaacaaggacctgaacagtcaggtcttctcaagcaccagatggctctattttacagaaaaggaaaacaatgcctagttaggtaaaacagccagaccagagtcactctgcaagttagaagtggaatcttgctctcttgcttgtgtgttactggttagcacatcactatcctgaagaacaattaataatatctcatttcttgccttaggagaagtcttttaaattactggtgcctcagtttcccttttatatagatgggacaaatgacatcatagtttattcactaatccattcagcaaaaatagtctaggtactacaaagacagccatatatcaaatgtagtccatatctggatatatgcactttttctatcaaaaagctacacacaaaaattacaatacaccttattttgcactgctatagagtttaggacaatgtactgtaagaggattatatatatatatatttattattattaaagttttagggtacatgtgcacaacatgcaggtttgtcacatatgtatacatgtgccatgttggtgtgctgcacccattaactcgtcatttagcattaggtatatctcctaatgctatccctcccccttccccccaccccacgacaggccctggtgtgtgatgttccccttcctgtgtccatgtgttctcagtgttcaattcccacctatgagtgagaatatgcgggtttctgtccttgcaatagtttgctgagaatgatggtttccagcttcctccatgtccctacaaaggacatgaactcatcattttttatggctgcacagtattccatggtgtatatgtgccacattttcttaatccaatctatcatcgttggacacttggcttggttccaagtctttgctattgtgaatagtgccgctataaacatacgtgtgcatgtgtctttatagcagcatgatttataatcctttgggtatatacccagtaatgggatggctgggtcaaatggtatttctagttctagatctctgaggaattgccacaccaacttccacaatggttgaactagtttacagtcccaccaacagtgtaaaagtgttcctatttctccacatcctctccagcacctgttgttttctgactttttaatgatcgccattctaactggtgtgattatatttttaacagtagaagcagactttgctggactctttcgagcccatgaaagaaaaatgtagggtgtacatgcacaggtataccctaaaactttttgaaaattgtgtataaacatacagtgttttcatctctttttcgtcatcatcccctgtcaagcatgcatcatgttcataccattgtacatgtgttaggaaaaaactggaccattcaaagattggcaagattggctggacccttcatcccattcttctatctttacctttcttcattctgtcactcctccttagaaccctctaccctgtctatccatatcagctttgtttttcaaggatccacttgagggaccaataggtttgtatttaggttatctgtagaggatcttaaatgcacataggacattacattttaaagttagctaactcttattttaaaggcacttgtcaagcactggccagtactcaggggtttgctgcatgatgggtcaccttcattgaggagcatttgcagaaacggactgccacacggtgataacttggctggactaaagcacacagatgtttgagctgttctttaatcatagatttaaatttcctattttcagagaattcactttggttataagaagaaccttgtagcaggaatggaccccagtcatccttttattggggaaaattttatgttttgaaaatgttaactaagccataaaacattcagccatccagtttttaggactgaaatatgggaatcatttctggatttagctctgcctttgtaattcagctcccccaatattagagcagcctccatatgtcccaattaagtggccaaagcttggcttctgtggattgattccataatgcagaccgtaatagctcataatgactctgaaagaactgtctagccaatcttgccaaaactaaaattgcctttcatttttaatatccccaactgttctcaccctgttggggatagcaaatatatttgcatttggggggaacctcatatgcagctctgtggaaaacatggcacttctcgctgtgattttatgagctatatgtagccaagccatgcatatcgtgaacatatctgcacacagacttgccaggacctgtgattcttgcaagccttttcattgttcctcagaatttgtcagtaggaagttggtgaaatacatctgcccaccctcctccttatttgggagcagaattcataccaggcatttggtttcttcagactgtaattaacaactatggacttagaactatatcccccaccctagctggtagtataaacaggacacgtggacaatagcctgaccattcactagtcctgttatctagtgctgctaagactggttaaatgttctgacctgaaatataagtattttgccattctctattgttctgtaccatttattctagttgatgtcacttctgttcgtaacctatagaactctttgtagatgggagagagattttgactatctagaaatgagaggggtaattaatgcagtaaagacctttagaaggtgaaggggaatggggtccagagcccaggagggcgggctaaaaaaatagagacagttctttgattctaaaagtagggaaggaaaaaaagttgaggatacacgcaagataggtttgggtgacagtcaaggtgacttccattttgtaaactaagttagaggtaaggttgatcaactgagggggaaagggggagtgtaagagtaaaacttgagaaagtggctagaatttggatagatcctgcttttccccaaactaattgtctctatcagcaaggactgggccagctaccctgaaatgattctgccacgcagtgaccatattaaaaatcttgaaagcttcatcagtaaactgctttaatgagtagggctctgcagcactgatcccacaatatgagttggtcccattacaaactgataatgtccagcctcagctgggctctcactgtcactcaacaatccattgatgtgtcttggtctgctacttctgccattacacactaccttcactcccaataaatacattaggtggtaatacttgggctagaaaattttcagtgagatgattcctttgccatggcagggacctagcttgtgtgactatcacctaatctttagtgctaattgtgaaaaggcatgagtctttctggacttctgagggaagaaagtcttctattcttttcagttaaatcaactaggatgcaaagcagaatataatttctctctaaagtccagattcctttgccttttgtggggcagcaggagagagagagaaagagagagagagagagagagagcgagcacgagagcacatgacattcctatgagtgacattagtagaagagctagaatcttctaccataacaggaatatgtttatgtatggctaatggtttatatgaaatgaatgtgcatatgactaagggaagactttgagatgaaaaagtgagaaactttgggatgagtgaacttgtgatgaatctaatgggtggcctagcatcagaaccataacatgagtagtagccaggtgggccaggtagatatagcaggtcagatgaaatccacttttcagaatacgggactaatattgagctgaggtatttgaagaacaggcatccagatataatataatattagggattactgtgtttcaggcactgttctcagtaccttatctgtacagtattaactcatttaatcctcacaacagccctgtgaagtaggtactgcggttttcgttttgtttcgttttgagatggcgtctcactctgtcacccaagctggagtacaatggcctgatctcagattactgcaaccactgtctcccgggttcaaatgattctcctgcttcagcctcctgagtagctgggattacaggcgcccgccaccacacccggctaatttttgtatttttagtagagacggggtttcaccatgttggccagcatggtctcgaactcctgacctcaagtgatccgcccttctcagcctcccaaagtgctgggattacaggcatgagccactgcgcccagcaaagtaggtactgcttttatccactgaggagtggggagtgtaagtaaattgcccagagttacagggctaattaacagtagaactacatttcaagcccatgcatttaattgggaagactgtgaagaagctatcacctgtttttaaaagagaggggtaaagcaaattacacaaggttaaacagctaatggaactaacttgttcaggaacccaggtgttctgtgtgtaaggtattgttttgttactgcacccttagtactcaaagtatcagcagcattggcatcacttaggagcttattagaaatgcaggctctcagtacacttctcacacctgctgaatgcaagtgtgcatacagttatttgtgtgcatattaaagtttgaaaaacactgagctattacttcattggcactagtttgcgggacagatatttacaaatactgttagccaaaggcagaaactacatcccaattatccatctaagacagggaaagtatgaaatttggcagggtttgggggtggagttcacatagtaggaaacacagggatttgaatagttgaccagccagtattggagaggttagagttcagaggtaaataaaatgggattctacaggaaatgaagttctatgcagtaacttcatcacataagagttcctgactaagtgaggtatgtaggcaagcagtaccagaagctagccctcctagagctcctgttatttatttgtcaaagggcagagctggttttgaagtgaatctgacttttgcagtggttgcagcagggagggtcaaaggatagatttggcacaccgtctagttgatttttcagcttccctgtcctgggggaatcacagatttctctgctttaagtaaacttgatatgtgaatatctggatttataaaacagtaaaaattataggtgtggcaatctcagtttatagactttgtaactaaattattcattttattagagagcacatgatatgttgctttttaataatgagctcccctaacacatttaagacagaattcaattttcagccctgttaaaaattcaacctagtaaaaacatatacaatataagtaagctgcccttgcatgagccgggataatttgcctaagcaactgtgtaaaatggtctgaatgtttcctgaattcaggacaaataggattttggtatatgtcaccctttgaaagacaaaagaggtgctttctggagaacacactgctcttgactttaagcctccttcagttctgtttcacagtttttattcttcatggtctgttgaactgaacttgtgacttcaagtggttcactgaactgagatttattgcagtttgaggaaggaaacagtaaaataagaaggcagttttgctatttttgtacaagacctcctaagcaacatttcacaaaacacatggtttcaattacctctgtggcatccacccacccacccactcatccattcagccaatattgtccagtgtcactatgttagggctgggaatgcagcagtggacaagatacatacagtttctgctctttggagcttatagtctagggtgagatgcagccaggttaaccaggcagtttccagtagagtgtgattaacagctaggatgattgaactctgggctgtcatgagaacataaaaaagatgtctatgacccaaaccagctgcaatgaatagacagaaattatattagctatctgtggctgcataagaaattacccccaaaattagtgttttaaacaatatgtatttgttattccacagatttccatgagtcagacacctggtcatggtttaacttagtcgtctgcttcagtgtttctcattggttgcaatctagggattgaccagggctatagtcatctcaaagtttaactggggaatgatcaattctaagctcacttgcatgatggttggcaggattcagtttcttgtgggttgttggactgtgggcaccagttccttgacggctgttggctagaggctagcctcaattatttgccatggggccctttccatagggcagctgacaacatggcagctgggttcatcgaagtgggaaagtgagggagaaagaaaattccagcaagacagaaatcagtattttgtaaatgaatctaagaagtgacatctcatcagtttcgtcatatactgctccttagaaacaagtcactaggtccaactgtactcaaaggcaacagcccaacacccaaagaaaagagaaaaggtttatataaggatgtgactgtcaggaggcaggaaacattgagagccattttagaagctggctaccacagaaatgtcctcctgtacagagatgtaagttgtagctccttaatggctctgttgaactattcttagtctcattcttactcaaactcaaagtttgtcaccaggctaccctgcctccggttcatagtatattgtcatagtgttacctcgattggcatgaaaaatagttatcaactcccttatttcttcgatcatttcaatcataatggttgggagggtcaggaaaatgccttcggaaagcaaggatattggaacaagtacaaatttaatgccggctttcatgatatctgtctaagatttctggtaggccttttctctgagacacctgtttttaattagattattttgatttctatggcttattcaaggtgcctttagtaatggataatgtagaacaagtatatttgtccattgggatctggaaaaagcttgaaaaccagctctcaggaagagaggtatattagttagggtgagggctatacttctataagagactacaaaatagaatgacttaagtgagatgacaatctctctcttattctcactctgtagtccctctccctcctcatccccttccctgccttgctctcttctctctctcattacattatagctggtataggctggtagggaagttgtgctccatgcagtagttcaaagctccagataccttccattgttgttctgccatcatctagaccagcggtccccaaccttttttaccagggactggttttgtggaagacaatttttctgtggacttggtggggggatggtgtaggcatgattcaagtgcattacatttatcatgtactttatttctattattatttcattataatatgtaatgaaataattgaacaactcaccataatgtagaatcagtgggagccctgagcttgttttcctgcaactacatggtcccatctgggggtgatggagatagtaacacatcatcaggtattagattctcctaaggagcccacaacctagatccctcacatgcatgcacagttcacaatagggctcgcactcctatgagaatctaatcccgcccctgatctgacaggaggcggagttcaggcagtaataccagcaatgggaagcagctgtaaatgcagatgaagcttcgctcgcttgcccgccactcacctcctactgtgtggcttaggtcctaacaggccactgactggtactggttcacggcctggggcttgaggacccctgatttagaccacagattgatagattatggctggcagatcaaatctggcctgctgcctgcttttgtaaataaagtcgaattggaacacaaccagccccattcatttatatattatctatgtctactttagcactacaacaccagaactgagtagcttttgacagagaccttaccatctggccctttatagaacaagtttgccagcccctactctaggacatggtccttgtgtgcatgttttcattccagattgtgggaagagggatgggcaagagttcagagtaaataactatattttaagaaattgttgaggaagttgtatatatgacttttgctcagaagccattgatgagaactagtcatgtggccacatctggctgtaagggtgaaaggaaaacgcagtccctgattgggtggctttatattcagacagtactcatgacaagaggataatgtatactgatataccaatattattgacatttttcaattaaacaatctaatgtacagataagcaaatttactttcttaacgacacaggggtagtaagaagtactttctgacatcagcagaaaatataatagagttgagctgctagaaaaacaaaaacagttaaagaattgggctacatagagattgaagctagaatactattcagaatccagggcagcttcagagacctgaatatcgggataggtgattttcagaggacctactttctttctctcctcctgaaaactggctttctaattttgtacttggtatagcttttctctgtatccccttttcttcttactcttgtattttctccttatttttctcttgaccataatttcctcatgactctagttttacggcatggcatttcttgattgatcttttcagtctcacttctcaaggtcctctttgttcattgccttgttttcacattattaccctgttcacatttctaaaaggcagagtgaattctgtccagattgttgtcttcagagtttctggccacttttgcaatggcttcctgagggttaagaattacgcttgtttgtggcattggtgactacagagggtggggtcatttggtataaaagattataaaagatggctttcaagggctttcccttgaacaagggaatggatatgggcagttgacaggtttactataataccatagtcataagagctacagcctctcttaaacacttaatactgcccagggccgttatgtgtatctttttatttgtcataactaaagcttgtcagtctgctcttatttgtgaataagccaaatatcaccaattcttggcattatgtatttgtaaaaaacaattctttgaagtttgaggattcccctagtgtagatagctgctggcagttacaatttgttaatgaacatgaacctcttggtaggtttagctgtaatagagggactgagtaaaaactcaaacttcttagatgtttgagaaagttggatttataacttcacattttattgtgttcatcttatcacttcccacagcagcaattttcacctcaaaattctcttgcattgtaggaatgaaggcttagtgtgtggaaggcactgtgttgaatgctctacaatacatttatttaattttcacacaaatgttgcaaagtaggtaccaatattatccccattttacagttgaggaaactgaggtacagaaaggtcgagtgactttcctcaaagtcacagagctagtaagtggcaaagccagaattcaagctcgggtggtttgaattcagaggcaagtacttcacccccatagttcataaagcacttgagtatcccgtaccccaaattttctagtgacacagattgtaatctgttttggatcccttttctcctcataaactactttcaggaatgctctaagagctctgtgtttaccagctactgatgtctctagaaaaaccatcagagtccatcaagtaaactatgcatgttaaaaaatatttagtgatatgtattcatgatggatgctaaatcttccaacggagccatgaaggtccattggctaaatgaatgtgcttctagatttgtctaagtacttactgtctagcataaatagttcacattatcttggtaaatgcagagggttgattttcttagtacaggttatttatacagccacaaatagtcccagttggtaatgacttttgggtgagtaatatgggttttaagtcttttacaaatatatgaaattttatggtaagtatgcagtgttacattaatatacaactaatgtcagaatggcctttgctgggatagtaatgctgataaaaattttttttgaaaacattcaggctgcaaatataacagttggtctgcaaaatttgaatgtactccttatccctatttactctcatcttattctgtctataaattatgctctacccttcctttaacacctggtacaaaatgcacgtccaggaatccagtcccaattaacttcacctaatgcatcactccctccctatgtgctcttagcacctctagatacagttcatagagacatttgcttttgttttcatgttttttgtaagtggtcttaagtcacttcatgtatgtttgttttgtcacattatataaattgaattgtcttcatgatgtcaggaagagccgttgcaaacagaaggtgaacagtaaataatgttgactgactgcccttaaagaatagaaacatctgtttgcttcaggtcaagactcttagaatactcattgaatatggatttccttaatcacaaggacatgccaggaagaaggaaaggaaagcacttatagtttttacaacaaaaaacataaaaaaagaataaaacaaaatccctctctgtttgattttcttcatgcccactctgattgcttcagactgactgattaaggctgtccaacagtattttgtaaataagggataaagtcctcctacacattaatttcttgaaaagaatatatggagatttgggtgtttcattcctccttaaagttgccataatgctttgtagaatgtgctagtgcaccatcttgcttctgtggtcaggtgaagaagtgaacagggaggtggtggtggtgtatgtgtgtgtgtgtatagagtcttctgtcataatattgacccccttctgctgagatttgtgtgatccctgatttatcatcagaaattgatcacaagagtttatctgtataggagaaaaagcaaagccttggaattgaagcaaggaaattaagagctcagttttgcttgaactcataaattataaattatgaagggaagttgacaggcctgaatttggtatgatggagaagtattttagaaaagatcaatgaaattcataggtatttaatagagaagcatatggacaagcatggctccaaatccagaagctttggagggaaatgtcctggtgatcatagttctcctataccatccctggtcccgagctgtgtccaaagaattggctcaattattttctagctctaaggatgctggtctagcctaggaatgacctaaggagtcaactctgctggcttatttttgctctcttaagactagtttaagttaggatatccagtgccgtccttcaaacatgaaggcagaccaattaatctgccatccataggacacgggtttgtgtagttgatcaactataaaggactgggcattcttgatcttctactctttctcactaggtctcctttatgaccagtacaaccttatgcttggtcctgtgctcacagctctttgtgtgtttccactatcacagaatgtgttccattttacttggtaaaataattttttatgcaactagtaaatatagttagctatttatatgactgtttccttcatcagactgtcagctaaggacagggtcatgtcttattctcctctgtatcaccagcacctagtaaaaagcctgttcataaatgttctataaatggatgagcccaagctgtggcctaggtgaagttagttgcagtaatgaaaatagtaacagataactgatatttagcacttactaataccaggccttgcactgagcactgaaatgaactatatcacttaatcctcacaaactactctgtgtggagttatcatctacattcataagtgaaaacacagaggccgagagatgttaagtcatttgcccaaagacacacagctattaagtattagagtgaaaattcaaaccaagggatgtcagattccaaaccttcaacattacactgcctgctaggatgtcaatctcatgagaagaaaataagcttggcccatttggtggagagctcagagtgacttcaggtttctgaacccaatctagtttcatattagaacagactttaatccaaattatcccagaaatctggggacttactagtgaaatcagatttttttccagaagaggtagactactcctaatttggggataaggatgctagtgctagaagagacttatgtggcatggtggcatttggtttaaatagtttctttataattctccctcatcagactgcgtgttttctctgttatattttcctaatgtcagggattggacctctaagaataggtgaaaagtgtccctggcagaaggaatataacttatgatggtcttgaagtgaaaaggagcttggcataatcaagcagcacaaaagtggccagtgtggctggaacacagggactgagtggcagaaacgctagatgagcctgggggcaggagggttgtggtagtggtgaactaattcagagcctccacagtacttggggtgagtttagtgggacagtgttacgaatgaataaataataataggtggagattctcccttactctcagtgaagtaaatcccttgaatatattggacatggcctctttgttgaattatctgctataatggactgtgttctaaggaaatccagagtgcagtcaggccctgaattatactcagaatatcttcttaaagaacgtagtctctatgaaaaattcaggagtagagactttgggccaagattatacagttatatctacagagagatataaatatacagataatttaatgaaatgaaattatttaaactcaatatactctaatagatttattaggtatgttgaaacctttagtcgctaattacaacttaatgaaataacaacttaattcccgttcctactcccttctttttcaatctacagttcacatagcaaattattcatctaatggttaatcatctgactcctctattagactctgatgagatagcctgaggtttgaagaaaatgattcttgaaagacacaaggatttatgaaacccagggggctccaggcatctgagcttccttacttttctattgggaagatgggaaggtggggaggtcccacattttgtacttttctccacagaagcattggagggggaggagaaggtatgctgggaggtgacctggcaataaagggaatagaactaacaattactgaatgcataccatgagtcagccatcttacattcattatgccatttaactggcacaacaaccatttgatacaggtaccatttgttatcattttacacatgaggagatggagactcagaaaggctaagtgacttgcccaagctcatacagctagttaggttgtggagcatggaatctaataacgtgcaactgtgggtgcctgcaaagtttgctcttccaacttactctgtgcctgcttctcatttttcctaatacctgaattctccttgcctctcagattttcatcaggaggtggcttctcaatctggaaatcagggcccatgagggaggaaagctgtagtaaatatgctttggtgagcaactagcttttctatttccaggatatgaacatctcatcagctgaataaacttaaggttatttctgcccacccacccacctacactgtcactattgctacctgacacttcatgataacatcacccttcaggattctccaactgcacgaaatggaaccccagagataatttgaggctgagctcagaatttatgtaccatgtatcaaaaatgaaacgttttagtcaggtttcctgagacccgatagccccagctaaactggaggcgagagggaaatctttttgagtatggttggttagggaaagttcaagcctctgtagaacatgatggtgaaggacctttgacagcctaaggccagaataaaggcaatgggtgcttggagtcactaggattaatagttctttaaaggcggggaccaagttttgtttttcgtttctagcacctagtacagtgacttgcattaagtaggtgctcaacagatgtttattaaacattcaagtgtaaaattctataaaatattaatacttgaagataagtacctatttgttaataggcatcttttaaagtaattcaagctataagaacaaagtcaagaaagtatagtggtcctttgggggaatagctatgattaagagatagggaccctgacaatgatgttgcagagccctagatttttgccccaactctgccattaactggctgtgtgcccatggacaagtcacttgactactctatgccccatttgtcttatctgtaaaaatagagggtaaaatgttcctacaagtgttttattcatatgttcattattttatgcacataataaaaatacccaatattcatttagctcctcgcagattacagactcatgtatatcacctcgttgaagccttccacaatgtggtgaggtaaatattatctcagttttacagataaagaaactaaggttccggttatagaagtaattgtagaagactactgctaagtaagtcttttgcctcaaatccagtcctctttccaggtaccacagctcttttcacatagtaattagctgtatgtaaataatgcttcccaagtgcttgaaaaatcatttgttcccttaagtcttcaaacatctctcctccaattgtgtttgattgttaatttactcagcaaattcatttccaaatttcaagccagctgaagttgacttactaggaatttcacattctctaggtcataattaacaaggcttgcctttatttttctgcaataagccttggttttttggtgaaggaaatgcacatgccctgctggaagcttaggcagattatgaggggccgtactttttagcttagctagaaatggaatctatgtgggaattgaactacctctatttcagctaacagcagaaagtacacctgcctttgcttgtatgcagattcatatatattggtgcagatatgacattattaacaaacctgtacatgtacccttttagaatattttgtcttccattaatggaaaattaatatatccaatgacaaaatatcaaatctactactggatattttaacatatattatgacaaatcagattcccttaccactttgtactgttgggaatgagtcctcaaatgtaccctctttccctagggcatgacacactggctacattttcataatttaacaaagtataaagggactttggcagatatcaccgaatctgtcagatttaactgcttgtaaattcaattagtcgggggaaaaacagctctggagaatatatcaaaattcaattagtcagcaaatcgaggtttttagcctactcttttgggtaatctatcaaaagggaaagggtacttcacacttatgatcaactaattaaatgcattaggccctgatgggatagtttttaatattcaccaccctttcaagtctatttggccagaaaacctagtatgaaagagttccaacagtaggcgttatctaaacaagtgtatagaatgtctaattaaggtacaggctgaaggtgtttccttgccttcttcttttaattgattgaaagagcctggctctaaattttcaataccttttaataaccaatttaagtgttactgggatgataattttattgtacaccaaatactgctttcttttgaaaatcttatcactaatgaaggtgtttatagctattaactgattatagtagtgctccttcaaaaaatgggtttctagtgagctaatgatatatcttaagtgttttgaatgatgtttagaggaattacaatgtggagtgactaaaccagaggctgcaaacattgtatgggggtgttctttcaaagtaaatatgtcatttctgtgactcataacttaactttgagtagatttatcataggcttgctgtaattgaattgtttcaaggctgtattttcttttgtttgaaattcatcccacagtagtgcaaatgttaacaatattgttttgcttctttataatcacttgtcaccctccccactatttgggcaaacatttactgggaagctttactccctcatccctgaaaggagaggagtgtggcaggtcttgtcattctaagacagcagttaagaataacaacccatgaggaatggtctggattaatgtttttgccacttgcagctctgcaaatatccctgcttgctctctgactttggtgaagttacagcttctttcaattttggcttcctcatccatgaactcccaatctcatccagtttaacatttccattcctttttatctgttggcattcatatcatcacacagttgttcttacctttctttagtcttttgctttctatctgactgtctttgggtaaccttggtcttgtagtccttttcaccttgaaactggctcaccttatttttatctcctcatgccttctatttattaatgcaggacagcagagccacctgctttctaatatttgcgctaggcccttttttgatgacattgctttccagcctttctctctgtaatggggagacctttttatctgtcaagtgtcactaccctacaggggaataaatgaattgaaggcaacacagaaatataaattaaactaatttatacttatctgatttttaattagagcaggacacatcaaagtttgatctgtgggtggcaaatacatttatttactagatattgcatcaatttgttccctgcataacacatccagttgaactgtggtgtgactgagaggtggaatgatataggaagcaaggaaaatattatagaacacaggaattaagggattgttatcatctgagcagggaattggggaacattgaccttaaagttgttataatcagcctcaattatcaactctatctagggcagatctttcaaatccaagttagtttctctctggcttctagaacactcctgggctgcttttctgattggtaggtgcttggggaatacaaactaattttaatactagcctgccaaatttaattgagaaggaatatctgctactgaaaattaaaaatttgtaagatagatgattggttttggataatctgccctttcagattaaatgtatgcaatgaatttaacatgttataaggaagatctatatagcgcagtgcttaagaatgtatctctggattcaaataagttgaatttaaaccacaggtacactttggctctttgaccataggtaagctacctgtcactctaaacactgctgtagcagctcagacagtggtttttttttttccatagtgggctgttgagcctgtcccattcagagaagacactctgaaattttaagaataaaaagcctggataatggcaaacccactaactgatgtttcacagatgactgtaccaagaggtgctgaggcttcaaaagtaatttctataagtaaaaagcagagaatggggaaaagtagcctaacacctttgaaccagctcaacttctctcttttttcacacctcgcttgaatggtcatactgacgagtactttctatatgttacctctctcctgtccctttttctgtcacttgcactttgtcttctccgccattctcttcttacccatccctcttctgtgtgtattgcctttcccctactccccatattcctatctctgtgtctcctctatcattcatgactcttctctttttggcatgtgtaatattgaattcgagtttagttaaaatatttgttaacatcatcaaaacaaaacacttttatgtataaccgtgatcaagaaagtgaaaagataatgtacagaatgggaaaaatatttataaattatattgctaatcagatattagtatccagaatatataaagaactcttacaactcaacaatgaaaagataagggacacagctttaaaaaacagcaatggtcattgtttcaaagaagatacgtaaattgcaaacaatcctgtaaaaagatgctcaacatcattaatcatggaaatggaaattaaaaaaagcagtgaggtaccatttcacatctatttgtatagctataataataaaaaaaagaaacaaacagcaaagttgtggggaaattagaacactcctgcattgctggtggggatgttaattggttcagttactgtggaaagcagtttggcagtttctcaaaaggttaaacagagaattgccatatgacccagcaaatctgctcttagatatatatgtgaaagaactgaaaacagagactccaacaaatacatgtacagccatgtttgtagcagcactacttaaaattgccaaaaggtgcaaatgggccaaaagtttatcagtggataaatgggtaaacaaattatggtacatacatacaatggaatattatttagccgtaaaaggtaacgtacaatgtggacaaaccctgaaaacatgttatattaaagaagtcagatgcagatgtagaaggctacatattgtgtaatccacttatatgaaaatccagaataagcaaatccatagagacagaaagcagattagtagtttcaagggctaaggtgaggcagagatgataaagaaaatgcttaatggctatggggttttgcttagggattagtgaaaatgttgtgggactagactgagatgttctgggactagccttgtgaacgtactgaatgccactgaattgttcactttaaaatgtttgttatatgaatttcacttcaatacattttatgtacagatgtacatatactcatttgctgcgtaacatgggtcaatgatgaattacatataggatgatggtctcataaaattataatggatctgaaaaactcctatcatctagaaaagtcatagccataatagcacaatgcattcctcacctgcttgtgataatgctggtgtaaacaaacctactgcatcgccagtcatataaaagtatagcacatacaattatgtacagtacttaatgcttgatagtgattataaatgtctatgttactggtttatgtatttactatactctttatcattgttttagagtgtgctccttctacctataaaaaaaagtcaactgtaaaacagcctcaggtgggtccttcaggagatatgccagaaggcattgttatcataggagacaacagctctctgcgtgttattgtccactgtacctttcctatgttcaggtctgtttagatacacaaatactgacctttgtgttacaattgcctacaatattcagtacagtaacatgctgtatacatgtgtagcctaggagcaataggctgtaccatatgacctatctgtagtaggctataatctaggtttgtgtaagtacactctgtgaatacatgactgtatgcatgttctgagatatacacacacccattaaagctattgatcttgtgttttacctttatgtgacactttacctttaaagttctctttgtgtgcatgtgtacaggggttgggaagaagcagttcagtatcatttaataagggggagaaacccaaccccaagatacttgatgaaatctaaggaatacagtctaagtaacacctacctgctcctcccaccaatataagaagagctaaaatcattaatgcatgtatgtataggaaaataatgaaagacaaatatggcaaaatgaggtcagttcaaaggatttatctgtgtgctaagagatgagatagaggctagtggcatgagaaaagcaaaaatggaaataagaggaaaatgaataggtagaactgagggcaatgacctggctcattggaaaaaaaaaagattttttggtaaatattctgtattccaaccatgtctaatagggatttatgaagtgggggaggagacactggaagagagagagagtaaatatgaatgtatttgtattaaaatctctagaataaatgtagtcatataaatctctggaatacaaattttcacttcagtacttcactgtgcaaaatagtttctgaggcaatgaaggaacataccagggctattagagaaagctatgggattggcaaatcagtgagggaggacttgccagctttgaatgcctagtaagtttatttacagtatacccctgcttggtccatgaactgtagtcttaccacagaaatagctggaattttgagaaaaactgtttttgaagttataaatgatcagctgctgtaatactggcttataagaccagatagtgtggccacaagtgaaaagagaataacctaggaagttcccctcttctccatgagttgtcattaactgtttgattgttcccagcagtattataactctcccttttccctggagcagtctgccatttttgcaaagtgaggaccaatttaatggggtttacttaatggattgataaggctgaggggcaaaggtttgccacagggaataaattgatggttaatgtatttttgcctccaaggccagaaaggagacataatgaaaagagtgaagtgaaaagataagactagggtttaaacgacagcttgtggtcctctgcagatgattcatttctgctgcttggcatgtgctttagacctatatgtttacaaggacaaaaatgggaaaattactccctgatcctctatatatgtacaatatatataaggacctattcctaaggtccttgtaaatccctagcccttaaataaatatacatttgagagaaaatatcacaatatagatttaacattgtatggagtagggagtagaccagtaattttttttctcactgaacgaacatttaaaacattaatatcctcttgcatcactaagagcagtaagactgcaccatcccctggttattagtgttcatagcaagctgtgtgaatcttgttggcaaaactttactagcctttgtagcagcccctgacccaggggcatctctacaaatcccctttgacagctgttttcatatgcactgagaatagacaagaagaggtagattttgactgaaacaggaggcattttggtgagagttatttcaaggaattttattgggaggaactttttttcagattgataataaaaacaggtccataggcaaaagctttataacagtattttaatggcaaattaggtgtgtttgcatcagttctgtaagctttcaatgctggtgttttaggagacaaatgtcctactttcctacagaattgtccctggtgttactattggagagcaaattatgtactgcatgggccctgggatatctttaattagtcagtgacgaaagctgggaaatctttcaccaatattctttaactttcaggtttaggatggctctaacctggcctgggtaaagaataatggacttggtgaccctccaaggccacttccatttcagtgattctattacctacttctgtcaatatttctccacttcctcctcccctgcagaaatgagagaaatacaaagcaatttgtgatcagcttccctaacaagccccctacacagaccacgaatatgagctcaaagcacattacttgaaattgtttaaaatgtaatcccttccaccttactcttgttttcactcaggacagagaacttgtttttgaaattcagactcttatttctatactcagaggcatgcaaccacaatcaagatggggtttggttgaattcaagttttttaaacctattcttcatgtataacatcacatctttttatgtgtatatatatatatatgtagaattatatgtgtaataaattacttcagttaagttgtgtgaggctagggtaggctgcagtaataatcaacactcacatttcagtggtttaacccaatagaagtttacttcttctgagagtccaggttgctttccagggaacccgtttccatatagtgactcaggggcttagactgctttgatctgatagtttcagcctcatctctgaaatgacatatgttcacttcccctcatgggccattggtcagaattaattacctggctttgcctaaatttaagggggcagagagaagccgagaaataagtcttccatgtttccagaaggagaggagaatttttgatataggtgaataatagggatatatacaagtttagtgaatgagtctgcttaagaaaattttgagactatggggtttttttagatataggatcatgacatctgcaaatagggatagtttgacttcctctctttctatttgggtgctctttatttctttctcttgcctgactgccctggccagaacttccaatactatgttgaatacgagtggtgagagagggcatcctggtttcatgccagttttcaaggggaatgcttccagcttttgcccattcagtatgatgttggctgtggatttgttatatacatggctctcattattttgagttatgttccttgatgtggtttggctctgtgtccccacacaaatctcactttgaattgtaataattcccacctgtcaagggtgggaccaggtggaaaaaattgaatcatgggggcagtttcccctatgctgttctcatggtaatgagtgagttctcaggagatctgatggttttataatgggcttccctcttccttcggctctcattccatctcctgccaccctgttaagtggtgccttttgctgtgattgtaagtttcttgaggtctccctagccatgcagaactgtgaatcaattcaacctcttttctttataaagtattctgtcttgcgtatttcttcatagcagtgtgagaatggactaataccttcctttaatgcctagtttattgaaagtttttaacatgaatagatgttgaattttctgaaagtctttgctgcatctactgagataatcgtgtggtttttgtctttagctctctttatgtgatgactgacatttgttgatttgcatatgttgaacaaagcttgcatcccagagataaagcctacttgatcatagtgaataagctttttgatgtgctgctggattcaatttgccagcattttgttgagaatttttgcattgatattcatcaagaatgttggcctgaagttttcttttgttgtagtatctctgcaaggttttggtaacagaatgatgctgacatcatgcaatgagttgggtaggagtcccttttcctcattttttgggaatattttcagtaagaatggtaccagctcttctttgcacatctggtagaattcagctgtgaatctatctggtcctgggctttttctcattggtaggctatttactactaattaagttttggagctcattattggtctgttcagtaaatcaatcttttcctggttcagtcttgggagggtatatgtatatgggaatttatccatttatacccagttttcttgtttgtgtgcatagagatgttcatactattctctgatggttgttggtatttctgtgggggtctgtaataatatccccttgtcatttctgattgtgtttttttgaatcttctcttttttcttcattactctagctagtagtctattttattttctattttttcaaaaaaaaaaaaaaaaaccagatcctggattagttgatcttttgaacggtttttgtgtctctatctccttcagttgagctctgactttgattatttcttgtcttctgatagtttgtcttagcccaaactcttcttaagctgataaacaacttcacaaagtctcaggatacaaaatcattgtgcaaaaatcactaatattcctatacaccaacaacagccaagccacgaaccaaatcaggaatgagcttctattcacaattgctaaaaaaaaaaaataataaaataaaatgcccaggaatacagctaactagggaggtgaaagagctctacaaggagaactataacccactactcaaagaaatcagagatgatacaaacaaatggaaaaacattccatgcctattgataggaagaatcaatattgttaaaatggccatactacccaaagcaatttatagattcaatgctatgcctattaaacaaccactgacattctttaccgaactagtgaaaactattttaaaattcatatggaatcaaaaaacagcctgaatagccaaggtaatcctaagaaaaaagagcaaagctagaagcatcacactagccgacttcaaactatactacaaggctacactaacaaaacatcatggtactagtataaaaacagacacatagtccaatggaagagaatagagaacccagaaataagaccacacacaactatctgatcttcgacaaacttaacacaaacaagcaatggggaaaagatttcctattcaataaatgttgctgggataaatgactaacgatatgcagaagattaaaactagatcccttccttacaccacatacaaagattaactaagatggattaaagacttaaatgtaaaatccagaactaaaaaacctggaagacaaaataggtaataccattcagaacatagatacggacaaggatttcatgattgaagacaccaaaagcaattgcaacaaaagcaaaaattgacaaattggatctaattaaactaaagagcttctgcacagcagaagaaactatcaacagagtaaacagataatctatggaatgaaaatatttgaaaactatgcatctgactaaggcctaatatctagaatctataaggggcttaaatcaacaagcaaaacacaaacaatcccgttaaaaaataggcaaagaacattagcagacacttctcaaaagaagacatacatccacccaacaagcatatgaaaaaaagcccaacatcactgattattagagaaatgcaaattaaaaccacaatgagataccatctcacaccagccaaaatggttattattaaaaagtcaaaaaataacagatgctggcaagtttgtggcaaaaaaggaacacttatacactattggtgggaatgtaaattagttcaaccattgtatgtgacagtgtgacacttcctcaaagacctaaaacagaaataccattagacccagcaatcccattactgggtatatacctgaaggaatagaaatcattctgttataaagacacacgcacatgtatgttcatttcatcactattcacaatagcaaagacatggaatcaacctaaatgctgacgaatgatagactggataaagaaaatgtggtacatatgccatggaatactatgcagccataaaaaacaagatcatttcctttgcaggggcatggatgcagctgaaggccattatccttagcaaactaatgcaagaacagaaaaccaaatattgcatgttttcacttatgattgggagctaaattatgagaacacatggacacatagaggggaacaagacacattggggcctatcagagggtggaggttgaaaggagggagaggatcaggaaaaataaataatgggtactaggtttaatacctgagtgatgaaataatctgtatagcaaaccctgtattacttcattgacagaacccccatgacagaagtttatctatgtaacaaacctgcacatgtacccctgaacttaaaagttaaaaaaaaaaaaaaaaaagaacattttgattccttcttttatggtctttatccaagggttcatacaaaaatgggaaggtaggcctatttatttgtaagttttcaaaactgaattgagctgagttgcctgaggagggggggcagacactcaatcaacaaacacattcttttttttaattattatactttaagttttagggtacatgtgtacaacgtgcaggtttgttacatatgtatacatgtgccatgttggtgtgctgcacccattaactcgtcatttagcgttaggtatctctcctaatgctatctcccccccccaccccacaacagtccccggtgtgtgatgttccccttcctgtgtccatgtgttctcattgttcaattcccacctatgagtgagaacatgtggtgtttggttttttgtcattgcgatagtttgctgcgaatgatggtttccagcttcatccatgtccctacaaaggacgtgaactcatcattgttatggctgcatagtattccatggtgtatatgtgccacattttcttaatccagtctatcattgttggacatttgggttggttccaagtctttgttattgtgaatagtgccacaataaacatatgtgtgcatgtgtctttatagcagcatgatttataatcctttgggtatatacccaataatgggatggctgggtcaaatggaatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatagtatctcattgtggttttgatttacatttctctgatggccagtgatgatgagcatttttcttagtacctgatatggtttggctctgtgtccccacccatatgtcgacttgtcttccccatgtgtcaagggagggacctggtgggaagtgatgggatcatgaggatggatttccccccatgttgttctcatgatagtgagggagttctcacaagatctgctggttttaaaagtggcagtttcccctgtgtactctctctctcctgcagccatgtaagacgtggcttgtttccccttcaccttccaccgtgattgtaagtttcctgaggcctctccagccatgtggaactgtgagtcaattaaacctcttttgtttataaattatgcaatctcaggtagttctttatagcagtgtgaaaacggactaatacagtacccatggtatatgcagcctcaatttttgaaaaatgatttactgcaggattcttttaagttaagagtcagcaaacatttttctgttaagggccagatagtacatatcttcagttttgtaggccatacagtctctgtgacaactatttaacttccattactgtgtgaaagtagccgttgacaataagtaaacgaataagcttagctatgttccaaacaaagtttgtttacaaaaacacatagtgggttgtagtttctgactcctgctttaaatagagagactcccttgtgaataagaaagtttaaagatacctgtttaccaaaaggtgagcaagagcagagaaattttaaaactaagtcagtgacagttcattagaaacaaagacaaaactactgtgaaataagccaatgtgaaaatagtttatcatttgtcacaagtgatttacattttgtatctaattatatgtgaacctgtaagttaagatgctcttgatcacaaggaatagaaaaaaattcaaactggcttatgcatataaatgtattggttcatgctatacaaaagttctgaaatagtctttatgtagtttcatcagagcctcaacatatttctctttcattatcttgactctgcctttttgctagcatcagctttgtcccctggctggccaacattaattggggctacttgctttcatagtcacatattggagaaagaatggatatctcttttttagccattgaacaaaagcactgtgctttctctgttttatgtgcccttaaaccaattaatgtagcaagggaatagcattactctgattgtctcataccaatctgggtattgggtgcattgctggagctagggttgaggtcaaacctatccagctgaaagactgaatgaatgtttaaaagcaactccattaccttccacaatgaccgcttcaccctgttgcaacttgtagcttcaccgtttcatcctgttgcaatttgttgtagcatatatgtgcagagaggtgggaaggccataggagaatttttattattagcaagaacctcaacccagagatctttgaatgtggataccatgttgtagcttttgctgaaagccatgtagacaccgcataatgtccctgatttgcctcagggaagatcagatttcttgctgggagtgatggtggtcacaaaggtcattggatatttctgtgtgctttctgcagatagtcatactggatataattaaggtatacaagaactgtggagaataaatatgttgttaggggaatgaacagctaatggtaagctgatatccagagtatcctgtactacatcaaaagatctcaatctgagtccattctaacagtattctatttctacattccattatgctatgcttatttttggttgccatatcttaaaacaatgcatcagagttgaagaatgtccagataaaattaccataggcatatctgtcacaaaatccagaatcagaagcaaatcgacattgttgggttttattagtgtcagtgatacaatggcatcgcaaattttccaatgtaattcagagagatccaagatgaacaaaaatattggggcttttcagtctggacaaataaatactgaaggaatatcattaaaacctataaaataagaaattaaacataaggtatacataaacatatttattaaattctaatatattaggacagatggacacatattttagctcaaaacaattttaaggcaaatgaaaagacatgcaccttcataaaatgagaaatcaggtcgtagaaataataagcacctccagcaattgctactagctgggcacatacccttgaaaaacaagttcatggtagttaaagactgatctgtctgtatcaaatgatgaagggcaatgaagatgttttgtagacatcctggaactttgagtttagcagcagtgagaacagctttgctgtaccttgaactatacccctttatggttcatgtagcaggactggtattttcttcttctaaatatctactttctttgcttgctgtacctgtttgtacctaaccttcaagctgttccattttaaaacactgtcagtccaactgcctgatgaactgagaagagcttaaaatggacaaagggcatgaacaggcactactcaaaagaagacattcatgtggccagcatatgaaaaaagtctcaacataactgatcattagagaagagcaaatcaaaaccacgatgagataccatctcataccagtcaggatggcaattattaaaaagtcaagaaacaacagatgctggtgaggttgcagagaaataggaacgcttttacactgttagtgggaatgtaagttagcttaaccactgtgggagacagtgtggcaattcctcaaagatctagaaccaggaatactatttgactgagcaatcccattactggacatatacccaaaggaatataaatcattctattacaaagatacatgcatgcgtatgttcattgcagcactattcacaatagcaaagacatggaatcagcccagatgcccatcaatgatagactggatgaagaaggcatggtgcatatacaccatggagtgctatgcagctataggagggagtgagatcatgttctttgcagggacacagatggagctggaagccattatccttagcaaaccaactcagaaacagaaaaccagacaccacatgttctcacttataagtgggaactgaagaatgagaacacatggacacagggaggggaacaacacacattggggcctcttggcagggcagagggagagagagcatcaggataaataaccaagggatgcggggtttaatacctaggtgatgagttaataggtacagcaaaccaccatgacatacgtttactgatgtaacaaacctgcacgtcctgcacatgaaacccagaacttaaaataaaaatttaaaaaaatgcatacaaatataattgaatagaatacctatacaaagatataaacatagaactgtgtaatttaacaaatacctttctttaagactcaaaaactcattctcaatatattattgaccataataatgctgcaattgtcaaagtctggattttcacacagataggtttgaaattcagccatgtattttgataagcgctattgtataggaattggagtgtactttcattcctgcttgcccttttgttctttctggacaatatccaaagcacagtatcttgctctaatagctattcttgactggatttctggcaacggcatttccttgcattgctcataggtgccttgtttagtgccctgcccatttttagtcctatctacttctaatcgtggtaaaagagggtgattgttcatagcagaggtaataaaacactatctgtaaagaggcaaatagtaaatacttcagggtcataggccatacagtctctattgcaattactcaactctgccattgtagcatgaaagcagccatgaatgatatataaatgaatgagctagctgtgtatcaataaaattttatttataaacaaaaatttgaattttatattattttcatttgtcatgaaatattctttaaaaaatttctaggtcattaaaaaatgtcaaaaatgtttttagctcatgggtcatatatagaaacatgggatgggctggatttggccagtaggagtagtttgtggaacacctagtttacagtgaggatattgagagggagacagggtctatgttttggctttgcttcaattcctttacttgtagtgctcttatattgtggaagtcagctttattttgtgttagctgtttcctcacttaaggtgataactctgtccatgtgttcaaaatgttaagtgagcctcaacttgaaagaactagaggaggtggtttctactttgtctctcatattgcttttccatagtatatgtttggaaactctgtaagaaagcagatcaaatattttctccatgcattgttttacagtaaaagcctgcatgtagcaccatgtgatgtacgagttgtctgcaaagattaaatcctaagtggacatacacaggacatgcatggaaaccagcagaatctgacgaatggatggtatagcaaggagcatatatgataatataatgcagagcatgcattctaatgaaatatattgttgccagtagcattattttgattacaaaaatataattaagtttaattgtaatggtaataataatgaaggagaaggtaagaaatagggaagccttcaagaacatagattccttctttgccatgctatggtaggatggtcatccccttatcagattgctattcacccagtatgaactggtgtaggcatttcagttatttgcagctgacatccattttgacagagccagtctccattgtgtttgaattggtacccatgatctattttgaaaatttaaatgtgtgttaatcaaaactgctagattgagtcttgcaatggagcataagaacaaagttgaagggtgaagtatcaccactgattgtagaaaatatttttaaaatgattaatttccaaaactgtggatgataaaatataaatatggtcagttttcagaaatattgcagatacatgtaacgtcctgttactaacccttggaaattctgataaaatgtaacacctcaggatgacacaaaaaattccaacttgccagaaaaaaagactgtaactgccaggggtggggtgcagtacagtcagactgtgtaaattaggaatgtgggttttcatgaccatgtaacaaaggaggtgaggtctcaggtgtttgtaaagtgaggttttggaattacagatccctaaggagagctggtacccttgaatttctaacctttaataaaagggtgaacaacaacaaaaaaatcctacccacagagaaatgacaaggaatttggctctttgcctgagatttggatggaaaaaaaaatctcctacagagatttgtaactataggcttacaattcgtttgtgtttggagtttcattttctatgatccccaaacttagaaggtagcaaaaaattggttctgagctagtgtctcccctgagtttcctggcagaagcagtcaaaagagcttttgaggaacatacagtacaggctacaaggtattgttgcagaaaaagtaaccctttataagacaaattcacaataaaatgttaccaacatgtgactaaacagttcaccctgatgaaagtcagtagacacaacaaacaatagaattatatccctaagaattagacatagcagaatagagatacaggagataattgaaaattaatgttcatcatagtgactgaaaagaagtcaaaatcctaagaattgaacaacaggctttgagaacaaaagatttacaacagaagaaaataaaagttttagaaaggaaaagtatgatttgatttgtgggctaattattggataatatggagctacagagattagtaaactgataaatagtctgaggcagtcactcacaatgcgacagagggatgaagggatggcaaaatatgagaggttaagagacacgcaaatgaaaagattcaacatatatctaaaaggggtgctaggatagcattaggagatatacctaatgttaaatgatgagttaatgggtgcagcacaccaacatggcacatgtatacatatgtaacaaacatgcacattgtgcacatgtaccctaaaacttaaagtataataaaaaaattagcatggtggaggagcaatattcaaagagataatggctaataattcttcaacactgatagaaaacccaatgcagatttaagaaactcagcaaacatcaagcatattacgtaaacaaaaggaatccacatgtgtaatgaaactggagagccccaaagaaaaatggataatgttaaaaaccaccaaaaaggcagatcatctataaaggagcagcaaatagagcaactatagacttcacaacaaaaataattgaggccattcttgttcatatggcaatgcaattttcccaacaccatttattgaatagggtgtctttttcccactgtatgtttttgttgactttgttgaagaccagttggctgtaagtatgtggcttcatttctgggttctctagtctattccattgatctatgtgtctattttttaaattatacttaaagttctgggatacatgtacagaatgtgcaggtttgctacataggtatacacgtgccatggtggtttgctgcacccatcaactcgtcaactacattaggtatttctcctaatgctatccctcccctagctccccaaccccgacaggccctggtgtgtgatgtttctctccctatgtccatgtgttctcattgttcagctaccacttatgagtgagaacatgtggtgtttggttttctgttcttgtgttagcttgctgggaatgatggtttccagctttatccatgtgcatgcaaaggacatgaactcatcctttttatggctgcatagtattccatggtgtatatgtgccacatttcctttatccagtctatcattgatggacagttgggtaggtttcaagtttttgctattgtgaatagtgccacaataaccatacgtgtacatgtgtctttatagttgaacgttttataatcctttgggtatatactcagtagtgggattgctgggccaaatggtatttctggttctagatccttgaggaatcaccacactgtcttccacaactggtgaactaatttacactcccaccaacagtgtaaaagcattcctatttctccacatcctctccaacatttgttgtttcctgactttttaaagattgccattctaactggtgtgagatggtatctcattgtggttttgatttgcatttctctaatgaccagtgatgatgagctatttttcatatgtttgttggctgcataaatgtcttctttttggaagtgtctgttcatatcctttgcccactttttgatggggttgtatgtttttttcttgtaaatgtatttaagttacttgtagattctggatattagccctttgtcaggtggatagatttcaaaaattttctcctattctctaggttgcctgttcactctgatgatagtttcttttgatgtgaagaagctctttagtttaattagattccatttgtcaattttgggttttgttgccattgcctttggtgttttaatcgtgaagtctttgtccatgcctatgtcctgaatggtattgcctaggttttcttctagggtttctatggttttaggtcttaggtttaagtctttaatccatcttgagtgaatttttgtaaaaggtgtcaggaagggatctggtttcagttttttacatatggctagccagttttcccaacaccatttataaaataaggaatcctttcccccatttcttgtttttgtcaggtttgtcaaagatcagagggtatgtggcaccatttctgaggcctctgttctgttccattggtctatatatctgttttggtaccagtaacatgctgttttggttactgtagccttgtagtatagattgaagtcaggtagcgtgatgcctctagctttgttctttttgcttaggattgtcttggctatatgggctcttttttagttccatgtgaaatttaaagtaattttttttctaattctgtgaagaaagtcagtgttagcttgatggggatagcattgaatctataaattactttgggcagtatggccattttcacaatattgattcttcctatccatgggcatggaatgtttttccatttgtaagtgtcctctcttatttccttgagttgtggtttttagttatccttaaagaggttcttcacatctcttgtaagttgtattcctaggtactttattctctctgtagcaattgtgaatgggagtttgctcatgatttggctctctgtttgtctattattggtgtataggaatgcttatgatttttgcacattgattttgtatcctgagactttgctgaagttgcttatcagcttaaggagatttttataccattaccatgctgttttggctgcgatagcctcatagtataatttgaagtcaagtaatgtgatgtttctacccttgttgtttttgctcaggactgttttggctattagggctcttttttgtctttatatggattttctatctctcatcatatacagaaaccaactcaaaatggattaaaaacttaaatgtaagacctgaaaattaaaaaaaaaaatcctagaataaaacctaggaaaaactcttctggacattggctttggcaaaaataattcatgactaagacctcaaaagtaaacccaataaaaataaaaatagacaaatgagatgtaattaaattaaaacgtttctgcacagaacaagaaataatcacagaatgaacagataacttgcaaaatgggagaaagcatctgacaaaggactaatatcaagcatttacaaggaactcaaatgtctcaataacaacaacaaaaacagccccattaaaaagtgggcaaaggatgtgaacagacattttaaaaacattcaaatggccaacaagcatatgaaaaaaataatcatcatcactaataatcagaaaatgccaattaaaactacaatgagataccattttatactagtcaaaatggatattattaaaaagtaaaaaataacggatcctggaaagattgcggagaacagggaatgcttatacaccactggtgagaatgtaaattaatacaacctttatggaaaacggtatgtagatttctttaagaactaaaaattgaactgccatttgatccagcaatcccactactaggtatctacccaaaggaaaataaatcatttgtataaaaagatgtttgtactcatatgttgattgcagtactattcacaacagcaaagatatgaaatcaacctaagtgtccatcaatggatgattggataaagaaaatttggtacatatgcaccatggaatactattcagccataaaaataaatcattttgcagcagaatgaattttgtttttggattttttttttttgcagcaacatggatggaacaggaggccattatcttaagtgaaataactcagaaagtaaaatactgcatgttctcacttataagtgtgagctaaataatgtgtatacatgggcatagcaagtggaataatagatattggagacttagaagggtgggaaggtagtgagggatgagaaattacttaatgggtagaatgttcactctttgggtgatggctacattaacagccctgacttcaccactacatagtatatccatgtaacaaaattgcacttgtagcccctaaatctataaaaataaagaaaaagaaaaagaatgagaccaaaagagaaaggaatattatcttcaagagctgaggaaaataacaatctagaacttctgtactgaatatcataaaagagtgtgagcaaaataaatgtaaatgtcactgaacactgaaataatttactactcatagacacttggtgaaagaactactaaaaatatatgtgctagtagaaagaaaattgaatccagaaagaagccagatgcatgaagcaatggtgaacagtgaaattggtaaatagaggtatatctaaataagaggtacatctaaataatgttgatgaaccacttacaggttacaagtatgatatggtttgaattatgtcccctcaaattcatatgtggaagtcctaagccccagtacctgtgtatttgaccttacatttggaaatatgtttgttgcagacataatgagttaagatgaggtaatctcatcttggatagggtgcgcacctaatacaacatgactgacgtccttataaaaaggggaactttggacacagagacattcacacatggaggatgtcatgtgaagattggagataagctgccacatacctgcaacaggaacaattagatgctaggggcagggcctagatatagatcttttcctaaagtctgcagagagagcacgggcctgttttcttaatcttagacttctagccttcagaactgtgagacaatacatttctgttgtttaagccactcagtttgtggtacattgttacagcagccctagcaaactaatataaaatacaaaatggatcaagacacttgaaaactgtaataggtaagtataatcagaattacattttctctaaggctcttgtattatagtctaggaggaggagtagagatgttgatcacctttagactttaagtcaagtatgcatgttaaaaatttaggagtaatcaacaaaattatttaaatagaatctgtatatccaaatcagtagaagaggacagaaggaaattgtaaaaacttcactcaatatgaagcaggaaggagaaaaaaagaagaaaataaaaagagtgataagtaagacatacaatggtagaaataaattcaagtataaaattaagttcaaaatgtaaaacaattaaattcatatgccaaaggtatagaagctcatatcaaaaattttttaacaaaattataaagctttagaaggctagtagggcttgatcatcgtcccaactattggttggagggttgttgagatttcacatgaatagttggaattttaacatgggagcaatattctaaccaaggggtgagcaaatgatagcccacagcccaaatagggcctgctgccttttttttttttttttttttttttgtacagcctgcaagctaagaatggattttacatatttttaactttgtattttagtttcatgggtacatatacaggtttgttatataggtaaagtcatgtcatgagggcatgttgtacagattattttgtcactcagctgctaagcatagtacccaatagtttttttttttatcttatccctcctcacactctgcaccttcaagtagaccccagtgtatgtttttccccaccatgtgtccatgtgttctcatcatttagctcccacttacaagtgagaacatgtggtatttggttttctgttcctgtgctagtttgctaaggataatggcctccagctccatcatgttcctgcaaaggacatggtctcgttcttttttatggttgcatagtatttcacggtgttcatattaaatttttaagattaactgtatgctcttgaccagggagaaatgtaaaacaacacagaataattgaaaataaatgaataaaagagatggatgagaaatatcaaccgaaagaaagccagcattacaatgatgatataaggaaaaaatatttaaagcaaaaagccttattagggacatggaaggtcactacttaatgataaaagacaaaactcactatgaagatatatattttaaacaagttagtctcaaatatataaagcaatatttgaaagaaatactaggaaacgttgaaatattcacactcatatttgaagactttttaaaaattaaactgaagtaatttattaaaataattttattatactttaagttttagggtacatgtgcacaatgtgcaggttagttacatatgtatacatgtgccatgctggtgtgctgcacccattaactcgtcatttagcattaggtgtatctcctaatgctatccctcccctcccccccaccccagaacagtccccagagtgtgatgttccccttcctgtgtccatgtgttctcattgttcaattcccatctatgagtgagaacatgtggtgtttggttttttgtccttgtgatagtttactgagaatgacgatttccaatttcatccatgtccctacaaaggacatgaactcatcattttttatggctgcatagtattccatggtgtatatgtgccacattttcttaatccagtctatcatcgttggacatttgggttggttccaagtctttgctattgtgaatagtgtcgcaataaacatacgtgtgcatgtgtctttatagcagcatgatttatagtcctttgggtatatacccagtaatgggatggctgggtcaaatggaatttctagttctagatccctgaggaatcgccacactgacttccacaatggttgaactagtttacagtcccaccaacagtgtaaaagtgttcctatttctccacatcctctccagcacctgttttttcctgactttttaatgatcaccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccaatttttgatggggttgttttttcttgtaaatttgtttgagttcattgtagattctagatattagccctttgtcagatgagtaggttgcgaaaattttctcccattttgtaggttgtctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaacagactttttttttgggatggagtctcactcctgtcatgcaggctggaatgcagtggcgcagtctctactcactgcagcctccacctcccaggttcaagtgattctcctttctcagcctcctgagtagatgggattacaggtgggcacaaccatgcccagctaatttttgtatttttagtagagacaggttttcaccatgttagccagtttggtctcgaactcctgacctcagtttatccacctgcctcggcctcccaaagtgctaggattaaaggtgtgggcctttaaaggcgcctggcctgtttgaagattttaacataactttcagtaatcaatatgcaaggagaaaaaaatcagtgcttatgttaaacagacttgatttaatggacataaatagaactctgggcccaataattacagaaaatattagagtaaaaataattaaagaaataattagagaaaatactttttcttttgagttacatgtgaaatatttctaaaaattgactgtgtactaggtgacaaatctcaaaaataccccaaagcctctataaacacctctttctctgaccacactgcaaagaaggtatgcatcagtttaaaaatagcaaaaagtccttgttaattttgaaattaaaaatactttgatgtaattcattggttaagaaaattttatgtgggaaattagaaaatatttagaattgaataatgatgacacagcatagcaaaacttgtgggatgctgccaatgtcagagttgaattttcagtgtagaatgtgtaagagaaggagaactaacagaagctgtgtccactttaagtagttagaaaaggaacaagatagttgattaaaaaagggaaggaaatagaagtagaaatgaatgaaatagaaaacaaagaaatgatagagaatcaacaaaaccagcatttggtctttgaaattattagtagacaagcataccaaaataaacttattgtaacactgattttacaaaaagacttgacaagtcatcagtattaagaatgaaaagggagatgctactgtagatacagtcaaatttaaaaacacagtaacaatatcttgaaaaactttgtacaataaataaatcatagaattgaacaaatggatactgtcatgcaaaaataaaatatattaaaagtgcctcaaggaagaataattaacctggataaatctagtacctacattaaagaaattgtatcaatagtcaaaaatctacatacaaaaaaatcaccaggcctagaggatttcacaaattagtttatcaaattttcaaagaacagataatctccattttatataacttcttcagagaattaaaaaagagggaaaattcccctgaactaattttcagagtctaatataatctttttacccaaacaagatagatacactttgagaaaaataaattacagattacctcacatacatggcagctaaatgtcataaatacaatatcagcaggttaaatccattaataagttttattaatgaaatactgcctcatgctgatctgaatttataccaaaaatatttaagaatggtttaactttttaaaaaattatttaatgtctttgataaccttaaagaaaaaagtaatataaccacctcaacagattaaaaaagcacttaatataattcaatataatttgattttaaaaactcctagcaaactcctagaaaactatacaaaaaacttttaaaattagataaatgttattgaccaaaaaccatttgagacaaagtaatcttgcctgctatcactacctctaagcaacaggaaataagaatagaaaaatgaaagttatgcgtattggaaagtaaacaacccaaaacttattgtgaaagaatgattgtcttgatataaatttaaaaataatattcaggaccgggcgcagtggcacacacctgtaatcccagcactttgcgaggccgaggtgggcggattgcctgaggttaggagttctagaccagcctggccaacatggtgaaaccccatctctactaaaaatatatgaaaacaacaacagcagcaacaacaaaaacaaaaaaccggggtagtggcatgcacctgtaatcccagctactcaggaggctgaggcaggggagttgcttaaactggtgaggtggaggttgcagtgagcagagatcataccactgcattccagcctgagtgacagcgagactctgtctcaaaataataataataataataataataatagtaataataataatcatgcaaactgttaaaactaaaaagagttcagcaacatttcttgataaaaaatagaaaatacaatactataaaacttctagaaaaacacataggaattcattttcatgacctaggattaagaaaagagttcatcataaaaattataaacttcttttctgggaaggacactgtgaagaggatgaaaaggcaagccacagactgggagaaatattggcaaatcacatatctaataaaggacttgaatccaaaatatataaagaattctcaaaactcaggaataaggaaaacaacagcctaatttaaaaatgggtaaaagatttaaacaaccacttcaccaaagtagacttatagttggcaaataaataaagtacatgaaaagatgctcaacattattagccaatagggaaatacaaattaaagccatgatgggatgtcactacatgcctatcaaaatggcaaaaataataattttaagaatacaattatcagtgctaggcagaatgcagagtagctgaaatttgcatacattttcagtaggaatgtaaaatggtacagctactctggaaaaacagtttggcagtttcttataaaactaaacatactacttccgtacaactgagcaattgcgcttttgggcatttatccaaaagaaatgaaaacttgtacacacaaacctgcatatgaatgtgtatagaagctttgtttctaataacccccaattggaaacaactcaaatttgcatcaacagatgaatggataaaacatattgtggtgtatctacatagtgggacactattcagcaataaaaaatgaacttttgattcatccatcaacttggatgaatcataaagacagtatgctaaatgaaagaagccagtctcaaaaggctgcatattgtatcattttgtttatatgacattctgaagaagataaaactacagtgacagagtggttgctagggtttaggagtagagggagagtgtgactacaaagggatggcatgaggtagtgttttggggtgatggaactgttctgtatcctgattctggtattggttacataaatctatacatatattaaaattcatagaactatataacaaaaagtcaattttactgtatattaatttaaaataaaatttaaaaatttaaaaattacttcataaaaaggaggatatgtacagtatcagaaggttgatcatacatcctagtgggcctcaaacaggcccactttatgcttttatcctggtgtaattattaatagtgtcaattgtagaattctgtttgaatggtaaattatatgcttatcctaaatatgaaactgtattcttactgtaaatatgaaaccattcattttaattttaaagtatacaagacaaaattaagaatgtattgcttttgattaccatttatatgtagtagcatggaaattgcatggaagagaaataaaatctttaggaagaaagggataacaaaagaatgggggcttcagctgacataaatatgacaaaattagaaataaaaaattcaaaaataaatataaggtggctctcaatggaaattccagaaaataagaaaatggtattttgattaacagcttatgtttatgttagaaccttgatcagttcttgaagcaaataggtgataaaaatggtggtcctcttggtttgctgaaaagtgaaatgatatgtgctgatgtcacatatcctctgactgttcctgatgaacctacctcattgtctgatgtccatgaatggcagttgctatagaagtctgtgcatggcagttatatgaacaataaccattgtgacaaagggaaccactattaccctaatggaaagagagaaattagagacacagtagccacacaaaactaaaatatattaaatattagtgttgtctacttctttaatggggaaaaagagcatatcattagtgtcaagcgcatcccacagtaggctctctttagaagaataactcagtgcaataatgtgaattgctttgtctttgattttgaacatgattaaattggcaggcagtgggtgggagtatgttgttcaggatagaagtttgcataactggtaactgtagcatttttctcagacactatcattgtgtcaaactatgatgcacaatgatacacaatgctgtgatacacaagctgtgatacacgatgttagttatcattgtgtcaagatctcatccttaacatctgcagtgatttgtgctctctgcactaagtcaaaccttcttagcctggcatctaaaaccctccatattatggcccaccctatctatctaagctctcataccaatgtttcccatcacacaccatttactgtagtcatctgtctccttcattattctagaagcacactgagttctttctcccctcctcacatgttgttttccttaagtggaatgccctaacttctcttccacactaatctaaaccctgcaacactcaatccaaacctctctggtccatgaagcctttcttggctagatcaaccttcactgatctcctttgaactatgacacttactattatgaatacagatttatagtaatgacattttccattgtttgttgttgtttcaaatgtattactattctcttcctcagaagattatataggctattggcaaggcagtgctcatatctcataagtctttttgactccttgtagcgcatgatagatgctcaataaacatttctgactgacttgaatgcccattccaaattatgtttcactgttttaaacatcacaaactgatcacttttattgtcagctactcccagaacttcttttctctcctgtgattttcactctttagttaatcattgagtgttttagagatataagaccaaaacagtatatccaccatgaagtcattttacagttctatgcttctatctgcatttcctggtgctgctttctatcttataagaacacaacactaccaaaagcaaacatgacttcttaaagcaattttaaaaagtagcctcttgtcctccaagggagcttaacctctgctgaagaacaagaaattaacttcagattctgaccaaatttttgacaagagcctaaagttccttggaggaatggtataataatcatgcttgtggttgtagtgattgcaatgttagcaatcctggcctgaaaatatttttactgtaggcatagaacatgaacttttcagtaagccaaaaatagtgaatggtgatcattgatggaggtgaggataaaaggttagaaccagaattaaagtctcagctgaactcagagatacatgcaaaagttggatcagtacagctaggcagtcaagatctaagcaatggtacaggcatagcagagatcataaaagttctcaaaagaacaagaattctttaagttgaatcaacgtcatccagaaccattttatttacttcccatttgggcatgagcccatctcagttcaagtcagctcaaggccatggaaaactaaagtatgtgtcttaatctgctttgattgggaagtgtggaaccacaggaaaaaaaaatcacacttgcattccagcaaaagagcattctaacaacaataagaacagaatggtacaagcaatatgtatgtacaggatttacttgaggtgtgccacaatatattgtaaattggaatgcagaactgctttgtagacgactcaatgactattgattttgatactgctgaaataagaagttattcatgcgtataggttctgtctgatacaattcacagcccaattgattagcctccaataaatctgaaaaaaaggaggatggcaagctctgctttaaataatgaagaatcattacagcttattaagatattctggcatgaggactgaatctgtcttagcatttcttccagcatagaaagtaggcaatttgagaactagaatcatggtagaagggatgaatagatgacagttactgcccatgttgctctgctggtaatgcctggcaaggtaaacattcaagacctgtcagtgacttggcctttcagtcagtgagatgactatcaactctcactagtaaaggtgagaagtattttattattcatagacaccaagcagagcctatgtgttcatgaatcttttggctttgctctttttcttgttcttcttccagcctcatttttgctcttctacagctatcattgctcatgctattcttcctttccactctaaatactctctcactgcctgcctaacaattcaaattttactcatccttcaaggctcagcacaagtctgactgtcacataaagcactatttggtaattcccgtggactagttatgcttgttctgatcttctagttttcttttgcagtaaaatatcagtcagcattcagtcattgtaattttgtttctttcattcaaattgaagttgaatattgaaactcacacatatatttatctaatgcttccacagtgcctggcaccaccatagctacacagctataccatattcacacaccacatttgtttcagaatagggtcattgtagaatttattgtccaaaccaggatacttttgagtgtaaaagaggatgcccattaataattatcctggacttcctttgaaatgcttctaaaaataggataagctaatagatgggtagagagaggattaatgaacagatgtgtgataaagtgcagtaatatgctaatggcagattttaggtggtggtcgctgtaaaatcattttcaccatttgtgtatttttgaaagatttcatgagaaaatattgaaaaaatataattatgctgagacaacacaggtaaactgaaatgttatggtcaacccttgctcagagctgctgttattgacctcagagagaaaagtatgagtaggtagacagaggaaaaggagtgaatagaaagcagtgtagctaagtgggtgggtatagtataaactaacacatgaatttaacacctagaattaggtatctggctttaacatcaagacagttccaggccagatgtggtggctgatgcctgtaatcccagtgctttgggaggctgaggtgggaggattgcttgaggccaggagttcaagaccagcctggtcaacgtggtgagaccctacctctacaaaaaattaaaaaattagccagatgtggtggcacatgcctgtagtcctagctacttaggaggctgagaacagaggaccgcttcagccctggagtttgaggctgcagcgagctattattgcaccactgcattccatcctgggtgacagagcaagaccctgtctcttaaaacaaacaagaaagagtgacagttccatttgtctgataccgagaatgatgtagtttggttgataaggagcttttggccattctatttcaaatgggttctaagagggagcaatgatataaccaagggaggagaaccagtgagtaggagtcattatatgaacctccaacctggcacttatgtagcaccagacctctgtgaagcatgtctttgggaagcagaccttttggtttgttgatttcagtagcagtagttggcatatcaggtggtaagcctagaaacattcattgaaaagccccaagaaatgttggttctcttatttgttagtttgctttgcatggcagatgtgtttctgaaaggaaaatgtggattttatttatttttaaaaaaacaggctgtattttcctaaggtctaacccagtggttctcaaacttggcttcacattgtaatcatctagatcgttttatgacatactggtacctggggccacccccattggttttgatttataataactgcgtaaggagtgtggtctgggcatcaggatttaaaaaatctccccaagtgattctaaagtttgagaaccactgatttcactcttaaagatgctgacatatcttctatttgaaggagctcttgaccatatggattgctccccagtgaggctgaaactgttatggagagaacagggttgagtccctctttgtaggagagaaaggcaagtaagaaagaatcgtgtgaagttttgctctgtggatcaaaatttaaactacagcactacttctaccaattttcatgtcttttgtcttacctcctgcaatccatagtcatatatttaataatcattttatcatgatactatacccctaatttttccatcttgtatatttggatatttatttattggattttctcagattgaggtccacctgttgttttagagcattatatatctaattaggtcatgtaatgcaaaacacctgtcacctgactactgtcatgactaatggtgaaacactgctagatggggatggtgaggaacattgtactatcctgtttcacctgtttgatggaggtgtcttaggaagtgggtaaaagtagtattttactagaaactatcagcaggaagtagatagtaaacagtctattttaggcacctacatttttttcctccctcgatcaataagaccagtcactacttacattatctgttgcctatctgtaattgcttgcaacagtgacatgaacatcctttttgcagagttctagtacatggtttcaggtcatcagaacttgagtggtttggtcacttgtcaggtaggaatgtcattgggtagacaatgtatttgatttgctggtgaggacactgattttaaaagtcattgcttatttaacataaaatatcaactggagttgcattatgattttaatctttttgggatatcaattattagaacacaaaattgttgtctgttatattagtgtccattttacattatttttaatatgcccagaaaactgttagatttatctcctctatgtacgttttcaaagtaataacctgagctttaatggaattgggattcatatttgagaaaatgaagtctgtgatattatgaaaacccatttattctatctacctttcctttttgtttttcttttctttttttcatagcttagtttataattattgctctaaacctagtccgttatttatcggggaaactcaactctacgtttgattggccttggctttattcaatctaactataataatttgattttttttatataaaatattcaatcatgctttaccatatgatgaacttcatttatacataaaagctacttgctgttctacctttggaaattgttaaagaatctcagtaagggttttctagccatctgcttccctttgaaaccttgtgttaatgtagatatctacagtggtgactctagggttattaaactgcagtgtccagttaaatgccgttgttcataattatctagaactccagtctacattaagaaatcacttctattgttttgatatcaatgtgtcttaaagtggactttctagttttactgcatggaggcatatacctatctcacatgcatctgtctttccagtggggtacctctctttaagagagccattgtaataagattcatacttaccaaacataatagttgtggtgcaactaatcacattattaaagtcgtcttcactttgttagaaataattctccatgatagttctttaaattggagtttctctagtacatttaagcatctgtttataaatctgtaattgacagaaaataaaggaggtgagaaaaataagcccaagtgctataaactactgccaaccggtccagaaattgaaataaataatctctaatactgtaatataaatcaatggggaaatgatgcaatttacaaaaactcaatttagacttgaattttgtaaaacacattttttgcccagggtgatgaatatttgtatttggattaatggtatcgtaaatttttttaaacaaaagactatgtcttttggttaacaatttaactattttatctaaaggaaaatgtgtagtgagatatgaagtgaacctattgtctctagcctccacattaatttgtaataacatctataaatttttgtttgtaatatttataaacatttcacattttgatggtaataaacttaaaaacatgtcaaccagagagcaaagaagcaaaatcaagaagaagtttgttgttgttgttgtttcagcactgaggatcagtgaaatgacttaacatccatgaaatgataagttattcagttatgaaagtaacctccaagtactgcagttagttaggagcatcaattttgacattcagtgcaagaaaaaagtcacttttctataatgaaataatattgcagtaaatagtgagattcctgtaaacctgtaattcatggcactttgcacagctatcttgatctactgagtgaatttgtaagaaacagtaagagataattttctcattttgtgcagagtgtttccattctttctatgactaaatacagatctctgaactaaattataagcacagagtaatattcagggtacatgaggagaaaaagcaatttagtgaccgttttgtcattaaaaactgaagcaaaactcccaagcctgaaaaccacaaaatctgtttattgccagcataatcttggcagtgatgagttatattcacgttattcaatgagacaaaagaagggtcaactactttttcaaaaacattttacttgctttataagcatttggaaggacttactcctgtttcctcagggctttcactgaccttatatgttggggtatattctgaaagtgagtaactttgggaagttttagcagcctaaaggaaagaaagggcaaggctgggacaatattttcactgcactaaaggttgagtgtgtttgtacacatacaactgaattatgtttctctggccaattgtaaatggctcaagggtgaggctctcagtctttgatttatttggaatttcacaataatacagggctagctcatagtaggcactcagtaaatgtttgtttaatgacactgagaaaatgtgtcacatggtgtctgtacagtgccaagtccatagaaagcactcacagttgatttttttaatagtaaatgaagtcattcagttcttggatattttggttgactgtacatattccaaaggcatggattcaggttaagtgctcaccacttcagaaggtgcagctgacattttaaccccaaattgttaatacttaactctttcttacccccaagggaagccctttgacccatggtgatagagcctttccagaaagaaggaaaaactccatttgatatggccacagaatctggcaggaggattcacttttagatttcaaagacaagtagagaatatggaagtaacatgagttgaatttcaaaacaaatcgtgacttcaggtttaatgcatttcaacaccaattctagtgtctcttctgaatacagctgacctgcttggcatcagtttatatacctgttattctgcttatatgttttgtagaaatatagactgacaaactactgccgacttagaattctgcttgagaccagctcaagaagttaagcagtagctggtatgcttcattagaggatttaattggccttaaaatgcaatgagttgtgtgtgtgtgtgtttactctctttactccgagtgcttcttttcaatgttcttaaatatacagtaatatatatttcaaagttattattgcacttatgttccctctttgaggccacttatttgcttcagaccttttttctgcctttttgattttggtttcaaactatttttttttttgcatttttattatccctctacaaaggtaattgaaattggtttggagagccttttaaagaccacttttttcaagctcagaatttacctccctgtgattgaaaaccacagtagagtaatggagggaaagtaaacaccttggcttatatagtaataattaccactgcaaaaatgtaaaaattattaattcaaaaaacttcaaatgctctctggtcacacagtgtaaaattttaggactgcaggagagttcctatggtcatttggtacttcctgagccttctggaaatttaatagcctctgagcttttctttagcctgaggtgcaaaaggatcctgctgcttgcttcattgggcttgaaaatagtgggcagaaaaaaatcttgtgcaaacacagtatgcatagtctttcatatacagattactttgcagacttcctttcagtagaaagtgttagataactttcagtggttggataacttacactgaatcaatggcaccgtcttgtttgctgtccctttagaccacatatttttaagatgggtgacaggttcagagatacaggctagactggagagctaagtgaagaaatccaagcctaagcaggaagcaagcagacagctttggtctcattaatgcctattttcaagcagaaaacaacctcacctaaccaaagggaaagtgcgtggttcctgggttagggggtgttctatattgataaccagaatgcaggatgctgaatgagtgaaagtgtttgctgtacacaaagggatgggtggctgggtggagatggtgtcaggaggtaggaaagggtcagacactggtaaatatggatggaaaaaatgtggactgaatgtattttgaacaaatttgatcattttggggggagaaaataataaggataaccgcacttcaggagggaagaatattatgaactgtggattttgaatgcatttaaatatttatgaaaatattttctttagactttttttcaatattctggatagcaaagaaatgttctcaaactttatttcatttatttttgcaaatttctgctggaaggatttggcaatacaggcagcactgtactaggcttctcaaaacatagtaggttaattctcctgtgtgactttcatcaagtaacttatctttttgtgttttcaaccatgaatgtacttattattcaggctagctgtgagattaaacagtatatgctatttattcatttgtttagtcacttattcactcaacaaatatttatagagaggctaacgtgtgccagacacttcatagcacaatttattaattcagtgaatgtttattaagcacctactctatactgttagagcagtgaatataaatatattatagaggtctctctttttcaaatttctcattctctctgtgtcttttaaaactttacttttgatttctttatctagattttattataattaatttaaaaatctccttgaaagtaggcaagttatcagttatatataaataaataagacaatatatgtggaatcaatttaaaaagtgtaaatcagtgtatatatgtggagtggtgttactattatttatagtcacttatcacccttgatggggcaatgataaacagctcatagagaagcatagaatgactagatccccaccccctcccatagaaagtggcatagcaatagctggatggatcagaaagaatgtgacaaatagaaaaaaaaaagtttttcttccctctagtctgtcattccattttaccaaagctggtgtactttgggatagtgtgattgttaagcctccctgtgggttgcaagtatgcttttaactgtgactattgatgctgctgctacagaccccctctgattttcctttacgtgctttatgctgtgaagaggttttttaaaaagaaagatccatctctagctctctcccctttaatagggtagatcagattggttttgtagggctgagttttcaccagtactatagttgtactggagtcacatgcctgcagggagcccctgctgaattgtaaatgtgccaatccccagagtgtagctcagtgtacctctgcaagcagtcagtagtttttcattaagcagtgatttgattagataaaaataaaagttgcttgagcattcatttttgcagcagtgcataacaaatttatgcaaattcctgtgtcagtaatctgcattcaaaatataaaagtgtgattaccaagccatgtgcacctgtattgaagtttaatcaggtacaaatattaatggaaagaataaagcgtttaacaaaagtcacagctgttcgaggtttgtaaaatattgcaatgagagcgttagtacattaatgataattttagcattttcagattaagcaaaattttattttaaaggaaatcccaaataaggcaattctttagtggcacttgggaaatgcagagaaataagattgggctaaatgactcagctgtttaatagtgaaggtgtgatcaaactgtttgaaatatatattagagaacaggtatttattaagaattttaatgtattctcaaggacaactagaatgattctaggaagtaaatggatattttacacctagcatggtgtctagcatgtaatagatgctcaatataaatgtttgtaaaactttttccttcattcatgctgattcattgcgtaaatcatttaagatattgtaaaaggagtaatgtatcgacttccaagtttgtaaatgaaaggctgtgttttatattttacaatggtaagaaaacaaaacaataatatttattgaatgctaggaactgtgccggacacattacatacattcttttagttcattctcttaacaacttatatagtaatagcttacttttagagatggaggaactgagcctgaaataaatcaaatccatggccacaaatcatagctagtctgactccaaggtcctggtttttcctctgtatcacagaatacatattatcccataattatctcagataatgcatggttacttctaggagagcactggtgtaacttttggctacttgtataaaattcatctgataacctaagaatctaaatcagaacgccacaaaacttaaagcatgaatttccaaatgtagcaaaaatactatggtgaaggattgacctctgcaaatgtgatttttaaaataatattaattttttctcatctttagaatagtgatctgagtgacactggacaagagagaggctaaattgtgattttctacgtctctgtctcttacaatttgtagttgtatgggatgagtcagaactttttttctgaatattgttctttaaaattgaacataatcccatcttcattcatagcaggactaaaaactaaaaggtataatttaatgcttcaagttttccatcctgttcgtttttgggaatgaaagccccattcctgtttattttcaggggaaggacagagtgagaaagggggtcatttctgggcttaagtcagatgtggctttcgtgccttgatagaaataattcattcaattggagaaaaagtgatagccccaggattaagttattctgtaggccatagtggttcacagaatttggaagacctatatcaatccttagctcagaaatacagttttccagtccttagatctaacattttatccaggcatgcaaagctcaaatgatctggcttcaatttaccccttcagggatatctctggttagtctttacaacaaactgacactagccagactagtgtacttatcctttactgaaactttccttcttttctcatgtcttttttctccttttctgtcatgttttccctctacttgtctccattcctcactccacccagatatgaatcttttctttcaaggtccaactcaaatctcatctgctccatggagactttcttgaaacttcagctcaaagcaatcttcctttatgtgtattcctgtaacattctctgtctgtttcattgcctatgccttttcccttcctccttccctcctcccttcccttgcttgctttcctctttccttcaacaattactgagacagtgtctgccaaccagaacatatttgcttctgggaatacaatggtgcctcaggaagatacaggccctactcttacggaggtcacacttaaatgaagcagacaaccactgatcaaagaaacaatcaattgcttcctggaagtaaaagaatatggttcgaggagagtggatgacaaaggggccatatagactaagaaaactgacttagggaagggggacaggaaatgcctcctgaggaagtaataattaagctgtggtctaaagtttgagtagtcgttaaccaggctatggggtagagcctgcaaagagcattggaggcatgggaatggcatatggaaaggccctgtggaaagaggatgagtgtacttacatgactctttttttgttgttcatgttctctctcctcaaacatactgtacaatgcttttggatgtgaacgatgtgttgtatttatttttaccaaattcttttgaaaggactttaattatcattgagtgcaaacttcagcaggccctgagaaaagttcagtggtttactgaaggtcacacacatagagacatgggtctcctgtacaccccctcctcatgcccagtgttctttcattgaaatgattctttataattttgtgtaaatttagccaacatacatctggaataagtctctgcatgtggaagatggttcatttacaattggtaactgtgcggtcatgtatagaatagaggagagcaggaaggtacagaatcaaaaggtgtttcattacatggaaagttttataggacaaagaggtacatgttagggaggaaatttacatttgtaaaggaccatgctaactaagctttggaatgcatagggtaaggattcaatctttgaagaaaatctgtgtgaaataagatatgaaaaacattatgatgattagaattcagagagccttggatttaatcctgttccaaatacatttcttgaaactgaaagaaaaaaatgataataatttggtagtgctatatttgtgtgacaattctaaaatttggcctacaattttttgacatttccaaccactgacaggtatgggcttatgtcccttccacttgaatctagttgaccaaatagaatacagtgaaagtgacactgccagtttctgaacctaggtttcaagaatatggaagcttccacttcttcttttaggaagcttgctcttacaccctagccaacatgctgtgaaaaagccaaacttcccatgggaaggcctatatggggaacaacaatggcctcttgcccacagccctgggtgggattccagaacctaattatattcaatgtgaatgaaccatcttcagagtagatcctataatctttagttgagccaccccagcttagaattcagagagcagagaaaagctgtttctgccaagacttgccaaaaattgcagatttgtgaataaagtaaatcattgttctttgaagcaactaagttgtggagtggcttattcagcagtgattgataattaatagatttggggagatcattcagatctgctgagcactggaaagttagaaagatctcagttcttatatagggcccttcaattttagaaggagaaggcaaattgaggaaatcaagaacaatctgataaatggaaacaacaccaaaataaattcatcaatcagagggagcaattatggagtcccagggaaatataacagtaaggattttatttagagtgtgtgggtagaagatatagagaaactagataccaatgttaggattccaggagaataaagttaggaaatgtatgagaaggcataatttatttaagaacttagggaaaataggatagggccaaagaccaggtcaccagcagagatataagtactgaggtccttgaatatctggctgcacctggtagtgtctcttcctcaacctgactctggcttgaagtttagcccctgcatgcctagcccatctgcttccctacagggtcttgacacatactatgccaagcaccttgggggcactgagggtttcagtttatagtccatgtatctaaatttgaaaattaatgagaagatggtgaatagagtcaatatatttcaaaattgcatgtcagatatggaaataaagtttgaacttgtagtttaattatacatgtaattatctttcatttacatgcaatgtcaatttttccatgacctacttataggatgaagatgaactcatgtaatttagagttagagttgaccataaaacaagtctggagaagaatattcttagcttagaaagggtggaatatatgttcctttgagcttttgggtgaaattgtcatgactgaaattataaattaggtaagaaattatgccatgtctggtaccaagtagttcctgcctttgatgagcctatttatttcaatgggtgaatatatgtaatagattaagacaattgagaaatggataatgtataaatgcgttactgtaaacaaaatggtttcatgtttgatggctactttcatgtttgattaagttgggccttgggacatacaaccatttcatttctcataggtttaggaaagtttagtgttagcctgataggcaaaatggctgactgactaggaaaaaggcaatggaagatataatttttgagagtattttggaagaattgattcttctgagaactggatgatatttatacttttctgaggcttgctcgctagtgcaagtgctattctaaatggagtgctttgcagattccagacatatgccacattcatgttgtctagatgatgaatgacttattgatagtccaggctttgtactatttgagatggtagttcttttaatagccatgatgtcattgagataaaacttagtgggatagatgttattaatggtcaccattcagccttttatttgcaatgaagccaaagggcagttggagggggatgaggtcagcctgaatcactgattcccttgaagtcttctgtgtgttcccattttgggatcctgtgaaaaaacagaagccaaattgaacaccaccacattttggatgagtttccatttgaggagctccaaaaactcccacaagtcagattcagaagagttttcaggagattgccaaagactgtgcagtattgctggcaggaatagaaacaacaagcagatgttttagcagagtggagcccattctgagagactattcccgggcattcaatgaaagagactggagaggaggttagttcagaacaaagatgagagagcctgacttgggcgtgcacttgcctaaaaatagacttacaaatttaagagttccaaagcccctaaagtaacttcagatggatatagttgctaattaatctcttgaacttcacatgaaaactccatctggcactgtaatcttgtgacaacttgctattgttgtggtattggtttaatttggtttggctttcttcttttttggaaacacacttctccctgtgcttatcacagtttttaaaaacccaaattaaaaaaaaacccaaatagttaaaaattcatagctgctttcatcaccagctggttgcatgacctttgataagtcgccagattcactttcttcatatataagaggaagaaagtaaactagatggtattttaggtctattccaactctacaatcagttaatttatttgaacacaagctacaagattatgagcccgtaaaaccaatatttataaattttctcttcatttctgaccactgatgaaaatgggaagaatatagaattcctctacaaatggcagattaatcactttaacagtaagacagagctctgagggtgaaatttgcatgtatatcataactcagagatgtatttgttcagcaaatatttattgggcacaaactatatgataggtgctgtgctaggtgctggaaattccacagtgagaaaaacatatggttcctgccctcagggagtttaaaatctagttcagaaaaaacaaatattaaatactgtaatcatataattataagtgggactaagtgctaaggaaatgaataatagtgaacctggcctagtagggaataggggttagaatgaggtcatggaagatttgtctgaagaacatattccaaagtattacagtacccagtaccaaagaagtccacatggcagacttcattattgaaccagttgtttttgctctgttctatgactctaactccaggcagcgaaatcaaaatcctcactattagtccaaaatggacttgggctagaacaagtagatggatcagggaaaaccactgtttatgaacagaaacaaaattcagagaccacattatgtcatagcattggagggaccttttgtatgccagggttaatatgaatgcatacttattttacattttccacaaggagcataagatatattataatcttatggatgcttgtgaactgaccccaggagttatgatctgtgttcaaatctcgttatttaacctttctggaaaatatgagaagtaaatgaggtaatccatgggaagggtttagcacagtgcctgaacctagtaaaactcaataaatttttctattgttgttcctgttagtatttaacaaaacagcaatcacccccatctctctctttctgagtaatacataagaaagttaccagtttccaaataaccattcttccttatacttcctatcctgaataatgtaagttagcttgatcaaggaaaaacaggggttgaagcttctagggcttcctggaaaatttctatgggatgggggcaattcttgctatggttttgtgcagaaagaggctgaaggtaattcagagggaggttataaactaactttaaaggcactggagttgcttaccatttaaaataatgttgttttggtggtggtggtaatgttggcgtgagagtgtgtgtgtgtgtgtgtgtgagagagagagaggctctaattgattttgaaaaattataaaatgtatattcaattatcatttcttggattttgaaaaattacaaaatatatatttgattataatttcttggagttcataataaatagggttcacttattgtgacaagggccccactatccttctttgaaattatggctataatttagtttcctagtacaagctttgctcatgttaccttctcagtatgtaatcactcatgatggcaatcatctatttgagtcatgtcacatggtttagtggtgattgttactgtctgagaaaatatttagcatttagctaagtatagttctttctaggtatactatgggcctttgttaggtatactatggagcaagtaaatgtaacttaattgagttttctccctcaaagcaggtgtgggtgcgttttcttggtgtaggctcatgatcaccttcgttatctgcagctttgctaccaaatacttctctttagttcttggttgaacatggttctgtattccattgtgaaacaggggatctttttttgtggggggaatgcttgtgttctagcccttcagaattgtgtttctcctgcacagaccccttgaccaggtcatggtcttttcacatggattatggttataactttgctcatgtgccctgtatacataaaatgatttcccacccaaactcttctagcctagatacattcatcctagatgcttttactctatcattcaagttcccttcctggccagagtccttatcaataattcttaggctatactgggcttgtctacttgagtgtaagtttctaaaaaggaggccccacaatatcttttttttttttttggagagcccccattctccagtcctagcacatagctgagctctaagaagatgctcaacaagtacttaatgacttaaatcctatcctctgagacatttcaacataactcaatgaaagatcagaagaaacaatctacacgaggatttgtatcataatctcttcacagttatatatatatttggggagaggaagaagagcacattatagatccttatcagccatatccagagaaagctgttactttcttctgatcaccaaaccaagtatgggacctcagacagagctgggtttgaggtactctaaggtaatggaatcagtgtaaacactatctaaaacatccgagtatttttctttggtcctcacacctcaggattcctgaataacttatgtactaaaaatcagaaggccagaaaaattgatttgaatttattgtccagtgaacttgctttttgttaatttaagggcagtagtttgaagggtaagttttcctgaagactctgcattccttgacctaaagtctccattaggaacataaacaatacgactgtatgtactgtgttttgaaaccactataaatggctctaatgtgtgaatcaggttatagtttaatttttctttgctggatcagaggcacttgagaataaaacatatgcagctgcaggatattgaaatatttcatatgcatatatatgcagcatattttctagggaattttaccccttagcaaatctagccaattctttttcaattctatgacttaacattaccttttctttttgtttttattagcgttcaggttttagactatttgtttccacaaattgtattttattttggcttaataaataaagaaattgagttacttcaaagtacgttgtggatgtcatttggtagcagtggataaatggaaagttaaatgacttgctcaaggtccaaaagaaagtcagcagcagggcagagacaaaatttctgtcctttttgccaattgcctgtcagattcactctgctaatgaaactttttgcaacagaacagtcttccaatgtttccaaggagccagttaattaaccaaataaagagaatgatcatagcgatttttaaaatgtccatctctctcacatttttcccccaaatttcattttgagtgtggatcaaggaggtggtttttacaatttaaatatgattggcaccattgctgttaaatgaaaatgtggctactgggtattgaaatatattttttaaaattggtaatcaaaaaccttgttagcatttgtgcccatctcatgagaagttcatagtgctttaaaattaacattgattaaataatgaactgactggagagagaccatttataaaattggagatagggattagaggcagttgtggcaatttctctgccaggctaggaacgctcattaatgagctaagagggctggagaattcatgaagggcagtatcacagatgattactcccattacgatgaaattggtaggccaatggatatgacaatatgatatttatgattatatctggttatattattgtagaagttaaatctttctgtatggaaacagtttagcacttataatgtgtttttaataaaatactcgtgtgcaatggcattttataggaattgtaaatgttaaccagtagactgaattggataagaaatgcaaaggcagattactttcaaataaaaaggggtagagtgtcaaatatgagtttcattagctaattggtaatataacatgcttgtttcccttgagcacctgaaggccagaccaagctgcagaaatgttgaggtttaaacaagcattgagcatactatgctttacagcctgagtgatcacaagggttaggaaaccaggacacaatctatagtctcaacaaatcatttaaagtatcattgcttaaaagctcacctaatgtttgatttttccttcccacaatttatgtgtttattccaaatctaaccaaatctctgaaatgatcaacaatatcatactcacggtatcttgtaatagatgcaatattctgggcagagagtatcacaataatctcttctatctggaattacaagggaaagttatggactgctttcccagaggttgcttttttcactgatcttgtggcaaccctatgatacaggcaagggctattatcaccattttgtaggctaggacactgaggctccaagaggtgggaagtaaatgacagagtcaaaatgtgaacctatcataaaaacaaaaaaaaatccccaaactcgtcaggtactatgcttagtacctgagtgacgagataatctgtacaccaaatccacgagtcctgagtttacctatataacaaacatgcacatgtacccctgaacctaaaattaagaagttaaagtttttgagaaatgtgaacctagatgctctgcccccaagttcagtgtccattctatgatccatgaatgacacaaataacagaattgtagttaaaattctcaagtgaaagttgtgtcagaacttcaatttagagtccttttagatttttgttttcaaatgtttgaaaaaggcacggtctgaaaaataatattggtccccctaagtccccccaaaactgccccagtaggactattataaggccagattactagactagaatttactgggattactttgtattaaacccagagcaggtagaacttgatttaagtaaatgcaatgtaacaaaacccaaatttacaacctagataatataccaaagatttgctttaagtgacaatttcacttgtatgttttaatcagtttacaaaaatggataatccatctctggggactttgagggaaacacacatgttatgtaaagcggaattaacctatactatgcaagagtcatgtgaaagtgacaggttgttgttcaaactaaatcttacctcctgcttgtgtgattttttttggtatatctagagtaatatagcactcttccctaatattcatccactggcatttggcatctagttaattacaaatgattgtagatttttattattgaaacagcatctaacagatttacttgtgtgtgtttgtattgggatgtacaaggaaatgtgttgtttcgaaggaatgtaatgtgaggtgtcaggtgacaaagatgctttctagggcttttcacccaacttgttccttgttcaagataacttttatttaacttgcctccaaatcaagccctgaatatcatgcaacacaacagagagatcttctcataaagtagttgtcttttagactcatcttgaagtgtatggagtcattttaatagccatagggagttgggcctagtcccagcaaatgcccagttgaaaattttatggaagatggagtaagtctttttttgttcattgtactaatatttactgagcactcatatcagacactgttctaggtattgggcacataaaagtttaaaagcttggaaaaaaaattctgccctcatgtcacttacattttagtggaagaaacagaccattaccaagataaatatgtagaatatataaaacctgtacagagtgggaatgatcaaaagaaaaaagtgaaggaaggagattgaagtgtatggataaagttttagttaaaggggccagggaagacttcactgaggaggactcacatgaaggaagtgaaggaactagccatgtggatatttgggggaagaatatttcaagcagtggaagcatcaagtgcaaaggccctgagacgagagcatgcctggggtattagaggagaagcaatgaggccagtgtattcagaggggaatgaatgtaaacaagaagaaaagatgaggtcagagaggtaatcgggtaactgggtaggtcctggtaaaaatcttggtcttctatccaagagaaagagagagagagagagtgaagctctgacttatgttttaacaagagcattcacattgcaatgattgcaatagactaaagaggacaagagaagaagcagagagaacagttaggaggctactgcagtaatgctagtgaaagaagatgatggttctagatggtaataatcagagtagagctcttaagattttctgacagactgaatgtgggatatgagagaacaaaaggaatcaaagttttggggctgaatgcctacaaggatggcatttatgtgttagtgaaatggggaaagctgcaggaggagatttgggatgtgacaaacatcagagctctgtttggagtatgtttggtttgagttgcctattaaacgtctaagagaattgttgtataggctttaaatgtatgagtctggattcaagggagacattctgggtggatatgtaaattggagacataatcacatagatggtatttaaagccataagattgggtgaattcacctagaaattactacatatagacaaaaggaagatgtctggtgacatgagaaaaagattttaaagtagtatgcatataatgttctcttttcttgggaaaaagtgcttatagaaagaagaatggaaatatgtttaccaaaatcatctctgggtactaggaatattggtgattttcattttattattttatgtttttccatatttcccatattttctttaatgaaaatggattgcctttataaccagaaagcagaataaaacaataaataccattaagaaaagaagatttttatctagagttgttctccaatgtctaaaataaaacatttgtttgtgtacagtcccttccacatgcttacatcctcagatacccacagtgaacatgctgaaaaaaaggttatttgaatcaaattacacatgacatgattgggacttgccatcaaggactgacaatacagatgtttctgtccttacatggagttgaattaatagaactagataaaatgtgcctggacggtaaagaatatgaagacctggggacagttaaacccaacaggactacatccagccagaatagattgggacccttggggctgagtcaaaaatcacatcctttgggaaaagagaattaattgaatgcttgttctactctcttgtgacattcttttccctgaaggccttttgccttctttttctagtagctcccattcagggaacagggtatctgctagttcagcaagctactcttaaatgttaataacttattcttggccaatttttcacacataggaaagtgtatcatcttatcatgttgagttttaaagatcatataatttttttcttttgaacatagaagctctaacacttctctttgcattctcttcatctccccatttgattataataaggattaccctcccccttctctggtggtgactcagacatagctaaagggggcttttctcaaacttcttttggaaaagagaaaaccgtcagtgtttggcttgaggacaaaccgagaatattttagctaagatgtaggacggttgatacagttatgagtgactgaaaagggaattgtagtggaaaagccatttgcgttttgagctatggcatttgctactgtgttagcactttgttaaaagtgtgtaaatgcatggtaagttttttaagcagaaacttggaaaattggtacagaaatttatttttgcatatgcttgcctttccattaagcagtaagtgtaatcctctccctgatgatctgatgatctactttactttttccttttcttcctaagaatgccgtgacccaattccaaatgttttgttgcacaaatgagctatgttactccctcttctggactccaaatgtcagaccaggctccctccaatattctatgaattttggcgatttttgaaatcaaagttagaacagtagatataatctatattcacccccagcctcctgctgagacatacataccacatacacacgtgtgtacacacagaacacatgttgaaagaaagaaacttctacctttgtcttctactcttaatagcaaagattgagtcctaagacggcccacacttatatatgaatttagatcaacaatgtaatcaaaggcatcaaattgtaaacattctgcctagaactggacttgagatcttacagaatgaatacaggtcttggagttctgagatctgagtgtaaatcttgcatctgctacttgctagcagagcaaccactgacaaactacttaagcatttatttaattctaaggccttacatacttgttctgatggcaaccagtatcatgggggttgaagttagacctgattcaaatctactacttggacaatttgggttaagtgatttattgctttagactctgtttcattgcctatggaattaggataatacctgctttttcagggcttttgtgaggattaaacaagaaaatgtatacaatatgtctaggagcagcatttgggacatatggtatattaaaaattctctcattattattgttgttgttatttctcttcttagtagcacaaatattttcttacctgtgaaaaccagaggctttcactaagtcaagccaatagcaggagaaaaaaggtagaatttctcatttttcaatttttgtggatacatagtagatgtatatatttatggaatacatgagatgttgtgatacaggcatgcagtgtgaaatactcaactcatggaaaatggggtatccatcctgccaagcatttttccattgagtaacaaacaattcagttacactctttattttaaaatgtacagttattgttattgactatagtaatactgttgtgctatcaaatagcaggtcttactcaatctttctaactttttttgtgcccattaaccatctccacctccctcctatcccccacaacacttccttgcttctggtaaccacctttctatgtccatgaggacaatggttttgatttttagatcccacaaataagtgagaacctgctaagtttgtctttctgtgcctgcttatttcatttaacataatgatctccggttccatccatgttgttgcaaatgatggaatctcattctttttatattccattgtgtatatgtgccatatattctttatccattcatctgttgatggatacagatcccttccaaatattagctattgtaaacagtgctgcaacaaacatggaggtgtagatacttcttggatatacttatttcatttcatgtaggtatatacccagcagtgggattgctggatcatatggtagctcaatttttagttttttgaggaatcttcaaactgttctccataatggttgtactaatttacattcccactaacagtgcagaagggttcccttttctccacatcttcaccagcatttgttattgcctgtcttttgggtataagccattttaactggggtgaggtgatatctcattgcagttttgatttgcatttctctgattatcagtaatgttgagcacatttttatgtccctacttgccatttgtacgtcttcttttgagaaatgtctattcaaatattttacccatcttttgattggatttttagatttttttcctatagcatagtttgaactccttctattttctggttattaattgcttgtcagatggatagtttgaaaatattttctctcatgatgcgggtcgtatctttgttgattgtatcctttgttgtgctgaagctttttactgcaatgtgatcccatttgtccctatttgatttggttgcctatgcttgtggggtattactccagaaatttttgcccataccaatgtcctggagagttttccctaagttttcttgtagtagtttcatcgtttgaaggcttagatttaagtctttaatccattttgatttgatttttgtatacagtgagagatggggtctactttcattcttctccatatggatatccagttttcccagcagaatttatcgaagagattgccttttccccagtatgtgttcttggcatctttgtcaaaaatgagtttgctgtaggtgtgtggatttgtttctgggtgtattagtctgttctcacactgctaataaagacatacctgagactaggtaatttataaaagaaagagatttgattgactcacatttccacagggctggggaggcctcaggaaacttacagtcatggtggaaggggaagcaaacatatccttcttcacatggtggcaggaaggagaagtgcaaagcaaagagggaaatgccccttacaaaaccatcagtctcagaagaactcattcactatcacaagaacagcagcatgggggtaacagcccccatgatttaattacctccccccaggtccctcccatgacacatggggattatgggagataaaattcaaggtgagatttgggtggggacagagccaaaccatatcattctcctccggcccctcccaaatctcatgtcctttcatttcaaaacacaatcatgcctgcccaacagtcccccaaagtcttaactcattccaggattaacccaaaagtccatgtccaaagtctcatctgacacaaggcaagtcccttccacctatgagcctgtaaaatcaaaggcaaagttaattacttcgtagatacaatgggggtacaggcgttagataaatatacccattccaaatgggagaaattttggccaaaatgaaaggggctataggccccatgcaagtccaaaatccagcagggcagtcaaatcatctccttctctttctcctccttctccttcttctccttctccttcttctccttctccttctccttctccttctccttctccttctccttctccttctccttctccttctccttctccttctccttcttcttcttcttcttcttcttcttcttcttcttcttcttcttcttcttcttcttcttcctcctcctcctcttcttcttcttctttttttgagacagagtctcactctgtcacccaggctggagtgcaatggtgcaatctcagctcactgcaacctctgcctcctgggttcaagcaattgtcctgcctgagcctcccaagtagctgggattacaggtgcccaccaccacgcctggccaattttttgtatttttagtggtgacagggttttgctgtgttggccaggctggtctcaaactcctgacctcaggtgatccacctgcctcggcctcccaaagtgctaggattacaggcatgagccatcacacctggccagggaggtcaaatcctaaagctccaaaatgatctcctttgattccatgtctcaccttcatgtcatgatgatgcaagaggtgggctcccatggccttggacagctcctgtggctttgcagggtacagcccctctcctggctgccttcatgggctggcattgagtgtctgtggcttttccagacctacggtgcaagctgtcagtggatctaccattctggtgcctggaggacagtggccctcttctcacagctccactaggcagtaccccagtgggaactctgtggcagctctgaccccacatttcccttctgcacttccctagcagaggttctctatgggggctccacccctgaagaaaacttctgtctggccatctaggcatttccatacatcctctgaaatttagccagaggttcccaaacccttcctgatttctggtcaagaaggtttgagacttgcaccctctgaagcaacagcctgagctctgcattggccccttttagtcttggtgggatgcaggacaccaagtcctgagactacacaaagcagcaaggccctgggcctagcccaggaaaccattttttcctcctaggcctctgggcctgtgatgggagcagctgccatgaagacctctaacatgccctggaggcatcttccccattgttttggcaattagcatttggcttcttgttacttatgcaaatttctgcatctggcttgaatttctccccagaaaattgggttttcttttctcctgcattatcaggcctgcagatcttccaaactattctctgtcaccttttgaatgcttttctgcttagagatttcttccaccagataccctaaatcatctctctcaagttcaaagttccacagatctctagggcaggggcaaaaagccaccagtctctttactaaagcatagcaagggctacttttgctccagttcccaataagttcctcatctccatgtgagaccacctcagcctggacttcaatgtccatatcactatcaacattttgttcgaaaccattcaacaagtctctaggaagttccaaactttcccacatctgttttctgagacctccaagtctctaggaagttcaaactttcccacatttttctgtcttcttcttagctcttcaaattgttccaacctctgcctgttacccagttctaaagtcgcttccacatttgagggtatctttacagcagcaccccactctctgcaataccaaattactgtattaatctgttcttgcattgctaataaagacatgtcccagattgggtaatttataaaagaggaggcctcaggcaacttacaaacatggtagaagaggaagcaaacatgctcttcttcacatggcagcaggaaggagaagtgccaagcaaagagggaaaagccacttataaaaccatcatatctcaggagaactcactcactatcataagaaaagcagcatgggggtaactgcccccatgattcaattacctccccctgggtccctcctcccatgacacgtggggattatgagaactacaattcaagatgagatttgagtggggacacagtcaaaccatatcactgggttctctcttctgttccattggtctatgtatgtatgtttatgccagtatcatgctgttttggttactattgctctgtagtataatttgaagtcaggtaatatgattcctccagttttgttctttttgcttagaatagctttggctattatgggtcttctctggttccatataaattttaggatttttttttctatttctgtgaagaatgtcattggtattttgatagggatggcattgaatctgtagattgctttgggctgtatggacattttgacactactgatttttccaatctatgaacatggaattttttttcattttttggtgtcttctgcaatttctttcattagtgttttataattttcattatagagattttttacttctttggttaatttctaggtatttaattttatgtgtggttattgtaaatgggactacatttttatttctttttcacattgttcactgttggcatacagaaatgctactgatttttgtatattgattttgtatcctgaaattttacttaatttgtttataagttctaataattttcttgtggagtctttaggtttttccaaatgtaagatgatatcatctgcaaacaaggataatttgacttcttcctttccaatttggatgccctttatatcttcctcttgtctgattgctctatcatggacttccagtactatgttgaataacagtggtgatagtgggcatccttgtcatgttccagatcttagaggaaaggctttcagctttttctcattcagtatgatactagctgtgggtctgtcatatataacttttattatgttgaggtatgttccttctatccccatttttttgggggtttttatcatgaagcaatgtttaattttatcaaatgcttttacatcatcaattgaaatgatcactaggtttttatccttcattctgtcgatatgttgtatcacattcattcatttgcatatgttgaaccatccttgcatcccagggataaatcccacttggtcaggatgattaatttttctaatgtattgttgaattcagtttgatagtattctgttgaggatttttgcataaatgttcatcagagatattggtctgtagtttttttatatgtttttgtctggttttggtatcagggtaataatggtctcatagaatgaatttggaagtattccctcttcctgtattttttgtaatagtttgagtagaattggtattagttctttaaatgtttgatagaatttagcagtgaagccatcaggtcctgagctttttttgttttgttttgttttttactgggagactttttattatggattcaatcttgttacttgttattggtgtgttgatgttttgggtttcttcctggttcaatcttggtaggttgtatgtatctagggatttgtccatttcttctagattttccaatttatccaaaaaacgtttgaatcttctatattggtctgaattttaaaagaaatatcctgctgagcttttgtctaaataagaattaatatgttagtatttctaaaatgttccactttgtgcttttcttggtatggattcaagtttatagtggtaaacacatataaataaaggctgctgcctcctactctcctttatagagccattgtgaatggttaataagggtgattaacccttaaagacacacacaatgccccagcattttaaaaataacttgtattttagatttatctctggtctttgtgggagaaccctatgactctctcatgaaatacattttgggagtgaccatttacttgcactagtgagaattagagaccatactttgttttgtggaccttttcagctgtagtcaaagtaaaatgactgcagtgtcttgagtagaactgaaaattgaaagtacctgcatcagtggtattgatcctggaggacttcattcctcatacttccctaaaatatttgtcctctgtttctgaatgacagtcagggataccccctgaaaaatgctgcccattgagcatgggatatcatcttgatgaattatttcaaaactctatcaaagtgttttccaaatatctagtgatctaatgaggccattcaggtcctgattttcatccaggccttgtttttagatattagctgggaaaagtacagagtgaagactgactgtctgcattggcacagtcagagggatcttgtggctcagcagttattggctacctaactggaaatcaaaccaatatagcactttatcaagtatatgtagtagtaaccacaaataagtcaacattttattaagaggaaaggggttggggaaacaattggctcaatttgccttactgagatatagaaagcctgtcatagaggacctcttctaaaatatcaaggattcaaagccatcacttcaaagcttaaaagatttaagggaaaagataaaaatcctatgacttcccattggaataattcctggctggcctgcctgcctgcctgcctgcctgcctgcctgcctgcctttcttccctccttccctccttcctccctccctctcttcttcctttccttcctatttatatcagatatagaaattttccttgcaggttctatcttcattgatttctgtacacttttcccatagtatgacaccatcatcatgattaacatcattggatacttattatgtcctagacactgttctaagtaatttgcacatattgactgacttattcttagaaacctaaggaaggtactattcttgtggaggcacagagacacaatgtgcccaaagcttcccagctagtaaatggtgtagccaagattcaaagataaggaatctggtttcagactctgtgatgataactactgtgctattaactaccaacctcaaaagtacacatgaaaagatgatgcaaataagccgttattgttaggccaaggttcgtttctatttttgctttgttttttagtagtgcactgaacaatcaacagtctctcagatggcatttagctgtcccagtttacacatttgcagggtggctggccagtgcttaaggtgtgacttggaactgatgtggctggatgtcaaatcagtgaccttggcagatatttggatggagaatatttgcttgtcaggtgtaccctgtttgcttttcctccacagggttcatgtagaagtttccatagtgtaagacacattctccacttttttcctgaaaacctagtacatttcaggaaattagaaccagtgagtttctgggggccatccatcaggtgcaatatcaggtgctgatttgtcactgactggcaggctctttcccaattcaaagcatgagaggactccaaacttctttttgtggttggagtgcccctggaagttgattcatgttctcattgcaatttattttacattgcatcttggcataatgactttgactaaaagggatattttctgatgtctctgctttaatttagaaataaccaaactgatttttccaacatatctccaaaactgaagacacatgtgcctaggaaaacaggggtttctaatgaaaatgctgacacaatctcatgaatgctgaggtttttaacagtctgccattcagtaaactagtatttttgtgtcctatgaaaataccaaacatctgcttgcaatgagcgtacttaacaccttttgggtttctttttagctaagctgaatgcacttgggaatgagtgaaacttcagataacaccggcaaaaagtttgaaataaggaatttttatttgaaaaccattttgtaagcataatggtacccatagtacaaattacaaacaccattcaaaacaacatggtagcaagatgttttcaaatggtgcaaagtccctgctcacaggtgtgaacgccagcaatgggcctgtcagctaaggctggttagtagaataagtggcaagaaggtaaaatataattgaaactaagaggcaaaactttatattccagggttcaaaataaaggacaggaatcagaagctaaagtgaatgtcaaagcctaggtagacacagtgggacagttggcaaaagaaaacttaaagtatgtattttttaattttaaaattctttatttttaattgacataaaattgtattttacatgtcaattaaacaattttatatgtcaattaaaagtaacacgtacaacatgatgttttgaaataggtatacatcatggaatgtctcaatttagctaattaatacatgcatcacctcacatattattttttgtggtgagaacacttaaaatccactcagtgattttcaagatacaatatattgttataaagtatacatacctggttgtacaatatatctcttgaatgctttcctcctatctaattgagaaaagcatgtgtgattattagagttgcctaactagtcttcctgcctcaaccctttcccccaccctaattattttctacattgctaccagaatctttcctgaagaacatatcaaatgatgcctctcccctatagtaatcacctggaaacattcagtgattccctatagtatactgaaaaaggtttaaacttctttaagggttttcatgattgggacccaaactattctttcagccttctcaaacactgtttatatccctggacatctgatacttatgctcagtggttctaaattgggactggtggcatttggaattccgttgaggtgttttgggttgccaaaacaggtgaagaataatatgggtatttagtgatctggagcaagggatgtcaagcatcttgtgttgagcaaaacagacccttaccattttagacttgcccgatcaaaatgacaatagcactcttgttgagaagctgcaagtttctagctaaactggattgttttcagatcttcagagatagtgcatgctttcctagtaatgtacctttgcttctgctcttccttctccttgctatgcttgcctctttattcattgttacctgttgcattcccatcgatcctcagggtctagctttcccgaggaattcattcttctttcctaccagagttgctgagcatactgtggtatagtagaaaaagtagtaacatgagaatcaagacacccaaatctttgccctggtactgccactcaccaattgtgtgacattggcaagtggtttttcttctctgagccttagtttattcatccataaaatgagcaggttaaaaaaattaggggattgaactagatattccctaacattccttccaggactagttttctatgggccccttatcacctatctcattttattttaatcacagtctaggatgtctttagatctctcaacatagcgtcttgtacattgtgtacctcaaatagttgacctgattggttcagagggctttatattccttgccttttgttgaagatgacactggccattgatgttgtaacattgttgtgctcaatccagtaaatatatatgtatgggctaaaagaatggcagggaccagttttctaaggtcacttaataagacaaggaagagccatgttgggtaattaatttgttgggaaattactaacattacctaacctctacagaaaagatcatacacatttaatgaatgtaaaagaatatagtaaattttaggtttttgttacatgtagaaaagtcttctctgacaaagtagcagtaattatgaaatatatatcatgtaggtttatattcctgtggcctgcaacaggctatttgtcttaaaattagaagttttgtaggcttcaaacgtgttcaactggcacttgccttgatataatagttcccttagagattggttggaatcacatttatgttgtccagttgtgtattcacaactgtgagtctgcattatgatgtatgggcacaatgctcagtacctagtttgcataatctttcccagatgcggggtttttcttaagccttcttaaagggctgtcactaaacctaagcatcatggcttggtttctatttgaatctgagaactgcctcagctgttaacttggtgaagccaatcatgttttcagctggtatttctctagtgttaccactttcacagaaaggtttggacacatgctgtgtcattaatgcccagttttttcctttctttttagtaagtcacataaatgtattacctgattgtcatgacatctaggatttttttttgtcctaggcctatctaccttgaagcaaaaaaggtgaattaggctttgatcacctcctcctccagcctaggtttaattagtgacctttgaattcacggggcccctgttttctccattgctgcctgctcccagaataatcttagcccttttttccacattccaagccatgttttagaaagttaataatagcacaacaaacatttccatagcatggtatgattctgtgtacaggttgctacatattatattcagtgaatgataagtgctaagtaagaataactcaaaagaatgagagatgtaagtcatcctatgttctagtttgcaacataaatccccaggaagcttgatgtaatgttcatcaccaccaccacaaccaccacccccatcatcatcatagcaactacaatttattaagtatttgctctttgtcaggcaacatctataatataatttaaatatcaaggcaactatattagttagattctattatgatctccattttatggatacggaaactgagatttagagaacttaactaatttgtctaaagtaatacaactagtaagtgtcagagccatgatttaaagcgagagtctgactccaaaacctgtgccttaactattatgctggactgcattctgttatagagaggaattcgttgaagagactcacttattttttaacttttatgttaagttcaggtgtatatgtgcaggtttgttgcataggtaaacttgtgtcatgggggtttcttgtacagattatttcatcacccaagtatgaagcctagtacccattagttatttttcctgatcttctccttcctcccaccttccaccttccaataggccccagtggagattcacttattttgatgaccatccaagggagtgaatacttctaaaatgcccagataactcattcaaagatggtctatttcccataaattccaaggaaaatgttctgaaaaggatcatgtgtattttgagcttctttttaaaacctagggagaaaatacaatatccccatgatccctgcttctttctactctgtctttaggttttttcatatcaaaaatgctgcaacctgaaggaactctgggctgtcggatctcctaaatttaacttttaaacctaagttgtaatcagcatagctttactcccacataccttctattttaccagccatatctcccctccagcagagtatcagcaccagggatgttgggcagaagcccagtagggggtggccccagtgttatttattgttttataggctgcagaataaagtatatgtgataattgatttactcttcgtcagcctttgaggctgataactcaattagcctgtcagatactgactgtgtatctttttcaaaaaaatcctcaaaggtgattttgtattttgtattagataaggtgtgagaggtattttttgcttatattgtattaaaagttcttattttctctgacgatcagcagcagaacaagcagtgttaccataatagttgggtttttttcttctttttaatctgtgtgcttcaagagagaatgatgatattttgaagcaggcacataaggaaataaaaatttaacaatctcaggtgaaataattttgatttccagtccccagctgagagagagagaatatgtattcagctgattggcagggctgcttgtgctcagtagcacaaattgctggattagagaaagggccagaagggtggtgagggaaagtctggtccatggctgagttatgattttaagacagtagattttgattgggcataatgatcagaaaaaaacttttgagtgcacaaacctctgcatacatattatgtacataataaaacacaaaaatgttatggacactaaatattttctttctatactctatggatgtccttttataaccacagggtacatatatccccattttgaagactactgacctaggagttatactttgtgtgaccctagaagagtctattagatggtctggacctcagtttcccatatataatataagagggatgggctaaaatacagtttcaagtttcattttatgcacgggtattcctatggactttagcctttctttcaggatgaggttttaactgctgttttggaggcattatgagccagattattactgaagaataaggataatattaattgttgcaattagtagccctcctattgcatttgtacattcacatttatatgcatgattatttcaatgtggcaaaaatacaatttactaagttaaggcagtatcacaatttgttttccctatgtgctttacgtatttccaccctatcttttaacaagtgatgttttgttaaaccactcagatatattcattgatacagtggttttaacaatggaaatttatttggctcagacctaaagcctttatataaaagttagtaccaaaattcaataaataaagctatcggttatttggttgtttattggatagagatcaatattgccttgttaaaggtaatctgagtgttagaccagtttgtatgatccatctttgctacaatttccacatgtttaaagcacagagatgtataattgttagtttgtctataaaatcctatgtatatattaaattgtctaaagtcatataaaatcataccctctagaccatagacaaatgggaaatcttctgtgtattttgatatttaagccaagttcattccacttgtgttattgggtaagttaatagatcatttcttattagagtttttgagttagggagacttaaccctgcctttcacacatccattatgaagacattgtaaaaatacttcagggtaccacaggaagtacaattttttctttttctttttttttgagacaaggtcttgctctgttgcccaggctggagttcagtggcacacacacagctcactgcagcctcaacttcctgggctccagtgatcctcccacctcagcctcccaagtagctggggctacaggtatgtgtcaccacacctggttgacttttaaatttttgtagagacagggtctcactgtgttgcccaggctaatcttgaactcttgggctcaagtagtccttctgcctcagcttcccaaagtgctgggattacaggcatgagtcaccacacctggctaaagtacaactttttagtctttgaaaagtaaaacatatttggatctatgaaatcaagaaaacaacttaatgtgtgtacctctccccttctatatctatataataatattgttatagtgtagttccattcagttattttagtttggaatcatgctttttattgaaattgttggtaattttatttgtatgtattaactgaacattgattattttgctacccagaatctattcacctttctttttgaaaccacacttttatttcctttgtagatcacccctccccacacccagcccacgtgcttaccataggcatatgaggtaggcctaagccaattagagccttacatttccataggcttcaatgattaatttaagggtgggcacattacccagttagagcaaaagagatacaatgaaacttcagtggacacacctgggaaagaagttcgtgctgttgtcaataaacttggagttatgtaaatataacttctggagttgctacagccatcatgtgaccatgaaagacaaatctgaaatggatgagagcagaggttaaattgaaagaatgagggatgagatctttagccatccaatcagacctatttaactggaatttttcattatgtgatccaataacttatcgttttgcttaagccacttaagggttctgttttctgtcacttggaactggaagaatccatttgatcatccctgtgcaatcttaggggaaggcatgggctttgtataactacccgtagtgccaaatctttcaacatggaaggagagaaagagacagagtgaacaaacatattcaggcgctttggcctgaattaacggaatgggtagaagtgaggcatattttttctctttaaatggtagtttatttcacgtttgtttagtgatgcattatgccacgctctgtgccagacacgacattcagaggtgaatgataattcaactctgaagttcacaatgaagtgggagattattccaatacaaggaacactttccagggtaacgggaacatatccaagagacatctaactaggatatgagacttgaactctgctctattgtgtcaatagtaggcagcgaagtggagaaggccattgcaggcaaaggaaataacatgagatatattctttaagagtccctgagttttgagtgccttatgtagctactggcaattgtagtagggatttatagtggaagaaagttttgtgcatgactaagtagtagtacttgggtcactgagacagcaattaaagggctgatactcctatttataaatgataccagtgcctagatctatgtctgaatgatagaatgtggatttagcttctccctagaatccaaaccatattatctgaatgcatgtttgtgcctcctgcagagtgccagtgcagcacaaatgatataccagagacgtgatctctatcctcaaggagggcaaaatctgaaatgcgccactttgataggaagcagaagagtggtgggatcgaggctgcaaaatttacatattcattgatatgtgactgggtatttacttcatttgcaaataataggtaagtgcattgtgcagaatagaaggcacatgaaattatgtaatttgaatgggaaatggggaaaatatctgtaaattactaagatgtgtggtgtagtaatcagctttctcttctgacaaaatatggcacatcaaccctctcatttattatgctctattacgttcttttaccagtcacgctacaagtttcacacactcccaccatgaaactgccagtcttcctactccatcactgcattgctagtgaaatgacttttaatgtgcaccgagtgtcagcagtcttctaggtgccctggaggaagaagacctctgcctgggcattcattctaaattaagcataaaagttagtgctcaattgtgaagatgtgcaaattataatttcaaaataccttaccatcttaaagctacgttccaacagctgggtattaatactacccagatacttgtttacttcagttatcttacaagctgtctacaatcagggtggatggtgttttagaatagaaaaagagcttatagctgtagatgatcaaataatcagtggccattaaaacacacaggggagttgcgttttggaattttaaaatgtttgaatcaaagggaacataaaaatagtaatagggaaatacagtctgttatggttcgcagactatagatgtgcctacattttgaaaaatcggccatttaaaatccaaatttaataaaacaaatggggtgattagttgcatttctgaagggttttgttgagggagatttgttaaaatatgtattgcatctgctgcttttaaatgttggctttaatagattatgaactctctggtgagatgaatagcaaggaaacaaaggtcaagtatttaatgtcaattgaaaaatgaagatgaaccatctctgcaattataatgtgttaatggggaaaaaattcaatttacaattagcaaagcactgcattcgaagaagcacttgtgttttgaaggccatacaagggaatcctggcatgtgtaatagcaaaaacataacatgtttaaacagctcatatagttagttaagccacgttttccaagacatgccataagtaaaagggtttatgaaaaaaaaaagagagggagagggtaagtggggtgggaaggcaagaagtggggagagataatgcttagaaaataatttggttgatcacagtaatgggtatatgagggaggattgggatcctgagagaagaggtattctaccatttgtctggctgtcatgtggacttgggagcaagagtcattcccagtggagtccattgatgtccctttcccttgacaacttactaatttatttattcttacatatacatattcccttattcatttgatggacacattttgtgagcaattatgatatataggaacataataactggggaacaaagaatgttgggggtaggcaaaatatcagggcacaaatttggaggatccttgcagtagtgcatagaaggagcaattgcatcttcactatttacagagatatagctaagcttgggccacattactgaagtcttgaagacatccaattgtacttgcgcatcatgaaagtctcattagggaaaaaatgcctttggatgctaagctggaaaatgaagacaatgttgctctcttggctttgacactaagttagatgtttgaccttggaccaacacttaagctttctgtgcctcagtctccttgtctaaaaaagaggataattctgtaatgctgcttgccatggcctcacatggatgaactcaggattaattagattaaagaagtgatcagtgaagcacatgaaagctcctcagaggtactaagtgagcaggacgaataacaattggaatgttagctatagagctgtaattggagtttgttttaaataggtcacttcctgaaaaccagggcaaatggtacttaaaaaaataaactttgttttacaatagttttagatttatagaacgattaagatagtacagagttcccatataccctacacccactttttcctgttgttaatatcttacataatatggtatatttgtagaatatattaatgaaccaatatttatgcattatcattgagcaaattctgcatatcatttagatttccttagtttttacctaacgctctttttctgttccaggattacatccaggataatacatttcatttaaccatcgtgtctatgtaggatcctcttgctgtgctgacttctcagacttttcttatttttttatgaccttgacattttaaagattatggtaaaatacacataacataaaatgtaccatcttaactgtttttaaggatacagttcattggcagtaagtacattcacactgttgtacaaccatcaccgccatccatctccagaactcttttaatcttgctaaactgaaactctatatccactaagcaataagtcactatccaccctccccctacccactggtagctaccattctactgtttctataaatatgactactctaggtacgtcatataagtgggatcatacaatatttatccttttgtgactaacttatttcacttaacaccatcaaggtttatcaatattgtaccaggtgtccaaatttcttcctttttaaagctaagtaatatttcgttgcatttatataccacattttgttcattcattcatctgtggatgaacacttgggttgcttccactccttggttattgtgaacagtactgctatgaatatgggtgtacaaatatctctttgagactctgctttcaattattattattattattattattattattattattattattattattattttgagacagagtctccctctgtcacccaggctggaatgcagtagtgtaatctcacctcactgcaacctcggcctccccggttcaagcaattcttgtgcctcagcctcctgagtagctgggattacaggctcccgccaccatgcccagctaattttttttttgtatttttagtagagacggcgtttcaccatgttggccaggctggcctcaaactcgtggcctcaagtgatccgtgtaccttggcctcccaacttactggtctgctttcaattcttttggagctataccaagaagtggagttgctgcatcatatggtaattctacttttaatattttgagaaaccaccatactattttctatagcagctgtaccattttacattcttaccaacaatgcacaaggttgtacatattgttgccaacacttgttttttttttatttttgatagtaactatcctaatgggtatgaggtattatatcactagcatttccctaatgattagtaatattaagcatcttttcatgtgcattttggccatttgtatatcttctttggagatatgtttatttaagttgtttgcccattttataatcaagttgtttgatttttgttgttgagttagatgagttctttacacattctaggtgttagcccctcggagatctttaattcagaaaagaatttctatgcaatgaaaagagagaaaagtaaagagtaagtaaatgaatgaattcatattggcttcccatcgagcagatctctgattcataagaattatctccaatatacttcctaaatatttaattttttcttttttaaaatataaaactttgcacacacctgtagtcccagctactagggaggttgaggcaggaggatcgcttgagtctgggatgtcaaggctgcagtgagctgtgatcctgccactgcattccagcctggatgacagagtgagactccgtctcaaataatatatatatatatatataaatatatatgttattgtgaacagtagtgctatgaatatgggtgtacagatatctctttgagactctgctttcaattattatttattattatttatatatataaaatttgagatatatagattattatttgagatatatatataatttttaccagccaattaaaatggatttttacttactaagcaggtagactggggctaccttggatttttacttactaagcaggtagactggggctacctttcctaaaaatcacttccttatccatgaactcaagtgaccagatgccttcaaaccaagtttcaaattgcccaaatgtcttctcaggagagaaaaatttgtccctgtgaagcaggcaggcagctcaggggacagatggatgccagggagtgtccctagagatgataattgtaacccatcctaacataacccttctcttcctttatgccctctctcaaaccacttatcttctaatttccattgacttcttctccctttttaaaggatgaaaccacccaactgatgcatctaaagtactagtggcagaactgggcttaggcatatagctcataacttgttattaggaagatataatagatagaaatgtgttttttgacagaatttgaagatgaggaagaaaattatagggaggctttaagtgttcctagctttcagcttcccttctaggaaccatctgatggtctgggttcatgtgcttggaagcactaagtgcagcatctccacactgagcaggctgatgtttgcatcgtcttccaggtacaaacagtctcctcaccactgaggggcactatcagatgtaattgggtctagcaggaataagacctaggaagaaagaacagatagaaaagaggtacacaagatgaaacatagcattctaccactaatggggattaggggtttgaatagtgcctagggcatcctgctttttcagaatatttacaaagaatggaatgtctagaataatgaagcctgacatagtgcttggtgctgtatacataatgtctcacttaatactctcaacccaatgaagtatgtactgttattatcatctccattttaaaaaggaaggaactaggcacaaggaagttacatagcttgtccaagataatacaggaaaaattagggaccaggtcacatttgtcttattccataactcttgcttctaacccaaccatttgtttggcttaatgagtggtgagttaaaaatgtgagcaatgatgtgaaggcagaaaaatgtggtctgcaacatgggaggtacaaagtgggggtggggaagtatagtaccagaaaaaaaaataactaaagttggttcagagagagaagagttagatggttattaaggaaacccctggaagaaaatatttggcccctgatgtctcagtaactcctatatcttcaatgtgaaagaagactaaatgaaattgataaaaatgattttttcatttcaaaatgagcataaaggtgttcttctccctctaattagtacagattaattagatgtaaactatagtccacaggccaagaaacaaattcaggtagggatatataggtggattaaaaaaacaccaaaatatgaatatcaaacaaatcctaagaaaaacagtacttacacattgcagaattgcttaccttatgttatttctggggatacctaagccatatctgtttattcagccactgatagcctctgaaaagtaaaagccacttttacaaatccggggtaacactggtgtctctgtaatcacaggacacagatcaagctagagtttgttactctgatatctctctgtcacagaaatatggccccatatgcaaggactgagtaagctagttgccagaatggctaggaagggggtgtcagtttcagccatggtattcttgtagtattatttaggctctgtgggctgccacgttccaacaggtctcactaggcagtggttgtgtatttttgttgcaggattacttgtaacaccatttcatttctaagacttgatgttctccctctctatttctatagagcattggaaattggcaaaaataaaaaataataatatagccaattcgatccaagctgacaacatgttcctatttttctccatctgccatgaattttatattctgacaagggcttgacctttggagaagcagacctctgttgggttacttctttggtacatttttatcttccaggtattttggaaactatttacctgtgctaataatttgccatccaaataggtcagtgcttcactgacttattattatttgtgtattctaaggaagcctatttggtatgaacagactcattcttacttttagagtttcttattctatcagaattcaaattaacagaacttctatatcatttgcaatgtgtcaaaatgaaatggagtcccttgagaagtttcccaaaaatggtatagtaggaaacctcaaagcaaagctttctactttacttagttttatttttttttttgttagtcagagagactcctatttactgctttaattgacttttttcatttttttaaacctcattgagccacaccttatagagctacaggtaacattattaaacacttaatgtgagacagacattgtattccagtgttttgcatgcactatctttataatatccctagtatatttttagctccactttacagatgaggaaattggggttcacggtacttaagaaactctcctgaaggcctgcagctagtgatatggaagctaagattcaaaacctgtccatctgactttgaagcagatgtttttaaacagttgactgatattagctagtgtattggctaagttactgtaacttggagaccccaaaatatagtggtttaaataatatagaaatttctttctctttgatttcacagtctgtatagagtagctctgatctatgagatcatttaggggcccagatgccttccatcttatgactccaccatgatttaggaatgcccctcatctgcatagttaaaactggatcactgttgcatctgcattccagcccatgggaaggaaagaagaaagagaggttatggaggtcaagtattttcatttctaagaatgtgaagcagaagatgctcacatcaattctgcttatatccttttggctagtcacatagtcacacctagctgcaagaaaagctggcaaatgtagtctctaaataggcaggcgtgtgtctagccagaatgctgtggtccaaatgttggttttcccccgaaattcacatgttggaacctaataccaaataagatagtattaagaagtgggggcatttgagaattgattaagtcatgagggctccaacctcacaagtgggattagtgcccttataaaagaggttcaagggagcacccttgccccttctgccatgtgaggatacagcaagaaggctccatctctgaagcggagagcaagccctcaccagacactgaatctgctggcaccttgatcttggatttctcagccttcagaactgtgagcaataaatttcgactgtgtatacattaccctgtctgtggtattttgttatggcagctcggatgaatgaagacacagaacttgggaggggcttctattactaaaaggaaggaggagagaacaaattttaaggggcaactggtagtccaccataccaccatagtgtctggtgttatttatcatcatccccttccagaatacaaaaagtcaagtagagggcatcagtaggagactatcttctgtagaaaagagaatgatctggtgtcagatactctggacattgcaggtaatgttataaaggttcagggatggaagctttaaatagcacctgtgttgacttaaatattcatgctaatattcacttagttttatatcccttcctgagaagttaggtttaggggacatttattattttagtatttatacagtagtcaaacttttgttctgtctacagccattttttcagttgttaccattataatattgataacctgaaccatcaagttaatccttttctttaggcttttattcttgtaaatattcatcagctcagcattttctttgctgagcaccttattcaactagaaaggagaatgttgccccctggaaatatcagcaatgatttagatgtgatcgttctcagatttcctcatgtctgtgtctcagtgtgcataaatatacaggctaactgttgctgaggcaaagggttggagatagattccatggtttatagcaaccctatttgagttgcaaatataaatgttgtatagatgctctcccatagtggtgttagagtctgtggatttacagaagagagttcttgacctcacaggagaatatgcggtaaagagtgttctaggagtagttagtagtagcttttctgggctttctttaggaaaatttaatgctgggatttgggcattaaaagttcctccacagtttggtgcaagtgcaaatacttctttaagggaatttttaaaagccacccaaagaattggattgtggaggaaatcaaagaatgttaacatagaagcagtagaaaatgtttctctatgtgagttctcatttgaatgtagatgtgagtgggtgggcaggtaggtactttatgtaatctgataggaggagaaatttagaggtggtagacttgacaagtatccctctggttctccagaactttaggatgacatgttagacattttcttgaaagttagtgagaggtgtttcctctgcaaacagatcgctgaaagtgaccagtttctagatgtagaaaccatcccagttgcccaggtttatctctataaaccagaatcaacaccaaccgactcttgtcttagcccaagggaacaagaaggtattctgcttacctgtttcccaccacaagaccaattttagaattcatttttatttatctcaatacagctgcctttttaattggcaatgatctctattgaatttctaacttatgctgaaacggtggctgctggtggctgtttgtatgaggtatttggtattttattttggcttaaatctgtttttattgctcaaatattgtcagcagatgcattatttctaccggaatttccactgctcagtgtacaggttatctccactttgacagctctgtatcttcaatgtcaggtacactgctcccaagtcatactagatttacacattctattatacttctattgaacagctcttaatctgctcagaagaaaacatgctacaaccagcaaattttatcctcttgcatttaatgggaacctttcttggcaaggatggacagttgtatttgaaccgttccaacaatatctggccagttttggaaagattttgaaggagttaaccctgtaacagccaaactctggttgatactttaatattgcctgaacacccaagttctaaccctgctctatttactgagttactccctcccccagctgccaataattcctaggaaccttgcctaatataatccctgttttagtcactataagttaggtttgatttacaatggaatttcatgctgaaattgggtggcaagatgcacatgtatttcttgggataactttactgcataatcttatattgattgtatttcaaaggaagtgttttcaattgtgctactcttagcttcatgcagcagtgggttgtgttataatggggttattccacatttattggctgagtttgtctctggagagatgtgtttgaaattaagaggaggtggggcagagttttcttctacagtttgcattctgaggtaggtaatatctgatattcaggccagttcatttttcttattgtttcttctctcctaagacactgtgaatataaagtaacaagagacaggacagaggctattgctagtctcctcatttgtatgatgggaataataatgcttaccttgcagagatgtgatgatgataaaatgaatataaagattgtaaacatgttcaatatatagttaatgctggtggaagcttctgagtagaaggtagactctaggattatccacacataacccttcatgtattttctgatctcctccactgagatctgtcctttgaatactatctctttaagtatgtatgctggggtattaagtctttttctttactgtagagttatctagtgtgtctttttatatcttctttgacatctttatctactgaaaaatctctaaacatctgtaactgtgctcagaaacctcttatccctgaagacccccagaagggctaagcggtaaccagagcagaggcaggagaagaagttgtaagaaagaggaagaggacaaaaaaaggaaactcaatgtttatgttgacaaatcagcttatttatcaagcatcttttttatgtccagcactatgctagaggtggaggaggtgctctggacttcaaggattatcgctctttcttttgtttttttgaaacagtctgactctgttgcccaggctggagtcagtggtgcaatcacagctcactgcaacctcaacctcccgggctcaagtgatcctcccacctcagcctcccaagtagctgggaccacaggcgtgcactaccacacctgggtaattaaaaaaaaaatttggtagagacacgggatttctctattttgcccagactggtctcaaactcctggactcaagcaatccttgtgccttggcctcccaaagtgctgggattataggcttgagttgccatgccgtgcctggcctctcttttttgaagtgttaagtattttagacttgaaaataatcagataatagccatcaagtaatataaaaacaagtcctaaggcaggccatttttgcttcaattataatttccaggtataacacccccatgttaatttagcctatgttggtgttttctctggtgtgggaaggttatttcaagtattgtaagatagttgggcactgtctatcttctccctccttattcagagtcttccttctgccctcagttttctgaccttgcatctgccttcagttttgcagtcctaactccttttttccccttatcaacccccactgctagcattttaaatgccattgactttataaggtgtcccttcctatagctcagcagttctaccttgttgcagctgctatatagcactgacctcttatctctttcaaaaggaaagatgaatctaagaagcgactgtggcaaagcaaactattcagaaactggcttgatgctatctctgagagaggtttgcttagtttgcagaagcaaatgtcgtgcatgcttccatgttgcttagtgtgatttgtcacttgggattctcaagcatttgatatgaggccctgactggcttagctcctcatcagaatgcactacaatttgttcacttcaaacccaccaggaatagagggcattcactttgacatctgctcttcagaagcagcccattaatactgtacttgatgtgtcaggttcttaaagaaatacttttagttcttttatccacaatcagatgacctggttcaaggtcagtgccaaccctaagctgtttttctttttgcttttcccttttgacagtcattatatgcctttgcctgtttgtaatcctcagagcctctcagctcaggcactggtaagtgtggtgcaaagattgaggtgggaccaacattattggcatccccggattttggccactctcagaggtacctcagtaagctacccagtgatctcatatcctctcttccttcctcaatctgtatctgttccaaactgcttcattcccactgctgtacatggcttctaatatagaaattatcatatagttaaaacctatcatatgccaggtgctaagccaaatattgtgcatgtattatatgtacatatattatctcattgaattcctgtagaacctctgcgaggaaggtggaaactcaggctctgagagactaagcaacctgcccaaggtcatatagctgggcaatgtagaatgcagggctgctaatagcttaacaacttaaccccttctggactagtactctttataaagataatcacttgtttattattttcaggcaacaaacacttattgcacattattttgtgactgccactatgctaggcattttggatatattaatagattaaaaatacagtagctactctcataggtatcaaataagctaggggaacgagacaaacagacaaatgaaatgccataaaaatataagatttgaggtgctaaggaaaccagaggggaacttaacccagaccatgaaggttatgtaccctatgttgcctcgcaggatgagtaagaattccctctctcattctcattctcattcatattctctctctctctctctctctctctctctctctctctctctctctctctctctctctctctctcgtatccctatgttggataggtccttctccttcctttgtacttttttgtgtatctcagtaatagcacttatttattcttttcattcacttaacaatagtttgagtacccactttgtgccaggcaacgttttcagcactgggaacagagcagtgaacaaaacaaagttctgcccctcttggattttactttctagtatggagatagacaggaaactaatagataaatggatatggaataaaatgtcaggttgttaaaagtaacatgaaggaaaatagattgagaagctggagaatgacagaaggtgctatcttatagggaagacttctttgagaggtgacgcttcccatgcagtactgtgattatgtgtttacatttctggctcgcccttgatactccgtacctctggaggtaatgggctaagtctttactttgtagccccagacaagagaatgtaggagtttgggggtatcagccaaggcatagttgaaatgatgagtcagtgagtctacagatgtcaagaatgaagaacagatgatgggggaggtaagggagtgagggagctagaatgctgggagattattgtcagagaagaggagatttacatttcagatttaaaagattgaacaattcctgatgattctgtggtacacttacatgtgggaatgactgggtacagtaaggggaagcccactgagtcatgtagctcaagaacctgtgaggctagcacagttgttcttaaacttgggcatacattaaaatcaactagagagctttcaaaattgcagcatgagatcttgccttaggagattctgattcaggagctctgaataggtttcagaaaagggatatatatatatttttaaataagttccaaaggagttttagatgcacagagccaaggttcagaatcactggacaaggatgttagaagtttgattcatgtgggttttaaagccatgaaagattatgtcaggactgagtggaaaggaggcctataagccaggtgtaatggtcctcaatgcatcttggaactgaccagaaatcagtagatggctgtgacaaggagggagagagtgtggtggaacacaggggatgattttggaaaaagaagagttttacacaaggatggagaagtgattaaaggctttcaccaattcagggctatgtagaaatttagggcatcagtatgcagtttggggtactttgcatggaagaaaagttctggcattagtctgcttagcagatctgacatcataacagttaggcatgatctgctccacctagatgtgctgtcagccttgggcttaggagacaaagtcctcagctgcatttatgaatttcagagagacactggacaagtaacttgagcaaacttctctaaagtgggcctgcctttagggaagaatatataggtaaagcctagagcatttctctgagagtttttggaactagtactatacataacaactaactagaatcattggttcagcgtcaattatatgcaaagtattaatcaactatatgcaaagtactcatcaactatatgcaaagtactgagaaagaagttactttctcctgaaagcaggttgtggggcaaatagcggctatttgataataatactggttcattgggttctgaatatttgaagtttctgatatatcgaatcattttggttttgaagtaaagattaccaagagctttcactcagcctgtgattttccctaggcaggtgagacttccaatcttaatagggcttacttaaatgatgcaaaaggcatgcacatgaaccagtaatttttattaataacattatcatcattgtaattacttgcaatcttggaaagatcctggggttataatgtaagaaaagcctgtatttgatttctggctcttgattcttagtgttgtgccccattaggcagcatagggaatgcctctgagttctaatcccctcctctgttaaactgaaaataataataatagtttctttatgctattgtgagaagtaaattagataatatatgtaaatgcatgaagcatatattaagtggctcaataaaagccgcctttcttctcagcttttctttagacaccttttccaatctcactgtagcaagtaaaaattattaaaattggaaccacaaatctttttaaaaaatcatttcaacttttaagattcagggggtacatgtacaggtttgttacttggggcgtattgcatgatgctgaagtttggaatacaaatgatcccattaccattgtagtgagcatagtatccaatagttagtttttcaactcttgccctcatccctccctcttccttcaagtagtctccagtgtctattttgccatctttatgcccatgagcacccaatatttagttcccacttataaatgagaacatgaggtagttggttttctgtggaaatataaatctgactctgcttgatgtgtttagaaattgttatcccctgtcaatgggataagttagtctctagcttatacagtatatgcatttgttacttgcctgcagtggaatatatttgaaaatggatcaccaattgatagttagactgttgacttctggaatgaaatgtgagaaaatataaccactcaagctacattcttctattatttgctaaatatccaaattgttaccataagggagaaatatgcctcatgaattgccatgtgactttggcatatgactgtggtaatctcatttttaagaactgcatgtaaatttgaagtaagaaattctagtttcaattaaaaacaaactgagctgaaatatccaaaattcactggctatgagcttatctttaacagttactaatttatatggccaagaggggttgtatttgcaaggccatccccttaagagctgaggttaaacaagtgagtggcatgggctataaatgaattgaaaattgccttctgttccagcccagtgcaatggtttgtgttttgtaataagccctagttggtgaggtaactcatgtcaccaggaggagctgtccacagactgcttgatttgtcactgctgtctgaaggacacaacaggctggggaagctggcactctgcagaatttttatggtgctgcatgcatgcattggtctcccttatcaagctgtaattcaataataaatacaaaaaaatttttgtttaaataaatctagggttgtgacacaacctgaccaaagctaggagagttaatgctgatgctgggatattaacttagccagggagcagtttgggtgaggggaagaaaaagatggatgctgggagagagtctctatttgtgatagagtattcatctgcatggctgtttttctggaatgctttggtctgtgccattggctcaatgtagtcatttttcaacttggtgtctttttgttcttcacgccctcaccctcctttttaaagagagaccaaagagcatgaagggtgacgagaaccactacaagaattttgttgcgataagcagaagccagccttatagagtgggttctgccattttctcccagaatggtgaatggttacaagaaaattactgggacaggtaatttggggaatggatggatttgtgaaacatttttttttttcacaaagaaaactgctttttattttttgttattataaaagtaatatgtgttcactcaaaaaaaaccttcaagcagtacagaaaagtataaagaaaccataaaaatcacctattataattttccccctcatatcagagataacatctgttaacattttggtatatctccttttgtctcttcctgttacctttttcacagtggtttattaggagaaatttctagaaatgtaattcacattttaggaacttgtgattcctatataaaagtgatcctccacaagacagtgctgatttccactccagcaccactgtgtgaaagtacagaaggaagcccatggtcacaatttattgcataatgaccacgtgccagtcactgctctaagtactttgtaaatattaactcatatcatcctcataacaaccctatgagatgggtactactagcattcccattttacagtcagggaaactgaggtttagaaaggctacacagctagtcatgagactgaaccagaaggttgatcaggctttggtataggagaaagaaatagcttctctctctctccctctgccttgcctgccctgccttgccctgcccttcccttccctgcccttcccttccctctccctcctctctccacccccacccctcccccatctgtttacctcaaggcccagggagaaacaaccaatgaaggaagaagtagcagcctagtggataagcagagagccagaggagtcccaagcagctgtgaatctttaaatttaggagttctgggcaaagatgtccttgcattattttcgttcctaaatgagcagaacagaacttcctctccagtgctgggctttgtgagctgaatttgaaccaacaatgagagggaaaatagcaacagatatagatacacttatgtttgtgtgcaaacacacacatatacccatggcaaggagtgtccctctgtggctctgatttctactcagaatcagaacaccaggagaaatgatgatctttgtcaaatgaggtgctcccttagtttcccagcattaaactagagtgggtatagataaatgttcataaatgcagtgatggagagagaattgaaagtctcttattatattccagaataattttgtatgaagtagcagaacatgtgaataactttctgtgtgaccttaggctactcccttcctcttactgaacctcagtttcctcccctctaaaagagaccatagaactaatgtatttgagtgttaagaaccctatctctactttaaacagttcctaactgatttgactttgggttttcttctcctggaccactcttattttttatttttttatgccttttcggggctacttgatctgttattggtctgctgttgctagaaattgttctgtggatgctaagaaggtgagttgcttcatatagtctatcaagtgagaacaattaggaaggcccctatggtcctagaagacagcttatcatagtatctttgagattttactcaaacctttactttagaactattgcctcttttagaggggaggaaactgaggttcagaaagaggaagggactagcctaacagaaagttattcacatgctctgctacttcataagtagcagatcttactctagtaagatgattcaagtgtctcatttttataaaaatgattggggcacaacgatattatgtgatttttccccaaagtaacatatctaattagtagcaagggcaggatagaccccagatcgcttcactgtctagtaaggtttcccaaagtgtattccacttaacacaagtccctcaatatactctgggtggagatcggggcatgaggaagaggattctgaggtcaaataagtttgggaaatgccgccctgtctaaggaagccacaatgtgcattgaagactctgagaaatatagagtaagggaacatatcactaatattgttatagcatttatggctttcagagcactttcatagccatttttagttgtgtactagaagagacaaagcaaaaatgcatataaagtagatcatgggattgaaaaggggataagtgtagccatataaacaaagggtggctgacagttgtggaggttcagcaaagagtcctgcagttattagaataaaactgatgattttgggcctggtcacagtaatcagattgctgaatcttcattttatttgaatttatttaaaggataactccaaaatcctgcaaagagaaaggaaaaaaaattcttaagatatttatagtattaggggcttttaaaatggatttccatccattgataaagaaataaatacccaaaagaagcaagaccagaaagtaactattactaagctgtcttgtattatttctcttggtcaaaatttattaaaagtttgaaagctcattgtcccattaaatgttggtgttaagacttcagttctttattcagaatgattggaggttatattttacacttaacattttccagctggggaactgaggtcacgacaagaatggccactcaagaattctgttggtccagcagttaaggtcatatatgggcttcttttgtggctcaggcagtagactgccattgttttcatatttcaatttgattttcttgttcataattcaagttgggagtgaactaagtggtatattttctccataagcccattgagaggctgagaatctgcttttctgcctctagattctaagttaagaagaacaagggcagggtgcatgtcattcctcttcaccattatatcaccagtggatagcatgggacctggaacaccatatatgtttaggatataattattgaataaataagtgttctgtagagaaaggaaagtggatcaaggtggaaatcatgtacctatttgtagtctactcaaagtatacaagcaatgtttgttgttgatgatgtgtttttctcatgataattgggttgtatttgcaagacctcacttatggaagcaaattaattgctatttaggttctctgactgctatttgggtaggtggcacagttggatgatagaaattatagtttttctaaccagaatctcttagtgacaacgtatattagatcagtgggtttctagtgaattggagtagaggtaaagtaatatcctatatttggattttcgaaacaacacctattaattatcctcctgcaccatcaccattataaagatgtggaaactcagtgtcagtaacttaccatgagcaccttactggttaatggtaccaccgtaactctgaggtaaatctactgttttacagtttggtgttcttggccacccctcctgctaccactaatcaacaacatggggatttgtcttggagctgctacttggtttcagtactgaaaaatatttcagggactctgtaaaattcttgatgggtcatcagccattgactaactcacctgaattccaactgtgtctggtaaagttctaccaaggatgaatgtattaacttctttacaagctcaaaaagtattagaggaggaatatgatattaccaagtgtttactgcccacttctcatgtagcataggggatatgtgaaagcatacagaaacattctgtacttttcaggagtttgcagctctgtacaggaggtcacatggaagtgcctggtatcttcagagaataacgcactatgatacagacatgttgcaagtatggcaagcatttaagtggtgctggaggtcggaggagggagggatcaagaagtaaacttcttgtgatgacaagatagtggcttttgggagcagacttcagtattctctttttgctctaactctccctttctgattcattttttttttctaccagtttggtggttaattagataagcagtgcccctacatctaccactaactcactttgttgatttcctattccacagtgactcctcagggaggaagataggtggtggagttcataataatggtaaatatgtagatgcctacaccttggggatacagattttggtacatgatattatggaaataggtgaacttagttggagaacagttttcaaaagaacaagctatgttttgatacgtgtggagggatttatgctgtccttgatatcaaaattttatgtttccataaatatgtgcctatttgtaagtagtatttcatgagggaattaggtggatggaagcgttgatagtacaaaagattttcccagtagtaacagttaatgcatgctttcccttatagcttaaaacaggtgaagggacttgaagtgagatgcttttacttgcattagagtagtttctctgtaaccatgttccccttcctctttattcaggttttcagcatatacaatatgtgtattaattattaggctttgctgtggggccattttttatgaacctccaaatgttgctgagtgtggaatagctctggggcttgataaaaacatggcctttattttcccaccagtctttccaaataaacctacctcataggaaagtataaagtggtttacagaagaagatttggaagccaagttcccatctttggagtcaaatggttcagcattctggcctggagaatggtgggtagaggggaaaatatgctcctttgtgcctttatgccttctcagactggctaacatcagagctgcatagcacatattctgagctgatggaattgggtaaaagcaggtttaatttgatctcagcactagatttaggagcaagtcaactctgaggaaagattcagtttcagcagagtggagctgagaagaaaccatttgttttcatgaaggaaaaataatctttgaagcaagacttctatccctctctcccttccttttttttttttaacttcagcttcattttcttgatctgcaaatctcaattcctcaaaatctcaagctatttttatgtgtctttttttcctttcataatgtataaacattagcaataaaaagtgatggatcaagttgttagaaaagggggcaactgtagctttttaggaccccaccttgaggaaatattctgttatttgaatccctcctggagtgtaaattccctccttaggtgatgaggtatgtataagtttgccgtaaaattatttttgttacactggggactcagatacacttctactcctactgctgggacttggtctgcatgaataatttgtgtgaacaagttgctcctgtctgtaaggaaactgttaaatccttgactttccagacacaaggatgtcatcttcaggatcctcactgacttatatggacaaatagtattgaaacagatgacaatctgaagttcctacagtaggttcaaaatccaggcagatatccccaacaaaagactaatgaaaaagtctactccgtatgagaaccatgccagggaaggtctttgaattcctacttctctctgttatgctaagctcagctatagatctcacttccatgagaacaaggctagtccttgtggcatttgcaaggaattaggctgggaatttgtggactatggttctaatttcatccctgacattaactgactaaccttgagaaacttgtttcacttttttgttttattttctctgtctataaaatgagggtgtaactacatctgccctagctgtttcacagagatattgtaagaatgcaacataaaaatggggtgttttaaaacctgttgaaagatgtaaacaaaagagacatacaaactaaaggtattgtcaggtatcattattgttaaatatttttggagctcttcaggagcaagttctttggcattgtctccctaaggagacaatggatatgagacgctatgaggaaaaagtaggtaataatacaaaacaggagggttggcggtggtagagagactctggacctttctggaagggctcaagtggctgaagggaaaacaaacattcatgggctggcccaaagggtaaagaaagttcctgcacccctaatctatgcattgtgcggtgatggggaaaatggtactcccattctttcagtaaaaatggttgatatctgaacccagctttggtgactcctttgccagtcctaagctagcactgctatgcaaaaagagacaacaaggggaagaagtcctcacaaagaaattcctgggttagggtaaagccaggaatgcaaaagcctaagggaaaagagtgttttttggttctttttttgtttgtttgtttgtttgttttgagatggagtttcgctcttgttgcccaggctagagtgcaatggcatgatctcagctcactgcaacctccacctcccaggttcaagtgattctcctacctcagccccctgagtagctgagagtacaggcacctgccaccacccccagctaaattttgtattttttgtaaagatggggtttcaccattttggtcaagttggtcttgaactcctgacctcaggtgatcccgcccgcctcggcctcccaaagtgctgggattaataggtgtgagccaccacgtctggcattgttcttcccatttcttctctcccctacagataacttaaaatcctttatctctccaaaagaccaagtaccatttagcaaatcctgctacctaagttgtaatgatctcttcagccccccccccccccccgcaaagtaatgtttgctatgacagaattacagtatgtctggaagagtttgtacttctctgtgatttggtacgaggcaatttaatctacgtgacaaagggagatatctgatttgtgggagcgctgcctcttttgatttccctctgtgctactgaaagaatggttggaatgataagaacagtatttttaaagtgtgttctgggcaatactaatctctaggtgttttttgtttgttttcagaaaagggcttctatggtcaaataaattgggaaatgattcatgctatgattccctctaggaaatgtgttgtgcatgttaggataccaaaagctttgagcagtttaacagtaaaggaatctgtttaactttgtttaatctagcatttcataaacttatttccttttggaagcccccttttcatataataccaatcactattaccctttaaggcctttaagaggtagattcattctcaaatacctgcatagttcagattgctatgccagacaacaaagcctcaagttagagaattcagtattgctggttagccttctccaaaattaaaattgctgtgctaagacaaagatagaatcagggcggtgatgttttctgtccaaaaaactattaaaatgttacagtgattcaacaacatcttcattatgagataggcaaacaatgaaagcggtccacacttattgcacgctcagtatgggccagccactgtgctaagcgctttctcttgttacttctaggcataaaaatgacccagcaagatagattgaatgagtcttcattttagagcccagggaactgagagctagagattatgtaaatcacccaaggccgcagacctagtaagaggcagatctgggatatgaatttcggtctgttcaactccagagtcgatgatttagatttaaaatatttaaagtcagactctgttttctaagtggaaaatggcatttcaagaaatctcaaaattctgtatctgaataatgtatcagctaagactctaaggcattcaggaggctgtcttttggttaaggggggctccacctgcatcgccagagtcagtctaagtataattataggtatcagcaacctagagaacagctggttcaatttaaagtgccctaaggatcacaagcatggtcctgtttacatttacaagctgataggccagttgctgtggctcatgcctgtaatcccagcactttgggaggccgaggcgggcggatcacaaggtcaggagatggagaccatcctggctaacacagtgaaaccctgtctctactaaaaataaaaaaaaaaaaaaaattagccaggcgtggtggcaggtgcctgtagtcccagctactcgggaggctgaggcaggagaatggtgtgaacccgggaggcggagcttgcagtgagccgagatcgtgccactgcactccagcctgggtgacagagagagactccgtctcaaaaaaaaatttacaagctcatttttttgcccacttactaagtttcaagcccatttccatcttctttcactgctgttccttgaggccacctctttaagccacttgcttgggtgcttataaatacaatgtccctcagatgggtacctttaattgtccctcctaatatcactaggtccctatccattcctttttcattgctctggaggggtggcttaaagccttattttgtggacataatgaaaacatgtccacatgcctctagactaagctgtctacaactgaagaaatatgacatccaactaattataacttaattttatcatacatttattattatatatatgttctaagtattttacatggatcaacttatttaatcctcatggcaactctatgaaggaggtactgttgttatcctcattttacagatgagagaactgaggttcggagaagttaagttactcgcctaagattacacagctagcaagctaagtctcaaacccaggtctatatgacctggtttgatgaataattaatggtattatgtgctattacttattttattatactagtcttgctgcgcctggattagccttcctccaaccagaatcttgcctttattgttagtatgctcattgcctcctcccggctctgccactttggtaaatagctgtctagtttgatggttctccaatgagcatcaatgtgtatcagaattacctggaggccttgtgaaaacctggattgctgggacccatccctagaacttctgacttaggaggttatggagcttggcagggggaggagcagtgaatttgtattcctgacaaattcccaggtgatggtccagagaccacatttcgagaaccattgatctcctgttaccactcaattaaccaactcttcttagaaactggttttctcttgagcaactcactgtttattaaaacagaactaaatgtttccattttgacttatttaaaacatcacctaaacatgtatatctccaagtgatttttaaattatttttaattgacaataattgtgtatatttatggggtacaatgtgatgttttgatctatctatacactgaagaaagattcagtcaagctaattaacatatccatcacctcaccaacttatcattttttcagggcaaggatgttaaaaatctattctttcagctatttggaaatatatattattattaactgtggtcaccatgaagtgcaatagatcacttaacttatccaagtgattttttaagagcagtttcactgtactgtgtcttgatcgtattcttgaacctaagtagtttggcatgcaaatgtgatttcagggatttacctccaattaattcccccaatggcttatagccacccccaccaccattcacatcatacctgaaagactttatgtgctatttaacttgattaaggaaatggtaaattgaagcttatttactacaagaatacttagtgacaggcaatatggcttggggattaagtacagggacattgtaattagacttgggtttgaatctcaactttgcctaataactagctgtgtaactgtgctcaagtgaagtaacttctctgagctctatttcttgtacagtgggagatgataatgaaatcaccctcatgaggctataaataagattatatatgtatagcataccctatcatgccaggtatttaaaaaaaaaactaaagaaatagctggtttatgttagtgattgcaaacctctaatcttcaggcctgtgatattccaaaaattgttgcaagagatcagtgacactgtgtgcataccaaaataaaatctcaaagatagaattaataagaagtagcatgtatagatgtacaattcatttccaatctaatctatgtagatgctgatttaattagtaaaatacaaattcacttagaggtatgactaatgatatgataactttctgtcattatgtagtacattttcatcaacagatattaaaagaccaacttttttgatatttaagaaaaatcttcacactttaaaaagttgtgaagcactggtttatctgaatagtctgttaatgcactatcccccagcagagagcaggcctctgaaagaggggaggccaggtcagctttgatgagcaaaggagacagaggacattctagagcatggggtgttgcttaaggagagcatgatgtggagggctggctgctgtagtgggggcaatctgagaaacccagggccagtgggaggatattagtcagggaagagcaggggcaataatgccaagatgtccagggaatctaccaaccagctaatctgttcctaggtgactaaggatttcaagtgaacaaccagccacaccaatagtgtatctagctttagagaaggactatgcgaattcattaggatagcagagtgtgtcttcctgaaggacttgggtgcctaaagtggaaaaatgcattgttgctttattctaattgcattattcagtcaaatcccttcaaaatgatcagcaaacagcccctgaaataggaaagtattggtggcaggagtgaaatttagagttgttttgatagaataattttcttcaggggtttgggctctgattgctacttagactgagtaaaagtattgctgaataaggtgctgagtaaatgcaagttgtcattaagaggaccgtggctagtctcttaaattatatccactattcagataaatgttgcatgccttcctaatagtctgcttccttatcgacttgagcatttagttgttgttgttttttttttgtttgttttgcttttttatttgtatttatgtaagagaaaaagggcaagtggtactcataacatcttgccagagcttcatagatgacatgagtatttgtaaatagggttggagttatatatattttcctagtctagaagtgcaagcttaagtttgcattcattatttgacacagtttggttatggtaatagtatatggtttggtagcagtttaggcttgatttagatgagaaaggaacaattgtgtttcatgtttttatttctaggaatagctgaattcagtttcatgtaattggtactcagaacacagctatccaagcctttctttatagtttctcttccatgtttccatttttatttccacccactcctatatagggcattaaaaaatgtatctctataaccatttaaaaacatgtctgtaaattttccacccagtagattttacaacaaatattttttctcaaaatagcttcgccctgcaacccaaaacactcctgaattattttgcactcatatctacccttcctaccatcccttaataagggctcagagaatgcagactcattaacatcagcctaaggaaaacagcatcacaaaaatcagtccaaggccaggcgcggtggttcacccctgtaatcccagcactttgggaggctgaggcaggcggatcacctgaggtcaggagttcgagaccagcctggccaacttggtgaaaccctgtctctactaaaaatacaaaatttagccgggcatggtagcacatgactgtaatctcagctactcaggaagctgaggcaggagaattgcttgaacctaggaggcagaggttgcagtgagctgagattgcgccactgcactccagcctgggtgacagaacaagactacatttcaaaaaaaaaaaaaaacaaaacaaataaaaaaaaaagaagaaagaaaatcagtccactttcaaagaaaagttaaaatatgcattgtaaaactggatagaactgatttgtacgctttttttgtagttaatacttctatgaaataatatatttaataaattttatatgactatcaccatttcacataattgttttcattggtgtgacggcccgcacaattttaaatcatttcagccgctgtatgcacagttttgtattttgctttttcaactaacacagcagtatttttctatgtttgttcatagtacaattttctaatttttaatgtttgatattccatcttgtttattcagcataagttacttagccattcccattatctgttgtattttaataatttgtgaggttattcatttattttctattaaagcagctaggcaaaagtttgactttacagtcactgtcctctagaatatcaatccctaagtgtttctgcttgactgttctaactctcccatttctacctgggtcaatctgaattctgccacgtaaaacatggttacccagtgaaagatctttacacacagtatattaggttgctaggggaaacttacagtagcaagctttctgtttgcttatttcacatacattctctcattaattcttctcaatgtgtctataagaaggtattgaattatttacaaacacttgggataaagaaggaggataggaagagttgcctgctgttggggaggaagaaaggaaagaataatcgaggtgatggattcattaagttcataacaagctgtccttgcaggaggtaagtctgttaggatatcttcttttcctttcctaccctaactctaaaatttcgtctggaccaactcttctgcctgaactataaacctccaccctgtgaacaatgtattaattttcaaatatttcttgtgtaggtgaatacaaccaccttcatatccacacatgtctgtgctcagtttggcaatgaatcaccttctaaacatccagaacaatcagtcagataaggatcacctttgattaagatcttctctgccaggctctattggaataggtgccagcttctcactacttagagcttacgattgtgcacaatgacagctaagatttgtctgggcaggaacatatttttcccactcttaaagtcaacatttgaggtgtttctaagtggaagaaattccctttgctcattctgacttttcattcagttcaagctctccatcttttgtaagaaatgttgttctccatcgtgctgaagcattaggttgctgtttccccaggccaatcagtctgaagataactttatgatgctgctagagcatgacaccatagtttatccattcttccgatttcatcagggtgcctgacgcttgttagacaactttggggatgcagactgtttggtccagccttgttgcaatcagcagtttttagcaaggattacctagacttatctttgagatccttgataatttaatcagtaaaaacacgacatggccttttgtaggctgcagtgagtgcagatagagtgccacaaaggcctctggcacgctgcaagagtaaaaggtggcagggcactacctgcccactcccaaatgctacatgcttcccctctaccacatgcaaatctttgcacttaatcatgtcattgccaagtcccgcttctggtactttgtatctcagctaaagaagatgaagaagtctttgggggaaattgtcttgtgtgggtaggtatttgagcaattctgcctgcaggtgaagaacttcagcttgtggctgcaccacaactcatgcagtggcacccacaacatgtaccaggaatacctggactcagccactgggggtgctgtcacccagtactacagagaaatgggtgcccagcaatgtggttgggcccactggatccagattgtgaaggtagaagggatcttggccagcaggtgccagcaatcaaacagttccacaactccaagatcaagtttgtgctgtcccaccgcatcctgcattgtcaacacaagccacacttcaccaccaagatgcccagcccaacaccttcttttaggtgcagggccctctcactcctggtctgcccaaataagcccaaaaactcccaggcgctaaagaaaatgcccaggacatggtgttgaaatatgcaaagagttgataccatgtgggacatctgataacgttagtataccacaatagtctttattgttgtggacacagagaaggaactcaaagactctttttgatgatcctgacataatcaggaggagacagtgaacaaactttatttcacaggaggctctgatgatgagtggtaaatttaggatatgttcaagattattctgctttcctccctttacaataagtcaagtattcattaagcaaccactctatttaagaccttgtgcaaagcactgtgggagacatgatgatctattaaattgggttttcttctttcaaacttaaattctagttggagtgacaagatctgaaaaattaggtaacacaggagataaatagttcaaggcaataatagaagaggtgtcatgagacaaaacattattatttgacaaatgaatggcacagacaagtgttctagaggttgcaagaagatagagctgagaggcatgctaatatagtgcctttttctcctgctgttttctctgcctaaaacgtccagtgtatacatccctctccacctgtaaaattcctatttctcttttgagatacagtcattgcctattcagtgcaatcgtcatcagcccacccagagttaatcacattacctctcataagcccatagaatcttagactcactgagagtataaaagcacatgttaatgcctagtgttccattattggaacgctaagcatgtgggaattatttatatcctactgctcaaggtcatcaccacggtctgattgaaaaattaaattgcaacctcaggtataaatgggtttattattcactgtaattattcacttacacattggattcctctaccagactgagaccttcaagggtaggggcaatttgatagtaatttatctttctgtcccaagaacctaccttagaattggacacatagtgttcagtacatttattgaaatgaaatgagtgtagtggaaagagtactggacttggaatcagaattaaaactgtcctgggcttggtaaatgtttgtttttctgaaatgtgtgtcatgtcacctctctgcactgaataaaatgatctctaaagttcttatagcactgaaaactgtgcaatcctagcctgggagtagttatcaaaggttttccataattgctgttgataataaataataatcacaacagttaacatttactgcatacttactatgtgctaggcatagaacatgaattatgtccttcaaccctcaaaataaccctatgtggtaggtactattacactcattttccagatgaagccaagactccaagaggttaatttactagaagtcacacagctagaaactgttgaaacagagactctagttcaaatctttttgaacctagaggcctttgctcttaatagccacactagtcattctcaaccctggctgcatatgagaatcaccagggagtttttaaaaaatagtgatagccaggcccaactctgcagagattctggttcaattgatctgggatgaggactaaacattggcagcttttaaaagctccccaggagattctaatatgccaccaggtttgagaactatttcattacatttttcagcctttgagagtacacctgggccttgtaaaagtttgcagtttagatggacaagagaaagaaggacattctgggtgggaattctgtttaagctttaaggtgatacacaactatctgaatgtgtcttatttctctgaagcaggtgccctttgttgtatcaaagctacttacagctgagtatatataggccagacttagttcctgatgcaattgcatttggaaacagtttcaagagtttcctcagttcagaaagggatggcttctgcactggctgctattaggtcatctgccactcttctgacagaggtcaacgggaaaaactacttccttgtgtagggacagcaggttggttctctttgccccatacagtagactgaaaacctgtcagtttctaagcaaccgtttaaatctggaattcatgaatcagattaccttactgagaaagctggaatgaagagaattttgaaaaagtcatggaatggcttccccctcctttgtggtacaacacttgccatggggctggctttacagcattcttgaagacattgttctctggtcactgcagtaaaagaagcagcttatttggggttttgttggctgctgctgctgaggttggggatagtttcctgagaatggtatacctgagaggatcgagaacagcaaagaagttggtagtaaaatgatattaccttctgcatgtggccattgagaggatttactgagataatccacgtaaaggggttagcatagtgcctggtccgggggtagtcctctgtaaatgctgttggctgcttgtatttctgtgtatttgtcaaaacaggatagtgataagatggcagaaagatgccaacagatacagtttgaggtgatgtttcttttatgacaaaggattagaaactagagggatggtatgaatagcagcagatagggcaccatgcttcctggtgaaagcatggtgctcaggtttctgcaaatttccttgggggtatgcagctgtgggtgacaccacttgcttgaaataaggattttgtcaggatctagaaggtccttttgccatttttactatattttattttaatcctttcctgttacttcccgactattttgcagactctgactacaaatctacctactcaccaaggtcaaataaatgaccacaactctttcacattcttaagtatttacgggaataataggtgaggggaagctcactttgcaggaaacatcatttagtgggataggcctgtttgaggtctacccctgcagggctctggtgatgctttggaatagggtttatctttatttggaagtagtaagaccttggcttcaaatgagaacaaaacatctcttaggagagttttttcctttgaaaatgctcaatatacaataatgcaaacttgtaaaaattttaattagtacagcaatgtataagaattaaaaatccatgttctattttccacaagcccaccatcagtctcaaccccccagacgatcacggttaactcttcatcatgcatccttccagatctttacccatccatctataaataaatatatgtacaaaaataggattccactatagtatatagtatccgttttccctctcacataacaatatgtcttggagattttttctatgttaatacattggtctctgtatctttttttttaaagcaactatgtaatataaatggacttttcattttgttccatttttttctttatgaacaaaacatttttaaataaaaacagcacttatgtgttaattcaattatctaacttcatacagccaataagtggggaagtcaagatttggaccaatgttggccgattccagaactcatggtattaactgctaggcattgctgtcatttccacaaattattttcactctagttttctaatgtaagcagtagttatgaggcaacaattaaatctcagagttgaaaggaacctttaagacaggttatttagtttaacatctcactctgcaagcaaattattagatgtttacttattaggaaaaatcattcctgaaactttattttggccaaataaaactccattaatttatttgcatttgcagtggtagaaactgtgggttgcttaaacaatagtttgtcttgcctcctttatattttatatcaccattttttcatattatcataaccctctgacataggtagagtaagctattattatgcccatttcataaatggggacactaaacatcagggaaattaagagacttagatttatacagtcagttgtggaaggccacttgaatggcaggcaaaggaccttagactttcccctgaagggagtgaggagttattgaagacttttgagcaggattgaggttatgggtttaggtggatggaggtcagtaggtggtaacatgacaactggaaaacattaggaataggagtcgcaagagccaagttagcaagccaagtcagccattcaagtgcaagtagataaggagcatgattaatcttgatagttatcaggcttgaaaggagaggatagatataagaaaaagtaagaagacaatcttgcgggagatgggggactggagagagaaaagaggtaaagatgattccagagatattggccagaagaaaatcaatgttggagggaagagtagtttggattagttgttgaacgctggcagttagatatttaagtagaaatgcgaagcaatctttggaaaatgtaggactgggacttgggtgagagcagttctgaggttcagcatcaagagtggtctaccttcacagagcttttcacacactcagcacattaagtctgaaaagggatcttaaaagtcgtgtacttgaggtccctcattttacagataagaccaatagatgatataaattgcctagggcttcacacagttcctgagaggtgatgataaatcagatcttttgagtcttagttgtttacttttacctgaaaacgagaagttgcaaactggtaatggaccactgatagttatgtttggccagtagggttatattactgttcacaaacacttgatgcctctctctgctccgccttccccttaacatcaaccttagccacatggcttactttggtcaatgaaatgtgagctgggtcaaatggtatttctagttctagatccctgaggaattgccacactgacttccacaagggttgaactagtttacagtcccaccaacagtgtaaaagtgttcctatttctccacatcctctccagcacctgttgtttcctgagtttttaatgattgccattctaactggtgtgagatggtatctcactgtggttttgatttgcatttctctgatggccagtgatggtgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttagttagatcccatttgtcaattttgtcttttgttgctattgcttttggtgttttagacgtgaagtccttgcccatgcctatgtcctgaatggtaatgcctaggttttcttctagggtttttatggcgattcctcagggatctagaactagaaataccatttgacccagccatcccattactgggtatatacccaaaggactataaatcatgctgctataaagacacatgcacacatatgtttattgcagcactattcacaatagcaaagacttggaaccaacacaaatgtccaacaatgatagactggattaagaaaatgtggcatatatacaccttggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagagcacatggacacaggaaggggaacatcacactctggggactgttgtggggtgaggggaagggggagggatagctttaggagacatacctaatgctaaatgacaagttaatgggtgcagcacaccagcatgtcacatgtatacatatgtaactaacctgcacattgtgcacatgtaccctaaaacttaaagtataataataataaaagaaaagaaaagaaatgtgagcagaaataatatgcattatttttgagatgagcattaaggcaaaatttaagtgtataatccaccagattttcttttccttctatcatgaggtcatcaatattctagatagaagtagctctgtcagcttgaacatgatatggaacagagacacaacttacctatgatgggagatgatatgcgtaacaaaaaaaacttgttgtaagctaagatctcagggtcatgtgtcaatgcagcataacctagcctgtcctaactgatacagcctacaacattctgaaaaactgaatcagtggctaacattaaaaaatttggagagttaacagaaaaatccagacttcgggtttctgatgagaaattggaagaggtggcaacatttagccaacttacatacacatggcatgatttgtctgaggctgcatagcagttcttcccttagaaatttgtgttgagtgtagttatacccagtatccactattcctaattgtatcttatacccacccattttttctttatttacatttacatatttacatattacatttatttacattatctgcctgggccttgcaagcatttgaatctgccactctggctttattatagctttccactcctcagggagaaaatgctagagacaaaaacaacagaggactggagacagaaatttagatagtacctacctgtaagtgtgagaaaaagaatcagtagagagacaaataataactgcctagaaaagtaacagaaaaaaaaccctgaattgcatagtgaccaaaacaaacaaaaaaacaaggaagagtcaggaaagaggggatgatcaacatcaggtaaaactacagagttcaagaataaagacagtgaaaaaaaagcaggtcacatgtaacccattaaggaataattgcagtgctttggtgattacggaagccagaggataagagattaaggggaaagtgctgctgagaggatggaggcattgagataatttcttttttaatgtttgctattgaatggaaggagaaaagtaattggtctctaaaatggcagcagaatcaagccaaagaggatttttccccctctttttttttctgtttttgaaagagggacaaatttttgcaaagcagagtaaggaggaaccaggtgattgagggagcaaagtgtgggagatgtctgggaggtgtggatggagaacacatctgatgcagttattttagaaataagggataatagactttcatctaagtctgctgacatagtgtatggggtcttagcgaatcatcagaagtgactcaaaagaagcagtgtctgggtcccacaatgggtattgggtaagggaagaatgatgaccttgtctagaagttcattgaaggtctgctgtctctggttacagttttgaatgaagagcagacaggcagtgaaggatctgatcactgagagactgaacgctgtttgtggcaggaacctgagccctgtgctcagatatattcttggtgctattctggccctcttttctgtcagttctgcaattgtactaataagaaatgtctcttgtctcccataggttaatgagtttggggaggaaaaatgcagagtttactatgatggcaggaagggcaatgcaaatggcctgctgagaaacttgaaatgcaccgcagggctttgaatttcatttcaaccgacaaacattctgctcatcaaacagcaccccctgaagaagcaatacagaattactaaatatactatcagtagtttccagcctgtgatcctagacccctggaaaccctgctgatggtctgcatacagagtcctacactattagtgcttacaatatgatagtgtctatatttctgtcaatgacataaaatggggacttactaatgctatattaccatctcatgattatgcttgggtttggaaaaaaatgcaactgacccatagaccttccctgtaatgcaacaaaaagagagccactctgtgtcatgatgtttatggagaccatgctgtcattcctactatgaccacaatgagagtattaccagggacttcctgatggggtcttagtgaagaatgaagacaagattgttctgtttttttttctgccttaacaagagcagcagcacttatctcactacatccagtaaagtctgttttgtggaggcatacaggtggagaggggacttggagatgaaagctggtaataggtggcccataggatcatttgcctatggaagggattgaagaatagaaacaaaattatagtcactatttaagtgttatggggtttgagttatgtgtccattctgtcagcagattcatttttctgagtgttgaatggggccacaatatagaagaggagggtagtgtggtggtgggaaatgtcctgcctcgggagggagggaaggatgtgtagagaaggaggggcctgatttttggactgtagagtaaaagcaaagagagaatgactggttttcaactgtgtttgactttattgttcttatgtcactggactatgctaggcacaaaaattaagaattagcaaaatgagcaaggcccatgttctcttcagcttattcactcaactataacagtgacacttggtgatattctattagcgaactagattacttctcagaatagcaactgttttccttgattacgtgaatgttgtaagtgacgtactgattcatacttttatggctggcctcatatgggagattgaaaaatcctttctgaggaagtggtatttatacagggacctcaaggatgagtaggagctagtcagcagtggtgggatggggagaagggattgctttaggaaacagtatgcatgtacaattgccttgggaagggaaagagcaaggaatgcctaaggatttcagagaagatcagtggagcatggtgaacaaataggagagtggtatcagatggggctgaaaaggtagacaaacaccagaagcataaagatttttttttgtgggactcagctttgagcattcattgaaagcaagtttatgaatattgttagatacattgtactagaaaatcttcatattctcgggcttgtgttgtatgtacagtcactcatttgatcattcattccaacaagcttatgttaaatatctgctatatgccgagttttttgtgccacagagttgtatacctcccagatctgtgtaaatttcagctgccaccaacaatgtggtcactttttcagtcctttccttaggatagcatcagactcagcttcttttcattattattatcttaggtataacattgctggtttgaagaacagggcccaatgccagtgacctctgctgccagctatccagaaaatgttttccaagactctcctggtaggcaagagcaggagagagaaaggaaactgcagctgtgtcttcatgccagtaaagcagcatttggggagttattaggcttagttcttacagctcttttcaactatgagctttgacaaagagtctgtaattgtcattttgaaggtcggtggatgtcacttccttcctccttggtctttctagtttttctttatttagactctgtttttttccctgctgcctttttaaatttgttccatctcttttattcagttatcctagccatctctctgagcatgggtaccaggggtaaggaccctgttctcagtaacagggaaagaggagctgtactcagataggctagcactgacccaggaatgcacctctgcagacatctttatcctccttcacaaatagtatttgtgctgaaggaatcaagtcaatggcaaagaaaaactggctttcttacctggatacctatttaagaagttttctccacttactctggccattactaatctgacctttctctgaactgtatcgtacatccccactgtgaataataaccatatgatttgcctcttgatgatttattgcattgaattagtttctgaatatttagtatttattgattttgtttccctaacaggatttgaaactcccttgggaaagggactataaccatacttatattttatcatcttagagatgagcaaaattgcaggcatgcagtttagccactcaatggatatttgactgatttaacgagacctgccaccttattgtacaaagcaatctaacatagaggaagacctttagattcccactaccatttctttgattattaaaagacagtagaatttttgacaatgattctattgtcaacctccctcagttgtctttctactggtagacctgtatggaggcatggatttagatgaaacatctatttctttgtgtcaaattctgctcctttgtgtggcagtctgcattatacaagaatgcgcttgccttatttctacatcaaagaaagtgagagccaagaaatgttcttaatgagttctttttggttcttatgccctctgaagcagcccaggaggaagagaggacaataataggggaggacagcaatataggaaagtaggaagatggtataaatgaaagggacagatgtcacttgaggcctcaaattaacttcatcagatctttgaattgctgcaaataaatggcaagtgcggagcaaggagcagtatgtgaagaagacattctttggtcttggcagcctgtgcttgtataacaaagatgagagatggagttgctagtattctctgttgaagatgtaggagttcaatagtggagaaaaaagaaaaatctaagaaagcaaataattgggatagggaaaggggattatgtttgtttcctattgctgctgtaacaaattacaacaatcttggtggttaacacaacacacatttattattttacagcactggaaaccaggagtccaaaatgggtatcactgagaaaaaaacaagatgtgggcagggctgcattcttttctggaaactctaggggagaattagtttctttgtctttttcaccttcttgagggtgcctgaattccttggactgtggtacccttccatcttcaaagaaccaactaactctggacaaactctggtgaagagtatgtagatgacataggagatacagggcaggaaacactgagtgaaagccaatgaccttctgaagatataaaataatttgtaaattttatgagagacaaatggcttgagagcctagtcatgctgctttaaaataattttatgttttttaatgcatatgaatacatttatacatgtaatgtgtgtctgttagagtgaaagttgatactgtttagttctgtgatttaagacatagtataagataaagtccatggacacaattttgtgaataatcttaaacttacccttcttttcccagagctaattgtttaatgctttcttcaccctctgctttatagccttctgtttcattctgggacacattccacccccctcatttttttttttttttttggttcctagccttttccctttgttcctctgctgacatcatacgtgtttttgataatttaataaaatacatagagtcaatcacagcatatgtacatttttggggcaaaaattctgtttaggaagacttctaaaatatttcattccatgctagttaaaatttaagtttaaagataatatttttacagtccctgtagccaattccctagaacctctttaatttatattctgtttctaattctacttctgatgcttcagtgctctgacatgtggcctgcttagaaaaaaaataactttgttgaggatactatatgacttgtgacttttccctaacttgctttggtcagagccatggatttaatttttatgtgggctacagtgtaattctaattcatgactatagtctgtactccttatcctgggttattttacaaaaggagtttagattaaccaccccaaagtgactagatatatgcaaggtttctatttctattattggagaaagaactcctgagtttctgccctactgatagtgagtcaatactccaataattgtacatagaggaaggcacgcagtgagcccttcagacaaaatgctttcatcagtctccttagtctttgattagtccttccttccttcctagaatgacctcatctctctcagaatgacttaaaaagaagcatggctttaaaaaatgagaataactgctaatgactttatgatcctgaggcaaagttttctttgcacaataaatgcttagttatgatttgatagtcaaatgtcgtgatggaaaaatgtatgataggcagtttgaatcagtgtagaaaactcagaaaagaggaggtatagcccaatggttaaatttgggggctctggaatcattaagagttggtttgggttctaagctcaacacttaatggctttatgaccctaaacagttacttaacctttctcaacttaactttcaatatgtgtagtattgcctatcttagagggttaattgcatcacagggagattttcattgaaggttgtttccctaagtaacttggtagctgctttgaagtttcactaagaaatcaacttgcaaaaggcagataataggagaaaagacatatacatttatttaacgtatgtacatgggatcctttagaatgaagaccaaaagatacagggggaactcttaatttttatgcttaggttcaacaaagtatggacagctatgtagaaacatgattggacaaaaagtgtatgatctaatgaataggttgagtggggaaacccagcaagtcctgtctgtctagattcttcttggcctctctgagcacacagttcttccttctgggcatggggcaggaccctctctggaatggaagggtcttatgagctacagccaaacaaggtaggccagataatttctttatggctggttttgccacagaaagtcagagggaaagttaaagtaatatttttaggttttatggctggcttgggggaacatgggttctggtttccatgacctgccttgaagaagggtgattctagtttctatggcaagcctcgagggagaatggaactgtgagaaaggaggatagcagaaggttaaagaaaaacttgtatctgaggctgatcctgaggccttaattttggggcattgttctctgagccccaacactgcccatccaagaaatttaagtgcagagacacactagaaatgaaacagaaataaggcagcctaatgtagttgctcagtggatgggctctggagctggattcaaccccatgctttaccatttagtagatgtatgacttcaggcaagttactttaccttctgtacttcaattttcttatctataaaatgggaacaataatagtgcctacctcaaagccttggtatgaagattaaatgaatacagataaaataataagcacagtgtctgacatttaattgatgtttaagaaagactatctcttcttattactgaaactaatgctgttagtactattaataaaaagatgatatatatagagatacaaggaaggatcaaggatgactcctatttttcaagcttgagcaactggtcctgtggtagtgccattcattgagatggggaaaagtgaaggaggaatagattcgggcgtgtgtttagtgaataacaagttttgttttttgacatgttgagtgtgagatgcctgtggaatatcagtatatagttagtcagttttggccgtgcgcggtggctcacagctgtaatcccagcactttgggaggccgaggcgggaggatcatgaggtcaggagatcgagaccacggtgaaaccccgtctctactaaaaatacaaaaaattagccgggcacagtggcgggtgcctatagtcccagctactcgggaggctgaggcaggagaatggagtgaacccgggaggcagagcttgcagtgagccaagatcgcgccactgcactccagcctgggcgacagagagagactccgtctcaaaaaaaaaaaaaaaaaaaaaggtcagtttttctgtgtctggagatcacagaattgtgatccaggaatgtaatcttgggagaagtaggtattctgatttttaagattatgatagtggatgacataaccaagaaacataatttagaaagagaagggaggagagcccaggatcaatctcggggccatagagggtgaggaatcagtaaagaaaatgaatagatatggaaagaaggtaggaaggaaatctacctttcatgacagttgagacagaagagtgtttcaagaagagagtaatcaactgtgtaaaatcaggacatagaaacatcaattgaatttgactcctttgagaagcttggttatgaagatgcatagaaaaattgaatggtggcctggatgagtcatcaaggaaggatctattttttataatatagaaagttatagtggatgtttatattgcaatagagacatacactagaaaaggagaaattaaagaagagaaaacaggagggaatgggatccagagtacaatagaggggcagggatacttcctatatttctatgagataaagtacatagcacaatgcctggcatatagtaagtgttcaatgaatagtatctgtcatgtttattgttgttgttgttactgtattaactcaagagcccaagctggcttgcatgtggaaaagacagttggagcatgcacagagccaatagccttcatggaatgaaaggccttggtgagcagatagcatttagagtgccgtatcctaaacaaaggcaaaaaaatgtggttccaacatacacagatgcttctcaatttacaataggattacgtccagataaaccaatcgtaaattgaaaatataaagtcaaaaatgtgtttaatactacaacacagcagatagttcccaacttatgatggttcaatttatgactttttcactttatgatggtgggaaagcaatacacattcagtagaagctgtaaccccatcctaagtcataaggagctccttgacttatgatgggtttacatcctaatatactcattgtaatgtcaaacaattgttaagacaaactatcctgaatcagaaactgtccggaaaagcatttggttaggttggcctatctaccctaaccaattttttttatatcatgggaggatgggaggtttctttgattatcatatggatgaaaagataaggtacttttattttagcaactgtacttcaaagaaatgactctaagaaatgggtagatctagttctgttgagattcactgatcagcacatccctggagaggtagccaacactctcctagtacacgttgtccctataacatgtgtgcttaaaggagaaatgaagtgtacccattgattatatttaccttagcaaaatgtgcttccatatgataacattatgcggtaaaaatgctttgtgatttacactgtttgtgtgatgttatgttctcaatacaatgagctgaaggcttttggctattattcctttagaaacaagcacctcttgttgagggctgattttgtccatattatcttgaaatgctttttgcctattcatctctaagtataaatatgagggtttttttttaatcctgcaaaatttcccataaacgtgtgtttttaaatctttcctaaagtggtctttatgcaaccaatagaaatcttaaatatatgatcagttttccaccctgtgttctctagataaagaaaagtttgactggtattagatatgaaaaatggaatgtgctttaaaattttcaatctgtcatttgagatcaatatcagagacagatacctattagactctttccacaactgtctcttatcgttgttaaagtttataagaagttacctggccaggaaatgggtttcactggttttaaacatccgttgttattggtatcatgtatctgctctcctgagtactgagcccagccatttggtttatgtgagtttctagactcctgtgtatttgccttactctctaggatttaggcttttttggttcccatattttgcttggtctagcctgtcacactttgttctttgtacctttagacctgtgtgtgcttgcttgatttaatttattatcttgtctcaactgctgattcagctttgccttctgactcttgagccctgggctaattctcatcctaaagcagcaggttttgagccttgcctccatgctacattgtgacctcagcaccagcattgagagctggtctaactcataggtctaactcagtacaacatttctgattttcatagcagttgcggtagaataaaaagaatactgtgcttaatgtttgaatctctgggtttaagctgtagcactgccagaaactcactaaatgcctatagacaaatatcttagcgtctctgaatttcagttttctcctttgtaagataggaataatattctccttactcatttttgtgattaaataagatatcttatgtaaaaatgcctaatgtgataactggcaaatgtttgtaaaatatttaatctcagttttggacactgtgatactctcatatgtttctttgtttccattattagcctgtttctttttataagcaattacttaatttatttccatgacaaataatcataagtaaaatgtatcagtccaaaagttttctggtaaaaaatcaaagtgaaattacaacacaaacttattttaacaaggtcccaagtttcccaattaacttgtctccaattcttatgtattctgttcaccaattgcattatatctcttctgaaaacaattaatatgacaacttgtaaatttctggcaaagaaactgagtatctagaactgagcagaaatatcacagtgattacaacaaattatttttgtctatttgcttgtaaatctgttttttttttaattttttattataccttaagttccgcgatacatgcgcagaacatgcaggtttgttacagaggtatacgtgtgccatggtggtttgctgaacccatcaacctgtcatctacgttaggtatttctcctaatgctgtccctccccttgccccccacctgttgacaggccctgatgtgtgatgtttccttccctgtgcccatatgttgtcattgttcaactcccacttatgagtgagaaaatgtggtgtttggttttctattcctgtgttagtttgttgagaatgatagtttccagcttcatccatgtctctgcaaaggacatgaactcattctttatcatgggtgaatagtattccatggtgtatatgtaccacattttctttatccggtctatcattgatgagcatttgggttggttccaagtctgtgctattgtgaatagtgttacaacaaaaatacatgtgcatgtgtctttgtagtagaatgatttacaatctttggttatatacccagtaatgggattgctgggtcaaatggtatttctagttctagatccttgaggaatcaccacactgtcttccacaatggttgaactaatttgcactcccaccaacagtgtaaaagcattcctatttctccacaccctctccagcatctgttgtttcctgactttttaatgatcaccattctatctcgcgtgagatggtatctcattgtggctttgatttgcatttctctaatgaccagtgatgatgagcttcttttcatatatttgttggacacttatatgtcttcttttaaaaagtgtttgttcatatcctttgcccagtttctgatggggtgtttttttgttgttgttgttgttgtaaatttaagttccttgtagattctggatattagccctttgtcagatggatagattgtaaaaattttctcccattctgtaggttgcctgttcactctgatgctagtttcttttgctgtgcagaagctctttagtttaattagatcccatttgtcaattttgacttttgttgcaattgcttttggtattttagtcatgaagtctttgcccatgcctatgtcctgaatggtattgcctaggttttcttctagggtttttatggttttaggtcttacagttaaatcttcaatccatcttgagttgatttttgtataaggtgtaaggaagggatccactttcagttttctgcatatggctagccagttttcccaacaccatttaataaatagggaatcctctccccattgcttgtttttgtcaggtttgtcaaagatcaggtggttgtagatgtgtggtgttatttctgaggactcagttctgtttcatttggtctatatatctgttttggtacaagtaccagtaccatgctgtttttgttaatgtagcctggtagtatagtttgaagtcagttagtgttatgcctccagctttgttctttttgcttagaattgtcttgtctatatgggatcttttttggttccatgtgaaatttaaagtcgtttttttcaaattttgtgcagaaagtcagtgttagcttgatggggatagcactgaatctataaattactttgggcagtatggccattttcacaatattgatttttcctatccatgagcatggaatgtttttccatttgtttgtgtcctctcttatttccttgagcagtggtttgcagttctccttgaagagttccatcacattccttgtaatttgtattcctaggtattttattctctttgtagcgattttgaatgggagttcattcatgatttcactctctgtttgtctattactggtgtatagggatgcttgtgatttttgcacattgattttttttttattatactttaagttttagggtacatgtgcacattgtgcaggttagttacatatgtatacatgtgccatgctggtgcactgcacccactaactcgtcatctagcattaggtatatctcccagtgctatcccttccccctcaacccaccccacaacagtccccagtgtgatattccccttcctgtgtccatgtgttctcattgttcagttcccacctatgagtgacaatatgcggtgtttggttttttgttcttgtgatagtttactgagaatgatgttttccaatttcatccatgtccatacaaaggacatgaactcatcattttttatggctgcatagtattccatggtgtatatgtgccacattttcttaatccagtctatcatcgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtataaaagtgttcctatttctccacgagactttgctgaagttgctagtcagcttaaggattttttgggctgagacaatggtgttttctaaatatacaatcatgtcatctgcaaacagggataatttgaattcctctcttcctatttgcataccgtttatttctttctcttgcctgattgccctagccagaacttccaatactatgttgaataggagtggtgagagaggtcatcctttccttgtgctatttttcaaagggaatgcttccagtttttgcccattcagtatgatattggcggtgggtttgtcataaatagctcttattattttgagatatgttccatcaatacctagtttattgatagtttttagcgggaagggatttgaattttatcaaaggccttttctgcatcaattgagataatcatgtggtttttgtcattgtttctgtttatgtgatggattacatttattgatttgcatatgttgaatcagccttgcatcccagggatgaagctgacttgattgtggtggataagctttttgatctgctgctggattcagtttgccagtattttactgaggatttttgcatcgatgttcatcagggatattggcctgaaattttgttttgttttgttgtgtctctgccaggttttggtaacaatatgatgctgacctcataaaatgagttaaggaggagtccctctttttcaattgtttggaatactttcaaggaatagtaccagctcctctttgtacctctggtagaattgggctctgaattagtctggtcctgggcttttttggttggtaggctattaattactgcctgaatttcagaacttgttattggtctattcagggttttgacttcttcctggtttagtcttgggagggtgtatgtttccaggaatttatccatttcttctagattttctagtttatttgcacagaggtgtttatagtattttctgatggtagtttatatttctgtggaatcagtggtgatctcccctttatacttttttattgtgtctatttgattcttctctcttttcttctttattagtctggctagtggtctattttgttaatattttcacaaaaccagctcctggattaatttattttttgaagggtttttcatatctctacctcattcagttctgctttgatcttagttatttctttttttcaaatcacactatttattgccatacagtttgtttctcttttcttttggttcacaatgcttaaatggggaggataatgaaaacaaatctcatagggaatataccctatagacgaaatacattaactacatagtgagttccgaaattattaaagtctagttgctcagttaggatggaagcaggcctctgtggaaagtatagtctaattaaagtttgaggtgtgccttataccaggggttctcaggggagatgatctgacctgacacagcagaggttcctagatgctaaagggttgttctggtgttggtgggcaaagctttgggggttagctcaaaggcaaataaggtatggccctgatagcatgagctctccctctttgagaggccgctaacagtgcagccctgctagggcctaagttctcaaactgtctgtgaaacttttaggattatatgtattttggattccagtagttgaggtcaatagctcagatatggggcctgataaggtatggcctaacattcttgaggggagagggcttatcacagcaaaacatgtcactcatttagcaaatcatataagtgcttggaattattttaaggctacaaaacaataacacaacatgaatttctccaagtgctctggaatatatcattgttagatgcaccataatttgatcataatttaagctgatcacataatgtttttaaatttagttggtcaaatgaaagtcattcaataaacataactggtgaagtggaggtcatattcgttagttttagtaatttcctattacaaaatatattatcagttgcagatatcagttgctccagtaatcctgcataacaaaccacctgaaacccaaaggcttaaaacaatgatcatttaatattgctcatgaaagtagagtttaggtaggtcattcttatggtcttggctaaactcatctgtctgcaatcaactgcaaattgaggaggctgctttgttgatcttgtctgagttctttgacatgtttatgcatgcttgagggttgaatggattttgtctaacctaaaatggtccttgactgaaacagctgggatgactgaaaataaggaagcctcaactctcctccatatctcttacagccttttatatattacccagttttagtttaatgaggaaaatgtctttggaatatttctgaggatactatttagaatttgtttttatgtttttttattagttatttcttgtcttctgctagcttttgaatttgtttgctcttgcttctctagttcttttgtgatgttagggtgtcgattttagatctttcctgctttctcctgtaggaatttagtgctatgaattttcctctaaacactactttagctatgtcccaaagattctggtacattgtgtctttgttctcattggtttcaaagaacttatttatttctgcctttatttcattatttacccggtagtcattcaggagcaggttgttcagtttccaactagttgtgtggtgttgagtgagttttttaatcctgagttctaatttgattgcactgtggtctcagagactgtttgttatgatttccattcttttgcatttgcgaggagtgttttacttctaattatatggtcaattttagaataagtgctatgtggtgctgagaagaatgtatattctgttgatttggggtggagagtactgtagatgtctattaggtcggcttggtccagagctgagttcaattcctgaatatccttgttaattttgtttcattgatctgtctaatattgacagtggggtgttaaattctcccactattattgtgtgggagtctaagtctctttgtaggtcttgaagaacttgctttatgaatttggctgctcctgtactgggtgcatatatatttaggatggttagctcttcttgttgcattgatccctttaccattatggaatgcctttctttgtcttttttgatctttgttggttgaaagtctgttttatcagagactagaattgcaacccctgctttttttttttttttttttttttgctttccatttgcttggtaaatcttcctccatccctttattttgagcctatgtgtgtctttgcacatgagatgggtctcctgagtacagcacaccgattggtcttgactctttatccaatttgccagtctttgacttttaattggggcatttagcctgtttccatttaaggttaatattgttatgtgtgaatttgatcctgtcattatgatgctagctgattatttcacccaatagttgatgcagtttcttcatagtactgatggtctttacattttggtttgttttgcagtggctggtagtgatttttcctttccatatttagtggttccttcaggagttcttctaaggcaggcctggtggtgacaaaatccctcagcaattgcttgtctgtaaaggagtttatttctccttcccttatgaagcttagtttggcttcatatgaaattcgtggttgaaaatacttttctttaagaatattaaatattgtcccccactctcttctggcttgtagcatttccacagagagatccactgttagtctgatggccttccctttgtgggtaaccatacctttctctctggctgctcttaacattttttccttcatttcgaccttggtgaatctgacaattatgtgtcttggagttgctcttctcgaggagtatctttgtggtgttctctgtatttcctgaatttgaatattggcctgtcttgttaggttggggaagttctccaggataatatcctgaagtgtgttttccaacttggttgcattctccctgtcactttcaagtataccaatcaaacgtaggtttggtcttttcacatagtcccttatttgttggaggctttgttcattccatttcattatttttcctctaatcttgtcttcaaactttatttcattaagttgatcttcaatctctggtaccttttttccacttgatcagtttggctattgatacttgtgtatgcttcacgaagttctcgtgctgtgtttttcagctccactgggtcatttatgttcttctctaaactgtttattctagttagcaattcctctaaccttttttcaaggttcttagctttcttgcattgggttagaacatgctcctttacctcagaggagtttgttattacccaccttctgaagcgtacttctgtcaatttgtcaaactaatttttcctccagttttgttcccttgctggcaaggagttgtgatcctttggaggacaagaggcattttggttttttgaattttcagcctttttgtgctggcttttcctcttcttcgtggatttatctacctttcatctttgctgttggtgaccttcggatggattttttgcatggttgtcttttttattaatattgatggtattgctttctgtttattagttttcttctaacagttaggctcctcttctgcaagtctgctggagtttgctgggggtccactccagaccctgtttgcctggatatcaccagcggaggctgcagaacagcaaaggttgctgcctcctccttcctctggaagctttgtcccagaggggcacctgccagatgtcaactagaactctcctgcatgaggtgtctgtcgacccctgttgggaagtgtctcaccatctggagacaaggggtcagggacccacttgaggaggcagtctgtcccttagcagagctcgagcgttgtgctgggagatctgctgttctcttcagagccagcaggcaggaatgtttaagtctgctgaagctgtgcccacagccgccccctcccccaggtgctctgtctcagggagatgggagttttatctataagcccctgactggggctgttgcctttctttcagagatgccctgcccagagaggaggaatctagagaggtagtctgactacagcggctttgcagcactgcagtgagctctgcctagtccgaacttcctggcggctttgtttaccctgttaggggagaacggcctactcaagtctcagtaatggcagacgcccctcccccaaccaagcttgagcatccagagtcaacttcagactgctgtgctggcagtgagaatttcaagccagtggatcttaccttgctgggctctgtggggttgggatctgctgagcaagaccacttggctccctggcttcagccccctttccaggggagtgaacgtttctgtcttgctgatgttccaggtgcaactggggtatgaaaaaaaaactcttgcagctagctcagtgtctgcccaaatggctgcccaattttgtgcttgaaacccagggctcttgtggtataggcacccaagggaatctcctgttctgtgggttgcaaagaccatgggaaaagcatagtatctgggctggatagcagcatccctcactgcagggtcacccacggcttcccttggctaggggagggagttccaccaccccttgcaaatcccagtttaggtgacaccccaccctgcttctgctcgctctccatgggctgcactcactgtctaaccagtcccaatgaaatgaactgggtactttagttggaaatgcagaaatcacccaccttctgtgttggtctcactgagagctgcagccagagctgttcgtattcggccatcttggtaaatctgtttttatccaagaaataatctgattcaacctttgtccatttataaaatgtgattgtttcttccattcaatggattcataagaacagcatcataacacgacgcgacgttttaatgtatagcattttggatatgcaatgggtgaagtcatgttcttgaaatacagctctatatgattaaaagtacctgttgtcacatggtctaatcataaagaagatgaaagagtgaatcagttcttattgacacttagtgcatggacaggtactctgtacatagcgttctgttaaatgcttaggacaacccagtgaggcaaacatagttattactgatttagagatggaaaaactgaacctcacacaggttaaggaatctgcctatagtcatgcagctggttaagagtagagctgggattcaaactctggtcttccttattctagctccctgtgctgtttttactacatgaagcaaactaggcctgtctcctgataacagaatgatagaggagatcctctacatttacaggctgttaaagtggtttatccaactcttggcagtaaacagatgtaaccaagtgtgaaaggacagggtaatcaggggacacagaacgggcaaagactgagtaggacatattcagaggtatgttttattcagctaattcatggctactgaatcttagacctgaaggtaggtacaactcaactctttttgccttcctcaaaaaagaggaagaaaaaagagaaagatcagtgttgaggaaatatatcactatggtatgtagaatggtatctgttaattattttggtgttgtgtcactcctgtcactatcttactaggtgacagcagcagtgtttttattcaagatatatgtgtgtaatattgttttcactggaaaataaataatggatgctatagtcttatgtccccaagaaaattttataagtttttaatgcatttatcatgcatccctacagataactttccccaggaaaattcagccatcagttttgtccatgttgttaatatatatgacatccataatgttacagtgtagagtcagaaagagttcatatttaagctcttccatttattatttaggtgaccatcgtcaatttacttaatctctctgaatttcaactccttctgtcaaatggatcctaagaatattttatgggtctataataaagaggaaattaggaaaaatacatgtacagattcttttatgtcctgttacagtgtcacatggcaattaataaaagctaattccattgctgataatgacaacactcctatagtaacttaagttacattagttctgcactgctcatatccagtttggcagggcagctattattgtgtatgcatgtgtgtattgttttcacatctagaatgtttatctcttgaggatgggaagtgtcagaaactgtttttgtatctctagggccttctcattgctttatttactagcatagttacttgtaatgactatcacaggaaagttatgtagcactttgaactaattttcaagataattattaaacaataactatgtttcttcttaggtattttgtctgtaagtagtgaaagctataggtaggagtgtttatttcattatgccatttggtttgattaatagcctttttctgcaagagtatttcttcaaagatttttttcaaatatgggactatttaaatcactaaatttaaagattttaaggaaatataatattttaaaactagctagcaaacatttactgagtgctaataatttgtcagattctattctaagtcctttggacatattaaataatttaatccttacaaacactgtatgaggtagaatatcattatgatttccattttacagataaagaaactaaagcacagggaggttaagtaacttgcccatggtcacacagctaacatgtagcagggcagggagtcacacatagttaatccaactctagaatctcctatgagtttcagcattatattgcctcttagtgtatgttggtgctaaatttttaagtaaaatgaactttggctacagctatcattattactgattcttaaatattatgcatttattctgataactgatctctttcacacaccctgattaggattttccaactgtgatttgtcctgcttctcttagttgggagtccatatagtttttaccaacttttcatcaaaagccattgcgggtagctttcttcatgtatcatctaattaaaatatcactctgagactgttcctacatttaaaaaacctttacttttatctctccacattttccgatctcttcttactattctgcttacatgtaactgaagcccgcaggagtctattagccttgtgtaagcataccgttggcttgtaattagatatgcagttgaaacaaagcagtttttaatttttttttcaagagtatctcttttcctttgtctgcctatgtaggaatccatctactctgttcagggttacttgaaatttctatatcatgcattagcaagtgaacctcagcttttatactcttggatacatactgctttagaaatgtttttgtcatactaatgtaaaaatcaacagatatgtattcctgccaggcaaaaaaggttttgaggataaatgtaaagtattttcgctacagccatttaatttttttgtttttgctttatttttattttattttttgataaataatcatatataattatggggcacacagtgattgtgatgtttcagaaatattattaaaagtagctaatatctgatatttcaaactccagttgttcattgtgggagatttcattctatctgctttcacattggttttccttacaaacttgaggctctgttcttgcctgtatctttctgagaaggaagattgaaaaaaaatggaagtatttcctgaggaggtggcataatttcttttgagaatatgatgtatagaatggacagctttcttctctctaccttagacagattttcatgaagcaaattgcttatttcccgggaataggttagaatttccgttccttaggtgttctgactatagtgcaacttcaaactggaacatttgagtttgaaattaattcttagggaagaatttcttcttgaggttcaccagaaaaaaggacagttttccctttcctttaaaaacatagaaacaatgcattttcttattacctcagtctaatttctgttttgctaatttggttctgctttggatttcattgctttaaaggtatatctatttatatacatgggctcaacatcagttgaaaaaaagttgattttggctcccctgacagtttcatcttactccgtttttgttcttttgaatttcataaatttacacttaggatattttaatatataaaatgaaaattataagaatgataatttgtgtagaaaatatacatcagatattctttatgagtagaagactacttctgcacatttttttctgtcatttctatgaattgttcatcgtcatctgcattaaaatacactcacttgcattttaatatacagtgtaagtgttgtttgtttgtttgtttgtttttgaaacagagtctcattctgctgcccagactggagtgcagtgatgtgatcacagctcattgcagcctcaatctcctgggctcaagtgatcctcccacctcagcctcccatgtaggtgggactagagtcatgcaccactctgcctggctaattttgacaatttttttgtagaaacggggtcttactatgttgccaaaggtattgctgtttatttttgaatgctgaaactaattttcagggagatcacaaagaaatcttttcatatttaaattataatcattttatgaaattgcttaactgtattaaatctgaatttgtctcgtgtaaagtcatttggttattttttttaaagcgagccttctgaatcatccactcagagccagactggctgggttaattagaagcagctggtgtgcatatggttctaccagaaacctgtaagaggtccacagaagaggtttgccctaggagactcatgagcagtggctagttgtgccaagagtgtagcaagaattggttgaggacaattcagggaagttattaaatagttggagcataaagacttctgttactaaaaaagattgtaagtcaggttttcacacactgggttttggcttatctactgaggataagtgactattgggagagccaaatcaatgtaaaaaggagaagaaatctatgaagttaagaatcaacattgctatgttttctttgaaatattttcctctttgttctttagactctttaatattatacaaatatattcattatgttttgttggttggttggttggttttggtaatccatttggttttctttattcataatctacaactctttttattggaatctcagtttgctaacccaaacaaaggaaccactaatcttttggtgacaacaactaaaccaaagtcactatctctggaactaaatagttcatttaaggcacagcctgaccactccctaatgctaatcccaactcctaagtaattactgaagtattgaaaagtgttctgattctatcttggtgtataaaaactttctattttcttctgcttatttgtgatgccactcctccttgttattcaatacattgctgaaacttacttctgtaaaatttttgtgatttgattgaatgaggactcccatgttactcagtcccttttctattctattcagactccttgtccacgccgcaccctttctggtcatttatctctgggacagttttaatattctattatctagcttgtcctttggctctttgtctacattattattggcttgataaagtcaatttgcattccctgaacacccactacaaaacttcagagaaaaatggtcccaaaactgtgtgggaaagacaagaggaaatcagttataaatattttacacacaaacaaatgattcacttgcagtcactgagagttgctattctcattcatagcctctgatataaacattcacaaagacttgttgatgaataaacatataaagaatgcaaagagttggtagaatttcttattgattattgatttccattttgctcttggatctacaacatggagggtaatgcaacctgtactcttcttgagcaccacgactatgtcactgtgcctagtcaggcattaaattaagtctgtgtagtcaagggtggttattgctgcaactcccttccctcacccaacaagaaaaagcaagctgcttctttgggtgtttcccctcactccttttgaaacatttatcctctggtccttttctcatcttttaattccatgaaaacttacctgtcttcagtctcattctgacaaggctctagtatttgctgttgaaaatgggaaattaagtcgaaaatcaatccctgtcaatgtttgccttctttgaaaacagaaaaaaaatgttgttagattgatcattgatcacattagctttatcttactcctactccttcattctataaatatacttttcctaaaccctaagaatcactttttaacaaatctattgttttcattactgaggcattgaattagagtatgactttgggctttgattgaatactgactctcaaaaacctgtgtaataacactaaattggagacacagagagggtcagtgattctctgtgttacctgttttatataacaactatgtttgagcattgtgattttctttgtaaaacatatctccaggctaactaaatggattttaaaaactgatactatcaggaaaaaaaaaaaacatttaactttggtgtttaagtctctacaacttggctccgccctatgtggccaagtttatgtcttcactatatgtcctacattggtcttattcattacttcctaattgcttgatgtatttttgtaatgacatttcatttagatttgaatttttttgactatgtgttacatttttcctaatactcccagttcctcaaaactttgtacagagctaagcatactaacaaaattaaataaaaagttcaatatcccccacttagatgtaatagaaatttatgccactaatactggcaccactgatacaaaggtattattaaaactgtttattttcttctctccctcacctgtcccagttgaagccttacctaaaatgttaacagtgcattagaaaaagttcttctgtgggtaaaattttagccacgttttcaaaacaaaataactttcttaagttccactgactttgatctcgtcttctacagccagacataacattgtagttgcagtcatgcttggcctgcttgtgatggtgattaaattggatctatgttactgtttatcaagatgtgacattaaagggtcagctgaaaggggctaatgggatgatccattctgtttgatagtgtttattatccacatcaagaaacaaccacattctacatgtgcacaatggagtgctattcagccataaaaataaagtaattctgtcatttgcaacaacatagatggaactggaggtcattacgttaagtgaaataagccaggcacagaaagacaaacacagcatgttctcactcatctgtgggagctaaaaattgaaacaattaaactcatggagacagagagtagaatgatggttaccagaggctgggtaggatagtggggggctgtggaggagatggggatgtttaatgggtaaaaaaaaacccagaaagagtgaataatatctagtatttgatagcataacagggtgactatagtcgataataatataattatacattttaaagtaacaaagaatataattggattgtttgaaacacaaaggataaatgcttgaggtgatggacaccccatttaccctgatgttattattacacattgtatgcctacatcaaaatatctcatgtaccccataaatatacatacctactatgtacccacaaaaattaaaaattaaaaaagaaaacaaccacattgacctatgggctatgtttaaacagaaataatgtatcctatatatgctggctatgaatattattgattctattattatttatatacaagtgaattaaaataactttttcaaatatacacaattctttattttttatttatttatttttttactttaagttctgggatacacgtgcaaagtgtgcaggtttgctacataggtatacgtgttccatggtgatttgctgcacatatcaacccatcatgtaggttttaagccccacatgcattaggtatttgtcctaatgctctccatcctcttaccccctatccctaataatggccccagtatgtgatgttcccctccctgtgtccatgtgttctaattgttcatctgccacttatgagtgagaacatgcggtgtttggttttctgttcctgtgggattatggcttccagtttcattcatgtccctgcaaaggacattatctcattcttttttatgggtgcatagtattccatggtgtatatgtaccacattttctttatccagtctatcattgatgggcatttgggttggtttcatgtctttgctattgtaaataatgctgcaataaacacatgtgtacatgtgactttatactagaatgatttatattcctttgggtacatagccagtaatgggatttctgggttgagtggtatttctggttctagatccttgaggaatcaccacactgtcttccacaatggttgaactaatttacactcccactagcagtgtaaaagcattcctatttttccacagcctcaccagcatctattgtttcctgatttttaatgatcaccattctgactggggtgagatggtatctcactgtggttttgatttgcatttctctaatgatcactgatgatgagctttcttcatatgtttgttggctgcataaatgtcttcttttgagaagtgtctgttcatatcctttgcccactttttgatggggttgtttgtttttttcttgtaaacttgtttaagtttcttatagattctggatattagacctttgtccaatgggtagattgcaaaaattttctcccattctgtaggttgcttgttcaccctgatgctagtttcttttgctgtgcagaagctctttagtttaattagatcccatttgtcaattttggcttttgttgccattgcttttggtgttttagttatgatgtctttgcccatacctatgtcctgaatggtattgcctaggttttcttctagggtttttatggttttgggttttacattcaagtccttaacccatcttgagttaatttttgtataaggtgtaaggaaggggtccagttttagttttctacatatggctaaccagttttcccaggaccatttattaaataggcagtcatttaaccattgcttgtttttgtcaggtttgttgaagaccagttggttgtaagtgtatcatgttatttctgaggtctctgttctgttccattggtctagatgtctgttttggtaccactacttgctgttttggttactgtagccttgtagtatagcttgaagtcaggtagtgtgatgcctccagctttgttctttttgcttagaattttcttggctatacaagctctttttttgttccatattaaatttaaagtagtttttcttattctgagaagaaagtcagtggtagtttgatgggaatagcattgaatctataaattactttgggcagtatggtcattttcacgatattgatttttcctatccatgagcatggaatgtttttccatttgtttgtgtcctcctttatttccttgagcagcagtttgtagttcttgatgaggtccttcatttcccttgtaagctgtatgcctatgtatttcattctctttgtaacaattgtgaatgggagttcattcatgatttggctctccacttgtttattgttggtgtgtaggaatgcttgtgatttttgcatattgattttgtatcctgagactttgctgaagttgcttatcagcttatggtgttttggggctgagacgatggggttttctaaatatacaatcatgtcatcagtaaacagagacaatttgatttcccctcttcctattcgcataccctttatttctttctgttgcttgattgtcctggccagaacttccaatactatgttgaataggagtagtgagagagggcatccttgtcttctgcctcttttctcttttcttttcttctttctttctttctttctttctttcttttttttttttttttttttgaggcagagtctctctctgtggcccaggctggagtgcagtggcgtgatcttgactcactgcaatctctgcctcctaggttcaagtgattctcctgcctctgcctcctgagtggctggaattacaggtgcccaccaccacacctggctcattttttatttttattagagatgggctttcatcatcttggccaggctaatctcgaactcctgatctcaggtgatccacctgcctcagcctcccaaagtgctgggattacaagcatgagccactgtgcccggccctcttgtgcctgaaagggaatgctactagattttgttcattcagtatgatattggctatggatttatcataaatagctcttattattttgagatatgttccatcaatacctagtttattgagagtttttagtatgaagggatttgaatttgaatggatttttattgaaggccttttctgcatctattgagataatcacgtgtttttgtcattggttctgtttatatgatggattacgtttattgatttgcgtatattgaaccagccttgcatcccagggatgaagttgacttgattgtggtggataagctttttgatatgctgctggactcagtttgccagtattttttattgaggatatttgcgtcaatgttcatcatggacatttgcctgaaattttctttttttgttgtgtctctgccaggttttggtatcaggatgatgctggcctcataaaatgagttagggaggagtccctctttttcaattgtttggagtagttttagaagaaatggcactagttcgtctttgtacgtctggtagaattcaactgtgaacctatctggtcctgggctttttttgtttcgtaggctactaattactacctcaatttccgaacttgttattggtctattcagggatttgacttcttcctggtttagttttgggagggtgtatgtgtctgggaatttatccatttcttctggattttctatagtattctctgatggtactttgtatttctgtgagatcagtggtgatatgtcctttatcattttttattgtgtctctttattcttctctcttttcttctttattagtctagctagcagtgtatctattttgttaattttttctaacaagcagctcctggattcgttgattttttggaatactttttgtgtctctgtccccttcacttctgctctaatgttagttattttttgttttctgctagcttttgaatttgtttgctcttgcttctctagttcttttaattgtgatgttatggtgttgatttgtgatcttttcaagtttctgatgtgggtatttagtgctataaatttccctcttaaaactgctttagctgtgtcccagagattctgctatattgtctctttgttctcattggtttcaaattacttcttgatttctgccttaattttgttatttacctcagagtcattcaggagcaggttgttcaatttccatgtagtcgtgtggttttgggtgagtttcttaatcctgtgttctaatttgattgcactgtggtctgagagactgtttgttatgatttcagttcttttgcatttgctgaggagtgttttacttccaataatgtggtcagttttacaataagtgccatgcaacactgagaagaatgtgtattctgtcaatttggggtggacagttgtgtagatgtctactaggcccacttgatccacacctgagttcaagtactgaatatccttgttgattatctgtctcattgatctaatattgacagtgggatgttaaagtctctcacttttttttttttttttgagacagagtttcactcttgttgcccaggctggagtgcaatggtgtgatcttggctcactgcaacctccacctcctgggttcaagcgattttcctgcctcagcctcccgagtagctgggattaccggcacatgctaccacacccagttattatttatttattttttttttgtatttttagtagagatagtgtttttccatgttggtcaggctggtcttgaactcctgacatctggtgatctgcccacctcagcctcccaaagtgctgggattacaggcatgagccaccacgcccagcctaaagtctcccactgttattgtgtgagagtctaagtctctttgtaggtctctaagaacttgttttatgaatctgggtgctccagtattgagtgcatatatatttaggatagttagctctttttgttgcattgatgcctttacaattatggaatgcccttctttgtcttttttgatctttgttggtttaaagtctgttttatcagagacggagattgcaacccctgcttctttttgctttccatttgcttggtaaatattcccccacccctttattttgagcctatgtgtgtctttgcacgtgagatgtgtctcctgaatacagaacactgatgggtcttgactctttatataatttgccagtctgtgtcttttaattggggcttttagcccatttacatttaaggttaatattgttatgtatgaatttgatcctgtcatcatgatgctagctggttattttgcacattagctgatgcagtttcttcgtagtgtcattggtctttatattttggtgtgtttttgcagtggctgttattggttttttcctgtccatatttagtgcttccttcaggagctcttgaaaggcaggcctggtggtgacaaaatccctcagcatttgcttgtctgtaaaggattttatttctccttcccttatgaagcttagtttggctggatgtgaaattctgggttgaaaattctgttatttaagtatgttgaatattgtcccccactctcttctggcttgtaggttttctgctgagagacccactgttagtctgatggacttgcctttgtgggtgacctgacctttctctctggctgcccttaacattttttccttcatttcaaacttggagaatctaatgattatgtgtcttgggcttgatcttctcatgagtatcttggtggtgttctctgtgtttcctgaatttgaatgttggcctgtcttgctaggttggggaaggtctcctggataatatcctgaagcatgttttccaacttgcttcaattcccccccttaatttcaggtacatctgtcaatcgcaggtttggttttttcacatagtcccatatttgttggaggctttgttcattccttttcattttttttctttaatcttgtctacatgccttatttcagcaaggtggtcttcaatctctgatatcttttcttctgcttgatcgattcagctattgatacctgtgtatgcttcacgaagttctcgtgctgtgttttacagcttcatcaggtcatttatgttcctctctaaactggttattctagttagtagttcctatcactttttatgaaggttcttagcttccttgcattgggttagaacatgctcctttagctcagaggagtttattattacccaccatctgaagcctacttctgtcaattcgtcaatctcattctccttccagttttgagctcttgcttgagaggtgttgcaatcatttggaggagaagcagcattctcgcttttggaattttcagcatttttgcactgtttttccctcatcttcgtggatttatctacatttgatcttgaggctgatgacctttggatgcggtatttgtgggagggtcttttcttttgatgtcgttgttgttgtcattgctttctgtttgtttttcttctaacagtcaggcccctcttctgtaggtctattgcagtgctggaggtccattccagacccttttcacctggatatcaccagtggaggctgtagaacagcaaagattgctgcctgctccttcccctggaagctccctcccagaggggcactggcctgatgccagctggagctctcctgtatgaggtgtctgtccacccctgttgggaggtctctcccagtcaggaggcacgggggtcaggtacacactcgaggaggcagtctgtcccttagcggagctggtgcactgtgctggtagaatctccttgtcaggatcagctgctgtcttcagtgctggcaggcagaaacaattaaatccactgaagctgccacagcagtcggccttccccctaggtgctctgtcccagggagatgagagttttatctataagcacctgactggggctgctgcatttcctatagagatgccctgcccagtgaggaggaatctagagaagcagtctggccacagctgctttgctgtgctatggtgaattctgcccagtccaaacctcccagtctccttagcactgtccggggaaaaccacttactaaagtctcagtaatggtggatgcccttcaccctaccaaactcaatcatcccaggtcgactccagacttctgcactggctgtgagaatttcaagccagtggttcttagcttgctgggctctgtgggagcgggacccactgagcaacactgcttggctccctggcttcagccccctttccaggggagtggatggttctcctgtctcgctggagttccaggtgccactggagtatgaaaaaactcctgtggctacctcggtgcctgctcaaacagccacccagttttgtgcttgaaacccagggccctggttgtatatgctcacaagggactctgctgatctgcagattgcaaaaatccatgggaaaagcgtagtactcagggctggcagcacagtccctcactgtttcccttgcctgggggagggaggtaccccagctccttgcgcttcctgggtgaagtgacaccccatcctgcttctgcttgctctccatgagttgcacccactgcctaaccagtcccattgagatgaactgggtacctcagttggaaatgtagaaattacctaccttctgtgttggttttgctgggagctgcagaccagagctgtttctattcggccatcttggctccttccaaacatacacaattcataaacatacttatgagttagagctccttctgatcttggtctatctgagagaatgtgtgagatttaatttctctgtttagatttcttaagctataatctggctttgaccatgtggaactgagcaacatttctgtatagcttttattcccactataaatgttcttgaggcttttaacttctgatgatctagtctttacaaagtttctgtagtgcccaagtgttgctgttttttttttaatgattaagatgaagtgattggcaaacttttataatccttcctatttcttcttaattcctttcttttctggaagttaaaccaatgtgctacacttttctgtccttctttaaacattaaaaatagaataattgcaccaagtggtacagatcaatgttcgtagtaccaagcagcaacctaggataatcaattaggtcaaccttttccaagtaagtaccatgggtcattagttctgagggaggttgggtaataggtgctgcatggaaaaagaggaagtagctatgattaaatgatatttgaaaactgatattttactgcatttttctcagagcctttaatatactgatgtttcatgtgaatttccaggaaagaaatatagtaggcagtatttacagggttatccaatttttttgcttccctggaccacattggaagaagaaggattatcttgggccacacatataagacactaataggaacaatagatcatgagctaaaacaaacaaacaaaaacagaaaacaaaaacacaaaaacatctcataatgttttaagagagtttatgaatttgtgatgagcttcattcataaccatcttgggctgcatgtggtccacgggtcgcaagttggacaaccttgatttaaaactttttccaaatgaaatgtctcagagagctagtgacaagtattccacatagcatattttgtgaaatgctacattagatgaatcctgcaccaagtgtgtggagacatgtgtcctgattcctcttctgccacagagtagttctgcgactttggagaagttgcctttatggcttttgcatttcctatttgtaaaaaaataggaagttgaattagaacagagctaggggtaggggatcacttctcagaaaaaactctgagactttttcagcccttccaacaaagttttgacataatcttctaatctcttcaaactttaaagctactgttgctttgggagcacagagtgtcccttatctgtgttgagatggagagtagaagttgagaaccactgggctgaaatcctctttgagctcacttccatctcatacttatcatgtgtattacagatagccagtcaaacccaaagtttgttttggctacctgaaaaaatgttaatgtttttgttgatgtgatatttcctcataacagtttgtcaaaaatattctgctacttagaagcagttataaccattccctttcatctgtttcaggaatacttatgtcatcagtggtatcaaactaaataacagagagagaggatctctaagaaaaaatgtttatttgggaatagaaattgcagtgggaatacaagtgccatagtaaactattcaggaaggtaaaagaagataaagatttttaaagaaaaaatgaggattacataaatattttgagataattatcttggctacaaggatcaataacaagggtggcacaatgtgtgaagttggacaggcagcttctgggcagattgtctcatggaaaattgaaatggtctttgtgtaaggttgtggctttcgcagtcttttgtgataattattgttattggggatttatgcctgagaaccctcccttcatggccttccttgactctatttgtcatggtttttagcacaaatgactccattttgattatgacaattttcacatttttcccttttgatgaagatatttttctgaaagacttactcattgattatcctatagttaggttttcattgtccctccatgccaagatggatctgtcctgatttcctctagtctggtctggtctccagtgtgaaggaagtgattgatgactaagagtcagtgtcaaaactcttttagccatatttgagcaacaagagagactggggtgagttgctcttgagctaaatctacctagagtccattattaagttcaaatttgtctgtttagtagatatttgttattatctcaaagtattgggccgatatcattttgttaggagttatacttttgtagaaatgtaacaactagctagctggtacaaagtttaaaaaggaaactatgaagtaaaattaatagtaatataataatcatagtttgtaggatagtttttttttaattatcctttaagttctagggtacatgtgcacaacacacaggtttgttacatatgtatacatgtgccatgttggtgtgccgcacccattaactcatcatttacattaggcatatctcctaatgctatccctcccccctctccccaccccacgacaggccccggtgtgtgatgttccccttcctgtgtccaggtgttttcattgttcaattcccacctatgagtgagaacatggggtgtttggttttttgtccttgtgctagtttgctgagaatgctggtttccagcttcatccatgtccctacaaaggacatgaactcatccttttttatggctgcatagtaatccatggtgtatatgtgccacattttcttaatccagtctatcattgatggacattcgggttggttccaagtctttgctattgtgaatggtgcctcagtaaacatacgtgtgcatgtgtctttatagaagcatgatttataatcctttgggtatatacccagtaatgggatggctgggtcaaatggtatttgtagttctggatccttgaggattcaccacactgtcttccacaatggttgaactagtttacagtcccaccaacagtgtaaaagtgttcctatttctccacaacctctccagcacctgttgtttcctgactttttaatagtcgccattctaactggtgtgagatggtatctcattgtgtttttgatttgcatttctctgatggccagtgatgatgagcgttttttcacatgtctgttggctgcataaatgtcttcttttgagaagtgtctgttcatatcctttgcccactttttgatggggttgtttttttcttgtaaatttgtttgagttctttgtagattctggatattagccttttgtcagatgagtatattgcaaaaattttctcccattctgtaggttgcctgttcactctgatgatagttccttttgctttgcagaagctctttagtttaattagatcccatttgttaattttggcttttgttgccattgcttttggtgttttaatcatgaagtccttgcccatgcctatgtcctgaatggtaatgcctaggttttctctagggtttttatggttttaggtctaacatttaagtctttaatccatcttgaattaatttttgtataaggtgtaaggaagggatccagtttcagctttctacatatggctagccagttttcccagcaccatttgttaaatagggaatcctttccccatttcttgtttttgtcaggtttgtcaaagatcagatggttgtagatgtgtggtattatttctgaggggtctgttctgttccactcgtctatatctctgttttggtaccagtaccatgctgttttggttactgtagccttgtagtatagcttgaagtcaggtagcttgacgcctccagctttattcttttggcttaggattgtcttggaaatgcgggttcttttttggtttcatatgaactttaaagtagttttttccaattctgtgaagaaagtcattggtagcttgatggggatggcattgaatctataaattagcttgggcagtattgccattttcacgatgttgattcttcctatccatgagcatggaatgttcttccatttgtttgtatcctcttttatttcattgagcattggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgaggcgatggggttttctaaatatacaatcatgtcatctgcaaacagggaccatttgacttcctcttttcctaattgaataccctttatttctttctcctgcctgattgccctggccagaacttccaacgctatgttgaatagtagttttaaaaataaattaatcctttataaaactgttaagaccgtcacagacatttacaatatgtttaaacttttagttttgtcctatatttaaaaaatagtcatcttattttaggacaaaaatttagcatataagttttttatacaaatttttaaaaagatttttatctgtatatatatatatatatatatatatatatatatatatatataacttaaacaatctctctttggtttctttaaatcttgtttttattgttctaaacctatatttaaaaacaaactttaaataacctgaatttagacaaaattactttctaaataaataacccattttcaatgcactttcaataattggttttgttagaaatacatcttttgtggttcactttgtatataaaattatacatattaattagaatttttaacttttagtaaccttaatttttagtgataatctaggaagaacttttgagctgtctatcatatatcagtattttatagatgagaactattttataatttttaaaaacatgttttctcctaacataattttatgtatattaatagatgtaaattatttagttttttaaataaaatttaagtattcaagaacaaacttatggttagtaatttatgttttagtattttatcttatttgaaaatgaaccagataattaatgagtgtttaatatttaagataactttagatttttcaattatatgaaaagtttatttataaatgttaatcccatttatatttaactgttttattatttatttatttgagacagggtctcagtctgttacccaggctggagtgcagtggcacaatcacagggaatttaactgagtaattgttttgaggtcagcctccatctcctgggctcaggtgatgctcccacctcagactcctgagtagctagaagtacaggttcccgccaccacacccagtcaatttttgtattttttgtagagatgggatttctctacatgttgcccaggctggccacgttgcccaggctggtctcaaactcccaggctcaagtgatctgcctgcctcagcctcccaaagtgctggtattacaggtgtgagccaccatgcttgaactatataatatatatatatggattacttacggaaactaagatattagacaaagctggttgtcattttgagttattttcttgttaaccactttttttccttatgaacttcatttgtaaattgttaatcatttttatagcctgtgaatatctgggtgtttacctaagtaatagccttaaatatatgagcgttttgtcaataacacagaaaagatagctgtttttactaaagtagcaatattaaattagtcttatcaatgagttttacaaacaaagattattatgtttttaggttggatttatagttttattacctcaaatcatctagtagagataagtataatcttgtctaaaaagtaaacccaaaaataatatgttgacaattttgaatatattttaatttttattttattaacaaatgtaaaactgattatttatcaaagatttacttaagtcatgtgaactaaaaagcatttgggttaattactatattttaacaatttttatgagtgctcatttacctaagccaatctaaacagaatttttaaaagggaattctggttaactctgccaggtttttccaactagatacaatacatgtacctacatgtaaatatacctagacatgtgtgtatatatacacaaaagatcctataggttttattttaaaattttaattatgaaacagtaaaacatgataatacaaacttaccagtttataaaatgatagttgcttttaaattatgtttttgacaaaatgggactagtttacatgggtaaattttatttgtcccagtaggtaatctaatgaaggctatagacctaaattttggataaagaatttttaatgtggtagttggattttttttttaaaaaaacctctttttatttttatttgttttaagtgagtttaagtatttaaatgttgacattttaactaggactggctgaattgtataaggaaaacaaaatttccagatgaccttgaattttagtaacaaatttattttttgttagtctggtttgactagttaacgtgggaagggaacattttagaaaatgttattatttcttttcagctctttttcatcccttttgggcacagaaagcaatttttatgtcagacagagatatattatggttttgaactgaagattttgatctatttgatctgagtctttcataaacatttatctaggttttaagactattaatcctttaattaactatttcattgccctttgtaattattagttaggcaaacctaagttcacattttaaaagttgtctaggttggttgttgccatggagctgttgtaatttgtagtatcattaatttgaaagtcctttgagactctttttaaaaaatcttggctgaaatctcataagaaatgagtatattttaatactagcagaaaagtcagcagatttaaagtgggtagaaaaaatagagagacaaagaacttagaaggctctccatgttaactctatagttggttgtagttttttttaataagcttagagagtttgaataattgccatttaagttctgagttttttatatggtttgcctaccagttgaaaaatgtgtatgagaatagactataaattttgaatgtatagttgtctagaattccagagggcttggcatgctttagaattttgagaatcctgttcttttttttcttgagaccagagaaaatcttatcagtactgtcagggaatgtcaggagtttggactggtattttcgatggcgtcgactaccctactagcttttaattggctgtcttgcactcaccatttagaatggttatttttgctcttggaagatgtttagaaacaaataaggtaaaaaagagccaaatcatttacagacacatgtaaccaaaccaaaatgacaccaaaatcagaatattcacaaaaatttttagccaggtttatacatcaaacaaaatattaaaacaggcacaaagaaacaaaagtgaatttaccagaaaataaatgtctcacagacagaatataaactagagttctcaaaccagaaggatccttgtctttatatcagaaagtgcttgtcaaaaaagacttatggtcccagaagggatgtaagattctttatttaaagtggtcttttaactaaatcagatctggaataaagtaaaaaaggactcaccaaagggagggagtctgagaatctgagagaagattcgccagggcagaaaaggaactcacgaaaatagagagtacaaaggactcagtcattgctgcattcaattccagaggtcaagatttgtctgaggtgagttcattttgaactcatttctaacactgtcttggtctgttgtgttgctgtaacagaatacctgagactgggtaatttacaagaaaacagacttatttagttcacagttctgcaggctggcttctgttgagagctttcatgttgtatcacaacatgacagagaaggtcaaacaggattctgatgcatgcaaagaaggaaccaaacaggaggaggaacctcactttatgacaacctgctctcatgggaattaatccagtcttttgagaatgaaaattctcttaatactccaagaatggcaccaaggtatttatgaggaatttgcccccatgacccaaacacctcccactaggccccactttccaacactgccacattggggatcaaatttcaacctgagttttggtggagaaaaatggaacacatccaaaccatagcaacaccattaaataacagaaagggagactctctaaaaagaaaaccaaataatgaactgggagactcttcaaaataaaatgatttcatatttaggaataggcattgtaatgggaataagtgggccatagtaaacaatatgcatattcaggaaggtgtaaaggaaggcaaaggttttaaaagacagaatgaggaggattacataattgtctttaagataattatctttggctacaaggatcaataacaaaggtggcaccagtctgaagttggacaggcagtttctgggcagatgtcctcacagaagtattttttgtgtatgtaaggtctttgtccgaggttttggtttttgcagtcttttgtaatagttctcattatcagatgtttttgcatgagaatcctccctttatagcctcctccagttctatttgtcatggtttttaacacaagcaactccattttgattctaacaactttcacaatagtgtttcctacaagctatgcctgagattaggatgcttgtgtaaatggtttattaagggagtgacctgaagaaaaacttgtaatgaagcaaaggaagcaggagaaggcaagataagaagctaagtaaggacatggcatcaggagaagcatagcctgatcccgtgggggccattaaaacacgaattacatcactgattgtcttgctcagtggtaaggaggatggacttttgtgctactgcatctgccatttattgatgaattgcttctgggatgagggacataaccttcctgacttatgaaggtgaggcagctcctatcagcttctgagaaggatgcagctgtgaatcattagaagccaaccctcagaaaacctggatgatgggtgcattggcccagaaaaaggggtatgagcagggtacaaacatcatctgctacaaccaacttacttgtgggaaatcaaaatcccctttggtttaaagtctgcctgtaagcatttaacagatacattcctaaagacagtagttaaatgtaatttaagtcaaatattaaagtgcctactgttagccaagctgcacaatgctaggtactgtggagaatattaagggaattgatcattatattcactcttgaaaagcttaacgtttggttggtgtgaagaataatatgtacataatattgtgaaatatcaacgataaggatgtaatcatatgttatagaaatggtacccaatggaatcagtggcagcatgcttaggtgatcagagatggacaactttgggctaggatacaaggatacaaagccctaggcaatctttaatattagtaaggatggtgagtctttatggtgggcaagtgtaaagaaaagcatcatggaggaaagtgggacttgagtttagccgataaggaatgatgaaggggaatgtgggaggtttatggtggagcaggaggttacaggatgaaaaacctgagtaaactttggagcattacacaatgcatgtgttgtgagggagcaatgaagagcatgacttagtttgtccagaggatttgtgttgcagggtagtggaaagagtatagccagtactgtaatcccagcactttgggaggccgaggcgggcggatcacgaggtcaggagatcgagaccatcctggctaacacggtgaaaccccgtctctactaaaaatacaaaacattagccaggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagagtatagcagtataggatggtactggagtgtgtgaaaaaagtatagaaccaggcagaagaatatgaattcatgtcttagatagtgacaagctcctgaatgtttttgagcatgagaatgatctgatgaaatgatgctttaggaagggttgtctgggcaaaacaaagaagttgttggagctgtctttatgcacaacttttaaaatggattaattgactttaagatgtcagaaacttgtttatttaaatctttcatgttagtgacttgtatttggaatgcagttacttaactcaggtcttatgcttgactacattcagcttttcagaaacagctgtattaggtcatccagaaaccctgattttttttttaaaggtatcattaagtggtgagaaagaaaagactcattcaaaactttcaatttacctttcaaaccaaagcccagggataattattcataatcatttctaagtctgaaatgtgacattgttccatgagtcatcatctaggttttaaccacacatgcacaaaaaagcacaacataataccacacaggctatttgagaaagcattcagagaaatgttctgcctttttatgttgacttcctgtgtataaatctggaatcataaaagtccaaggacactcttcagtaggagtacattcagtaaacagcatgtgtggagcaacaactgtatgcagaactggagtagaagctggttacaagagaaagaatttttttttttttttgcctttggagatgctatagtagaaatagaatacaatgtttgaaaaatagaatgtttgaaaaatgtatgagaacatgtgtaaagcaatatctaaaaggggacacatgagatataaactgagaattaatgccaaagggctaggagaagtcacaaaagaggactcagacatgagggagtcacaaaactaattttctgacctgggccaatttttccttaaattggcgtggtttaccagaagaagagaacattgtgtttcccttcctggcaagtacttttggttgccgaagactatattatcagatggtgaaaatgttcattctattgatgtggttcctcagtggaaagtcatcacatctttctagaagagccaaaatcttttgtgaatgagctgtgttttatggcaagcttttataaatgattctagaattacagagtttctcatgccagaatatctatttgctctgggctagctagctaaaggactgacctctgccctggactatatagtaaatacctatcttcttaactcacaaatgaaggttcttagactaaagtttggacatgggtccagagaatatgacaggaatcaggattccagggcgatagatgaggcagcaaagtttggagctactgagtcagactcagctggagttggctactactaattcaaatgagctagggatcaagaacatggaatctaaaaggaaggaatggggtaagggaatggcaatctggaccagaatgggccagaagccaaggccaatatacagtgggaaaatggttattcaaactgggggaagctaggtcagtatagcaaaggtgaagccaaggctaaggacaacagtccagattcttcctagcaaagtgtctcacagaaatagagagcctgaatccttgagtatacaattaacagcacaggttttgaaatcagtctaaatacaaatctcaactctgccacctaccactatggtaccttgagtaaaagttccttaactgtgctaaggatctggatccgtttttttttttttttttactgtatctctctctgttgcccaggctagagtgcaatgacactgtagcctcgacctgctggacccaagcgatcctcctgcctcagccttccaaatagctggaactgcaggcatgcaccaccacacctggctaattttttatttttatttttagcacagaggacgtctcaccatgttgcccatgctgatctcaaactcctgggctcaagtgatcctcctgctttggcctcccaaagtgctgggattataggcatgagtaactgctgctggcctaagacctaattattgataatgaggacagtatagcatcttaccacataaatttgtggtgtgagttaaatgaggtaacacatgttaaatatctgatcaagtgccttccatgtagtaagcactcagcatggtaatgtaattagtgttagtattgctgctgcttctgttcctccaccacatcatcattcacacgattttggaatagcaaaacaacagtatgtggtattccaagaagactgaagcaaataatttgagaaatcttttttcttatggaaaagttctctaaggattgtgaaatatttgaaacagaaaatttcagttaccttgtattcaaatatttattatcttaaagcccaaagccttctaaatgctaaaactctactgtgtatcagatatgtcagcaagacaatattcacattaacaacaggaaaatgaatcgggacaaaatctgcagaagtgcacatgaaaaatggatgacagaaattagtttctaaccaaaagggaatggcttgatatgaaattggtaagaaattgttttccccatgaccttgaaaggtcatgaataattaaaatgccattaaaggtctacatttgttgtgaattcatgcatgtttagagcatatgtatacttaatcctggaacaatttcttatacctctttaactactcccactcctgccatacttagtaccagtgtcttatacataatgataatggacactcatacactgattgattcagcttatggagattggtagcttttattggcctttgcaaaacttaccttcaaaaactaaattaatatatgcattttgtagcttatcaagaataaaacattttaatagctttgattcatagataaaatttatagaggaaatgatttctgtaatatgcataaagacataatctgtgatttaatttattctaatcagaaagtgagatttcctaataaatctgcttttaactattctggttatttctaaacaattctgccaatttgttacctttgccctcaaactttactttctctgtttgaatgaagttggctgccttttatggtttacaaagcaattgaagacattcccacaatgccatattacttattagaatttttatgtgtgacaagccactctttcttcactttagcacttctcaaaacttacaggaataatattggttatcttatgggtcacagaacaaatacctattggactctggaggccagaacccctactttcaacttgactgctaagtatcttaatggtaagacaggcaggttgaggcttataggtttaggacataagatgttaaagctgcaggtggcagagtgttgagaaatgacattattctctttgtgtgtacatttatttgtcctttcttaatgctccaagggctgtagggtgaagcattgtaaagatgtaccagatcccagaaggttagcagttaaacatttttcagtttgcaaatgcaacaaaccatctcccatagtgtatttactatttcaaaaattgaccctctaaaaagaacatgcaatccctggaattcatggaaagactgggaccactttaatgagattcccataaagtgaaaactgtttattaaatgttgctaggatgttttcttgctggaaagtagtattgtgtgttcatattataaacattaaatttaagggccaagatggattgcctatggaagactcttgtagtctatcagcagtcctcaggtcacattttaagaactgagaataagtggagaatggctcacttgtacaacactattgcctgtgtagcacctctgaaagtcctcctactactcagattaatcagcgctgccatatggaatgtcattgccttcctttccctccaacctgttttttgtccctatagtacctgctgccaatagaatcatagattcatacatactaaaaaaaatcttcactttttaaagctaattgttagaatcctgcagttttaggggaaaatcaggtacactatatttagaataccctcaccttgatattgcaggaagcaaaattctcaattttttttcagtccgccagtactcagtcttccctcacttgggtcctaagactgaaagaggagaatctagattttaatacagttaataataatgataacaaggccatgtgttggtatgatgatgaaaatataaatcaaaatggtctttgatttaagtgataaatactacagtgtccaagatttgagattcctttgttccttgaagatagaaactattcattcttggtaccctaatatttagcagagagttttaaacatgatgactgctcagaggaagtttaaaaatgattgtaacttataggaattaaacattttatctacagtaaagagtttacaggattttcagaaatcagagaagggcttgacctcaaatgtaaacctgctattggtatgaacttcactaatttcctaattcagacccaaatgttaattttcttagagaatcataaaccacaccaaagttaaaaacaaacaaacttgtaaacaaattctaaacaaaatccaacttctttcattaaaactagtaattaaaggagaataaaattgatatgcatttactcaaagttttaggagcatttacctcttcaaaagaattcatggatcaactgaaacttaaacttttaaagattttaaaccactatctgtgtcacttgcttatctgtttggtcttggtttagtatgaaacatgtctctggtctgaaataaaagacgattgcatttcaaaaaagaccaatttataacaaaaaactcaaatcaggataatatgaatgaagtggtattacacataaagacaagagcagaagtcaagtttttccccaaaggatctgaaaatatcatcaagagtcaatgacctctcatttagcctttgaataagaagagtcattctttagctagacagctggctggaaataaataaaaatgggattgcaagtaagatcagatattaatctctttcccatattgctgagactctgaaacagtaatatggtactaaatttatacagataatggcttgattgacctaccctattcagctcttcttccattgaggttttgttcaaatagcttttaaatttatttctgatgaggctactagggtgtatgctatattgctaatatgttttttcaccaccttgaatactacatcaaccctaaagagttcattgttctagctgttctactcaaatatccatgggtctctctactcatggccatttatctacctatgaattttctgggtacaggaagaccaagagtaaaaggagacgatgaagatttttagtttgctgaaagggacataaaacaacctgaaaatgacacagaaacacctttaatagagtgctaaattgtgtgctaaagcaaggtcagagtggaacaacaaggtacagtgggaagagcaaaggctttgtaatcttaccgacttagttcacacccatgcccatcacataatgtctctgagtctcacagtctcctcatctgcagaaagcacttaatataatgagacttacctgacaggatttttgtgtatccaatgtgaaacatactaaagtacttagtacaatccctggatcccaattaatggtaggtgctatgattatcacagacagatatgagagaattggccatgaagctgtaatttagggaaaacataaattatttgatctgggtgagaaagtaattttttctaactggtataaatgtagccaccttttctataatgaacataatggacttcagaaaaccatatcctattacttgcctgtttggcacaacatatgtaatatagtttaatgactgtaacttcaggcatgaacctaaaactacttggaggtaatattgctttgcgttgcagtttcagtgaagtggacaggcagaatagagttcaattttacagtctgacctcttagtcattacttaaagccaccacagagccatttttaatctttgcattttcctctttgcaagtagtttctaagacagacagcgtgtcatactctaactaaatttcagattttaaaaaggcatttagctctgtaacttcagatgataaaaatccatttaatggagaatgttcttttgctgtctgcttggtcgataaattaaacagattaattaagtcaggctgtcaggaccaaggactgtcactaatgttagcctatggagctgacccatttatcagagactgaggctgaataaaggcagtctttgtcctgtaattctgtaatgaatacaaagaaatagcttatggagagaaaattctgtcacctgactgtatctcaaggcagagtagatgtggtgggaagaaaccctatcattgttattttcacttacttaattgatttgctttttccctatgtttctctgtatctacctttgtcctttgcatgtcataggaggctccttctcaatttgaaacataatcaataatgatttcctttgcttatctgaattggagctatgtgtgacacagtacacaccaaagatgtataaaacatcatccttaccttcgtagaacatgcacagaaataatacaggttaaagtatcccttatctgaagtgcttgaggtcagaagtgtagatttttttttattttggaatatttgtatatacataaccagttgagcatccctaattcaaaaatctaactccaaaatactccaatgagtatttccttttagactcatgtcagcactgaaaaaaatttttggaatttggagcattttagatttagaattttaggattagggatgctcaacttgtatatgactacgaaataaagaatcttggtggggaaccagaccagcaaagtggaaaaaagttaggttaaattggaatccaggattgtaataatgtgataccattaccaacttcatcaagcacttaagacttccaggtagtctttccagaggtcctgattcttggaccctagctatcttactccttttctttacccctcctttgactttgtccttggtgcatatgatctggcaaatatgaacttgacttctgcctagtattttccgccattactcccagagccttcctattaactgtattacctgaatttctaaatttagaaaaacttgctaaccactaccccttgatagaatgccaatgcagatcagatcagtggtctgtatgcccagcattctgactggaaaaggttccaaaaatgctttataaaaattgtttttgttgtcctttttagcatcagtctcataaggctaaggggtgaccctttaaaaagtctacttttctttaacaatccaattatttatctgcttactaacaaatgtttattaaatgcccactatgtggccaggcacatgcgagcactggggacattaaatatgtaaataaaatacattcagtgccctcaaagaactccctttatagtggaagacagacatactgaaaaataaaatatagactatcctcaacttatgagggttcaaattagtatttttcaactttatgatagtgtgaaagcaatacacgcctctacttatactcctctacttactatggagtcaagccataaccccattgtaaattgaggagtatctgtgtatatggtgtggtaggttctataaaacatatgtatagtcatcctttgatatccatgagggattgattgatttggtaccctcgagagtaccaaaatccaccgatgctcaggtcccttatgtaaaattgcatagtatttgcatataacccatgtatatctccctgtgtactttaagtcatcttgagattactttcaatacctaataaaatataaatgctatgtaaatggctgttatactgtgtttattcacgttttaaaattgttgtattgttattttttctaaatattttttatctgaggttgattgaatctgtggatgcagaatccacaaatacagagggtcaactgtaaaaggtaaagggtagtcagagaaaggttttaaaaagagaagtttgagctgggtctaaaggataaataggagtttgttaggcagacaaacggaagggggaggcattctaggcatagagcagcctacataaacacccagtagcatgaaatgacaaggtacaatttgaaagtagtttgatgaggctgaaaaggagtctaagaaggagaagtcttaggagaagtaaaagatgtccctgaaaaggctgacataggcttgaacatgggggtccttttatgtcacattaaagatctgaacttcattttgaagtatattgctgagctgcagtttatgagcttcttgccttaaataagtcattggttactgttatgtgctgaattgtgtcccatccccatcttcctccctcccctgccccccattcatatgttgaagtcctcatacccagtaactcagaatgtgactgtatttctagatcaagccttcaaagaagtgattaaggtaaaatgtggtcattagtgtgggccctaatctagttggcctggtgtccttataagaagagaagattaggacacaaacgcagaagaccatgtgaaaacataggaaaaagacttctaccaacaaaccaaaaaaagaagcccctagaagaaaccaatcctgtggacacactgatctcagatttctatcctccagagctatgagaaaataattttctgttgattaagccactcagttatcagtacttcgttatggtgaccctaacaaattagtacgattactaataatatagttccaaactttataaatgttaccttttaaaataaataaataaaaacattcaagtttattcctaaaataataacagggtgttcatttacttagagtttaatatgcttctttgagtataagagaaatcggtgatgccaccttaatattttggttaatgaagagacaagttcagatgtatgttaggaagattattctaggagcattgtggagggagtatcagaggacactgtgactagaaacaggaagaccagttaggaaagtgttgggggtctttatggggcttaataaatatcatagtgcccctcttctctgcctaagttctaaaccaattgagaaataaaacacaatgttggcagtttgagatggaaataacacctttaattctatgaaggctagacagttggaggatgtagctgagcatgaggaccaaatacacttattaattttctgtaccccagactggaacttggaacagcccagtcaagaaaaatttgaatctgagtatacttgctcagaccactgccatccactgggctgggtagagagggagaaagacactaaagcccagatccagccagttgataaatgtggatcatttaatcactcatacatttatgtaaaagcttttttctcttgtggcaggttggagagggatatagtcattcagatttattatagtaccccaaggtataacaaattccattatgttatatctgctatgtaacataagacctttcatatgaaaagctaaattaaaaagttgctactaccaatgccctttccctttttctccacctcagaagcttccaatgacagattatagaactaaattttgggaataagttaagaaccagggtaaattccttgcagacaacggtggccaagtgttctgtgaaattgtttcactgtctcaaacagctttgctgtagtcaaaagctcatggaacagctgttaattcctaaagtattcttctaagctgtaaagaatggttgacttttgccacctggcccagctaatcagaagctgatttcaaggactaagacatagcttctatcaccgtatttatgatgaaaatggtgtaagactaaatactatttcatgagctcctttggtccttcaatagtttaactcctcagttgaagagaagcacagttcatattttgagttgaatgatgatgtcacttcaattccaactctgaaatgtgaaatgattattgtcttcagccattttctcatcctgggaggcagagcttgtctaaatattgaaagccattgttcatgaatagtataagacttcctttagctttagggtccctaaaggctcccacacttgggggaagcttgttgtggaactgacactgagaactcttgtcataatacagagggcatgtgagccaaataaccaactttcttgaattctggatgttgccttgcaaactggcattcacttaacctataggctgtgttataaagagcccttggattcccacattgcatcttttcctttcaattttatagattgatcaacaaacttcagaggccaagcaaaaagtaaaagagcccctcaggctaaagatagtccttatttgggaacaattattaggtatcacattcattgtttctgagctctgaaaacttcaaggaaactcactatgtttctcgaacatatcctaagatagcaaggcaggaggaaagtggcagagaaactgtttaagttgggaaaagatacaaagtcaaaacattccaagtggcatatttgagcacttactcagagtacttctggactgtttactcagttggattcggaacatgtcgtgatggttaatattgagtgtcaacttgattggattgaaaactgcaaagtattgttcctgggtgtgtctgtgagggtgttgccaaaggagatttacatttgagttggtggactgggagaggcagatcctcccccaatctgggtgggcaccatctaaatcagttgccagcgtggctagaataaagcaggcagaagaaagtggaatgcaaagacttgctgagttttctggcatgcatctttctcccatccttccccaggaagacctctggccttttaccaggatagatgtgcagtggggaaaggagaatgatcagaccttttgtggactactggacactggctctgagctgacattgattccagagggacccagaatgtcactgtggtcctccagttaaagtaagggcttatggaggtcaggtaattaatttagctcaggtccgacttacagtgggcccaatggatgcctagactcatcctgtggtcatctccccagtgccagaatgcataattggcatagacatacttagcagcttaagacatacttacccccacattggctccctgactggtagggtgacagttattatggtgggaaaggccaaatagaagccattagagctgcctctacctagaaaaataggaaatcaaaaacaatatcgcatccctggagggactgcagaggttagtgccaccaacaaggacttgaaagatgcaagtcttgatacctttatcatatgacataagatttatttacttcagatcagcatttaagtgttattaactttatgtgatagcttttaggttaaagattagtgtgcttctggttgtgtgaaggatagctatattatgttaggcataattatgaccttattgttgttatttgaagattatgtatgattttgggagatgtgtatgggttcaagttgacaaggggtgaacttgggatggttaatattgagtgtcaacttaattggactaaaggatgcaaagtattgttcctgggtgtgtctgtgagggtgttgccaaaggagattaacatttgagtcagtggactggaagaagcagacacaccctcagtctgggtgggcaccatccaatcagctgccagcatggctggaataaagcaggcagaagaaaatggaatgagaagacttgctgagtgttccgcacttcatctttcttttgtgctggatgcttcctaccctcaaacatcaaactccaagttcttcagcttttggactcctggacttaacaccagtgatttgtcaggtgctctcaggccttcggccacagactgaaggctgcactgtcagcttccctactcttgaggttttgggactcagactggcttccttgctcctcttgcagatggcctattgtgggatttcaccttgtgatcctgtcagtcaattctcctaataaactccccttcatatatacatatatcctattagttctgtccctttagagaaccctgagtaatatacatgtactggcagttgctttccttctatagtgaccacacaatctgtctgttatttataatggtacctttccagtggctattgaatggattaattaattaagagatgagtattcaaatgctagttatgcaaatataaagtcacttctgacctatggttcagacaatgaataaaacagtgaaatccatgggaacactgttttgcaagttttgggtcacaactcatagtgtgttgtagagtcaattcagtaggttacaactagcatttaaaagagataggattgaaggaaatagaaagtattggagtacgttgctcatatgaaggataattttttctttgttaaattttaaaattctatacatgtaagtatatgctagatcaagagtaaagtactttttttatatgagccacagtcaaaatagtttgagattggcaaactctggcccacaagtcaaatttggcataccacctctttttgtaaataaagttttattgaaacatatttatgctcatttattcaagtattcctagggcttcttttgaaatacagtggcaaaggagagtagttgccacaggaccttacagtctggaaagcctaaaatattttctctctgacttttcatgggaaaagtttgtggatgccggtattagaaaatactggagacctttaggcatagagagactagttttggtgatttagaaacaaatgaaagtgaatataatcgatttctatgtagttgggagttcatcttatttcttttggctcatagcaagcattgttagggttttaacacttcaaaatgcatttgaattgagctaatgacagataatttaaaaattggggccaaaaatgaatgtgtgtttcttgaacacagtcatgttcttaagtagtgggttgaggctatctatcctagtatatagcaaagattcctcactttttgtaaactttgtaaacactacccaagaagattctagaagccaacatgactggcttaaaacctttatatatgctttcaaaattgtatagccatgcatcctggctaacatggtgaaaccccgtctttactaaaaatacaaaaaaaattagccgggcacagtggtgggcgcctgtagtcccagctactcgggaggctgaggcaggagaatggcatgaacccgggaggcggagcttgcagtgagccgagatagcaccactgcagtctggcctgggcaaaagagcaagtctctgtctcaaaaaaaaaaaaaaaaaaaaaaaattgtatagccatgtaacaacaacaacaaaaacaaagacaggattggggaactaaaaatggtatcacaaggcggtagatacgatgcaagctatgtacaagaaataaagcagaatgagtagcatctaattgcctcttctctttccctactaaatattggctgcttaagttacttaccagcaagaaggattgcttcttatactcatctgcattagtttaaaccatgcttattgagccatacatacaagaactgcgacggatgctgatgactgtaacaatccacatggctacagagggtatgtggatgtgacagtgaggggttgagtctggagatattggtaatgcccaaatactgtgtgagagggaccctctgaaccaagctaaagagaaactggcctttatcctgaaggaaatggggagccatgggaggtttttaaccagggaggtagataatcaactatgtgtttcagatacactctttgcagtatgactgatggattggagggagtagaaactggaggaaggaaaaccaggtagaagattattttagcaatccaattgagaaataatgagggcctgcagtgagtgcagtgacctgtggactgtttccatgggtatagatgtgaaatgtgtttaggaataagaagcacaaaatttgtggagaggaatgttaacagattaatctggaagttaagtagggacctcttaatggaaggccttttacaccatatcaagggattcagtctttattgtaaaggcactaggtagggggtactgatggaaaatcactttgctgcagtgtaaaaaatggattgaaaatagacaagctcagaggtagagagatctcttaggagactatttccagaagacttgcttggaaagtagttttaagtgagactatgagcatattaagttcctcctattgcctctcagacacaagtagaacaatggaacaatgcagtcacaaaagtatacaatttagctatattgcaagattgagaatatattcttgatatgctagtagcaagatattggactgctccctcatgcaaagctctgaagttctatatgtagacatgtgtttgtgagatattaactcttctgatgggataggttattctttagggccactctccctctttagggtattaaattacctgtatctgctctgaaaaataccgacgaaaacaacggacccattccttcgttttcatttttgtttgaaatccagtgccaaggatatttgcaacaacagtagatgactgcagaaaagaacttgataacttgtccccaatggggcgtctgacatcatgacatcatctcacatatgtaattgttatttatttgatccccaaagaaacataagtgctgcttctgtggcagtagaaatttgcataaatccaagatctcctgtgaagctgtacccttccaattaatctttgcaaggggaagggattatagtcttctgtgaattacactgctaattaatttctacacaaatcaattttattttgccaaatacacaagtcaaccttgcacagctctgaatactacatatatccatcgtcttaaaaagactccagtcaaatcatcattccattctttctcaggaaggaaagcaaacacactggattgagacattttcttcccctttcgtgttaactttgatgtttgaaggtgccttgaataatcgtttctttttttctgagcatatgttaatgtcaaatattcatttgttttaatatcaatgattctgccttgtaaaacactgttgcctgggatgaaaatgtcaacttttcttgggcctcggtataactttctggccaattcttgaagttcttttaatgcaagttttttgtttttgtaaggggaaaagtatcttgtgtatccttagtgttattcactcaaggctctgagaaactgctgtaaataccttttacttttattttttattttttattattttaatggacaaattatacttgtatacatttatagtatacaatgtgatgtttgatatatgtatacaatgtagaatgattaagtcaagctagtgataacatatccatcaccttacttatcattttttgtagtgaaatatttgacttactcccatagctattttgacatataaaatgtattattgttaactatagtcatcttcctgtcttaatatatattttaataaaaacttcttccttttaaaataattttttccccaaaattcatatgccacttcatggttccctgtataattctttttttgctttgtctcttcctagagtgggaaagactatttcttttttttcattattatactttaagttttagggcacatgtgcacaacgtgcaggtttgttacatatgtatgcatatgccatgttggtgtgctgtacccattaactcatcatttaacattaggtatatctcctatttctaacagaactatatccatgaacagttttatccagaaggagctatagccaagctgtattacaaaagctataagaatgtcagtcacatgcagatattcaaacatagaaaaggggagaggctgtgtttgtgaggcccagttcccactcttctgatttcatttcttctttaggatcttttcaccaccaccaccacgctggtgcacatttctggtaattgttggaaaaacatctgggtggatgtagtgtgactactattttttatttatctctgtttagatggaattattccaaaagatctcttatatgtatcccctggagaccccatgctaacacatgcctctgggatgttgtggtttttccactatcactacaataaaaatattaccattgcaaccattttacaatagcttatctgaagaacattacaaattaaatgagcttagagacagaagtcagtgctatgtataagaatagtagctatttatttagtgcttacagtgtgccaggttctgggctaagcaaaatctatgtattttctcattttatcctcacaacaactctatgaggagattactaagaaagcttgctgtgttgaaaaacataataagcttgtgattactcttgcttttgaagaaaagtggtagtagggtcactctattgctttgaaacatattcctatatttaactatgaatagcagtaatgactaacatgtattgagtgcttactatgtgccaggcactatactaagcactttatctggattgctccaaagtagatactaggaatttatggatgaggcaaccaagaatcagagatgttaagtaactggctcaaatccgcagcataaatcaggcaagtgggatctaattcaggttttgggtgactctgaagtttgtgttctcaactcatacctcctattactagttgtcctatttgtctccccaccataccctgcattctttgtaactttctcttacactattatggaaaattgtcagggtggcattatattttctatctccgtgatttttctcaggataccttgtcttactggctcttctggaactgttctattctgtcctcctaaaagaaaattgtcttcaggaaaacataagtttcttttattttgttttttgttatttctaaattgttagttgtgagtaagggagctatttgtatatcttatggaatgctttctgtctgtcacttatctcttattggtaagtgacaccagggtcctgagttctctgtgaaaatgttctaactgtaaaaattaccccaattatgtaaccagcttctttgtaaactttcccctgagactctgaaagcattttcagatctccccaaaagacaaacatataaagaaaaagtcaaattaaataacgacttatataagttcttaaatgtctataatggaaataaatatgattttttaaagttccagagtatgaaaagatcccctgaaaaagtatgtttctattcatataaatctcaccaaatcggactaattggtcaaaaagtcagtttgtttaaaaatattttatattcgagttgtctactaaaggaaattttcttttataataaagtttcctttacaactgttttaaaatgtagaaagaaacctgcagaaagcctttccattgttccaaatgacatatttttctattgtcacatgataatacaaatctgggacaccacagtagaaatatagaacaaggtgctgctattgaatctccctggtccttaatttattcatttatccaataaaggaattatcttgttgatgtttaagttcctttccaactctgacattgtttttttccttaccatgggttctgaattacctttccattgttctaaaattctaagaaatgatagttatcctgtattttttttctgaattcttttcataccttgtagtaatgtaatgtacctaattctaaaatcccctgggtaagagggacaggaagatcttggaaggattcaaatatgacacacaaaggggattagaatgcaaactgagatatcttcaatattaacaaaatattgatgtggatgattccttctctcctaattaatccccattatacatcaaaacttcctgaacacttatgaaaatcagcatcttgaaggaacactttcatacatttgattaaattattttaaaagtggaggttagatttataatctcaattaagttataagttccttaagtgcagagatcatggttttgtcttactatccacagtgcctagcatcctaaaggactcatggtagtcattcagatttattgttaaattgtatctgttgttgagaagccttgtatagtgttgtgtataaattctggccaagatgatggacaaagcagaagggaaatattataccacaacagatgcataaaatgctaaagaaaataaattttaacatgcatagccaagcctgaaagtatgaaaggggtatctccagatgttggaaatgaagaagaaaataatagctaaagtggcggataataattgaagctttacaaaatgtgaaggacctggactctaaacacaacttatcttaggtgatgaggatctaatgcctcgtatgttgggagcatgagcagtttcaacctttctgggacctgaaagtcatacaatttggaaagctctccttaaaaattatcttacttttcaatttcactaaaacccatgaacatgtgcacacatatgtagggccattccttgggccatgaagggagcccatggacatgaggccctgaaacctaagcttcattagctacatggtaaatctgcctctgacttttgtcaaggtcacaagcttggtaaaaaccaaggagcttgacttaggttacctatgtggaagccagaaccagaaaagcaatgcatcatgtttgaatagctaccagaaaacctctgctagctggcttagggtcttgtaggtaattcactgctggacccaggctttaggtcacctgagagtgactagaacctttgagttgtagaaactacagccaattaatagatataaaatctagtttgaatatggtgactcgtctaatattcaggcaaaggcatctgtgaaaccactccagaggaggccatcacaacccatgacctatttatatcttctacagaaaatattctcatatatccatggaagatgaacccataaataaaaagtataaaatacatgagaaaccttaacaccaagaaatatacttcacagaacctagagatgagagaattcacatccaagcaaccagagatagcagagcaataaaaggtgacttcaaattaagaaatttataattgcgtatgtgtatatagacacacacacatagaagtgcatatatgatttttaataaagtctcattcctttgtattagtcagtttgggctgctttaacaaagtaccatagatagggcagtttataaataacagaaatccaagatcagtgtactggcatagttgggttctggtgagggctctcttctgggttgcagaaaagtgcaagagagctctgtgaggtaactattattaatacaatggcatttatctcatttttgaggactccacattcgtcactgagttacctccaaaaaagccctaccacaaaatactgtcacattgggattagaatttcaacataagaatttttgagggacacaaacattcagtccattgtaatcttcaagtgtatatatcattttgcttcatgtaagttatattagctttggttaagttatgttgcagtaataaacaaccccatgatctcaccggcttaccaatagaaggttgatttctcacttttgttaggagttttctggaggttgactgcagctctgctccatgttttcttcactaacagggaagcctctatctgggaccttgacactttcaattcagaggaggaagagcaaggcggtaaatcactcgatggctcttaaaagttctaggaagcagcacatatcacttccacccatgttgcattggtcaaggcaagtcacatatccagacatgatgaaaaagaggtagaagtatataatcctcctgtaggaagggacagtgaatattttgaacaaaggatacaaaatttgatttgacaaataagaaatatttgatattagcaaatgagtccttctgatatgtatatagaggcttgaaaatcattattttatgtattaatagtttttccttgtaattctacaggctcttagcaattcttcattgatatgataaggattatcataatctgatattcattaaccttgctatgaatgccagaacaggttagttccaatggcaacactcatcttctacccacaaatcacgtccacttcttggactgatctttgatgctgccaggatacaggaaagtgaatagccgtgttaatcttgacactcatatgataaggattatcatcattatcatatcactttcaaattagctggatccaaatatacagacatgaatgtttttcccccaactctgcttctaaatcaaagttctttcccaatctttatcttgtctatttacagacctctaaagtatgatttgattatttttaactgtctgtattcctctctctctctctctctctctctctctctctctctctgaaacttaggatatgcatagataggatcatgggcagggtagatggggtggaacatgtttttctttcctcaccagggaaatttgatattcactaaccttgctatgaatggcagaagagattagttccaatggcaatgctcgtcctctacccacaatcaggtctacttcttggactgattattgatgctgccaggatacaggaaagtgaataaaaagaaaagccatgttaatttcaagctccatttagaaacacactagaaaaatcaatggctggtaagtagaaatcggcaaaattggcaggaagaatttttacattcaagcatagaaggggctggaatataaatctgcacactgaccagataataaccagataaaatgatgatgatactagaaaggcacttgacaaggctttttcctaatgttttagtgcactgaggaatgttcacctcttagattcactgaaccaagattctgtcatttaaaatttggggattaaagtttgtcattagttttctcaagccttactgatttcacagaactgaagtaggcagatactggctcctggaaggagtgattaaccagcaactttagtgctaaaggaatttaggaaatctggattttagtggggtatacttatgggaggccctcttcttcaggtttaaagatcattttctatggtgaatttaatctcactcagtgttacatctgaaaaatgggatattattctgagatcttcctcacttattataaaagaagaggttttctaactttgtgatgctgagagaattacttctctcatccccatgtttaccaattctcagcaccaacctgaagtacatttttctccatgaagcctgccctggcaattccagccttcacttctttttgtttcttcttgtgaacttctagggaaatgtatggcttagagacactacaatcctatggtcttcagtattgttccttaaattgactcatacttattggtttattgagtatctattctgttgggtattgtacttaacactgaggataccaaaaatagatatggcccctacctcaagatgcttacagtctagtgggaagaagagagagaagtaactgggataattaaaatacaatatgaaaaagaaaccatgtgaaaagcaccaagacataagcacagggtgctgtgggagtgctcagttgtgtatgttgttgttctatccaaccagagattaagtttctctaggacaagatccacatcttccacttttctcccattccccgtagtgcctgacttatactatccttggtctggaactcttttccccccacagatatatgcattccttgatcactgtattcttttaagtctttgctcaaagatcaacttctcagagacagttgagctatgttattcaaaattgtttctctctcccatccaccttacacacatacagtcacattctagaagcacatattttcttctttccttgctttatttttctacttagcacatatcaccatctgacataccatatcatctacctatttaattttgtttattatctatcttgcctgctagaatataagctctatgagaacagggattatatctgtcttgttactatttttttttttctctagagaggcctgtaacagtacataacagttacttacagtaactttaaagatattggcttaagttatggatgggtggtaacagtgcaagttggctcgcaattagtaattctttagtgggttgaatgatttctcttttaatcatttaatagagaaactaccactactgcctctactactacctctacttttaatttggcttgataatgaagggcctgttctgcaattcttagaccctgagaagttgctcttctggatacatgtcagatcccccataactatgtagcaacagtcacacttgctgccttaagcctctttcaccctctgaaggcatttagcacatggaccatgctttgagaattacagacacagttcatgaaatctctcttcttaaatttatatttaacagttaccatatgttcatgaccatgataattttgccccatacatttgtttttatttggggtcttgcatggtaggaagactttaagaagtcaaagattattttttcgtcttttcccacttaacaaaatcaaaatgtttcttaatgctgacgtagttactaaaacctatctatacaaaatagtttgctacttctaaggtaaagattgaaaaaatagtgtcaatttctgtttagaagatttctattattgttcctagtggaggtacaaaaactggttcacacacacaaccaaatcactgttatatagctttctttttttttttttttttcaagggacatgctgaattttattttatttttttctctgtaacaatttcttttattattattattattattattattatactttaagttttagggtacatgtgcacaatgtgcaggttagttacatatgtatacatgtgccatgctggtgcgctgcacccactaactcgtcatctagcattaggtatatctcccaatgctatccctccccgctccgcccaccccacaacagtccccagagtgtaatgttccccttcctgtgtccatgtgttctcattgttcaattcccaccgatgagtgagaacatccagtgtttggttttttgttcttgcgatagtttgctgagaatgatggtttccagtttcatacatgtccctacaaaggacatgaactcatcattttttatggctgcacagtattccatggtgtatatgtgccacattttcttaatccagtctatcattgttggacatttgggttggttccaagtctttgctattgtgaataatgctgcaataaacatacgggtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctaccattccttctgaaactattccaatcaatagaaaaagagggaatcctccctaactcattttatgaggccagcatcatcctgataccaaagccgggcagagacacaatcaaaaaagagaattttatatctttcttttgctttttatagcatctaacttcaggtaaagtttttgttaagatttttgcatgtcactttttggaaaacatttaaaatcagcattagtgtagaacttacacatgtaactattcaagagaatgcaagatgaatttaggaataatttctgagtcagatttacaatgcaaacatcaaacatgagcaatagagctattaaccttgaatcaattgagctgtctgtacatacagggcattttttttttcttgagacatacccaggggtaaaggagataacgtaaactcagtctgtgaataaacaatattgtttactggaagagatggcaaacaagctcatagagaagtaatggacatgcagaagatctggaaaaactgaagtaaggcttcaaataaatttgggaaagatttagtaaaaatctaagcctccacacagtagcacattattggctagtgttggagatggcttataggaatctttatggactaagattcttctggcttttattccacagatatctctctgccaagtggctttatacttcccttactgatacttcacatatctttgtgtacattgttagactgcatggactaagtgtggtaccttgcgtctgtaccatgataccagttagcatggaccccggcacattggatcattcagaaatgtagtttcaccacactctgtgccaggtcataatgatcttccctttgatctggctttccactaatattataccatccctgatgtgacaattcaatggttatctgaatttcttatatatgagtaaaataataataacaatgatgatttgtcaagcactttatatccagcaggcactgtgctctgtgctttatatattactgtctgttttaatcctcacaacaacccaataaggtatgtattcttattctacacatttcaaagatacagaaactgaggcacaggaaagttaaatagattgctcaacctcacttatgcatttgtctactctattagctttgctgtgatttccacaaaggtagatatcagaaggtgtgaattctcttttgaagttggttctaaacacagtgttatgtatatttagatggctaatcatagttaaacttataagtgtgtcaagtaattttagggcctcctgggaggtctctttgttctcccagatatctttcctactgaattgctgatgcctaaaatcttgcaattcagaaataccttatgttggcttgaagcttcttgttccctgtttaaagggcagatatttctggaaggataattctaaaaaatattactgggcattcatgtaagtatattttattagcttcctttttttttgaatgaacaaattttgatgggagcaagtttcgaaaacgtgaggacccaggatacctgaagttggcaagaaaaatatagtatcaagggaaatatggaagaggaagacattaaaggtacaaaaagttcaacttcatcttgatttccaaccgagccaacctcagttaataaacagttttcaatgactcttttggtaggaattattacaaagttatataaaatattttatcatagggaaagaatcggattctttgtaaatcaggctctggtttgattttagacttttatatttttattaatttgtgcatatttaatgtaaatgactaaataattatgtagcgatccattgctagttgaaatttagaatggggcattgccctaaggcaatatctccagatcagtgaaaattctccttagtcctaacctttctttttatgtttttaattgcaaaactaaaaagcaagcaaacaaacaaaaaacccaaacacgttaatttgtaaaagagaccaagcaaaactagtaaaaaaaaaaaaaaaaaaagagtgcagaaaacatagccttgctctatgaaattgacagcactttggtgtctgcattttcttgcaatattaatgagaaagtcaagcatcatgtttgtgccaaatggcaacttgtttgacacacaacagtttcattttcaagtgtaatatgttgattctttattggattatttcaggttttctttttgagtaaactttatatttcctttgctgtagtatatacaacattaaattcttgccctaaaccaattccttccagatatgtcaagctctccaagtctggtgcaaattatcacagtagtttctgctggaattttatgttgtattttgtaaatgtagcaaattgacttcatcctctacataggtatgaggttagctatcatgagttgtttcaggacaggatctcatattttctggttcacagtcatatgatttgtttgggtccttttcagtgagatgggaggaaagtggagacttacagtgagaagtactctaaattacaagagattatcaagacagactaagtctggactgaggattgattttcaggtagccaagtaggatggccaacttgacaattaattagggtaatgtgaaaagtgggggagtgtgtagagtgagttgattgcttggtaatcaaatgatagtacttctcattttctcctgctgagtacgctaaatctgttttgcaatttttttttatctgctactctttacttctcctttaagtaattgcagtaagtcacaattacgctagtcatctcctctgacaattatcaagtttcacctcaaagaatgcctggaacaaattatgaaggaaaaatcttagaattggggacatatggccttagcagagtaagctagtaaaattctcccatggcaaactactgagtaaagcttctataagacagccctgccagagattggcacccttcctaacccccaagatgttagtagaggatagtacttcttcagagaaaaagcgtacagtagtcccataagcatatagcctctgcagtggtctaccataccatagaccttccaggaatcagataacatttatttttccactaacttttcacaagaacatagaatacattttcttgtagaagatttagacaagtaaggctgtttcttacatccattattttccaggaggatggcctgtcccccagatccttacttgtttatttccatcatccaagttcatcacttagaaccctctcctaagcaaggacacagcttcatgattcattttgcatataataaactaattaacaagtacatcacaaaaatcaaaatttgctacagttcaaataggtctatgtgattcttatcacgcaaactgttcgaagtaatgcattttgatagaattgtagtatcttacaaattaaaatttctgtcacaaaactatacctttctgttttccaaaatcaaaggtgcaatagaataagcaatccttcaacacgccatcaacttttgagtcccatgattgatttttgtaggctattaatgatttatgtttcacagcattaggtgacatagattgattttgagtcctaaatgtttcaataacgacctcattttgcggagtggttattaatgtggtagtatagtttaacagcactacacccttttaaaagcagtttaatatttttttaagcaaaactaagattttacacaaggtcattctaggctctcaaactttattttacataacgtaaaatttttataaaaatgtaagattatcatctcattttaagatggcattttattaattaagagtgaaaatgttaattttgtagatatttttcatgcacctagagaatattttaaacacataaaaaatgagatatacctttctttacaattacgttctttgctagtgaacatgggagtcttcatttcccttcttacaaatattgctgaatttaattcagtaaaagtggtcatttttcatatttatctgtaaattgcactgaattttgttgtagtcacattaggaagtaatgatttatatgctttctaattatttatctgcttatataagcatagtctcattttagaaatgttattgaattaatgttgtaatacctggaacaaagaaaaataatttccatagactaagctctgcttttcagaaatctgatcttgttttgcatgctgtactctgtaatataggtaaatgcaggtgccaatcaggcaatttattataaaatttaaatagacgctgggaaaagtgcatagaaaatgcttatctactgaaaagtggctgttttcctgaatataaactctaagaggctgaaaccaaatagttaaagtatctgtcctattgcagaactagggacacaatacaacctgaggagttactggttgctctcttttattcccatgtgaggatattggaatgagaaggtgcatggcagttgtatgttctggaaagcttgtaatatagacaagagaaggtggtgagaattttttgagaacttttccctaagtcttctgttaaactgaagcttagagtaactcacaaataagtgaactaaaaaaaggagataaaataaatgtttagtttttaaaaatgctacttttatgaaaaatccaagcttaccactaaagaaaaaatattctaccatgttcaaagtcatatttggtcaacaggcatatatgcttctctttatggaatacttgtttcctgaaacaacatgaaaatctcattttataatagactggaaattattgtttacaacatgtaaatatgcttacagaaatgtgcagatatgatatacaaatgctgaaaaaacacggaagaataacaaaaagttggggcctggcttcaggtatatttttaaagccttttaagaagaattcaaatgatggaaggggcataagttggtgtggggactatgagcaaaagaaattcatgaggtgatatttttctttctaaataagtacccattttcaatgattaatgtagaaaattagttgccttgttggaagctgttatttattgctgaataacataccatcccaaagcctatgccttttaacaataactttcaacatccatggtaatgagaggtgaagccggctgggcttctgggtcgggtggggacttggagaacttttctgtctagctaaaggattgtaaacacaccaatcagtgctctgtctagctaaaggtttgtaaatgcaccaatcagcactctgtaaaatggaccaatcagcactctgtaaaagtggaccaatcagcactctgtaaaatggaccaatcagcaggacgtggatggggccaaataagggaataaaagctggccacccaagccagcagtggcaacctgcttgggtccccttccatgctgtagaagctttgttctttcgctcttctcagtaaatcttgctgctgctcactctttgggtccgcactacctttatgagctgtaacactcactgagaaggtctgtggcttcactcctgaagtcagcaagaccacaaacccactgggaggaacaaacaactccggacgccccacctttaaaagctgtaacacacactgcgaaggtctgcggcttcactcctggtcaagcgagatcaagaacccactggaaggaagaaactccagacacatctgaagatctgaaggaacaaactccggacacaccatctttaagaactgtaacactcactgtgagggtccgcggcttcattcttgaagtcagcgagaccaagaacccaccagaaggaaccaattccagacacattttggtgaccacaaagggactatcacctatcgccaagcggtgagtaccattggaccccttttgcttgctattctgtcctatttttccttagaattcgggagctaaatactgggcacctgtcggccagttaaaagcgactagtgcggccaccagactaaagacacgggtgtcaggctttctgggaaagggctctctaacaacccccgactcttcggagttgggagcgttggtttgcctggaacaagcttctgcttttcctgtacttctgggctgagtcaaggtcaacagagaggaaagccattcagctccagggtcccgacaacaagttggttgaccctgtgaccatgagcggaactctcgaagtcatgttgcccaagcgagactcgcccatctattctatctatcttgacccttgcctcttgggtcctaatgcctgccagacaaacttcctcttgcctcttctttgaggctagtcccacttctaaaaaccactccctatctctggtgcttttctagtttctcctataagaatgatttctagtgtaaactccaggactctgttaccttctttaggcacccaggctcaccaatcagaaagacataatttttacccaaagccccatcacaggggggactgcctggaattttaggatccctcctcagactagcaggcctaacaaaagctattcctgaagctaggatatggggaacctcagaaattgtatccttcctattcatataagtgaggacaaaaaacatcactcttccaactctggagatccctcccctccctcagggtatggccctccacttcatttttggggcataacatctttataggacaggggtaaagtcccaatactaataggagaatgcttaggactctaacagattttcgagaatgcatcagtaagggccgctaaatccgatttttctcagtcctctttgtggtctaggaggacaggcaagggtgcaggtttttgagaatgcattggtaagggccactaaatctgatttttctcggtcctctttgtggtctaggaggacaggcaagggtgcaagtttttgagaatgcatcagtaagggccactaaatcagaccttcctcagtcctccttgtggtctaggaggaaaactagtgtttctgctgctgcgttgatgagtgcaactattccaatcagcagggtccagggaccgttgcgggttcttgggcaagaggtgtttctgctgctgcgtcagtgagtgcaactattctgatcagcagggtccagggactgttgcaggttcttgggcaggggaagaaacaaacaaagcaaaaccatgggcaattttgtctttcagatggaaaacactcaggcatcaacaggctcacctttgaaatgcatcctaagccattgggaccaatttgacccgcaaaccctgaaaaagaggtggctcatttttttctgcactatggcctggccccaatattctctctctgatggggaaaaatggccacctaagggaagtataaattacaatactgtcctgcagcttgaccttttctgtaagagctaaggcaaatggagtgaaataccttatatccaagctttcttttcattgaaggagaatacacaactatgcaaagcttgcaatttacatcccacaggaggacatctcagcttacccccatatcctagcctccctatagctccccttcctattaatgataagcctcctctaatctcccctgcccagaaggaaataagcaaagaaatctccaaaggaccacaaaaacccccaggctatcggttatgtccccttcaagctgtagggggaatggaatttggcccaacccaagtagatgtccccttctccctctctgatttaaagcagatcaaggagacctggggaagttttcagatgatcctgataggtacatagatgtcctacagggtctagggcaaaccttcaacctcacttggagagatgtcatgctattgtaagatcaaaccctggcctttaatgaaaagaatgtagcttcagctgcagcctgagagtttggagatacctggtatcttagtcaagtaaatgatagaatgacagccgaagaaagggacaaattccctactggtcagcaagccatccccagtatggatccccactgggaccttgactcagatcatggggactggagtcgtaaacatctattgacctgtgttctagaaggactaagaagaattaggaaaaagcccatgaattattcaatgatgtccaccataactcagggaaaggaagaaaatccttctgccttcctcgagtggctatgggaggccttaagaaaatatactcccctgtcacccaactcactagagggtcaactgattctaaaagaaaagtttattacccaatcagccgcagatatcaggagaaagctccaaaagcaagccctgggtcctgaacaaaatctggaggcattattaaacctggcaacctcggtgttctataatagggaccaagaggaacaggcccaaaaggaaaaagctagatcagagaaaggccatagccttagtcatggccctcagacaaacaaaccttggtggctcagagaggacagaaaatggagcaggccaatcacctggtagggcttgttatcaatgtggtttataaggacactttaaaaaagattgtccaatgagaaacaagccaccctctcatccatgtctgctatgctgaggcaatcactggaaggtgcactgccccagagtgcaatggttctctgggctggaagcccccaaccagatgatccaacaacaggaccgagggtgcccgggcaagcgccagctcatgtcatcaccctcactgaggcctgggtatgtttaaccattgagggccaggaaattgacttcctcctggacactggcacagccttctcagtgttaatctcctgtcccagatgactgtcctcaaggtctgttaccatctgaataatgctgggacagcctgtaaccaggtatttctcccacctcctcagttgtaattgggagactttgctcttttcacatgccttttttgttatgcctgaaagtcccacacccttattagggagggatatattagccaaagctggagctattatctacgtgaatatggggaacaagttacccatttgttgtcccctacttgaggagggaatcaaacctgaagtctgggcattggaaggacaatttggaagggcaaaaaatgcctgcccagtccaaatcaggctaaaagaccccaccacttttccttatcaaaagaaatatcccttaaggcctgaagctgataaaggattacaggatattgttaaacatttaaaagccttaggcttagtaaggaaatgcagcagtccctgcaacaccccaattctaggagtacaaaaactaaatggtcagtggagactagtgcaagatcttagactcatcagtgaggcagtaattcctgtatatccagttgtacccaacccctatactctgctctctcaaataccagaggaagcagaatggttcactgttctggacctcaaggatgccttcttctgtattcccctgcactctgactcccagtttctctttgcctttgaggatcccacagaccacacatcccaacttatgtggacggtcttgccccaaaggtttagggatagccctcatccgtttggtcaggcactggcccaggatctaggccacttctcaagtccaggcactctggcccttcagtatgtggatgaattacttttggctaccagtttggaaacctcatgcaagcaggctactctagatctgctgaactttctagctaatcaagggtacaaggtgtctaggttgaaggcccagcttttcctacagcaggtcaaatatctaggcctaatcttagccagagagaccagggccctcagcaaggaatgaatacagccataatggcttatccttgccctaagacattaaaacagttgtgggggttccttggaatcaccggcttttgccaactatggatccccagatatagtgagatgactagaccactctacactctaatcaaggagacccagagggcaaatactcatctagtagaatgggaaccagggacagaaacagccttcaaaaccttaaagcaggccttagtacaagctccagctttaagccttcccacacggcaaaacttctctttatacgtcacagagagagcagagatagctcttggagtccttacttagactcgtgggacaaccccacaaccagtggcatacctaagtagggaaattgatgtagtagcaaaaagctggcctcactgtttaagagtagttgcagcagtggccatcttagtgtcagaggctatcaaaataatacaaggaaaggatctcactgtctggactactcatgacgtaaatggcatactaggtgccaaagaaagtttatggctatcagacaccacctacttagataccaggcactactccttgagggaccagtgcttcaaatacatacttgtgtggccctcaaccctgccacttttctcccagaggatggggaaccaatcgagcatgactgccacaaattatagtccagacttatgctgcccaaaatgatttcttcaaagtccccttagctaatcctgaccttaacctatataccgatggaagttcatttgtggagaatgggatattaagggcaggttatgccatagttagtgatgtaaccatacttgaaaataagcctcttcccccagggaccagcgcccagttagcagaactagtggcacttacccgagccttagaactgcgaaagggaaaaagaataaatgtgtatacaaatagcaagtatgcttatctaatcctacatgcccatgctgcaatatggaaataaagggagttcctaacctctaggagaaagcccattaaataccacaaggaaattatggagttattgcactcagtgaaaaaacccaaggaggtggcagtcttacaccgccaaagccatcaaaaaggggaagcagaagggagaacagcagcataagtggttggcagaggcaaggaaagaccagaagaaagaaaagagagaaagagacagaaagtcagagagagagagagagagagagaggaagagacagagacaaggaaggagagagagaggagaagagacagagacaaagagggagtcagagagagagagagagagagagaaagtcagagaaaggaagagacagacaaaaagggagtcagaaagagagagacgaagaagtcaaagagaaagaaagaccttctttctatcttccttctttctgacagcaatttactcctacctttaattcagcctggataaaatgatctcatcttccagagcaccagttttaccttcctatttactctttgcctatctatccttcctgcttccttggatacctcatacaatcacccctcaccttccactagctcctaattacctctacaagactctcaacctaacccacgctctgttaaaccagtccaatccttccctggcaaatgactgttggctttgtatctctctatcaacttctgcttacgttgccactcccattcctgcaaaaaaactgggtctttaccaacttaacctactaccctagttatgaaggaaaagaccctttccaacttctaaatatgcaatcattagccaaattccccatttctgataggaccaagaataccctaacaggacatgcaatccaacttttacattcttacatttcccacctcacctattacacaagcaatgaaaagcccatacacggcactgtaactatgaataccatcttaactttctaagttcctttatgcatccagtgcaacctgttatcaggcctgcctctggggcacctactaccccatcagcgtaattacaccccacaacttcaagccccaactgatcatagtaacttccgagtcacccaaacagctccattcagatggcttgtccgcttctcagggcccccaaaagtcatcatctcctccctacttaacaaacagtccaggttctgtaatggcaaacatactccctgcatgaccattcacccctggactccctgcagcagtgcccccaccactagtgaatgcctgctcatcccctctttcaaccactctctcaaaaggttcctagtcgatacaaaacggtgttttctccaatgggaaaatagaacacagggagccactcagtttgatcccaacacccttccacccgctcaccagagctaccttggcaagtagtctaggagtatgggaaaatgaaaacaacaaactcacacacctttttaacatacacaaacagttctgtctacccagccaaggtatattcttatgtggaacatcgacctatatctgcattcctactaactggacaggcacctgcaccttagtctttctaagtcccaacattaacattgccccaggaaatcagacattatcagtacccctcaaagttaagtctgtcagcacagagccatacaactaatacccctattaatagggttaggaatggctactgctacaggaaccggaatagccagtttatctacttcattatcctactaccacacactctcaaaggatttctcagacagtttgcaataaataatgaaatctatctttattttacaatcccaaatagacttttttttattgtactttaagttctagggtacatgtgcacaaagtgcaggtttgttacataggtatacatgtgtcatgttggtgtgctgcacctattaagtcgtcatttacattaggtgtatctcctaatgctatccctcccccctacccccaacccaagacaggtcctggtgtgtgatgttccccttcctgtgtccaagtgttctcaatgttcaattcccacctatgagtgagaacatgcagtgtttggttttttgtccttgcgatagtttgctgagaatgatggtttccagcttcatccatgtccctacaaaggacatgaactcatcttttttatggctgcatagtatactgtggtgtatatgtcccacattttcttaatccagtctatcattgttggacacttgggttggtccaagtttttgctatcgtgaatagtgccgcaataaacatacgtgtgcatgtatctttatagcagcatgatttatagtcctttgggtatatacccagtaatgggatggctgggtcaaatggtatttctagttctagctctttgaggaattgccacactgtcttccacaatgatagaactagtttacagtcccaccaacagtgtaaaagtgttcctatttctccacatcctctccagcacctgttgtttcctgactttttaatagttgccattctaactggtgtgagatggtatctcattgtggttttgatttgcatttctctgatggccagtgatgatgagcatgttttcatgggtctgttggatgcataaatgtcttcttttgagaaatatctgttcatatgctttgtctgctttttgatgggattgtctgtttttttcttgtaaatttgtttgagttctttgtaaattctggatattagccctttgtcagatgagtagattgcaaaaattttattccattctataggttgcctgttcactctgatggtagtttcttttgccgtgcagaagctctttagtttaattagatcccatttgtcaattttgtcttttgttgccattgcttctggtgttttagacatgaagtccttgcccatgcctatgtcctgaatggtattgcctaagttttcttctagggtttttatggttttaggtctaacatttaattctttactccctcttgaattaatttttgtataaggtgtaaggaagggatccagtttcagctttctacatatggctaaccagttttcccagcaccgtttgttaaatagggaatcctttccccatttcttgtttttgtcaggtttgtcaaagatcagatggttgtatatgtgtggtattatttctgagggctctgttctgttccacttctctatatctctgttttggtaccagtaccatgctgttttggttactgtagacttgcagtatagtttgaagtcaggcagcatgatgcctccagctttgttcttttggcttgggattgtcttggaaatgcgggttcttttttggttccatatgaactttaaagtagttttttccaattttgtgaagaaagtcattggtagtttgatggggatcgcattgaatctataaattaccttgggcagtattgccattttcacaatattgattcttcctatccatgagcatggaatgttcttccatttgtgtcctcttttatttcactgagcagtggtttgtagctctccttgaagaggtccttcacatcccttgtaaattggattcctaggtactttattctctttgaagcaattgtaaatgggagttaactcatgatttggctcctgtttgtccattattgatgtataagaatgcttgtgatttttgcacattgattttgtatcctgagactttgctgaagttgcttatcagcttatggagattttgggctgaaatgatggagttttctaaatatacaatcatatcatctgcaaacaagaacaacttgacttcctcttttcctaattgaataccctttatttctttctcctgcctgattgtcctggccagaacttccaacactatgttgaataggagtggtgagagagggcatccctgtcttgtgcccgttttcaaagggaatgcttccagtttttgcccattcagtatgatattggctgtgggtttgtcataaatagctcttattattttgagatatatcccatcaatacctaatttattgatagtctttagtatgaagggctgttgaattttgtgacaggccttttctgcatctattgagataatcatgtggttttcgtctttggttctgtttatatggtggactacatttattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgtcaggctttggtatcaggatgatactggcctcataaaatgagttagggaagattccctctttttctattgattggaatcatttcagaaggaatggtaccagctcctccttgtacctctagtagaattcggctgtgaatctgtctgctcctggactttttttggttggtagtctattattacctcaatttcagagactgttattggtctattcagggattcaacttcttcctggtttagtctttggagggtgtatgtgcacaggaatttatccatttcttctagattttctagtttatttgtgttagaggtgtttatagtattctctgatggtagtttgtatttctgtgggatgggttgtgatatcccctttatcattttttattgcatctatctgattcttctcccttttcttctttattagtcttgctagcggtctatcagttttgttgatcttttcaaaaaaccagctcctggattcattgattttttgaagggttttttgtatctctatctccttcagttctgctcttatcttagttatttcttgccttctgctagcttttgaatgtgtttgctcttgcttctctagttctcttaattgtgatgttaggttgtcaattttagatcttttctgctttctcttgtgggcatttagtgctataaatttccctctacatactgctttaaatgtgtcccagagattctggtatgttgtgtcttttttctcattggtttcaaataactttatttctgcctccatttcgttacgtacccagtagtcattcaggagcaggttgttcagtttccatgtagttgagtggttttgagtgagtttcttaatcctgagttctagtttgattgcactgtggtctgagagacagtttgttataatttctgttcttttacattttgctgaggagtgctttagttccaactatttggtcaattttagaataagtgtggtgtggtgctgagaataatgtgtattctgttgatttggggtggagagttctgtagatgtctattaggtccacttggtgcagagctgggttcaatttctggatatcctcattaactttctgtctcattgatctaatattgacagtggggtgttaaagtctcccattattattgtgtgggagtctaagtctctttgtaggtcactcaggacttgctttatgaatctgggtgctcctgtattaggtgcatatatatttaggatagttagctcttcttgttgaattgatccctttaccattatgtaatggtcttctttgtctcttttgatctttgttggtttaaagtctgttttatcagagactaggattgcaacccctgcctttttttgttttccatttgcttggtagatcttcctccatccctttatgttgagtctatgtgtgtttctgcacatgagatgggtctctgaatgcagcacactgatgggtcttgactctttatccaatttgccagtctgtgtcttttaatgggagcatttagcccatttacgtttaaggttaatattgttatgtgtgaatttgatcctgtcattatgatgttagctggttattttgctcattaattgatgcagtttcttcctagcctggatggtctttaaaatttggcatgtttttgcagtggctggtaccggttgttcctttccatgtttagtccctccttcaggagctcttttagggcaggtctagtggttataaaatctctcagcatttgcttgtctgtaaagtattttatttctccttcacttatgaagcttggtttggctggatatgaaattctgggttggaaattcttttcttaagtatgttggatattggccaccactctcttctggcttatagtttctgccgagacatccgctattagtttgatgggcttccctttgtgggtaacccgacctttctctctggctgcccttaacattttttccttcatttcaactttggtgaatctgacaattttgtgtcttggagttgctcttctcgaggagcatctttgtggcattctctgtatttcctgaatttgaatgttggcctgccttgctaggttggggaacttctcctggataatatcctgcggagtatttttcaacttggttccattctccttgtcactttctggtacaccaatcagatgtagatttggtcttttcacgtagtcccatatttcttggaggctttattttgtttctttttactctttttttctctaaacttctcttctcacttcatttcattcatttgatcttccatcactgatatcttttcttccagttgatcgaatcggctactgaatcttgtgcattcatcatgtagttcttgtgccatgtttttcagctccatcaggtcatttaaggacttctctacattggttattctagttagccattcatctaatcttttttccaggtttttagcttctttgcaatggtttcaaacttcctcctttagctttgagaagtttgatcatctgaagccttcttgtctcaactcatcaaagtcattctccatccagctttgttccattgctggcaaggaactgtgttcctttggagggggagaggcactctgatttttagtattttcagcttttctgctccgttttttccccatctttgtggttttatctacctttggtctttgatgatggtgatgttcagatggggattctgtgtggatgtcctttctgtttgttagttttctttctaacagtcaggaccctcagctgcaggtctgttggagttttctggaggtccactccagactgtgttttcctgggtatcagcagcggaggctgcagaacagcgaatattgctgaacagcaaatgttgctgcctgatcgttcctctggaagcttcatctcagaggggtacctggccatggaggtatcagtctgcccctactggggggtgcctcccagttagactactcgggggtcagggacccacttgaggaggcagtctgtccgttctcagttctcaaactctgtgctgggagaaccactactcactttaaagctgtcagacagggatatttaagtctgcagaggtttctgttgccttttgttcggctatgccctgcccccagaaggggagtctacagaggcaggcaggactcctttagctgtggtgggctccacccagttcaagcttcctggccactttgtttacctactcaagcctcagcaatggcgggcgccactctcccagcctcgctgctgccttgcagatcaatctcagactgctgtgctagcaatgagtgaggcttcgtgggcatgggaccctctgagccaggcatgggatataatgtccttgtgtgccatttgctaagactgttggaatagcacagtattagggtgggagtggcccgattttccaggtgctgtctgtcaccgcttcccttggctaggaaagagaattccctgaccccttgttcttcccaggtaaggcagtgcctcaccctgcttcagctcacactcaggtgactgcacccactgtcctgcccccactgtcggacaagccccagtgagatgaacctggtacctcagttggaaatgcagaaatcacctgtcttctgcgtcactcacactgggagctgtagactggagctgttcctatttggccatcttggaaccatctcccaaatagactctttggcagcagtgactctccaaaaccaccaaggcctagacctcctcattgctgagaaaggaggactctgcaccttcttaggggaggagtgttgtttttatactgaccagtcagggatggtacgagatgccacccgatgtttacaggaaaaggcttctgaaatcacacaacacctttcaaactcttataccaacctctggagttgggcaacatggcttctcccctttctcggtcccattgcagccatcttgctattactcgccttcaggctgtgtatttttaacctccttgtcaaatttgtttcctctagaattgaggccgtcaagctacagatggtcttacaaatgggaccccaaatgagctcaactaacaacttctgccaaggacccctggaccaacctgctggccctttcactggccttaagagttcccctctggagggcactacaactgcagggccccttctttgcccctatccagcaggaagtagctagagcagtcatcacccaattcccaacagcagttggggtgtcctgtttagaggggagattgagagttcaaggcagctgggcttctgggttgggtggagacttggagagcttttctgtctagctaaaggattttaaacacaccaatcagtgctctatctagctaaaggtttgtaaatgcaccaagcagcactctgtaaaatggaccaatcagcaggatgtgggtggggccagataagggaataaaagctggccacctgagccagcagcagcaacccactttggtcaccttccatgctgtggaagctttgttcttttgctcttcacaataaatcttgctgctcctcactctttgggtccacactacctttatgagctgtaacactcactgcgaaggtctgcagcttcactcctgaagtcagtgagaccacaaacccactgagaggaataaacaactccggatgccccacctttaagagctgtaacacaccctgcgaaagtctgcggcttcactcctgaaatcaagagataccatgaacccaccagaaggaagaaactggacacatctgaacatctgaaggaatgaactctggacacaccatctttaagaactgtaacactcaccatgagagtccacagcttcgttctcgaagtcagcgagaccaagaacccactggaaggaacgaattctggacacagtaatatagatgactaggctcagctggtcacttatcaggatcacaggcagttattatcagatggctgtggctagaatcatctgaaggctcaagagagctggatgtcaagatagattcttcacacatgctcctggagcctaaaataggaggaatggctggggaatagctggacatttctcttttaatgtggcctttctacatggtgacatggtctttgtcgtatcatgatggtctaagggtagactttgaagttacatgataattatttcctttagagccattgttcccagagacagaaagtgaaagctgtgatttttaaaaatttctgggctcataatctgataaagagtcacttcatattctactggtcaaaatgctcacagagtctgccaaaattcaaggagagaggatatgaaccccacctctctgtgggaaaattatcaaacaatttgtgaccatcattaatctactataaaagttatgcaggatagattagcaggatgcttcttatgtttttgttgttgaaataacagggacaaggaataaaaacctgtgcagaaatcagaagatctacttttgcatatacaaagtgaagagttgcttgtaaagcaacaccaggcattatagtgcctgtgaccttgatattagaatcaccttgccctccaaaagtgccatggacatcacttttataagtcagattctatttatatgctctagagttgctggctacttaaaggagaaccttttgtaaagtgaagaaaagtttaaaggcattgaacacacaggaggtgcaatgataaatgttactttaccctctctcattccattagtgttttcttaaaggaatattgggtcctactcaagacttaactgagatggctgatcttaagtgttgaatataagcccccgttcttggtcttggaatgtgaacattattgggtatcattgacggagagattggcaaaggaaatcctgcaagagataggagacctaaattttcaataagtgttctacttggtttccatggaaactgggttaggtagtgaatctcacttgatgtgcacttctgtgccttcttgaacagatctttaggagtcggtaaaacaatagtgggatagcattaataaaatctggaaagacaagtacaggtctggtggaacaaaaggaattgtttggggacactggtgttgattttatgctactggaagtactttgagctgcatacaactcatgtagcatgctcaatgagagacaactaagtataggtatattagtattcacagttgcaagtgacaccaagctaaattgaatttaaaataatataaaatatctaagttttctaatccttatttcaaataagaatcagaaaaacaaaaggctggggttaacctttttctgcatttctgcattgcatggctgtcctgcctaacatcagccttcactgatatctccttaacttaactcttagcaaaccagacatgtagccagaactcttattccctgccaattttgtataatgacactgtagaaatgaaaacttaaaatagccattttttcccatgaaagcttttaatagccatccacaaaacttttcttggattctttgttttaatctctgagctgaacattttcttttgtttcttttatttttcccaacaagtcctccattgatgataatcttaggaaatacagttaagaaaatgatactcttccattagcactgtagtcaaaaaatcattttgcttctatttctgctgtcaattccttttttgttgagttgtttttgtatgataaaagattaataataagaatatactttttactgcaaatattttttttccctccagtgggagtataggtataaataccaagcaatttgaattaaacagattaagtcgtagtattgctattccaattgcttgtcattacacaggaggttatggttacagctgactatacagcactacctgagccatacattttacatttgcaatcggcctattatagatgaactgtgaaaattggagagagctttttatgataattggaagatgttttccttgaagtatgtaaagcccttgagagaacttgaattacttgcttgtaattttgttataagctttaatcctatttatttaacttgaagtttattgctcctgaatatattttcctatgtctttctattgagtgacatacatgctatattttcaatatttttatttgaatatcattacaaattttattttgctttttgttttcaaactcaaaaagttgttttcccttgggcatgattcatagataaatgaagttacttctgggttttaaattaggaatatcaatggaaatacaaagacagcctctctttgattgtacttggttctttctgtgttctgagtaaacctgacctaacatttcagataccaactgggaatctgtaggtgatgtgtgcaacattttatgccacacataattgtgtgctcttttctttttctttcttccccttaacaatctttctctggtttgactggtctcttccctgtttctgaatacctcatgctcattcctactttttgatccccataaaccatttctgtgcctagaatgccctctctcctcttcagaaccatccaagtcttctcatctctccccctgacaagatactccaacttatgttttactgtgttcaagaatatttaatataactactacagcctaaattaatctatcatctatgtgctcgtagcacttatttgctagaccattatgttggtacccaaccatatgtaatgacaccttgcttctctagagatgagaagtgtgagaaagcccacctgaaatgatgatcacagagctgctgcattatgggtacagattttactaacagccataatacacaatttaattttaattattagcgaacttcattatctgttttataaatcctcaagtgataagacacagccaattcccattttcctcatctgctaggtgatatctcatcacatctaagatcccattgattgtaagacacatcactcttttacgtaccacaaagaaaagacactgcccgtaaaactgtttcacaagagtttgctatcactttgaatttgtattttgtacatatcaaaagagctctttgtcatttaaacatattgttttgtttatcacatcaatctttaatttacctggcatacgggatcagatacattaatgcatgtttaaatagtttttttaatctctggaatttcttctttaaaacattctagaccagaggttcttaacatacagtacacagattcttgaaggcggagagtctctgaatagatatagtggtcaactattactgcaacaatgctacattaaaaaccaacccccaaactcactggcttaaaacaacaattatttattttcatctgtacatttgtaggtcagctggaggttagctgacctaggctgggctctaagctggaggttgagctcaggtctaccatgcatgtctctcatctttcttggaataaaaggctacgtggagcattgttttttctcatggtgatggcaacattgcaagaagaatgagcagaaacatacaatgcctcttaaagactagagttagaaattgcattatatcacttatattggaaaaagcaaattaggtggccaaagccagcatcagtggagcaaggaaatattctctgcctctggtgggaggagctacaaagacctatggcaaaggtcatgaatttagggagagacgaaggaatgggaacaatggtgcagcctactaaaatcagtttcaaggagaccaaaaagcctctaaaattctttgctaaaatgttgtatcataaagggatatttttctagagaacatgttcttactattcaccagattctcaaggagtgaatgggattccaaccatttccaagtgagaaccacttactttaggtccttctattattcctttgtttgttcattcaatattaatatacctcagttaatgacccaggattgatttctgtgaacattttaaaattttcaggtgattgaggagttggttgctttcttttgcttctttttttttttttttttttttttttttttgagacggactctcgctctgttgctcaggctggagtgcagtggtgtgatctccgctcactgcaagctccgcctcccgggttcacaccattctcctgcctcagcctcgcgagtagctgggactacaggcgcctgccaccacgcctggctaatttttttgtatttttagtagagacggggtttcaccgtgttagccaggatggtctggatctcctgacctcgtgatccgcccgcctcagcctcccagagtgctgggattacaggggtgagccaccgcaccctaccgagttggttgctttctaccaggtcatgtattttaagagcctggcaggctctaaaatttgatttggcagggctctatcagcaccaggtaacctttctgtgcttgaagcttagctggtacccactcccatagtgatgtgttagtgaatcccatatggaagaaacatagaggggggacattgaaacaagaaagacctggtttcaaattcctgccctgccgtttactacctgtgtcatctcaggcaagtaaataaacctctatgcacctcagtttccttttctgtaaaatgagagtgacagttcttatgctacaaggtcatcgtcattgtgaggattaaatgagacaatgtgtgtatagtatttgtcacatgttaggtgctcaacaaatgctagtccctctcattcccattattgtttacattatgctgacaattttatcctcattctgtaatataaatagtatgtccctatcctgtgaaatattaatgaagaaatttctgaatgctattcctttttattttttgtttttaaaaacagttattagctgtttgtttctatcagcagattctagacccagaataaaatcatatttacacttgggcgtttctatgagctctctttagcctttctctcctggtatgaacgttatggaagtaaagtagcttctttttccctcaaaggggactgccaaggccaaaaggaaattgaactttgtcttcctagtcacctctgatctttgacataacagagactgaggaggtgaaagctaattcttaccaagtactttttgacacagtagattgagcaataatggaaaaagttctgagatgttgtttttcacaaaattaccactgttaacctccaaattacatcaaccgaaacaattttttgttctttgaactctgacacagattgaacgagccctcatcaagagtaagaaaaaaaatttctctaggttagtaggaattggcctattttgaattctattccagccagtaaacatgctgttaactttgaaaattctgtgtagatttaaaaagaaatactctaatagctaggtattttattaccttttaaaattatttcagcctcaagcctaacagattatttagtaatgagtgacatttccgttgcagaatagcaggtggataattaatgaataatgtgttctattttcctgtctatatgtatatattctagaaatataactagtgttataggtaacagttcccagcttgatcaatgtaaataaatataaggcccagttttaaaaacataaacattttaaatctgcaatgcttttatatttcattcatcaaattctagtgagaaaggcattaggcatgtaaaaaataaaagaaaaaaattataaattgtggtgttctgggggagataagctgatgataaaggatatatactatccaaaaaggctgaaaagactactctttaaaagagtatcttcaatgcattttaaaattgatgtacattaatttagctaaattaacaatgggaaattaaatactgttcagcaagcttattgtcctattagaactgtagcttttttggctgcagagggggcattaaatgttgatgatattcaatacaatagccaaaacctttttattccactatggatttgctactaacgtgaatctttaaaagggagaaagcaagctattttgagggttctaatttagacaaggctaatgaattgtgaaaaaaatacattttcatcaaatgtcatcagctgaataagcaaatgcattaagttatcattttatatatgttggtcagatattattctctctcttcttcccaacaattctggtttcacagatgagaaattattttaaaagaaaaaaactttctaaggagaatcttcattaggctttcaatagagattcaccctggacacatctagaaatgtaaacaccatagtaaaaaaaaaaatgtaaagaataaactctcttgggagctgtttgagctggcttataacaaagggaaaagaatgggtgtccattggagtttctggaccctttgaggtcagttgtagtattgctattttatttatttatttttatttttttggagacagagtctgactctgttgcccaggctggagtgcagtggcatgatcttgtctcactgcaacctctgcctcccaggttcaagtgattctcctgcctcagcctcccgagtagctgggactacaggcacgcatcaccatgcctggctaattttttgtatttttagtagaagcgggattttgccgtgttgcccaggctggtcatgaactcctgacctcaggcaatccgccagcctcagcctcccaaagtgctaggattacagatgtgagctaccacacccagcctaatattgttattttatagataacgatgataaattacagaagggataagtagtgttctgttccaggtcatacaactagcaaatgtcaaagcaggattaaaactcagatcattctggttctaaactttcacctgtagtttggattgttgagtccaaggagaggaagatttttgggtcagaagattctgcaaaactgcctgcatatgcttgccttctattcacaaatatccctctctccttatttgtatattgtagtatcaccaactaatggccatttctgatggtcactgggtaagttgttcctctcttgatagctctgctctaacatggaaagtacttatcttcttttatatatatatatatatatgcatacacacacacacatacacatatatacatatgtagttttctttttaaattattctttttttctcattattatactttaagttttagggtacatgtgcacattgtgcaggttagttacatatgtatacatgtgccatgctggtgcgctgcacccactaacttgtcatctagcattaggtatatctcccaatgctatccctcccccctccccccaccccacaacagtccccagagtgtgatattccccttcctgtgtccatgtgatctcattgttcaattcccatctatgagtgagaatatgcggtgtttggttttttgttcttgtgatagtttactgagaatgatgctttccaatttcatccatgtccctacaaaggacatgaactcatccttttttatggctgcatagtattccatggtgtatatgtgccacattttctcaatccagtctatcattgttggacatttgggttggttccaagtctttgctattgtgaataatgctgcaataaacatacatgtgcatgtgtctttatagcagcatgatttatagtcctttgggtatatacccagtaatgggatggctgtgtcaaatggtatttctagttctagatccctgaggaatcgccacactgacttccacaatggttgaactagtttacactcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcccccactttttgatggggttgtttgtttttttcttgtaaatttgttggagttcattgtagattctggatattagtcctttgtcagatgagtaggttgcgaaaattttctcccattttgtaggtttcctgttcactctaatggtagtttcttttgctgtgcagaagctctttagtttaattagatcccatttgtcaattttggcttttgttgtcattgcttttggtgttttagacatgaagtccttgcccatgtctatgtcctgaatggtaatgcctaggttttcttctagggtttttatggttttaggtctaacatttaagtctttaatccatcttgagttgatttttgtataaggtgtaaagaagggatccagtttcagctttctacatatggctagccaattttcccagcactatttattaaatagggaatcctttccccattgcttgtttttctcaggtttgtcaaagatcagatagttgtagatatgtggtgttatttctgagggctctgttctgttccactgatctatatctctgttttggtaccagtaccatgctgttttggttactgtagccttgtagtatagtttgaagtcaggtagtgtgatgcctccagctttgttcttttggcttaggattgacttggcgatctgggctcttttttggttccctatgaactttaaagtagttttttccaattctgtgaagaaagtcattggtagcttgatggggatggcattgaatctataaattaccttgggcagtatggccattttcatgatattgattcttcctacccgtgaacatggaatattcttccatttgtttgtatcctcttttatttccttgagcagtggtttgtagttctccttgaagaggtccttcacatcccttgtaaattggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttgaggagattttgggctgagacaatggggttttgtagatatacaatcatgtcatctgcaaacggggacaatttgacttcctcttttcctaattgaataccctttatttccttctcctgcctaattgccctggccagaacttccaacactatgttgaataggagtggtgagagagggcatccctgtcttgtgcctgttttcaaagggaatgcttccagtttttgcccattcagtatgatattggctgtgggtttgtcatagatagctcttattattttgaaataacgtcccatcaatacctaatttcttgagagtttttagcatgaagggttgttgaattttgtcaaaggccttttctgcatctattgagataatcatgtggtttttgtctttggctctgtttatatgctggattacatttactgatttgcatatactgaaccagccttgcatcccagggatgaagcccacttgatcatggtggataagctttttgatgtgctgctggattcgttttgccagtatgttattgaagatttttgcatcaatgttcatcaaggatattggtctaaaattgtcttttttggttgtgtctctgcctggctttggtatcagaatgatgctggcctcataaaatgagttagggaggattccctctttttctattgattggaatagtttcagaaggaaactagttcctccttgtacctctcatagaattcggctgtgaatccttctggtcctggactctttttggttggtaagctattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatatcccctttatcattttttattgcatctatttgattcttctctctctttttctttattagtcttgctaacagtctatctattttgttgatcctttcaaaaaaccagctcctggattcattaattttttgaagggttttttgtgtctctatttccttcagttctgctttgatttcagttatttcttgccttctgctagcttttgaatgtgtttgctcttgcttttctagttcttttaattgtgatgttagggtgtcaattttggatctttcctgctttctcttgtgggcatttagtgctataaatttccctctacacactgccttgaatgtgtcccagagattctggtatgttgtgtctttgttctcgttggtttcaaagaacacctttatttctgccttcatttcgttatgtacccagtcgtcattcaggagcaggttgttcagtttccatgtagttgagtggttttgagtgagattcttaatcctgagttctagtttgtttgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatttctgttatgtctgcttggtgcagagctgacttcaattcctgggtatccttgttgactttctgtctcgttgatctgtctaatgttgacagtggggtgttaaagtctcccattattaatgtgtgggagtctaagtctctttgtaggtcactcaggacttgctttatgaatttgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttatgttttccatttgcttggtagattttcctccatccttttattttgagcctatgtgtgtctctgcacgtgagatgggtttcctgaatacagcacactgatagatcttgactctttatccaatttgtcagtccgtgtcttttaattggagcatttagtccatttacatttaaagttaatattgttatgtgtgaatttgatcctgtcattatgatgttagctggttattttgctcgttagttgatgcagtttcttcctagtctctatggtctttacattttggcgtgattttgcagtggctggtaccggttgttcctttccatgtttagcacttccttcaggagctcttttagggcaggcctggtggtgacaaaatctctcagcatttgctcgtctgtaaagtattttatttctccttcacttatgaagcttagtttggctggatatgaaattctgggttgaaaattcttttctttaagaatgttgaatattggcccccactgtcttctggcttgtagggtttctgctgagagatccgctgttagtctgatgggcttccctttgagggtaacccgacctttctctctggctgcccttaacattttttccttcatttcaactttggtgaatctgacaattttgtgtcttggagttgctcttctcgaggagtatctttgtggcgttcactgtatttcctgaatctgaatgttggcctgccttgctagattggggaagttctcctgaaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcatttcgtcttccatcactgataccctttcttccagttgatcgcattggctcctgaggcttctgcattattctcgtagttctcgagccttggttttcagctccatcagctcctttaagcacttctctgtattgtttattctagttatacattcttctaaatttttttcaaagttttcaacatctttgcctttggtttgaatgtcctcccgtagctcagagtaatttgatcgtctgaagccttcttctctcagctcgtcaaagtcattctctgtccagctttgttccgttgctggtgaggaattgcgttcctttggaggaggagaggtgctctgctttttagagtttccagtttttctgttctgttttttccccatctttgtggttttatctacttttggtcttctatgatggtgatgtacagatgggtttttggtgtggatgtcctttctgtttgttagttttccttctaacagacaggaccctcagctgcaggtctgttggagtccccttgccgtgtgaggtgtcagtgtgctcctgttggggggtgcctcccagttaggctgctcgggggtcaggggtcaggcacccacttgaggaggcagtctgccccttctcagatctccagctgcttactgggagaaccactgctctcttcaaagctgtcagacagggacatttaagtctgcagaggttactgctgtctttttgtttgtctgtgccctgcccctagaggtggagcctacagaggcaggcaggcaggcaggcctccttgagctgtggtgggctccacccagttcgagcttcctggctgctttgtttacctaagcaagcctgggtaatggtgggcgcccctccgccagcctcgctgacgccttgcagtttgatctcagactgctgtgctagcaatcagcgagactccgtggttgtaggaccctccgagccaggtggggaatataatctcatgctgcaccattttttaagcctgtcggaaaagcgcagtattcggttgggagtggcctgattttccaggtgccgtccgtcacccctgtctttgactaggaaagggaactccctgaccccttgcgcttcccgagtgaggcaatgcctcgccatgcttcggctcgctcacggtgcgcgcacccactgacctgcgcccactgtctggcactctcttgtgagacgaacccggtgcctaggatggaaatgcagaaatcacctgtcttctgcgttgctcgtgctgggaactgtagactggagctgttcctattcgtccatcttggctcctctctaaattattctttaagttctgtggtacatgtgcagaatgtgcaggtttattacataggtatacacatggcatggtggcttgctgcacccatcaacctatcatctacattaggtatttcttctaatgctatccctcccctagccccctgtcccctgacaggcaccagtgtgtgatgttcccctccctgtgtccatgtgttctcttcctaatgtattttaaatacctgagtttcctttttgtgtatggtcagtacagcaaacttgaatttctagaacctgatatagtggtgtcttgaggtttttgtttctcttttgttcctaatagtttttaaaaattttgtagctctcttcactcccacagcactctacatattcacgtgcacacctaattcatgagctctctatacagaaagaaataatgggaatgactgggaacatgctattaaatggatatattttcagatcttccttaaatcattttctttgcagccttctacttctaagaccgtatcatgaggcttattgacacaagggagaaaaagacacatgcaagtaatattaggaatgaaaaggtaatatgatagatataacagagatttgaataaatcagaagagattaatatgaagcaaccaactttatgccaataaaatagaaaacaaatgatatggacatattaatagaatgtataattgatcaacattatctcaagaaaaattagaaaaccttcataaaccaataagcttaagcatattgaattggtaataaaaattatcaacctcccatctcccgcccaaagactccaggcttatgtgattagatgattttattggaaaattttctctaactgtcaagaattaaatgttccaaattacattaacaatttcagaaaagggaaaaaagctacttaatttactttatgagactagcataaccatcataaaaccaggaaaaggcagaatctgaaaagtataggccaatcctatttataacataggtgaaaatgtctgaaacaagaaccattagacaattattactcaggtacaagccccaagagtcatctttctttcctgttttcctgcttatactcaatatctagtgagtgaggtcctgttgactctgcctcttaaacatatctcaaatctgttcaatcttctttgtcttcactaccaccataggcaagtgaacaaatatctcttcctgcagtggtctctgttcactctccactcttgctcttactgcagtacttttaaaatgtaaatcagatgatgtcgttcctgcatcaaaattctctaaatattttccatgatgtatagaatagaatccaaacctctcaccctggtctacaagtccctgcactatctgacatacagcttcatcaccatctcttgctactctgctccttgctcactgcactgtagacatactgatcttcttcctgttatttgaagagaccaagcttgttgccacctcagagaatttatattttctgttccttctgtctgaattactctcctgtaagtgtttgcaaataaatcttctccgtattcaggccttcactcaaatatcgctttctcagagaggccttccctagtacatctccctgtttcttcatttactcttcttcctaccttttactctgtatcccattaaccttcttattttgcttcatagtgcttatcagtatcctccaataatcattttcagatattttagaaatgcattgtccttctatcttttatcagctgcaggtggacagggatttttttttttctttttttcctttgttttgttttgttttgttttgttttgttttgctgtatttctaacacctagaaggctggggaggcactaaatatatattgcatgaataaatctaatgtaaacttccttaagtcacagatgagaaaactgaagcccagggaaggaatgtgacttgatcaagattacttgcccacctgggaatagaatcctttctcctgagttacagtatggtgccctttctgctataccacatgtttttatgtgcctctagccccataattctagtttcaaaaggcaatcccatcctctccctggtggactagtataagtattaatttatagagatgtttatgaagcatactgcaggcaaatcaatatgataatgagagttagatattgatactatattattttgtagctttccaatagtgactgtttcatttcaggattgctttcctttcagaggtaggaaaaatacttatttttaatgtgtgtgtctatcagcaaatatggtaaagcatgttaaggccaagcatgctgagctgatgacattaacttatcctaaataagtctcacatgagccaactggttcagattaaagccccttattcaccatgatgcaaagtacttttacaataaaacaaaaacaaaacaagagatcacatagcaagggtgtgtgtgcatacatgcctatgtgctgcaagttaataagtacattgtgtaagtaccatgagactgtgactgtgccagtggagatacaaaagaagtagcaggcataatccttatcatcaaggatcttacaaaatatagtcttgaaattactagaaaatagttctgatgcattatataagcaaggcaggatagtaagagtaagactgtatctaccagggccagtgagatacagaataagagaaaaatcactatgaggtagagttaatctgaacaaacaacacagagactatgcaatcaaaactatgggtggcctgcctttttactttttgtggcaagactcagtatatattgatatatcattaaaaatcattcattttgtttgtatgcaggctgttaccatcgaccacaggagacagagttttctaagactttaaaataattcttggaaggtaataaggtctggtagttgctttcgattttctaagcagaaacacagtgttcaagtaccctttgtctacattcagaattgggagtagggatgtttcctgacactgtggaatatttcacaaggtttcatcaaaatttcaaaatatcagtttcttcatggtatatcacttcaggtccctgagcaaactggaaggggtatgttctgttttgtttgctctgggtagcctatatctctggaatgtctgtttcctgtcaactgccactagagggaggctgattaagtgcatttcatttgtgaatggaattttaagcaacagtaaaggattctcaccaaacacacacagccctttcaggcctaatcctacaaacccaattaaaggtaatggacactctatttgatgaggcagttcagctaagccagcactctctgatggtagctagagaggttattcagaattttgcaaatgccatccatgtctgcaggaatttatgcctttatatcagctgcatagtagagccttctatttgcaacatgcaaaacagtaaccacatttcttctttaaaaatgtattagggaagaaattatgtactagaatattaggtttcttataataagagctatagggactttaaaaataggttttggttgctgggagtagaaatttggttgggagtgataaattttctgcatttatttatttctgaacatttccttaagcagtgtgtgcaggtaaatgaaaatattatcaaatttattttaaaataggacataagaaccagagcagcgtttctctaaatagggactgcctgcaataagatcactttgtagggggagttgtttaaaaattcagatccctagcttcacactagacctgctgaatcactctctgaagttagggcctgtggatctttactaaaaacaaacaaacaaacaaaactgaccaggtgtttctgatatactctaaggtttgacaacattggaaatcgaaattgtggagtaattacttaggagcaggtttggttagaaagggttacgcagaagggtaatgtgggtttggagtgctggtcaaatttctgacagctttttacctcatttgcatctcaatgttgtttctaaaaaaggaaatgctaaaaaaggaaagtgtctcataaaagagaagactaaaacattgtggcatacccacataatactatacaaccatttaaaataattttataaaatgatatataaatgcatctggaaagatattcttctattgttaattgagaaaagcaagtcacaaaacacacatgttgtgattgctttctttttttattattattatattttaagttttagggtacatgtgcacaatgtgcaggttagttacatatgtatacatgtgccatgctggtgtgctgcacccattaagtcgtcatttagcattaggtatatctcctaaagctatccctcccccatcccccaccccacaacagtccccagagtgtgatgttccccttcctgtgtccatgtgttctcatcgttcaattcccatctatgagtgagaacatgcggtgtttggttttttgtccttgccgtagttaactgagaatgatgatttccaatttcatccatgtccctacaaaggacatgaactcatccttttttatggctgcatagtattccatggtgtatatgtgccacattttcttaatccagtctatcatagttggacatttgggttggttccaagtctttgctattgtgaatagtgccgcgataaacatacatgtgcatgtgtctttatagtagcatgatttatagtcctttgggtatatacccagtaatgggatggctgtgtcaaatggtatttctagttctagatccccgaggaatcgccacactgacttccacaatggttgaactagtttacagtcccaccaacagtgtaaaagtgttcctatttctccacatcctctccagcacctgttgtttcctgactttttaatgatcgccattctaactggtatgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgttggagttcattgtagattctagatattagccctttgtcagatgagtagattgcaaaaattttttttcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctcacgtttaagtgtttaatccatcttgagttaatttttgtataaggtgtaaggaagggatccagtttcagctttctacatatggctagcccgttttcccagcaccatttattaaatagggaatccttcccccattgcttgtttttctcaggtttgtcaaagatcagatagttgtagatatgtggcattatttctgagggctctgttctgttccattgatctatatctctgttttcttaccagtaccatgctcttttggttactgtagccttgtagtatagtttgaagtcaggtagcgtgatgcctccagctttgttcttttggcttaggattgacttggccatgtgggctcttttttgtttccatatgaactttaaagtagttttttccaattctgtgaagaaagtcattggtagcttgatggggatggcattgaatctataaattaccttgggcagtgaggccattttcacgatattgattcttcctacccatgagcatggaatattcttccatttgtttgtatcctcttttatttcattgagcagtggtttgtagttctccttgaagaggtccttcccatcccttgtaagttggattcctagatattttattctctttgaagcaattgtgaatgggagttcactcatgatttggctctctgtttgtctgttattggtgtataagaatgcttgtgatttttgtacattgattttgtatcctgagatttgctgaagttgcttatcagcttgaggagattttgggctgagacgatggggttttctagatatacaatcatgtcatctgcaaacagggacaatttgacttcctcttttcctaattgaataccctttatttccttctcctgcctgattgccctggccagaccttccaacactatgttgaattggagtggtgagagagggcatccctgtcttgtgcctgttttcaaagggaatgcttccagtttttgcccattcagtatgatattggctgtgggtttgtcacagatagctcttattatgttgagttatgtcccatcagtacgtaatttcttgagagtttttagcatgaagggttgttgaattttgtcaaaggccttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcattgatgttcatcaaagatattggtctaaaattctcttttttggttgtgtctctaccaggttttggtatcaggatgatgctggcctcataaaatgagttagggaggattccctctttttctattgattggaatagtttcagaaggaatggtaccagctcctctttgtacctctggtagagttcggctgtgaatccatctggtcctggactttttttggttggtaagctattgattattgcctcaatttcagagcctgttagtagttgttttctagtttattgaaagtgaaagaaaagaatctgaaaggctcaaagtctctcacattcttcagatggcagagaaaacaattcctcattagatttctgatgttataatgttcaaaaagagcaaactaactttgcaaaagaagattccttaggtcaaatgtggtcctgggtacaaatgaaactaggagtttctctatttgatttttatccacagatttgatttaaaaaaaaccttggggaagctcccaaattgattgtgggttctaaagggagggctttgccaaataaagtcactaacatgcaggaatggaattcttcaccaaatggaccaggcaaaaacaacctctgccctaattcccaaacctagaatgggttatcttattggccctggtagaaatgcctaattgccctttggagtagtctaaccctattttccaggtaagaatttaaacaccagggtttataaatgagtgttcccagctgaggtgagccatcagctgaaaagtgcttgagtggaaaactggcttaaaacgttgcctagaaacaattaatagaaacctggatattaagagtttcggactgaattctatacaagatgaagctgcttctcatgccagaagagacagaaaagacatggctctttggaaagtctcttctctttctataatctgtgctgatctgcagtagtggtgacttgtgattttactttaccagatatactaattactgccctaggtaataataccagagaagattttaggactccaaaaaaaatttatgtaacgtttgttaaaagtccaataattaggaaattagcaagttaggcattaactatagaattttccatggtctgtcgctaccagtgtttctcaactgaacgtttgcaattatctaacacatgctaactctgtcaatattttaccttttatttctggttggtaaccttaggaaaatagagcatgttcttaatcaaaccagagttccaggtttggtttcctactatagtaaccttggctctgtctcatgaccagagatcacaccctagccacatataaaggccataaggggaactgaaagactatgtgtatactttaggtatcctcattcatcaacaagtgatcatgtacttgtcataatcatggcatgttaactggaaaaaaaacaaaaaagtagaggaggagctgaaaaactatattctggttatgatggaccaatggggttacattaacacactatatttaatacatttatttaacatttggagaggtgcagggcaaagggggtttgcatctattccatgccttagcattttacttccacaacctatggtcttaacttctgttgctaacttagttatcactattcaaaatgtaagaaagagaacttgtttgctgatacctcagggatcataagattgtggattctgactagtaattctcaatatgaaataaaattaatagaggacaaaatggagtaaaattaacggaggcaaaatcttagttgagtatcctgttgtgttacaaagctcattggaccatggtctggaagcccgtatactattcttgatggtattaatttttattgtttctcaaatttatttttaaagccttgatgtcctttgaacaagatagcctatggagctcctctgtggtccctaagccacctttacaaaactttagggatttaatgaatatggtttgaaaagaaccaaactactggaaagaagctcaatggccatccataggaaaattcatagatgataatctcttcataagaggacgaacattaagaattaactagatctacgtatgtaacatgaatatgtttcaagcatgacatttaatgaaaaaataagttacaaaggatacacagcataggatactacattagacaactcttatgctacacttcaggtcctcttggcctcacaagactctggggactcttgggcactttttctttcttttttttttttttttttaagatggtgtttcgctgttgtcgcccaggctggagtgcaatggcgtgatctcggctcactgcaacctctgcctactgggttcaagcgattctcctgcctcagcctctcaagtagctgggattacaggcatgtgcgaccacacctggctaattttgtatttttagtagagacagggtttcaccatgttggtcaggctggtctcaaactcctgacctcaggtgatctgcctgccttggcctcccaaagtgctgggattacaggtgtaagccaccacgcctggcttttttttttttttcttttttctgagacagagtctcttactctgtcgcccaggctagagtgcagtggtgcgatcttggctcactgcaacctccccctcctgggttcaagtgattctcctgcccttagcctcccgagtagctgggatcacagacatctgcaaccacacccacttttttttttttttttttgtatttttagtagagatggggtttcattgtgttggccaggctggtctcaaactcctgacctcaagcgatccaccttcctcgacctcccaatgtgctgggattacagatgtgagccactgcgcccagcccaggtgctttttctgcccaagccaattttgtagggactaattctgtttgggctcagactgactttacaagggtacaatcttgcttcatgtctgttttgtgtgacttgtatgtcctgcatggaggcctctctattgccactgaggcataagaggccattggactggctcagcacccttgtctacacaactcagaagtgtgagggatgtaatgctccatggggagactctgaccaatggagactattgctggcagatcatttcttctcctcctcttccccaatatttactttactgagttatagtagtaaatacagtctcgaagcaactggtccctagaaatcaagcaatcaattgtgcttgataccaagcaatggccaactcaggatcatactttcctattaacactttttcccctgattcaccttttctttccccttacttctacaacactgggattacactaccaaatagtagtagcaacacataagattttgcctcaggctgtgctttttttaatgtcccctctaataaatctcatgttgaattatgatccccagtgttagaggtggggcctggtgggaggtgatcatgtcataggggcagatcctgtatcacttggtgatgtccttgtgatactgagtgagttatcgtgagatatggttatttaaaagtgtgtggcccctcccctcccctcccctctcttgctcctgctttcatcatgtgacgtgcctgcttctgcttggccttccaccatgagtaaaagctcccaaaggcctccctagatgcctagcagatgccagtgccatgcttgtacaccctgcggaaccatgagccaattaaaactcttttctttaaaaattacccagtcttaggtattcctttatagcaatgtaagaatggcctaacatgctagattaagacagagtccatttacatacattttaaaaacactaaaaaaggagagattaaagatgctgattagatacagctgggaggtgccttttctgtggaaaagaaccaaaatattgagtatacctgcacactctgaccagatcttttgagacaaaacactgaaattcaatagagaagtgacagaagacaccctggttgaagagggatgaagtgaggctgcctgcttggtattgtgagataccaggactggcccccagaccggtgccattcccaaggaagtgttgagggaagaaaccccgggacaccatattcccactgtggatctctgagttcctagctacaggaattcctccagactccttcagacctttggactggcagagggagctgcctggagataacacagacacattgcttgaaccctagtagagcccaaaagtcttcagtgtgctaggcagcgacagcaaaagctgactctgagctcccccacccccaccccagagctttgcatcctgccctaagttgttacaggtcctgctgtctgctaggcttggagagaacagggccagggaatgctcacatgcccaagacaggtcccactgccattgccatggggctgaggtacagccaaagcatgaaatcccacatctgctaaaccctcctaagactgccggtctggccattcccacaggggaggggccaacaacatagcctccattgtcccgcctaggtggtttgttgatggcctaggtgcagttcacccccctgtcacatgtggtccttgaccttgaggggccagtgaacaaatccgctggccttgtcccagtttcccaggacttgagcacaccatccaggtggatgaaaatgagattcgtagcctgatctctagcaggggaggagccctcactgtcagaataagagaagagcacagctcgggttcatgtaatggcatgggaactcccttcaggagaccgggccaggaagggtgtggcctgatagccatggtttctgcctcagggagtatcatgaatgcctggaatggcttggcaatctgggtacagattgcttgggactagtctagtcagttgggcctgttgccagcattgaatactggagggagatctcccaagtccagggtgcagcagctgggtggggtcccatggctgcctgctgggctgataacccctggcatccttcttaccctgagcgtgctctgtggcacaggagaggcgccgccaccccccactggagggttgtcccagtagcccgagagcagcccctagacccctgcgaaggtaagtgtttacgactgccttggagagcctggctgtgggcttgcccaacccagccctgcccagttttgccccctccagccaccttggtggtagagtgtggagcaggacccctgggagccccataccctgcccatttcaggaacaccctagtacttcccccatcaacaaaggccaagtaaaaagtccactgccatcagcgcaaatgctgtcctcggcaatcgccatctactggctgggacagcaaactgcatgacccatcacaactgcaaatatcactgtacagtgctcagctggttcttgcctgctatcgccacctactggccactagggtgaactgcgtaatctaatgtaatcgctgctgaaagaagcacacagtgctgggaaatgagataagcttcccaaggcctccacctctccatctctgttggtgtggcacagcacaccactacaacaacctacaaacaactagcatcttagaaaaccactacagtaaggctatctataatcaatgaattaatacagagtgttggtgccctaaaagcacaaagaagcaaagccgaaggactctacccaacatacacaacagtaacacactcaagcggggaagaaaaaaatcccaccgaaatgaaagtaagtttaaaaatagaaagtgacagcttctacacatgaaaagggaccagtacaagaactccagcaacatgaaaaaacataacgttttgacacccctaaaggaccacactagctatctagcaatggatcctaaccaaaatgaaaacttggaaatgccagataaagaattcaaggtatggattttaaggaagctcagtgaaatacaaaggaaagtggagaaccaacacaaagaaatcagaaaaataattgaggagataaaagattagatacatatatttaaagaaaacaaacagaacttctgaaaatgaaaaactcactgaagaaattttaaaacacagttggaggctctaacaatagactaaaccaagcagaagaaagaatttcaagcttgaagcccagtcttttgaattaacccagtcaaaaacaaaggaaaaagaatttttaaaaatgaacaaagccttcgagaaaagtatgattatgtaaagtgaccaaacctacaacttataggcattcctgaagtagaagaagaaaataataagaagtttggaaaacgtattttagggaataattcaggaaaaattccctgatcttcctagagatgcaaacacccagatttaagaaattcatagaacacctgacagacactatacaagagaaacattgccaaggcatatagtcaacagactatccaacatcaatgtgaaagaacaaatcttaaaagcagctaaagagaaatacaaatcacctataaaggaaatcccatcagactaacagtggacttatcagcagaaaccttacaagccagaagcgatcaggggcctattattagcctccttaaatgaaaaatatgccagataagaattttaaatcctgccaaactaaggttcataaatgaaggagaaagtattttccagacaagcaaatgctaagggaatttgtcaccactagactggtcctacaagaaatgctcaaaggtgtgataaacatggaaacaaaaggatgatacttaccgtcataaaagcacatgtaagtagaaagctcacagatcctataaagcagttacacagttgagacttaaggtaactaggaaacaaaaccatgacaggtacaaaacttcgcatgtcaatattaactttgaacataaatggcctaaatgtaccaattaaaagatatagacgggcaagttggatttaaaaaaaaaaataagatccaaccacctgctacctataagagacccaccaaatgtctaaagacacctacatgctcaaagtaaagagatggaaaaaatatatattatgcaaatggaaaacaaatgagagaaggggtagccattcttatatctgattaaaacacactataacaatagtaaaaaaaaaaaagacaaagaagggcattaaataatgataaagggttcaatacagcaagaagatgtaagtatcctaaaaatatgtgcacccaacactagagtatcgagactcacaaaactaatactactagacccaaagaaaaaacactgataacaatacaataatagtgggagacttgaacattccagtgacaacacaagacaagccatcaaggtagttggttttctgccttgatgacctgtctagcattgtcaggaaagtcaacaaagaaactctggacttaaactggactcttgaccaaatggacctaacagacatttacagaacattctacccaacaactgcaggatatacatttttctcacctgtgcatggaacactctcgaaaattgaccatatgcttggccataaagtaagtctcaataaatcaaaaacattgcaaccatatcaagtatcatcttggacaacagtagaataaaattagaaattattaccaagcataactctcaaagctacacaagtacatggaaactaaataatttgcttctgaataacttttgggtaaacaacaaatgaagggagaaataaaaaattttgggaaatgaataaaaatcgaaacaaaacataccaaatctctggaatacaataaaaacagtgctaagaggaaagtttatagtattaaatgcctacgtcaaaaaggtagaaagatctcaaattaagaacctaatgtcacacttcaaggaactagaaaagcaggaacaaaccaaacccaaagctagcagaagcaaataaataacaaagatcagagcagaactaaatgagattgagaccaattaaatgatacaaggaatcaacaaaattaaaagttggttttttaaaagaaaaaacaaaattgatccaccactagctagtttaaccaagattcaaacaagcacaatcagaaatgataaaggtgacatttaatgttaaaggtgtagttctgatatcacagaactacaaggaatcatcagatatcactatgaatatctctatgtgcacaaactagaaaacctagaggaaatcaataaattcctgaaaaaaagacaaccctccaagaatgaaccagtgagaaataaaaatcctaaacataccaatgagtaatgaaattgaatcagtaataaaatgtctcccaccaaaaaaaaaaaaaaaaagcccaggaccagatagattcacagccaaattctaccaaatatacaggtaagagtcagtaccatctctactgaaactattccaaaaaaatcgaggagggaatccttcccaactcattctatgaggccagcatcattctgataccaagacctggcagagacacacacaagaaaactttaggccaatatccttaatgaacatcaatgcaaaaatccttaatgaaataccagcaaaccaaatccagcaacacatcaaaaaagctaatccaccacgatcaactaggctttatccctggaatgcaatgttggttcaacatatgaaatcaataaatgtgattcatcacataaacagaactaaagacaaaaatcacatgattatctcaataggtgcaaaaaagtctttcaataaaattcaacatcctttcatgttaaaaactctcaataaactaggtattgaaggaacataccttaatataacagcaacctatgacaaacccatagccaacatcctactgaatgggcaaaagctggaaacattccccttgaaaatcagcacaaggcaaggatgccctctgtcaccactcctattcagcataatattgacattcgtggccagagaaatcaggcagcagaaagaaataaagagcatgcaaataggaagaaaggaagtcaaactatccctttttgcagataacatgattctgtatctagaaaaatagcttcagcccaaaaactcctttagctgataaataacttcagcagtttcgagatacaaaatcaaagtacaaaaatcactagcattcctatacaccaacaacagcaaagctgagggtgatcattatcaatcctctgaaaacaaatgagcaacaaatattttctggcagtgtacttagctccatcaaaggagtgctgggtgaaataaaaatgttatgctctggtcactaccctgatagaaatctttagaatcctgttagaaaatcatttccaatgtctgaagcaaacctgcaaacattacaagaattaattgctgaactgcttgagatgtactagatatgttattcaaatttaggtgtatttcgtggcacatttctgacatgggtatttctaaattttcaaaatatatcgagagaaagagattaactctctgaaaatgtctttttgttcatgatttcctagacaaaaatcctttcttgtcattgcttttgaaaaacataatctaggcccctatttgtatcatcacggttatcaaactttaatgcagtgtcagtgtttgatgtgaagattagattgtcctgaatttggccagtctgggccatatgtgggaggcattataatttgattctgttcacttaagaagtatatcttttaaaatcatttgagtgcaacactatattgaaatgattgttagtgttctctcttgcatcacagttgatgtatcccatcatataaggatgttttcagacctgtaagccctcatattaatagtaaatctttgctcatctttgaactctggattgacacactgttctctcatttccttttgaattgttccactgctcagggttctttgtggcaagtaagcaccactgtttagaactaacaaataccaatcaactcaggcttagggattcaacttgattaaggaccagtgagatttgtatatctgtgtctttagagtctacctgtttaccaagctgtactggaccgggagtcagctttagctttacattgaactagctgtgtgactttgggaaaattactctctggatctatttgggaaaataatttatctggatcttggtttccttatctataaatgaaaacatttacactaggttgtcttaactttaagattctgtaactccaatgcaaagtaaacaaagaccaggtgaaaccatttggcaaacttaatgcaagctaatttctcctattgaagataagactaaactatcaccattccgaagcccactcctcttcctacctctcttacaatttaaatctaacctacctttgaaagtcaactacatctccatcacttccatgaagtctttcctgataacacaacaacctccagtggtatctttttttcaattataggattaattatcatcactacacttagtcttctctatcaccttgtattgttgtttaattttagtgcttttgaggtcaggaatgatgagttatgaacatttatattgcccaaagcacattgtccagtatttcatatgcataataggttctagatttgttgaattaatgttgaaggaatgaatggagtttaaaaatcattctgaaccattttcccaaattcacaatgcaaaagtgattgaatttttcccacctttctttcccaaaaaagatgcataattttgacaatattatacgaaatctaaagtacactttggaatttaccttaaatataaatccctttccttctagtctcctaattttcctctttaaaaagattgagaatacttcctttttagagtggcctgccgtagaaacatttgtattttccttctatattccttagaatacaatgcattttgatcagccagtgtatgaatggcgttttgttttctattacctttttaggaaacatgacaaatggcattgttactcctcaagggagtgtttggttacttgcgctcaccagagccagttctctaggatttgatggaaacagatgctagcattcccatcacaaggtgtatctccagtgtataagtgttgacagaagcaaagtcaaacaatattcaggtcaacatttaatttttttatttttaattattgtaggttcatagcaggtatatgtatttatggggtatgtgagatgttttgatacaggcatgcaatgcatattaatcacatcatggagaatggggtatccatcccctcaagcatttatcctttgtgttacaaacaatccagtgtaactggattgtttagttattttaaaatatacaattaagttattgactatagtatctctgttgtgctatcaaattgtagatcttattaattttttctatttgttttgtatcaggtcaacatttgattagattcattatagatattagtccagcttattccggttccttgagaatttgccaccgagtgtcttatcagtccctcattatccttcttagtctgcattgagaatgtgttagaacaagtgcttagcaactcaaaattcatctagcctgggagacttggaagaaacattttagctttggcctcatgctgtgggagccatgttgtttctctgtcaggttgaggctgtgccgcacttacggaaattagcccaaaaaaattgttttctctctccttttctgtaccagaatgagactccagggtataagcaaaattgatgttgcttgaagaaatttcaaaggttcccaactcccagagctcaagtagccacggaaataagcactggccaaaaaatgtacttagacttgatggtaattgggaaccatttgagggaagggaactaaacatgtactacgtgatgttacttcgtagaataagaaaggcttgtgttgaattggtattttaaagaataatggggaaaaattgggcttctttgtgtgggtttgtaaggtggtgtgagggcagcgtgttggcaatacctaggcaggattgaaggtgataatataaattgaatatatttctggtaaaggatttttgaaaataaaataaactaatgttttcttagattcactcctactttattttcttaaagaaatagtaacccttcctattggtatgtcaggaaaagataatttgttcttaaaattttactagaaagaaaagtatatcatgttcccaagttgacttgtatgcaaaatcaaggttatactttccaaaattaatgcaccttgttcctctgaccccttaggcataattaggggttttgtgctcttacaaatggacttagcaaatgtggcactgacataatcatggaattcatggtatttttcccttgtgattataacaatttggaccccatcaagaaactccttattcagcctttcgtttgttcataagctgacttcttttgacttaagagaagtcagcttatattagtgctaagcccaaaagaaccttctgcaatcacactgcgggggaccactttctatgccctctgctcacatttgtgttccaaatcatcagtgttcactggcccaattaggccctctctagcaacattagccctcagagctttgcttgccaatgtcaacatacattctcagttccagaattccactgtcttacctcaagtgtcacttgagcagcccaggctttcttattatagtgtttatttctgtcactgattcatcattttttatttgtctgactcaaatccaggtagttttgctcaatcgatggcaggctgttaaacagcatgtgtgtttagggcagcaattcattcatccattttgacatgcacacctgacatcttcattaatgcccagcacaaatttctcagattccagatctgcttggtatctccatattccttctgcatccacctctttgccacaaaagacacttcatgtaaatgtcacttttttcaagtttttcacatgttccacagtggaaccatatgcttatagaaatgatgcccttttaggtctgtatccaaacatagcttgtcaatgactgctcacaaattctaagtcagcttataagcttttacactttttctgaaatgttttctttagggcttgtaaacttcttcccatgttattgcttacttgttgtacccctgtgttctttttcgacattaactccaaccaccttaccacctttttattgccctttcaattcatcacattcagctgaactgctgcctcaggcaagtgcttcctctctatgtctgtttattgagtttggggcaatctctgtaacagaaattctgctacaatggtctttcttctatcctatgaccatttgctaagctcttgaaacatcagtcatgttcagttcttagaaaacctacattgaagaaaaaatagtactgataattttatggaattaatttaatatttatagtcagatagtatgagttgcttacctgaagatgtgcagggaacctctggagagccatactgacaagtaagttgtggcttagtctgtatgacttgagagctattggtttttcttgttcacatagttgtcaccattattgcaatattataaacatttcctgagtgctcactatgtgataggcactgtgtcaagaactttacatgaagtaactattcaatactcacagtagcccttcaaagtaggttgtattattatctctgttttacagacgaggaagcagagaaaatcaggagggtaaatgacttatttagggacatacaacaaataagtgttagaataggcatttgaatttaggcagtataacctcagagttcacaaaactcttacccttcgtattatactgtcttcttataatgatagataacatttattgagaacttacgatgagccagtcacttatgatgagctagtatagttagccatattgcattcattaacttattaaatcatttcttcagcccttgaagacaggtgacattatttttcttttacagatgaagaaactgagtgaggcttagagaaaataaacagtctttaaagtgattaaagtgattcccctagtaagtagtagagacaggattttaactcctatcctcaaccattatgccatactgtaccaataaaggactaaaaaccgacaaacagaaaagttgatccatgggttcctacagccacaagcaaaaatcatacctttattcctgctgcttgcaggacctattagctggaagatgttgggctgtatcatcaatatccataatttatgtatacttattcctgggattaaaaatggtgggaattcctaagaagcagggaagcaatactttttttcaagagagttggtttacccaaaaatgacagactatcttgccagaagtagcactaagatagggtggaatagaagctggtataccccaacgaaaagtgaatataaataaatatgtattacagtggaaacagaaacatggcaaaagaaaatgtgaagcacgggattgcactgttataatgccacttctcccccacctcccctaaaaaaaaaaaaaaaagccagtgaactgctaagatctagctgtacctgtctatttataatggagagattggtgcattgaaaaaacaagatttttgattggagaaggttagaaagatgatttaggaatatgagctgctacccaagcaagacaggccaggttggatttccacagtgggaggcatgaagaccctgggtagtagcgaaagctgtggtattatttgtgagaaggccaatgaaaagatagaaaaatactctgagacatattttatctacttctgaaatttaattatgactgactttaatttcaggcattatttatttctacttttgaaaatgtttaaattattgaaaataaattaaaagaacttttttattattggtagaactttattaaaataatatagacatgctttcattggtctagcagtcctatgctaaattaaaataaggatcaagaagctttaactttacttaaacagtggcatgctgctctcagtgactttgttaatactgtgaaaagactttaaaatctcaaatacacacagactcacagatatgtgggaaactatgagtgtgtgtgtgtgtgtgtgtgtgtgtgtttgtatatatatatatatatatttttttttttttgagacagagtttcactcttgtcacccagctggagtgcaatggcgtgatctcggctcactgcaacccctgcctcccaggttcaagtggttctcctccctcagcctccctagtagctgggattacaggcacctgtcacctgtcaccacgcccagctaatttttctctttttagtagagatggcttttcaccatgttggccaggctggtctcgaactgctgacctcaggagatccatccccctcagcctcccaaagtgctgggattacaggcgtgagccaccgcgctcggccactatgagtatatattaaatgtaaattgatattaaatcccaggaggatagggtcagaaacctatgctgtagggtggcatcaaatactacaattttacaggtaaaaaatcacacatacacacacacacacatgatgaaagatctttcaagttcattatttgaagcagtcatgtggatattacttgctgccaaatcaatctataattccagtttctctagaaaagtgggttttctattatataaaagactacaacaatggaaatagtctgattcattcacagtctcacacacacacacaatcatttatgggctgaggatgtacatgtaccatggccttcacatgcccttcaggagaaaatgaattttgggggagaaacagatgttttctattaagtcaagttctgtatggtcggagtttaaggcaaagagttaagctgaatatggaaattaaagccaatttatcaaagcatattttaaaagactttcttgttaatactagagtttgggctgggaaatttctgcttcttaacataccgatgttagtagggatttaaagtttgctgccaggcttctcttggaatattcttccattggcacagccctagagatgctaactctgaaaaacgggatttggctggtagcacctgacacagccaatcttgaatttccactaaagtatctatgaagacatagaaaaatgatgagagctcacaacaatgctgataatttggattgacagtcaaattattgccagaaccagagagaaatttccactagctaaaaatcaggaagaagtagattgaaaagtacaatcagcgaaccactcataccatgctgctagaaatttggtaagccaatatatcttaatgtaaatgacgagttgatgggtacagcaaaccaacatggcacatgtatacctatgtaacaaacctgcatgttgtgcgcatgtaccctagaacttaaaatataataagaaaaagaagaaaaaaaggaataggtccaaaaaaatctcatctttccccccatgcagtctaaatcctggttccaaaacacacattctatacccagcaaaacaaggagtacttgtcttattgcatggaaagtacttttttagatagctagaaggctggacaccaaaccctaaaatattgcttttttctctatatatgcttgagcactactacttccagcaaataattagaggagaagacatgaatgtggatttgggatttctaatatgaagtagtggtaaattatcttcaaggtccattccccagaaacataatgctataagtgggagcaaagaaccttggtaggaaggtattctgggtattctagtttttcatgtattccatcagttctgattatcaataaatcagtcagttgggtcaggagaggatccaatcttagtccaaagaaggtgtattaatgaaatcaagttagacaccaagaacagacagttgaaaatatgagatatatacatcaacctattgtcccgttgcatactcgagaaggggatttatctaaaacccagtttgagcttaacctaggacaattgttgtctcctaagtattggcaagcatgggatcaagatagattggaactcctttgaaaataagcaatgaaagaaaaaacaatgtggaacatatggaaaatttgcaaatgggctaaaggcaaattattttggagatttcaagaaagaacacatttataaaaatgggtttttaaaggaatcagaaaaaatattagaaattgatgattttagctaaaatgcaagataacatagctcttatgaaaaagcagactgtaaaatgtaggtgttcacaatcttttgttaggtcatgtgacacttataaaattttcttttttgaggaaattctggactctttcctcatataaaacaaatttgtaaatacactcacaactttttttttttttgcattccgtttctggggttttacatatcctctgaagcctatgaacttcagtttaaaacatctgccatcaaggaacaaatcaagacacaatgaagataatcaaggaactaataaaaattaggcaacaaaatgagactattaaaaatgtgagataatcaagataaggaaaaattacaagaaattaaaactcaaccacagatgattattatcagtggaggctgcagagaacagaattgacaatgctgaaaatcagatcagtgagaatgtcaaatatacttgaaaaatcatctcagaaagcagtgaaaaagacgaagatatgactcatgagggagaagatgataaatctgaagaatggatatccagtttaataattttaagtattcctaagaaagaaataaaaacaactaaagccataatgaagcatatatttaaaaaaacaaagtttcctgagttgtcaaacagcttgaataggctcatcgtagtctaggtaaaattagtgaaaagggagaagaaagccacatgctctaaagtttcttttaaagtcatagatgctactgcaaatggcatcttcatgcataatcacatatttgtttggcatacaaatatagatagccaacagggattgtaaataatacgaaataacagcagaaaaatatatagtgcctaaaaccttgtgctgcggagtcaggccagttttaccacttagtagttgtgtggatttcaatgagatcagtaactcttctgaatctgtttccacagctacctcatagggccctttgaaaattaaatgaggtagtttatataaaatgcttaataaaaggtctagcacttaggggacactgtgcctaataatattgttgctattatattcaacaatccacaattgtgatatacctagattgttcataattttttgttatgtttgatgctccaacaaatataccagtctcagcagtctctcagtaacattattttacattcaattctgtattaatttcattagtaaaaattccagttgttttaaattccattactttgcacatcaatttgaacatttatttcaaatatttattggggccaattgtagttctttctctatgaattgcccatgtgtgacttttgacattttttttggttttataatctcagtcatttcattaagacttggaaaatcctatataatctaaaggtatttgcatattaaaaacaaaaggaaaactttgttataaagtgtgccaaagtttacaatatttttggccagtgaaaccagagagcataatttttatggcagcaagaaaattgaaagaaagcttcatagaacaatatatgtattcctcttgggagaatttgtgacttctagccgaggctttccttcaaacatgtgaaaattaacatatcatctgctttatccataaatatactcttcggtgatcattttcacttgtaaagtgtgccatacttgcagagccaaaatgtttttttcatttattctgttctactttcttagtaggcacagagtggactggatactttccaagactgaaattcagtatgatcttacaggatctcagttcttggaaactttgttaatgtgcatgtaactattgtgacagggcaagaatgcagtctactaagagcagaaaattctaaatttaggtgtccttggctctgttttctcaagttttgtcaacatcttccatgcatatattcagaactaaaacctctgtcattgctcttactggggcaacgtgtatctgttcttctacagatgagctgccttaacctctgtggtttctaccgagctcaaacttgtccattgaaagcatattctacaccgggcatagctaatgttgtgttgtacattcattgatactatgcttttccctcccctttcaaaagcaccattacctgtcttctcccatttcattccctgtcaaatttatttcccttctcctgttccaaaagacaaagccatataccaggcagtagcgtccatccaagagtatttttcaaactgtggattatgacccattcctggattatgaactcaatttagtgttttgcaaccagcactttaaaaatgacacagaatatatcagggtgtatcacatataggaaggcaagtacgttttcatgaaacaaacataggagtgtactgggtccaacctaaagtgtattttgttctatgggttaaggtcaaaaatgcttgagaaacagtgctataaagcacacttcaggatgcaagacatagatttagagctaatttaagggacctgtcagctgggcagctgccctgggtaccaatctatagaagcaaaaatatttcacaggtactaaaatatcactggagatataagcagatggagaaaattgcatttaccagactctttttttttttttttttttgagatggagtctcgctcagttgcccaggctagagtgcaatggcgcgatctcggctcactgcaagctctgcctctcaggttcacgctattctcctacctcagcctacaggcacccgccaccacggtggctaattttttttgtatttttagtagagatggggtttcaccgtgttagccagaatggtctcgatctcctgacctcgtgatccacccgcctcggcctcccaaagtgctgggattacaggcatgagccaccgcacccaaccttaccagactcttaagtaggaaagtagtacatgtgataaggtagatgaattggtagatagagttgtattgcttagagcagagagactgggctctgcctccagtgatctttcttttctccatgtgctttctccatctccacacagggctcagcctgcttcttcaatagatgttgaacaaatacttttaaacatttggtttgaagagctaccaaattattagcctgctgagtttgctcatatgtcttgactcaagtctgtatagacctttaattgagaggggaaaatgctattgtaagaaatgtatttattaggatagtaatagctgctgtaacaagtaaatcctcaaatttcagtgactttgcacaatacaagattacttcttattcaagtaatggtccattatccattacaggtgtcagcaagtaagtgagtagctttcctccaaaagatgattcaggaagctagatatcttccacgctgtgaccttcccacagagctttcagagtcttctgtatctagcccaaggatggaaaaggagagagtggagaagacatacccagttactacaaactcccatttgaaagtgatacccatcacttctgttcacattccattggcaagaattgtttacttggccacacctggatccaaggattggctgggaattgcagtatctgactaggcaactgccttccagcaacatcactacattaaggcatggggagtgggtggcaggcatgaatttttgatgaacatctggctgttgcagtcacaataagttataataccaatcaaggtgtctctagaaattgtcaacacagaatttggaaacatattgctcctcccattaccatctttaagctcttttgcagtgtgacagggttatgttgatcattaatgcatttatacatttttgtataaaagtaagccatttcattttctatcttactaaagtagtgatttggacatctttacatttagctgcatattgcttttagtttaaaatgaatgtagttggcaagcatgaagtgtataagatagtaaatcctaaattacaggcagccacctcatttattcagctgctgatttccatttggttgtccagacagagcactttgcattatttgatttgtgatatctggatgcaaatggctttaagttttgattaaacacaaagcttgaaaaggtttaaacagtaagccagtaatattgaaaacattacaatctggtttagataaacaatcatctgaatgaattggatataaacatatttattttgggcaggaagcacttgttcagaaatttctcttatgatgtgacttatttaagcttctggacatcaaaatagttcataattatggatgaaaattgttggcaaagacgttactgctttattagaattcttgtccaatatcaatatggtgctattatttgattattgctttatcttttattctctgataatcaggacaaaatattgaaatttggaatattctaatagcaattagagttttcttcaagatacctgtcaacagtgtgtgacaatggaaccctgtgttgcctgtgtctgaaatgcaatgtacaaatatcttcaatattatgaatgcagatttgttaaattacgggtgataaaaatgactttgcttcagtgaaatgattctaattctaaatttatataatgaattattcactcttctttcccttttgttttctgctctagtttagtgagcaggttcattaagtgctaatattaaattcactagagtatacaaaaaaaaaaaacccagtaatagcatccacatggttgattaaatggcaaggtaggaggctggccgtggcgtttaattggaggcatgggagctgttggtttctttgtgtaatctgaccctctgaatgttgattcttctaacaagtgaccaaggaaaaaaggaaagtggtgtcatgggaaaatagcatttgcacatttcacaaataattgataaataaccattatgaatgtagtcattactttacatcagtgtttgcaatgtgtaattcattgaaatatttgtcttgtacaacactccacaagaaagggttctagaagcaaataagttagggaaatgctggattgtctctcagagataatcaacaatgcatgctagcttttttttttttttttttttttttgagatggagtcttactctgttgcccaggctggagcgcagtggtgcgatcttggctcattgcaaactctgcctcctggattcaagcaatcctcctgcctcagcctcccaaatagctgggactccaggcatgcaccaccatgcccagctaatttttgtatggttagtagagacggggtttcgccatgttggccagggtggtctcgaactcctgacctcagatgatccacccacctcagcctcccaaagtgctgggattacaggcatgagccaccacgctgggccacatgttagcattttatgggatttcataaatcctttagttgggaagcctatttgacttttttaaacctagagatctcgatttattttaagcagccttttttttggttgtttagtaaatattaaacctaatccctgaatctgcccaactttttattttcttataagaaagaggtgaaaaataatgcttataatttttaaagggcagaaatatttttgttttgaaaaccaaagttgaggtatataccaaaaataattcaaaacaggttttgaaacaaaaaattccatgggaatgttcatggtggcactattcacagtaatcaaaaggtggaaacaatccaagtgtctatcaacagatgaatggataaagaaaatatggtaggtctgtataatggaatattattggtccattcaaagcaataaagttgtgatacatgctacaacatgaatgaaccttaaaaacatgttaagtaaaagaagccagtaacctacaccgtatattatctgatttcattggtatgaaaagtctggaatagacaaacctatagagaaaggaagtaaattcatagtcttttaggtctggggaggtgggagggtagggctatgacagctaaagggtaaaggatatatcttttttgtgatgaaaattttggaaaattggctgtagtgatagttgcatgtatctgtgaatatactaaaaacattgaattgcatgtttaaaatgtattagttgtatagtatgtatagtatgtgaattatatctcaataaagctgataaaaatgataatcaccatttggttaatacacaaatatccgtaagttcctcttcttaaatatgaagcatatttttaaaaggcagggattatcctgttaaagcttctcagtattttatgatttttcagtttaaatcatcaatagcaatattgtacacctcaaaattggtacatcatataataatatgggctatatgtggatggatatttgttcatatgtagatatacatattttcaagtgacctgttttggagaaatatgtaaaggtatttaaaattatattaccagcatactttcaaaaagttctaggggaaatataaagcaatattagtattatccctgacttgtggcaattaaagtaaatgccccactagaagatacttgggagaagttaggtctcaagattttgttgtgaatgttaaggaaatgcagactaatttcttatttgggggtttattgtggctctcgtctcactggacctttaatcttggtttccttctctagttcgtatacttttcttggatctctgaacattggagtgcttcagggctagttgttggacccattctcacttctttttttttttacattgattttttattttattttattttattatactttaagttctagggtatatgtgcacaacgtgcaggtttcttatgtatgtatacatgtgccatgttggtgtgctgcacccattaactcatcatttacattaggtatatctcctaatgctatccctccccctccccccaccccacaacatgccctggtgtgtgacgttccccaccctgtgtccaagtgttctcattgttcaattcccacctatgagtgagaacatgtggtgtttggttttctgtccttgcaatagtttgctccatgtccctacaaaggacatgaacttatccttttttatggctgcatagtaatccatggtgtatatgtgccacattttcttaatccagtctatcattgatggacatttgggttggttccaagtctttgctattgtgaatagtgccgcaataaacatatgtgtgcacgtgtctttatagcagcatgatttataatcctttgggtatatacccagtaatggaatggctgggtcaaatggtatttctagttctagatccttggggaatcgccacactgtcttccacaatggttgaactagtttacagtgccaccaacagtataaaagtgttcctatttctccacatcctctccagcacctgttttttcctgactttttaatgatcgccattctaactgatgtgagaaggtatctcattgtggttttgatttgtatttctctgatggtcagtgatgaggagcattttttcatgtgtctgttggctgcataaatgtcttttgagaagtgtctgttcatgcccttcgcccactttttgatgggttttttgattttttcttgtaaatttgtttaagttctttgtagattctggatattagccctttgtcagacgggtagattgtaaaaattttctcccattctgtagatcgcctgttcactctgatggtggtttcttttcctgtgcagaagctctttagtttaattagatcccatttgtcaattttgacttttgttgccattgcttttggtgttttagtcaagaagtccttgcccatgcccatgtcctgaatggtattgcctaggttttcttctagggtttttatggttttaggtctaacatttaagtctttaatccatcttgaattaattgttgtataaggcataaggaagggatccagattcagctttctacatatggctagccagttttcccagcaccatttattaaatagggaatcctttccccatttcttgtttttgtcaggtttgtcaaagatcagatggttgtagatgtgtggtattatttctgaggtctctgttctgttccattggtctgtatctttgttttggtaccagtaccatgctgttttggttactgtagccttgtagtatagtttgaagtcaggtagcatgatgcctccagctttgttcttttggcttaggatcatcttggaaatgcgggttcttttttggttccatatgaactttaaagtagttttttccaattctgtgaagaaagtcattggtagcttgatggggatggcattgaatctgtaaattagcttaggcattattgccattttcacaatattgattcttcctatccatgagcatggaatgttcttccatttgtttgtgtcctcttttatttccttgatcagtggtttgtagttcttcttgaagaggtccttcacatcctttgtaagttggattcctaggtattttattctctttgaagcaattgtgaatgggagttcactcatgatttggctctctgtctgttattggtgtataggaatgcttgtgatttttgcacattgattttttatcctgagactgctgaagttgcttatcagcttcaggagattttgggcttaaatgatggggttttctaaatatacaatcatgtcgtctgcaaaaagggacaatttgacttcctcttttcctaattgaataccctttatttccttctcctgcctgattgccctggccagaacttccaacactatgttgaataggagtggtgagaaagggcatccctgtcttgtggcagttttcaaagggaatgcttccagtttgtgcctattcagtatgatattggctgtgggtttgtcataaatagctcttattattttgagatacgtcccatcaatacctagtttattgagagtttttagcatgaagggtgttgaattttatcgaaggccttttctgcatctattgagataatcatgtggtttttgtctttggttctgtttatatggtggattacatttattgatttgcgtatattgaaccagccttgcatcccagggatgaagccaacttgttcgtggtggataagctttttgatgtgctgctggattcggtttgccagtattttattgaggatttttcatcgatgttcatcagggatattggtctcaaattctctttttttaattgtgtctctgccaggctttggtaacaggatgatgctggcctcataccattctcatttctatctgcagattccctttgtgatcttacccagtttcatggttttaagcatgtttatgttgatgactccataatttgtgtctctagaccagacttctctccagagctccagacttgtataaccaacttgactacaccttgtttccatttggatgtctaatagatatctcaacagttaatgtttcccaaactaaacttatcttgcttccaaattctgatttatcccatcttttcttctcagttaatgactaatctgtcttttctgtttctccagttgaaatctttgagtcaccttgattaatcttctttcatatttcaggcatgctaaccccgttagggcttttatattgtttcccctacctggaatgttcatcccctgatatgcatatgattgcccccacctcctccttctagtctttgttcataagtcttcttccttcttagtgacagccacatcaaccacaccacttaaaattgcaactactcagaaccacagatctcctgcctactcttttgtttctgtaaaaccactagctaacatactataaaatttacttacctatcatgttcattttaaactgtctttccccattataatgcaagtttcatgagggcagagatttctgactagtttgttctctttatgtattcactgtgccggaaattaagaccagcacatagcacaggattagcactcaataaatatttgttcaataaacaaataatactatgtcaggaaatagtttctattatttttggtgaccctaaaagtggctcctcatgtgtggaagtagctgatgtggatttaccaaaacaaacaaacgaaacacatccttttataggatgtgtggtgtgtgttttctgactagactaatgtacaatttatgacaatcaccaagtagctgttctttaacaatatgcccgctatccacaaacatttccaactctaaataccaaggagtactctttatcactttctaaaaacattttgaatatttatacctcctctagtagaaaagcaaggactttcatttccggatttttctcttctttcttttctaaacatctcctctagagtaaaatcaaggacattttatatgaaagtttggattatgataacatttaattatcactcatatttcacagagtgtatttttaaaaatttcttatgactttgttctcttctcaggattaacttgtctctgaaaatagatcttttacagcctagcaaagaaagcaaaataatatatgtgcacaattagcacaaattgatcttgctatgtgaactttaatttcagaatttgagatttaaatgactcttctatttaaattgtcaacctcagagtctcattagtctaaattttacatttaatttatgaggacaatgctgcctccttagaactggcacttatactctaagttatatgatgtctagtgggaaacgctggtttaggatttcttttcctaggccttattttcagctatttcattaacttattatatgatcttagactaattatttaatttctgtgcctcgggattttttaatctaataattcagagaaatattcctcttctgtatatatcttagaggagacattaatgtgtgctggacgaagcacaggtttctgggtcataaagacctgggttgaaattctgctcagctactaactaactttgtggctttagggaagtcagtgtcactgatccttatttctgttaactgtaaaatggtgataagacctactttaaaagttgtaaggaatagataaataatttgaaaagtaattagcatatggccagaaccaatcttggtcctctgcctgctctttctcttccacctgcctctatcctggctgtaaaatgtgtttggagcattacattttacatatgcataaagtgcctgtcatttagtgggtgcttaataaatgctagttcaattggctgtgacataaggtaattgaggttactaaataaggaagggtgaatagtataatggtgggaaagaaaatgaggaaaatgacaaaataaagtttaaagaaaaacataagaacttagtaaatataataaatattactatttaacataataatgtactgttggtttgagagtgttcacgttcacaaatgcctaaaatatttagtaaagtctctacaccatggataagactattatcctactgagccctacatttttgcaaaggtttcataagatagaataatatatactcataactaagaaaatgtttaaatgatcaaatccagtactttgcccaacaggtttagcaatcaccgcattatctgctgctaattagaatcaagtgtatgatatacagggctcattaatttctttggaaataagaatcatagggcaatgcgtgtctttacaaatgggtaccagttaattttaataacttaatgtatgccttcttttacatgcacccaaagtgaaatgtatagtgtatacgaataatataaatgtttgttaatgctcagcaagacaaaattttagaatacgccaatgagcagtttcattaattactgtcctattgcaataagtacatattattaacacatctttctttgatgtgattcagtattagtcatgggtgagtgttaatgtgctccaaactatatagaccttttttgaacttcatacaacccactttctttttttttgttgttgccttaggttggaatcagatggatacatgatttttttttctttttcaggattataaaagtagtcccatttttaaagaaaaaatcataaatatggtttcataagatggatggtgatttaatatttttttacaaagtccaaattatcatttattatttttttatattccatgcttgtgcatcttcacaacgattttttttaatgtaaaaacttttttcccagcactttgggaggccgaggcgggtggatcatgaggtcaggagatcgagaccatcctggctaacaaggtgaaaccccgtctctactaaaaatacaaaaaaattagccaggcgcggtggcgggcgcctgtagtcccagctactcgggaggctgaggcaggagaatggcgtgaacccgggaagcggagcttgcagtgagccgagattgcgccactgcagtccgcagtctggcctgggcgacagagcaagactccgtctcaaaaaaaaaaaaaaaaaaaaaaaaaaaaaactttttaaaaaaattattattatactttaagttttagggtacatgtgcacaatgtgcaggttagttacatatgtatacatatgccatgctggtgtgctgcacccactaactcatcatctagcattaagtatatctcccaatgctatccctcccccctccccccaccccacaacagtccccagagtgtgatggtccccttcctgtgtccatgtgttctcattgttcaattcccacctatgagtgagaatatgcggtgtttggtttttagttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttcttgtttcctgactttttaatgatcaccattctaactggtgtgagatggtatctcattgtggttttgatttgtatttctctgatggccagtgatgatgagcatgttttcatgtgttttttggctgcataaaggtcttcttttgagaagtgtctgttcctgtccttcgcccactttttgatggggttgtttgtttttttcttgtaaatttgttggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagcctgttttcccagcaccatttattaaatagggaatcctttccccatttcttgtttttgtcaggtttgtcaaagatcagacagttgtagatatgcggtgttatttctcagggttctgttctgttccattggtctatatctctgttttgataccagtaccatgctgttttggttactgtagccttgtagtatagtttgaagtcaggtagtgtgatgcctccggctttcttcttttggcttaggatttacttggtgatgtgggctcttttttggttccatatgaactttaaagtagttttttccaattctgtgaagaaagtcattggtagcttgatggggatggcattgaatctataaattaccttgggcagtatggcaattttcacaatattgattcttcctacccatgagcatggaatattcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttatatactgagactttgctgaatttgcttatcagcttgaggagattttgggctgagacaatggggttttctagatatacaatcatgacatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagcattgttgaattttgtcaaaggccttttctgcatctattgagataatcatgtggtttttgtctttggttctgtttatatgctggattacgtttattgatttgtgtatgttgaaccagccttgcatcccagggatgaagcccacttgagcatggtggataagctttttgatgtgctgctggattcggtttgccagtattttattgaggatttttgcatcaatgttcatcaaggatattggtctcaaattctcttttttggttgtgtctctgcctggctttggtatcaggatgatgctggcctcataaaatgagttagggaggattccctctttttctattgattggaatagtttcagaaggaatggtaccagttcctccttgtacctctggtagaattcagctgtgaatccatctcgtcctggactctttttggttggtaagctattgattattgccacaatttcagctcctgttattggtctattcagagattcatcttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatgtctttgattcttctctctctttttctttattagtcttgctagcagtctatctattttgttgatcctttcaaaaaaccagctcctggattcactcattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtagccagtagtcattcaggagcaggttgttcagtttccatgtagttgagcagttttgagtgactttcttaatcctgagttctagtttgattgcactgtggtctgagagacagtttgttataatttctgttcttttacatttgctgaggagagctttacttccaagtatgtggtcagttttggaataggtgtggtgtggtgctgaaaaaaatgtatattctgtttttttggggtggagagttctgtagatgtctattaggtctgcttggtgcagagctgagttcaattcctgggtatccttgttgactttctgtctcgttgatctgtctaatgttgacagtggggtgttaacgtctccctttattaatgtgtgggagtctaagtctctttgtaggtcactcaaggacttgctttatgaatctgggtgctcctgtattgggtgcgtatatatttaggatagttagctcttcttgttgaattgatccctttaccattatgtaatggccttctttgtctcttttgatctttgttggtttaaagtctgttttatcagagactaggattgcaacccctgcctttttttgttttccatttccttggtagatcttcctccatcctcagggacccacttgaggaggcagtctgcccgttctcagatctccagctgcgtgctgggagaaccactgctctcttcaaagctgtcagacagggacgtttaagtctacagaggttactgctgtctttttgtttgtctgtgccctgcccctagaggtggagcctacagaggcaggcaggcaggcctccttgagctgtggtgggctccacccatttcgagcttcggggctgctttgtttacctaagcaagcctgggcagtgacgggcgcccctcccccagcctggctgccgccttgcagtttgatctcagactgctgtgctagcaatgagcgatactccgtgggcgtaggaccctccgagctaggtgcaggatgtaatctcctggtgagctgttttttgtttgtttgtttgtttgtttttgtttttgtttttttttttgagacggagtctcgctgtcgcccaggctggagtgcagtggcacaatctcggctcactgcaggctccgccccctggggttcacgtcattctcctgcctcagcctcccgagtagctgggactacaggcgcccgccacctcgcccggctaattctggtgcgctgttttttaagcccgtttgaaaagcgcagtatttgggtgggagtgacctgattttccaggtgccgtctgtcacccctttctttgactaggaaagggaactccctgaccccttgcgcttcccgagtgaggcaatgcctcgccctgcttcggctcgctcagggtgcgtgcacccactgacctgcgcccactgtctggcactccctagtgagatgaacccgggacctcagatggaaatgcagaaatcacccgtcttctgcgtcactcacgctgggagctgtagaccggagctgttcctatttggccatcttggctcctcaaccaatatttttaactaaatttaaaattacaataaacagttatataacatttgctacagttccagatctgagattcaggagatctctatttgtgaaaataaattgatatgacatgtgataaagccccattaccaaaagggaaatgaataggcaagaaaatagctaaacctaatagtcaggaaatgtaagacctaaaattttgagattctattttttcttttgtaaattgaatgcacaactcacttaaagtaaatgtaaaatcattcatattcaactttctgagctgacgttaccaaaaaagtgaaagttaaaaatacttggcttctattgtaaaattgcaaataaaacccatttcatgaaagtggctttaatattttgatgtttggcttaacagttcaattcaacaaacatttactctgggcaatctaccatggtgtttaagagcattggctttgcaatggaatagacatgggtttggtttcccataccacaatttactgtctttgagtgaattactcaacaactaattgtcttaatttcttcaactgcgtagttgggctttcagagcctactttgcaaggatgtagtaaggattcaataggaaagtgcatgtgcctggctatggtaagcactcagtaaatggtaactgctaatgtcaactatgtgccagactctatatgctggttatacaaagatttaaaaaagacgttatctggcattgatctttgagtgagctacaaaaaggctatgtattgagacaggactgtaatgcagctgccttgacaacatgttccaatcagccacattactgagttgtctgtattgcacatataaaaatatataatatcaaattaatgctaaatgaactctgtatgtgtaaatgttgaagaatgtatgagttttccagccctgatgcaaaattattggtggggcatatattggctgtggtttttcagcacaaaatacccttataaaatgtattttgaggaaattcattataccattaacatttttagagtgagatcaacattttttaaaaagtaaactttgctttactctgaagtgactcactttaaaataaagttggcattttggaaaataggcacaatttttgttgctcatgagctttgcatgaaaaacttgcacgaggccaaaatagcatgcctcaagcatctataggtttattgggcagtctctgtgtatttcttgatagataaaagagagagccctccagaatgcagtcaaatgtgtaatgaatcacaagaacacaacatgatttattttaatgcaaagagtgaatttactttaacaaaagaaacattaacacacaaaataatgttgttatcttattaagagttatgtattatttcccagaagagaagaacttttggggtacaccctaggccctaatcagttaaaggatattacctatatactagattatatggtagatgggcaaaagataggtgtttttcatatcatctgatcccctcatgcattcatcagctgataaagctacaaaaataccattaaaaagaaagatgctaagtccttcttatgcacaacttacaaaatttagttttccaattaatttagcattttattcagaaagagctgtcaactagcaatatatgcttaccaaattctgttcagaactcataatggtgtctcccaaggcttagcagtgttcttctgaatcagaaattcatttatgtctagtgtcatgtttaagtgtggactatgttttgatctgttctttgccaatttgtcattcttggatagtgtattaggtgtgattatcaataatgcatttgttcttcttgggtagcttgtaaagggattctgaaggaaattgcaaaaggaaagttttttttttcttttagtcttcaacaactccaacattgcaggaacatgtgcttacctcccatggctaccacgttgaaaggttactttcatcatttactttgttcatggcagagaggttacagaattgaggaagtcttagccctctcctcaaggatgttgtagtctatttgagaagattaacaagtcaagaagtacatatttacagtgtgctgagtactcttatagaagaaaacacagttgctgtggaaactcagaggaaaataacataactaagttagagaatcctttataaatttggattctctataaacatatatttggatagataagttctgagacatacatgccacatatcctacagtatctatgtttacaagtcatattttggcatcctcttgagtggattaacccttaactaaacattccagatgttaaaacaatatgaaattgttttgtttattccaagaaattcatgcacccaggctcagaaagaaggttgagcaactttatttggcttctctcttataattccctgaagccaagctaactggcttagtatacaatgaacaatgaatcaagaaaataggggtaagtttctagatggaacaaaggtattcattattatgagtataaatattttttctcttatcaactattatcaacataatacatgttctaatatgttcctgatttttctggtgatgtgaatcataaatttagtcaccctaatcaacaagcctggcaacttggacactggcacatctaatatatatttttgtagcaaaactcaaaatcccactttctttttccttagccatttctcttttttgcactttctttgggatgactattcttcttggacagtgaattgaacagtagtgaggaggatagaagttagactgtgttccagactcacaaaattaggctatagaaatcaaaagtgtccagggacagttatgctgaagacagattgaagggatattctttctttctgccctgggccaataggtccaatggaattaattcagctggccagctattttaaaaaatgtcatgtaagtaaaatggttgcaaagaaaaactgcgttaccttgaaagcactccatagataaagcatatgttttacagagcagacattgactctagagaagaggaaaaccacagtgatttttaatcattaattgtaatgactcttcaaataatacataagcaacatggggaagtaatttttcccttcttgccatcattacctaaaaaaccatagctgttttgaattatatgatcaattcaattcattacaagtttcttgaaggtctgttgggtgctatgtgctagaaatatagtgacacacaagacagacatagtttctctcctcatggagcttcaagtctgatgggcaagacagatattacactaatagttagagatttccctcttttcttttattttctttttcctttctttcttttctttttttcttttttctttttggagacagggtctagctctgtagcccaggctggagtgcagtggtgcagtcatagcttactgcagtcttgaggggctcaaatgatcctcctgcttcagcctcgcaagtagctaggactacaggcactgaccgccacacctgagtaatttcaggtttggtgactgctagagtatgaaagtgtaagacgggtggcctaatttaaccttggagcaagtagatgtggccatattgcaaggcaggcaaccccctaaattggggcctagccccagaagttttttggcttcacttaggaaagaattcaaaaatgagcctgtggtggaagaaaacagttttattgaggcagcagtgttacagctcagtgactgctcctgcagagcggggctaccccataggcagtatgttgagaatagtagctcaggggcagttctgcagtcatatttacagccagttttaattatatgcaaattagagggcagggtttactcagaaattcctagaaaaagggtggtaacttctgggtgttgccatggtaatggtaaactgtcatggtattggtaggcatgtcttgtagagaggtgctttctgtgcctctttcctgttgtagccaatcttcaatctggtctggagtggagtcctgcctcttagccagagattcacttaagttgtggcttagagatgggaaaggcagaggagagaatagccagcctctattcttagtaattgttagtatagctgaaatattcctcaaggtcactgggacactttcttcaggggatataagggaagaacagtccctagctgtttaacatgctttctatgtagatagtcctttctaagctgcagagtctgctgttctttacacccctctgtccggacaacagaaatttatttcagctcaccattatatatgttatactcccagatatatatatatatattatactcccatatatatgtattatactcccatatatatattatactcatatatatatattatactcatatatatatttatataaaatactccccattctcagtatccttttctagaatcgtttaactttctaaaaggattagcccttacttattacttgtgaactcttttattatgttctccaagaattctatagcattctcagacccagtacaatgtcttcatccttcttccatttggttttaaaagcttctgtcccagcaggaaacacaaagagttaaacttggattcaaccgcttctatagctcatccactgagagtcttccatgccaaacagcgcatcatcaataggagttagatttccctattagttaaaaatgaccagagaacatgaaaataatttggggaaaaaaataggggttggaactgtgaaatcaacagtatttgttttgaaatgtacccaaaatgatccaatgttgctttctggggtgaagggaagtgtataacaaagagtgggagatcagtacttttttatttgctccacaagtattctgtagaaaacatggtaaactgtctctcaggatacatttgagtgcttgccacaattcaaaagagcctgatctcttctgttgtggcccagctaaagggtgtagaggagagtcctccttttccttcactcacagctttcactgacttggcagataaagggcatccctggaatatgctgaattgaggagggagatctggcttctaacagtcccagcagcactactgactgacactaatcctggttaactcacttcccttctctgggcctcaatttcaccatctgtaaaaacaagaggggccaggtgtggtggctcaggcctgtaatcccagcactttgggaggccaaggcaggtggatcacttgaggtcaggagtttgagaccagcctggccaacatggcaaaaccctgtctctactaagtgtgtgtgtgtgtgtgtgtgtgtgtgtgtgtgttatgccgggcgtggtggcgcatatctcagctactggagaggctgagtcaagagaattgcttgaacctgcgaggtggagattgcagtgaaccgagatgctccactgcactccagcctgggcgacagagtgagactccatctcgaaaagaaaaacaaaacaaaacaaaacaaacccaagagggttcaactgtaattctgtggctttcttcatagcagtaggcattctatggaggcaccattaggagaaattctggtggccaagggtttgccactgacgtacatactctgtccttttttctcactaagagcagttctggttttctctgcttttgttttcaccttcacatacaatatcatttgaccaaagaggttcatatcttaaaaaaaattgtaaaccattgtattggatgatttttaagaactatgactcttttgctggctttaggtatcctactctaaggggctcctatgctgctggatagttgagaatatcagttaataggggtggaggtggcttagctagaaggtgctaaaaacatccctgaagccctaaagggttataatttccccttcttgcatgtatatttgctgctgctgagttaagatatgacaatagtaaaaactggacagtccttttgggtatacccagaggggtttccccatgaatgaagtgggcagagctaacagtctaagcctgaaatggtgtatgctaaagagtagaggcaccaagggtgtcaaacactggtgctgtccacttctgcagtgagcttggaaatcctcaggccaggtgttcttcagaatgcaaagtccctggaattaaaggaggaaacagccttggaaagctttgagtttgcaggggagttgccctcttgtctttggatgggatcagggcagggacacccatgctgaagaactatcaaggaaggatagcacctgagggccaaaggattaagaggccagctgggggttcagagggagggaggcagataatgcctttatgaacccattccacctgattatagtgtaattggattttgagggacttcaagatccatggaaacatcccacttgcttttatttgggattttgactatcagaaactggcaatttgggaacttgactttatattagttttatcattgcaacattttctttggtttcctcttcattttgctaaagtttattttgaaaatgtcatatcctttgttattttccaagggatatgaatttctttaggaatatccaaggcaggtctatcgtcattggtgtgtggcctgtgttattggttggtttaaatactcttctgggctgggcacagtggctcatgcctataattcgagcactttgggaggccaagggaggaggagaggatctcttgagctcaagagttagagacagcctgggcaacacagcgagacctcatctctactaaaaataaaaattaaaaattatctgggtgtgctggtgcatgcctgtagtctcatctactcaggaggctgagactggaagatcgcttgagtccagaaggttaaggctgcagtgagctatgattgcatcactgcatcccagcctgaggtgacagagtgggaccctgtctcaaagtaaataaatgaatgaatgaatgctcttctgtcactatcttgaaattcttaataagttttgaagaaaggatcttggcttttcatttttgtaccaggctccacaaattatatagccagtccttgcccttggtatccattttatcctaattttactaggttatatggttcatgagtggtactagggagaataatagacagaaagggagagatgtgttttgttctaggccccaggtatccagagtgtcattgaacctgactaccaggtcagactgcctggaaattgatagtcctggtgttcaggactgggggtggaatattaagctccagaggcctaggtatagtcatttctgggttgctgcttaggtaattcatgtatatcacgtgtgaattatttttaaggtgcctcatgtgatctcttttgtaaacctgaccacagaagcagggcagatagagtgctggctaaagaggatctattgctgcaactagataagaaaaaagaacccctctagtagcttcctaccactctggaatgctacacacagtacaggttggtaagtgaatgctgccatgtgccttggattccttcttaggagaggtactaatgcattatcaaaattatttaatttttattatttataggcttcttatcaagccttcaggatgaggactaatatgatttcagtgctgtgggtttcagagagaagaaatctatcttaggcttagcaacctgggggtaagtgccaagctgataagcatggcagattaaaagcccattttacctagacatactgacaccaatagtgttgttagtaattgactcatcatcactacgatacatatcctgaggtgttcaccatgagaaatattgtgtctcctttcttttcacagggtctccgtggaattagtaacaggggatgctggttttatgggggcagtctgtggatgtagggagttttaagagaaattagcttgctagtcaataaccagggctttgcttgtacctctcctgatcagatgaagaatcatcttttttttttcttgctctgttaaaaaaaattgcaaagaaagcatgaacaccttaacttctctcatgctagggaaaaagccttaagaagggtagtacatcagactagtgatgcccattcgtgttagcctttgttatttgcagcttacatggcctcatctggaaatgggctatcaggtgtcgtcttatttctaagctggctgttacatttaatacaagtggagtttgtgtgtaggtctactgcacgtattcttggtgctcagggacttatagtggtcccttacagtttccgaaatcaatcttgctctgagatgggggcaccaagtttgcagcatctccctcctacagtcatttagagttattgatttgcattgaaagaaatgaaagttggaacactttttttaaaaatagactttttttctaagggctgtcaggaagatatgcctcttttccaatattatgtgtgcttgtttgacttagtacgtaattattgaggttctctctggcatttgagggtaccaattggggatcacatcccatgaacacagttgaccacatgtgtgccttcagttggtgaccatccacagcaaagggccttacccctctaccttaagatttcattcactctagcttgacaaaacattgggcaatcccatattataccttcccttcgcttccattgctctccccagaatgcctttctctgctttctttctttgtccaaacccatctttcaagcctctctcacatgccactatctccatgaagtcctctctaaggatttcatctcaaactatcatcctatccttgaaatgttgtatgatcattaagctcttaccataatattttacatttagttatcctgtatcttaaagttctttttctcattattattttaagtctttgtagccatatagctcctactggaaatacacttatttattttttatcctgcagagtacctgcaccacttaataaatacacatttgattattaagtcagtgaaagggttcaatcactgatggcttcattattaatgtaaatgttatatgagaagagcagcatttatatcttcactcaaattagcttgtgaggttaactctagaacagaaagctggggaagtctattgaagaatacaaggaaaggaaaactacctaaggttttgtttagaataatcatccaaaaaatgatcatccttgttttaagatgagaaaacagacatagagaggttaactgatttgtccagattgcacacctagtaaataacagaatgaaaacttgaacccaaatcctttgactaaatgctatgctctttcctattgtgagtcatggcatcctggcaaccttgggtgtgtaggtatgggctctttactttttctgtgtcattcttaaaatgtagcacccaggagagtatggggaaggggagcagggagaaaaaagaaataggtatgcattcacatagaaattcaaatactggctaattgcaatatgtgaatcacaacagtaatgttaagatctcctcatttcccccctcattcttacaactcctcccctttccccattttatttcttctcttcacattccaccttccccctcctccctccaagtatctaattatagttttgcaagaaaaattacagactacatactgcaataattcacacctggaatttacattgattttatggcatcaagctctgagtgccactttgcgttgcattcccatagcaacaccaaatcgtagactaggagaaagaaaaatctgagaactcagcatctgcagctcctgaatctcttatatttatgacttggctcttccttgacaagttgcctatttttctaactttgtttttagaaagcatacacaaattaaaatgatcccacttcatattttgattgctttgaatttgaaaaatgcttgaaagggtgttgctctacagtaacagattaaaaaaaaagataattggatgacagacagaagagtaggtgtgaaaaagtttgtaaaagcatcctgagaactcttgtctctcacacctactatagtaaaaatcaaagcaatcccggggcctctggcacatccttctgcctacagtggccctccacttgctgacctgtagactcagaagaaagaagcagccagaggtcaaacattgctgccttgaagtaggatcacatttgtgcatttcagttgaccttctggatcctgagccctttccttattttttgtgtcttgtttgaccagagatctgaattagcttttcagatttgtctgagttgctggatcctttgtttccatccactctgtgaaatgatatctgtttttctgccagccatgtcctgatactaaacgctggtactgttagcatgacttgactctccttactatgggtaatatttttcaaggttccttccaggagtcttagttcaattgtcacctcattttagagttcttccctgaccgatttatataaagtagttccctctaccccattcctccaagaactctcaattcaactactttgtttcattttccatagaatatatgattatattatacattaactgagattccctaatgtgtttactgtttcagtgtctgatcttccccactggaatgtaagagcagcagcctagtctgtcttatattcgacactttattttcagttcttagcacaatgcctggcccagaataggcactcaaaaaagtatttgttagatgaatgaatgaatgaatgagtgaatgaattccgcaagtgcttattgaatacctattatgtgcttaccgcatgattacccattttggaaaatagacaccactggcctcctggagagtttaccagcagaaataccagatattaaaagtctaatgtgtaccatctgtttcgttgctttctgtcactgtggccttcacagcagtaggaactcaggaacagtttcaggccttcacaggctaaaatgtttccaaggtgctcttcagagctggagggcttagtttgcctcacttctatgtttctacacaccttgctttctcctaattcactattgggcaatcaagttataaaaacattgacatagttaagtctgtttcctagtgtaggctcaaaatgattttgaaggtaagtaaatatacttgggaaattgacagccaagatttctgccatgtgcaaccaaaggaaaggttattaatacagtgaagctaggtatatctcttcatggtgactaagctattttagtaattttctttaggtttattgacttctttattataagaaacaatgaaaatcttaaggagagtcactcactggcaagagaaaaaaaaatcatttgccctaagtgcggagaatagaaaactaaatcatccactattactaatgacaaccactacaaaggccatttagtgcgtagcctatgctacacactaaatgtgcgtagctaaaggtgcaatgcactaaaggtgcaatgctaaatatacttactctaaggaaaaggaggacactttaaggctgaaactgggagaattttattctttatgtatgtcattaggaatttcctttcctgggagaagacacatcaacacctcagtgtagggacattggaaggtgcctttaaaaaagacattagttgtgccttttaaattgcttctctccacaattccagggtgattcttcaatctctgcctttctcttcataattcactcaccttctctgggcctctgcttcccctatttggacaatgaggctgatgctatatgctctgtctaataggagcgttggatggctgttatctcatttttttctgtctggttaatagttacacaaatgctaggcattattttggttattgttagtggtcgtcaatatttacctgggtttcttcatccctgagaggggctaatagtaaccagttcgtcccattacatgcctccgcctgacagaattaaagaactcatagtccttgggatctcagcagtcagatatcaaatagtttccctaatcaagtagtattttattagtggtaaccatggtatttcagaagtgagatctggatttaattgagctatgatagagttttccaggttttagtagggatagattgagctttccttttaaacattataaaaatatattgtctccacattattttaattaggaaaaatttgaatagtcttaaggtagtacttaatacttacatttgatcttccaaccaaggaggtttcatcataaatgtagttattcatatgtaatcacatctcacatagtaatgatatttacataacaagaaataattttcttcaggaaagttgagtatgtcctgcacacatcagtatggcattatggaaaacattctgacatctaggcatttctcattgacattaatagggtcaatatcctcacctgtcaccacaaattagaagtcacccctggatcttgttgtgccctgagggtagtaaatagatttccatgccccagacccaaataaaatatcaccagtatcttttctcttccttggctcaggtagtatacgtcctgaaacagatgacaactttaagtttggaataccaattgggtcagaagataaacaaagtgcctcattttttgactcatccatgcttcctccacctccatacaagtatttttgacaccaagtttcttttaatccttctttaagagattcttcctataagattaaaaaaataagcagagtacctttccaaataacaaaacataaaggtaagtatcttgcaagtacataggattcattttctgaatatagtataacttaataataggatgtgcgtgtgtgtgtgtgtgtgagagagagagagagagagagagagggagatagattatgcaatcagatatgaccctttatggatctatgattggtttacaggtacttttcatgacctatgagatctgatggtgagcacatgttactcaaaattcattgatcaattcaggaagcatttgaaaattgcccaataactgcttttcagaactaatatccatttatattcatttatttcaaccaattcctaaacaaaagcttcagagaaaaaaatctcctttgtctttgcctgaaaaatatgtgtaattgttgacttgtcattttatattgtgttacctgcctttatcatggtactacattgtgccagggatttatttatttatttatttatttatttatttatttattttatttattttgagatggagtctcgctctattgctcaggctggagtgcagtggtgtgatctcggctcactgcaagctccacctcctgggttcacgccattctcctgcctcagcctcccgagtagctgggactacaggcgcccgccaccacacctggctaattttttgtatttttagtagagacggggtttcaccgtgttagccaggatggtctcgatctcctgaccttgtgatccacccgcctcagcctcccaaagtgctgggattacaggcatgagccaccgtgcccagccgatttatttcttatgtacccaagaaaaataagaaatagctctctgcccctctctctatccgaattaacatcaaagacaaacagatatgatttacagatactagttggtttagacaatatggtgtactagatgtcctagaaacccttatgataaaatgcctagaaatactgggaaacatataaaaaagtttttttttctttttttttaaatcagagaaagggtcttgctctactgttgcccaggctggagtacagtggtgtaatcatagctcactgcaaccttgacttcctaggctcaagtgatcctcctgcatcagcctcccatagcactggtattacaggtgtgagtcatcatgcccagtcaagaaacattttacaaaatgcatacctgctttcataagaaattcagggaaaacagccagaggcacaccaaaagaaggatctgcaaactgaagtactaaggtaacagtaaacttgcagttgccctgggaatatttttctatctcagttatctaccaccttggattttagtgggctcataaggaacaggagatgaagccttgtttctatacatggtgttgatttgggatcgtgattgccagttgaatctcctatccacatagaaatagtggactaaaaggtatatatatggccaagaataaagagaaactagaagtatattagtttgtcttggcctgggctctgtgaggtaaaaattgtgaaatgtgaaaatgtatatatgtagtctgccttcatgtaaataaggatcttaaatctgcaacatctcatgtgatcctggaaactttgagcaaagaaattaacttaaagtaattccagatttgtatcaccacaggactcttgtatgatgcaaaagtcaactctttctgaaggattttatcctaacaggtcttgtaggattcttaaacatagagcccccatgaacataaattcacaatccaaagttataaaactgacactgaagtagtgtcagaagaaactacagaacagcgtatttgacctttaagaacttcagatactgaaattatcaaatattagatttaacatttatatttaaagtatataaataagaatcagaaacatgaatgaaggagaagatacaataaaatggtgagatatatttgcagaaatatcaaatgtattttacagaaatgaaaaattcagtagatggattaaacagaagattaggcataaagaaagaatgagctataagaaaaatctggagaaactgtcaaggtgcagttcagagaaacaaactcatgaaatatataggaagcatggaaaataaaatgaaaagatttatcatatacctagagtttcaaatgtaaagaaaaagtaagattaggagagaggtgagatccaatgagaaaatgactgagaatattctagaattaatgaaagacatagcttcagagtcaggatgcataatgtatataatgcaggaaaaataaatcatcacctaggtacagaataataaaaccacagaacagcaaaagcaagaaagaatataaatttaaataaatagcaactcaacctccatctccaaatgaagtgaaggagaagaaactaaatatagaaaaagtttggtaagtggaaaacaccaagtaaattggtgaaaaatatcagtaatcacagtaatataaatggactaatgtgacaaattgaaaaagtaattgttagattagacttttaaaacatgctacttatcagacttttctaaaatataggggcagtagaaaaattgaaagtaaaaggatggataaatatttgtcaggcaaatactaatgcaaacgttacatattttcatagctatattatatttcagataaaattgaccttaaggttaaaaaagaagcatactaggaaaaaaagaagtcttacataatgactgagaattcaattcactaggaagttctaacagttctgaatttgtatttacttaacaatacagtctcaaaatacatgaagtaaaaactgactgaataacaggaagaaacacacaaatccacaatcatgagggcagattttaatccactagtcaaagtaatggataaatttaaaagacaaaaattgttggtgagattatggaatagagatcaacacacatttacaaattttagacattgtggaccatatgatttgcagaatctcttacagctactcagttgtgccagtgtagtgtaaaatcagtcttaagacaaaacttaaatgaatgaacatatctttttccaataaaacttcatttatggacactgaaatgtgaatgtcatgtctttttcaagtgtcacaaaatctacttttgctaattttcaaccttttaaaaataagagctcttttttatctcacatgccaaaaacaggcagtaggccagtcttggcccataggctgcagtttgccaatgcctaatatccaagatttgtacaacagaattaataagtttaacttagtgaaaaatcttgcgtgtagtaattagaaaatacatattattctcaagaacatatgggatatttactaaaattgtcacgtattatgccgtaaagcaactaccaatacatttaaagaaatccatataatacagaccatgttctcttaactcaataccatcaacttaaaaataaataacaaggggattatttttaaaacacacttttagaaaaatttaaaatatacatttgaataaatattcacaagagaaaatgttcatattggacattagaaaatatttggagcaagtgaaagatgaaaaaaagtacatgtaaaaacttgtgaaattaacaaactgatatagagaaagaagttagtagcattaactatattaaaaaataaaaggttataaattaatgagctaagtttcagttctaaaagttagcaaaagaacaaaataaacacaaaaaatagaaaaaaagaaaataagaggaggacagaaattaacaaaacagaaaagacaaaccttgtagaatcaacaaagctaaaggttcgttctctgaaaagactaataaaatagacaaacccttggcaatagtaggacgtgtacatacatgagaagaagaaagagaacaccaatgatgaacaatattaggaattaaaaaggagagatatgactagatatgaagtaacaaataagaaaataccaaaagacaactttataccaatatacatgagaacttagacaaaatgcatgctttttaaaagaaaaacataacttccctagacaaactacagaagaaatagaaaaccttagtagacttataatcattaaagaaattaaatctgcaggaaaaaaaagaacaaaaaaaggaccttaagaaaaacactgaaaccacaggaaaattcaactaaacattcaaggaacagatcatttcaagttcatataaactctccccaaaagataaaaacatatattccaaatttcttttctaagaataatctttattccaaaagtagataaagacaataggaaaaatgaaaagtgtaagtaaaacttattatgaacatagatgaaaattctaattcaagtattagtagactgaatcaagcaatgtataaaactgttaataaagtagaccaagttcagtttcactggagtctaaggtttgctgaacattagagaaaatgttaatgtaaatcatcacattaatggaaagtaataaaattatatcaccatctcaatatatacagtaaaaacatttgctaaaaaccagtgcctgttcatgaaacaaaccaaagcaaacacacagttattaacaaagtaggaatagaagcaactgataaattgtgtctacaaaataatctgttgcaatcatcatgttcaatggtgaaatgttaggtaaattcctcttgaaaatcaagaacaggagaaaattgcataacattatcattcctactcaacagtgtaccagaggtcctaatcagtgcagtaagacaagaataaaaggtaattattaaaatgttaaaaatgcaatgttgtcacagtgtatagactttcatgatttgcctacatagaaaacctgagataatctataaagccttagagttaatgatagtttaacaaaaattaaatgtattcctatatgtcagaaacaaacatttggaaaactaattttaggaaaaaaaccgcgtataattgcaagaaaaacaataagatacctagaaataaatctaacaaatgtttaagaccttaatggagaaaatataagattttattgagagatagtagacttaaataaaggcagatataaagcatgttcatggaagactcactatgataaagatgacagttctctccacttaatctatatattcaatgcaattccaatcaaaatcccaacagggttttgttttttgccttttgctgtgtgtgtgtgtgtgtgtgtgtgtgtgtgtgtgtgtgtgtgtgtaagtaaaaatataagctgattccaaaataaatacagaaggaaaaagacctcaggatagccaagaaaatttttatgaagggacatggcttatcagctatcaaggcttattagtaaagctagaataaataagctaattctcttacataaaaactaggccaatagaattcaatataatatagatccaggagaaagtcctttccatatataaaaacttagtatgagtcgacattgaagattagctgggaaagaacaggctgttcaataaatggcactggaatcactggttaatacacgtttaaaagggggttatcttgacgtcacaccatagacaaatataagttccaaacatttaaaagatctaaatgtaaaaagaaaacctttaaaatgtttagaacaatataaaagagactaactttatgacagagtagaaaaatagttctttgaaaggttttataacataaaacataaaggaaaatattaattcattttactataatagaagtaaaatattctgatcatcaaaagcaccacttaaaagtaaaaaagataatgaaaaacctggggaaagatatttgcaaggcataaaattaataattagaatccattctaaaaatgttttactactaatctacaagagaaaacaactcaagagaaaattaggcaaaggttatgagcaggtgtaacctttcataacctctcacaggagaggaaacatgaatggccaataaacacaggaaaagttgtttaatttgacatgtaattagagacatctaagttacatctaaaatgatatgaaatttctccaccctccagattaatagaaatttaatgtctggctactccaagcttttgtgaaattgtgtaggaatggacactctcatacactagttttttttttctttttttccttaaagatttttcccttattatacactagttgttggtgggagtttaaattggtgcatttactgttgaaggcaatttgtcaatatctagtaaaattgaagatggaaatatcctacaaatgagcaattccactactaggtatatttcctagagaaattcttgtacatttacaccaaaatatctgtaagatatatagaactatatcctggtttgtgagaaaaaaggcaaaatttaaacaatgtacctatcattgataggggaatggataaataaattatagtgtagtcataaaatgaaacactaaatagtgaaaataaatgaacttgaggtaaatatttcaacaaattattgatataattgatacagagcaagtgagccccaaaattggaacttagcctgggagagttgttggcttcacccaggaaagaattcaagggcaagcaagtggtgttaggaacttttattgaaacagcagtgtacagcagcagcagaggtactgctccttgcagagcagggctaccccacaggcagtgtgctcagggcatgggcagttctgcagtcatatctatacccacttttaattatgtgcaaattaagattatacagatgcttctagaaaaggggtggtaacttctgggttttctggtcattgtcatggaaaggggcgctaacttctgggtgttgccatggtaatggtaaactgacatggcactggtgggcatgtctttgcagaggtgcttttgcctcttctctatttcagctattcttcaatctggtccagagtcaagtcctacttcctacctcattcccccttcaaagattaaatactcctctttaaccttaagggggatgcaaaagtgcagaggtacatctttgtaactgcatcctgctgagtttatgggcataggcccttcctaccaccagaggaataaaaatctctggatcttatctaaggggcccacaggcaagacgcttttactctctgggtcagtagatgggatgggttggaagtcttgtgccagcattgtctttacctagaactttcgtaatatagaagacacaaactttattaagaagttaagcaaacaaaggccaaagattagtaataacaagacagctattaaaggccctacgaggccgggcatggtgggtgacacctgtaatcccagcactttgggaggctgaggcgggaggatcacctgaggtcaggagttcgagaccagcttggccaacatggtgaaaccccatctctactaaaaatacaaaaattagccgggcgtggtgaggcaggccggtaatcccagctactcgggatgctgagacaagagaattgcttgaacctgggaggcagaggttgcagtgagccgagattgcaccactgcattgcagcctgggtgacagagcgagactctgtctcaaaaaataaataaaataaaataaaggtcttcggagaggtaaaaaccaagtgagacttgggaaagtacttttgttagtcaacctgatatagttgggatcagtgccctggttatatctatgtaaccaggtagcttgcttatagatcttttgaatgttaacctcaatctgtccagaggcgttaatacatgagcagcaggttttattaataactgcacagactccacctcattcagcttgtaaataatccaatcctagtctattatagagaactacatttgccaaagagtccagggactcttgaactctctttagtccctgacctgtgttggtggctaaatattttagggtttcagttaggtcgttttagggttgactcatgatagacaaaaccactccatagtgccactagtcctattgttgccctgattcctgccagagttaatcctattgcttgtttaattctggtgttcctcagtcttagggggttataggctatgaaccctggaggcacaagggtgtccaatgtacattcacccctgtcctaaatttttgatgtacaagagaaagctacttctaaaagaacaagtggctctctgggaagttgggtgtggttatggggtgtgactttttcccacttacggccacaaacaaaaatgagcccagttgaggcacacatcgaggccttacagagtatgatgtctattctttgcttccaagttgggtccatagaaatattcttcccctgttccaatgggggtggtcgaacaatctttgttttccagaagcgggcagtactcccaccttcccagattaggcagttgtttttcccttgcatgttctgatccaatagaagccaccatatatgggttcctcactctcaagtggaatcccatttaccttgctctggccttgggaacttggcagctagaattggatcacagcatcacagggaacttcctcttttatgtcattaaaacaacagtgggtgcaaaagatagaatcattagtgtactggaggtatagatacccaacttcccaggttcaggtaatagtggtgggggagtgcaggtggaatctgttaagtaggggagcatcccacctaacaagtagggagttttggatacttgaggattgctatcattagttaggagatctggagagatggctgtgagagtttatgaataggccagaagatggaactctctatcttggggatgttgataaatccagcaaccataaagatgattccctgatgctacaatttttgaaatatttactatagagttttgttcctacccacactggattagagtaattgggagatcaaacagtattaatagtgacagcatggtatccagctgggctttagaatggcctctacacccaacaagaacaaaagagatgtctccccagaggaggtagctggctaaagcaatagaaaagaaacattgtagtcaagaagagaaaaattaatgctcctatttccacccatggcatcatgttaccactgctggctgagtgttgattcttttaaataggtagtggaagtcttccaaaggtttacagaagtaggtcatggtgccctctctttgtgcctgtgactcataagaaacaggtttaatcctcgatagttgtactcaagtagttattccctgacatttaagtggtggcagtatttaacaatacccagtagggacctttcagttaggttgtaactgattctcagaggatctttctttttggtttttagtaagactaagtcttgtgagaggcaataatttatttccatattctggaagagacttgtgaatctagcctaaattttaaagggggcatagtgaggtttgtctaactccctgatacctgtcatggcctgagttagtttttaagtttctttggaatttcctttgctcaagggacttacagtcaaaagacttatagccaattaaacattctaggccagatgggaatggaggtggtcaggcactcatcagcacttaaaaaccttttaagcaatgtgagtcaaaaactaaaagccaaaaatgagattatatcaagagaaactatattgggtgaagacactgctcccacaggcctctaaaacaaaacactttagcatctggccacaataatagaaccagaagaaaaaactcacaggagccgacaaaaaagctaaaggagggagttacatgaactcactgagaagctttcaaaagaattagcttacagaattgaaaactttctggtaatttcacaaattaataccttaagaaaatttggtcttaaaatgtaggccatttttaaagagtcaattataaacaattttcttttagttacagcaagcttagtcacacacaaaaaatttattttataaattccctttcgtgaaccttatcataatttacacagatcatctataacatgcttggcctttctgacttttcctacactatctctttcttaaataaccaatcattttaatctaggacaataatttactatagagaatccttttgatgcaaaattactcctttttaaatattctttcttgcaaaaaatatattttctgtcaatagcattttttatatctctcttttttacacatttgttccctcatattttgaacctttctttcaataacttccaaattagacaaaaattattctttttttccagtaaagaatacatttctttggcacatttcatataaaactaggaagcaagaaatcctgaactacccaccatacattggcattctatatatgagaactattccacaattttaagattttaaaccacacaaaaagctcattatttaagcatctattccattcacatgtgtttaacatttttacttttaatagctatgtttagaccacctccaagaaccaagatcccatgcaaaggtagtcaccatttaaagccattttaaccattttaaaacctatgaacatcagtgatttacctagctaaaaatcttaaagttaaattttaaaagacgtaacatttctcttcaaatgaataagcctagactagccttgtttaattcatgagcactcttttatcagccaatatgatagcctgctaaacacaacacacattaaacctgtatatacacttaaacacatcaaataaaatgacatatacaaagcaactggattcaagttatttacaaaattgggacttacctatctgccaaattttgttagcaccagtaggtatagaagacaggaagaggcagggaagaagatcccatagcatcaaataaagaaggaagctgggggaactgcagtgctcagggggaaagcccagagtccccaagccaccagagagatcacccagtagtggagacattgaagaaaaatgttcaagcggctgcttgtctgccactgtgggaagctgtccattaggtcaagggtccagacccttagtaaatttacttggacaaggcagctctctgggggctagcagaagaaggttagctctggacacaatattttcctctcactggggacagttaggacatcttattgccaatggtccttttgcttgcagtagacacactgattctggcccaggggcctgcgagttgggattcctttctgggcattccagccgctgatcttgcgatgctttcttgagatgggtaaccctgcagaggcagggggattaaagcatttgctaataattgcattttttggctatttcttttttttcatctcttttgccctgtccctattgttgtagactttaaaggccatgtttaagagttggcttgcaggaatttgcggtttctttgctgctttttgtagctccttcctaatgacaggagcagattgaataataaaatgcgtacccagaagagtttgcccttctggggagtttgggtctgcatttgtatatttcctgagtgcctcaactaaatgaccctgaaacagagcaggattttcaacttttccctgagttatttctctaattttgttataattgactggcttaaccatacacttttccttccacttttttcctacagcacaagtaatagatggcaatatttgatgacatgctaaacaaaacacaagttgtaatgactgtatatacacttaaacacatcaaataaaatgacctatacaagacaactggattcaagttatttacaaaattggaatatgacaagttatttgtgagtaatgacaagttaaatcaaagaacatggtaaacttaacaaactactctataaacttttttggattctttgaaaactggccaaatttgtccttgtataaagccaaatcacacatagaaattggcatataagctccaagtgttttcttatttccattagctacctcctgcaatagatgtaggtttgcctttaggggccccagtacagggcccctctccaggtggtactggttgggcttattttcctgggcagtgtggggtatagctggggctagttggataagtgaggtggctggtgcctgatgaccttggggtgagatcctttgttagagaactggtaggactcctctcagaattgggggaccgaggagactccagggagggcataggctttctagccggagcagctaggaggggattccttaggcatatagctttctggtgcctggaaataacgagagccagtaaagggccataaaaccctgtacatagggatatcctcccattttcctcttttttttttatacagaataagtccaatcgtaaaatgtcgttataatgtataggaccatgcttaggtaaaatctgtttgctttctaatttgtattgaacccaaatggtgttgcaagagaaaatgagtttctttttctctaagctgaatttgaatttgctccaatagcttaaaagacaccctagtggtcagtcctctgggatgctcatcattgtctccatgactaataagaatatttattggacataggactttttctaagtctaatgagaaaaaaaacaactgggcctttgttatttctcccttttagatttctacttgctatctaagtataggtagtaaggtgttataaaagtggattgtaagtatttgccagtgaatgaaatatgacaaaaaagggtttttattaagcaaagtgtagaaggaaaaaataaataaagtaacaataggaaaagaaaatgttgttacagaaaatgataacttttagggcagaaaatgagaaaagacaagaccaagattcctctaggatgggcctccaacccataatactggaaggaatgccaatgccaaaaccctggaacaaccaggggtgtccaacaatactgaatgctgaaaacctggaatacctgagtatcaagccaacaagtgtttctacaccaaatgcccgaaacctcagagtttccaggggttctccaaatgccaaaaaccccagagtatctgtggggcatccaacagtgaaccccaaaggcctgattggggccacagaaaaatgtgactctggtgttcctcagtaaacacaatggggaacctctcataatcaactgccctgacttaaacaattgccaaaggagccaaagccaaaaaaaaaaaagactgcaaacaaaacatgcattttaggactgaaaataaaatggctagtggagcaataaaatagagtcagaagagaaaggacctggtgaagaagtgacaaggatgtgtctcaggacactcaattaatgagtgacttttcactgaccacttagccaaagacttttatgccctaacttatctgatattgtggggaagggttcagaggggacactcacccattcacagtagccaaaattgtgctgactgatcttccacatgggacccggatgaaggtcttccccaggttcccttaacttaggttgacttagctgtcacacatgaggtgcaagtgcagggattgtttacctgccagcctactggtaggagcagcaggtcccattcaaggtggtactactgtggacacttgcctgttcactcagctccactgcccactgggaaagatgatggatctggaaagggcctttggttagtgttatggctttgcggtgttagcagctctttattgttacagcctcagggttatagctctgcagcttttggttgccatctcaccatctcttgccaattgctgcctctccactgatcactgattgccgtcatcgccactgtctcaccatcttacctctccaccaatttccatctctgctctctcactctctctcacttgctgtctttgtccctttgttggtcaccagataacacagggcaggtgagctctaaaattggggcttagcttgggagggttcttggcttcacccaggaaagaattcaagggcaagctggtggtgttagacaacaacttttattgaagtggcagtttacagcggcagcagaggtactgctcattgcagaacagggttatcccattggcagtgtgcacagagtagtagctcaggggcagttctgcagttatatctatatccacgttttattatatgcaaattaaggggtagattatgcagaaatttctataaaagaggtgatatcttccagctcattggcttgttgccatggaaagaggtgataacttccaagtgttgctatgacagtggtaaactgacatggcactggtgggcatgtcttatggagagatcctttcactttttccctgtttcagctagtcttcagtctggtccagaacccaagccccacctctgcagtcaagtcctgcctcctacctcataatgagccaagaaaagcaaggtaccaattgaaatgtgcagagtagttccatttctacaatgtttaaggacatgtaaaacaatgttataaattgatgatacttctatgtatatatgcatctttaaaagaatgcaagagaatgatgaacatctaaatcaaaatagtggttacctcatggtgtgggagtaggaatgggaatacaagagtgtaggagcacacaaagggcttcaattgtattggtaatatttctaagttggttatgtctcatgggtgttcattatattaatagtattagtcttcttcaatgtctaaaatatttcataatatactaaaagtagcatactatgtctctgacactctacactcgcttttcctcctgaacctctgtttaattatgaaactctaagaatattctcattgatgttggaaacaaggcaatatcaccacgatcatttgacttagctctggatgtaccagctaatgcaattagatgaaagaaagaagatatgtaaaaacaaaaagaagaggcacaatcatcattatttgcaaatgtcattatatacctggaaaatccaagagtaccaactggaaattattataattgtataagtatgtatctgtagaagtgtagaaaatataacaacagatttcatgcataaaagctgctaaaacctagcaatataatcttaggaaatttatagaacctatatgaagaaaaaatgtattttttatttttttctgtctctgatgcttgaatcaagatgaaaaaccattaactctattgaggaacatgaatagatggagagaaatatcctgtttttggataggaagacaatagtgaaaagacattaaagtgtaatacaatcccaataaaaataccaagaaaactttggactaggcatagtgatttcaaagtacatacaaaacatgaaaataaacatgtgagaatagctaggataattatgaaaaagtgataaataaggattaactttacaatatatattctaagctcctgtaattaaaggtgcaggaataggaagacaggtcaaagcaacagttttttcattctagaaatagactcaaacactaacatatataattaaagggccatattaaaatagaagaaaaatatgttaaaattgactatacagtaaaaagtaaaggtaattccctctcccattataccaaaattaattccagaaagcccatatatttgaaattatatgagtgaaactctaaaagtattagaagtaaacatggtcatggggaggtagggggatgggagatcttggcatataaaatacctgagatgcaaactctagaaactctagtggaaaatattaataaatgtcactaaataaatttaaaaattctacacagaacaaatatataaaaggggaaattctgggaaatattttgcaatacatgacagataaaagtttgataatttattatgaatcagtacaagatcattcaatacaaaagagtatgaacaagcaatttactaaaggagaaatataaatggattataaacataggaaacaatcatcagttacatttatgagtaaatgcagattaaaatgagtggcaaatagtaaattttgatatttaacagtgttggtaagttaacaaataacatagaagcaaatccattgctagaaatttgtcctactgataagtggttttcaacctgaagcaatttttcccctaaagggacatttggcaatgtctggagacatttatgaggatcacaactgggacatgtgttactggaatctagtgggtagaagccagggatgctgccaaacattctgcaatgtacagtacaacccccaacaataaagaattatctgaccaaaaatgtaaattgtgccaatggtgagaaatcctgctacagatatacttgtgtatgcagacgcatgttcaagggtactcattgccactctgtttgtaaaagcaaaggactagaagcaacctaaatatctatcaatatgggtctagttaagtaaaatatgacacattcacaaagggctgttgtatagtttattttaaaaaataaagtagatagatgctgagaagaatatgtttacaagagacacaaagaaaaaaattaggattcagaccagtgtatgcaatatgtctccatttatgaaatacaaagaaaaacatgaatatatgcatgtatgcatatacgtgtgatgatctgcaagtacacacaacaaatagagaatggtcatctctgggtaatgaactttttgagtgggagactcactttttattgtgttcttttttgtattatttgaaattctactttatgaaaatattattttcacattctttaagaaacccaggctgatattttaactccaacttacctttgcaaggcttctctctattttatctctaaatagaagacacactccatgtaaagttggccaagacattatttttcctttgtgccctctgcctacaaaggcattctgccaattcccatttttgccttttaaaatcctttaagtggttgtaggtgtctggcattttatctagatttttaaacctgtttcattctctatatgtttgtttttgtaccagtaacatgctgttttggttacaaaacaaactaaccttgtagtatagtttgaagttggatagtgtaattcctctggctttgttctttttgcttaggattgctttggctatttggacctttttttgtttccatatgaattttagaatagtttttttttctgtgaaaatgtcattggtagtttcataggaatagcattgaatctataaattgctttgggcaatgtgaccattttaacaatgttgattcttcttatccatcagcatggaatgcttttccatttgtttgtgtcatctctgatttcttccagcagtgttttgtacctttctgtgtagagatctttcaccttcctggttagctgtattccaaggtattgtgtgtgtgtgtgtgtgtgtgtgtgtgtgtgtgtttgtgtgtgtgtgttattgtgtgaatgggattgttcttttttttctttccaacttttaggttcaaggggtacatgtgcagttttattatatgggtaaattctgtgttgtgggggttcagtgtacagataattttgtgacccaggtaatcagcataatatttgataggtagtttttcaatcctcactctcctcctacccttcaccctcaagtaggccctggtgtctattgcctgcttctttgtgtctgtgtgtactgaatgtttaggtttgtgttcttgatttggctctcagtttagacattgttggtatatagaaatgctaccaattttttttacattgattttgtatcctgaaactttgctgaagttatcggatctaggagtctttggccagagactatggggttttctagttataaaatcatatcatctctgaagaaagtttgatttcctctcttcttgtttggatgccttttatttcttcctcttgcctgatttatctggttaggacttctagtaatatattgaatggaaatggtgagagtgggcatctttttcttcttctgattctcaaggggaatgcttccagcttttgcccactcagtaggatgttggctgtggatttgtcatagattgctcttattattttgagttatgttccttcaatgcctaatttattgagaatttttaacatgaaaggatgttggcttttattgaaagccttttctgcatctattgaaataatcatgtagtttatgtgatgaatcatatttattggtttgtgtgtgttgaaccaaccttccaaatacagcatgttctcacttaaaaggcagagctaaacattgtttacttttacaatggatgcaaagaagggaacaatagacactggggcctacttgagggtggagggtgggaggatggtaaagataaaaaaactacctatcatcagatagtatgcttattacctgggtgacaaaataacctgtatgccaaacccctgtgacatgcaatttatacatgtaagaagcctgcacatgtaccccatgaacctaaaaggtagaaagaaaaaactgatcacgtgattcctgttcattaataccccttataatcttctgtttttctttggcatatgtgatcagtatacacattttaatgtgtataaaaaataaaatccttcaaggtaagtcccatctcaaagaccactttctataccaagtcttccctcatcctctcaaccacttggaagtacacatttatagacacataacactttgtatttttaaggcacccataccctgtgctacagtgatttatgagcatttttactttcttctttcctccatatcaaaaactcaccttacattttgagtttttttaagggaaaaatcatatcttattcatctttgaactagttttatagtatgtagcaaagtgcctgaggcataatcattggtcaataaatatttgtcaggttgaaatgaataaaagtttataatatacaggcaaatataaatgggtaaatacaaaacagaaaacaaacagaaaaaaaataacaacagaattagttcagtttgttggtaacctaaactctcttgttctttagtgcttttaaacctatacatttaactattgttaaaaatgtattgttaaacatatattgcgttttctggaacaggaaaccaactgtgtatactgtaatatacctatgtgatgtttttgtatttcttttaacacaaacttttcaattcttgtatagcaattccactgaaattgtaattgctacttttaagtgtcagtcatttttcatatgtctcactgaggaaagtgctatttgtttttattttacatgtgatgcatcaattgtacaagcacatgagacacttattttatcatctctaccctccatgtttcttgactgttacattttactactgaaatccagcatttcagatattcatgaggctgaaacatgtccataatcatcacattccccatttctttgggaacaacatatacatagtcgagaaactcactgtatcttaaggcatgctttgtcatctactaactttctactcattgggatggagttgcactgagagataaggttgcatttaagcaactgcacacacaaggaagaacagtaaccactgttgaatgagtggtcaatgtcataacactgcttcacagggaggtaaaaaacatggcccatttttattagaagctagaattgtgtccggaatagaaaatgctatatatatatatataaaatatttgctctctctatatatagaatattagatatatataatattagatacataatataatattagatacataatatataatagatacataatattatataatattagatacataatattatataatattatattagatacataatattatataatattatattagatacataatattatataatattatattatagacatattatatattatattatagacataatatataatatattatatgcataatatataatattatattatatgcataatatattatacatataatattatgtacataatatatacataatattatatacataatattaacataatattatatacataatattgtatacataatatttcatatatatatataaatatttgatactgtggaatacttttccccagttagtgaggttactttctattgataatactctggctatacagccattttacttgtttctaaatttaaaatcaaatcactttagcaagtatagatgtagaattttaggaacctctggcctttttacaggtattttccttggcaagggctccattgagttggcaatctagtaacctgcattgtgagggcacattataaaagttacaccaacatctaggactaacttttggcttctcagatggaagataaggatataataaccaggtgttgctgttattacctttagtatttgaagcagttgtaatgtttattttatttcaactttgggtaaatttaaggaagcagaggaaatataattagtctataatttaaaaacataaagccaatgtaagaaaatctgccatagttaattatagtgtccagattaagaactttcagcctcttccagaataatgtatgagcgcagagttaatcacatgtgggattttcaaaacatttaattgagaaaaaaatacaaaaaagtacttttgagaaaatatgacccacagcaatcccattatctccactgttaaacctccccactagctgctttttttctcatctgtccttatctgttatcttgctagatgccatgtgaggaggccactaaagtagaaagaaacctgttctttgccttcaaggtagctctggaggcagtaattaatatggaaataagcgctccattgtgtgattcagacaaatatgatgggagcatatagtttcaaatgaactgtggtcatcagagcaggtcatatggagtacatgggccttaaaggatggattacaccattactgtttcaaatgtaatagtgtagaattatgctaatcatgggttagggattccattttacattaaggtcaaataaattttctcaggttacagaagataattcaacctaaaaatatgtttcaaaagagtacctgaatacagatacattttaaggtgtttttattgttttgttattggaaaacagcagagagtagggatgaacgtgatctcttgctattttttacttgttaaggactaaataagaagaaaatgactaaaactgactgcaaaaaataagaataaaaataatagaaaagttacaactggtatttaagagaacatggatgaaaacttatcatattaattaaagcatggtattaaaaagcaaattcacttagctgttcttcctttatgtttataaaagattggattaaatgaccttccagcttcaaaatctgtaaatttattaaagcatagtgcttgtttatctcattttgttttatttttctttatttttttttttgagatggagtctcactgtgttgcccaggctggagtgcagtggtgtgatctcagctcactgcaacctctgcctcccgggttcaagcgattcttgtgcctcagcctcccaagtagctgggattacaggtgtgtgccaccatgcccagctaatttttgcatttttagtagacatagggtttcaccatgttggccaggctggtctcgaactcctgggtcacttgtgatctgcccgcctcagcctcccaaagtgctgggattgcaggcatgagccaccacgcctggcctgtttatctcattttaaataaatatgagtgttttcagagagtgatgatcaaatagcagaatctctcctatcaaattttttaattgacaaaaataaatattaaaaggaccccattaatgctgcatagctaaattgagtaagtacacatctggttatagaggttatacatgctggggatgagtagatggttattccaacctgttactgttctcacagatgtcagtttgtaattactacctcttgtcagaaagatgctacccacatggatttcccagaatttagtgaagagagtcagaatggagaaagtgaaggagctttgggcttggtgataaaaagacaagtaatatataacatttttccccttaaaaaacgtttctcagaataagtgaagcatttaatgaatgcctttggagctatcaaatatttgtcttttcctgagatccagacgcattacatttacaaactaccgagttatgtgtacctgtatttcattgttggcattttttgatagaaacttgtggtatgcaaaaggaaatgaaaagcttatagtagacccccaacactagtcttacaaattcaagccaatacatcaatttcatattattcagtgtcacccatttgcctttgacatctttgctcacaatattttcttgccttgctatttgtccttcagagttctgctcaaattctacctcttctctaaaagttttcctgtttatctcatattccttttccatttctctgaatgtctctgtagcactgaggcctcaattatatgtgatcttacattgttctctaaattcttactctgatttgcttcactatcctgactgctcctccaggaatgggcatttctctagcttcagttcctctctttatacaatgagggtgacaatataaccatgttaaaggcttctttggaggattaaatgagataaaccatgttaatcgtggatagcacagagtctggcacacattaagtatccaataaactttagctattgttattatgtgctctaaaggcttagtaattgatagcttgattaagttttctttcaagtctgaattttaagagaatataattttttgtctgctagaaatagcctcagagtgtgtctacaaaagtagaacaactagttaaacattgaaaatatggttaactagttgctttctctacatgccactaaaaaccaatttggctgaattatctgagtgaaataattgactgtttaggaataatggcatcagaatgtgcataatacataaattttcaccagtaatcactgctaagtaatataagttgaataaagtcatgcccatgaggcatttagatagaattgccacttaactcagtaaaacaaccattttgacaggctttaagataatttttttctgacttcatcaatttattctgtaagttgaataaattgcctgggattttgtgtatagaaacaacttcaatctctttaagtcctgtcctgatttcttttaagtaccaaatacatggaccaatacttactcttcttatactcctgctgtggggaattttccagtttcaacaaaacattaagaaatgacatgaaatgcacatgcagtgtctgcctcacaggcactaatgttaatacaatgcattttgcttgacaaatcagcaccacttgaatagaggccttgttacccatattctcctatatagtgatctctgcattcccattttctcacattttggtggtaaaaaatacattccattttgcagtggacttcactgactatccagacaataagcacaaaattgtctcagcctgtgtgcaaatatcttactcagcagtcagggctactcaggaggatggccttttagcacaggaaatagtgttccaggtttctggaaagatcaagggagagcaaagctttattgagaatgtgactcagtgtgatacaagcttctggcatatacccaaggtaatgtcagtaacttatttatttggaatttataccctgacttttttcagaaggctttgaggtagtttataagttgtgtataatgtaaaaaaaaaaaaaaaaagacaaggaacatttagggcttaaaacaataaaaaccattctgttagtacagctatgttactctcaactacggaactgttccttacttatttaatcagtgaggggttttctcgctttgtgtcctttagcaaagtaggccttaaatgaaaattttcaggcactctttattgttggcaaggtcactggtggtctctgagattttgtgcctcctgcctcccgactgcccaagaaggctgccctcctgcattgtagtttcatcccaaacagggtgcttggggacctagatgcccaccactgagttacacaaatcagcctttagctgctttgtgacagcaaatacaaatgggtatgatgtgcatatgtgcttctcagtgaatcattcatcatctgcatgatgtgtctccccaggcaagaggtatggtagcacagctccctcaagtaaagcatgtctgataaattttgtagactgttagtggaaattttcagtgtttttctttctaaatgcttagtttatcttgcccaccaaaagcatagcacaaacaactttgccaacatctatgaagctctaagaccaagctctgctcttaaaggtttgggaaagtgatttgtattctttagtcttccagagtgaagaattaaagtttccatagttttggctttactggttttcttctgaccactagctatctgctgtggtgcagagacatttcctgtagggatacatgccttagcaatttgttttcatcactgtcacatcaactcagcattttcttgtcatctttcagttctgataaactgcttctgaattgacagctgtcaccaagatgcttacatagcaatttaaggttggtctaattgacaaaggttaaattttctacttgctcactaaacactaagaaattgggggtgattatagttaggagctattgccttgttatgtgtaaatgaattatggaacactgtagtttctatgcatcttaatagaactagatgtaatatcttgtttctaaatggatcaaagattgaattcacaggaactctagaattcattttattattagcattattgataggaaggtgccaatatatagactttgccgtcttttgttagcacatgatacctactctcattccagttaaggcttgaatgcccaagaaggcactatgacaatattactgcttgaaataattttgttttactttttattgtgcttttattgaagtctgtgtttttaaatttaaaaacatgcactccacacatattaaaatgctttttaagatgttttagaaattgtgtgtcaaagaaattcactgattaagtaatgctaccctttcttttcatatgcatatgcaatttttcactgaatatggacatgtacctttctaatctacaaacatacaactatgtgatggtataggaactgctgatactatttgtactcacttaaggtaataaagaggcttatttagggctgatcacaaaatgagttttcataaagtgaattacatttctcattttattactttattatcctttttatatatggatacttcatctcagctatagtaacacagggaacaactggtggacaaagtgtgtgtatatcctcccccagaaaagcctggggtaacctttgagaagtatagtgcataagaaatgtagtgcctaagtatttgctctttcgctcattcctttgtggttaatttcaatgtaggcatactggggtgtacatcttgagcctgggcagcaaacaaggcatagggtttggccattcttattatgctcttggcactgaatactctaatatcattatgcttttccctacaatgagccatctttcttataaggctgtacttctagtcccaaagagagactgaatgagtgtggatggcccaacctaccctcataactgagagaccaactcagattgcatggtttgtacctgctgctagaaataaacgggatgtgaagaagagtaaagaatcatattgttggcaaggataattctcattaaatattttttccagtttgaatcttctttctgtgcatatgtagcatattttgctcccttggactacatcttctcaaaggacagctattattcctattgtttacattcatacagtcctcttactgcccaatatttgaaatattttaagtttacgagggaaaaaatgaacatatgactatattccttcatcaaaaaatggtttcctatttcaatatcctctctgttctctggatttatcaactccaaaattagttttaaccatgtctgtaactataaaagcacaataaaaggtaaaaaaaaattatttcccaaaccatttcagactaattattggaactcattttgtcatgactctatttctcttttattgtcttcatctctttcatttcattgtatgtatgtataacacacatatgcatgtaaaaaatcagattccactgccatacttttctattttcttgtttcttcctcctgcctttaataagctgtaagcattgcttaagttctcctattctgattcatgtttcaggtagctaatgtaccactccttgttttctgtgatgaagttaggaacaatttgactcttgactatcgtttgtgttaccctcagtcacagttgttctgtactagatgttgttgacaaggcaataataagccctattaaatcctacctcttacatcaccaaaatctatgttattggctagacaaattgggccgatgtgtatctcttcactcagaaagttttcatgacttctccatgtataaggactcataagcaaacactatacaaatctggaaaatatatttccttgtgtggtgtaaaagtcacaggaaagtattaaatttggcttgggtaatgggatattcttcctcatttgtatcatgcaaataaaactccgtaacattttacaaatcacatacccaccctctctccccttgggatggggttggaggtgtatgtttttttttaacaatggtagcattctttttgacacaaagcaaggcagttcaaaataacactgaaacaatcctacattcatgcttcttcttcttctttacaaggcatctgacaggaaaagtatcaatgtgctaatctccacagcaaatcatgagataatggacatcttgcaaaagaatataaggtgacttgaggattataaaggtaatcttgtaatgcttttgaaaactcttcgaaagcactaaaacatcaatggcctgagagagaaggaagacctttaaaatatattgcatattattattcaataaggcaaaagcattatttgatgccttctttgggatcagtagcagttgaaagacctgtgttgcaaaattatatttaaaggtcaacagctgttttattccagatggaacctactcctgaagatgtttaaacacttttttatagaaattgtgattactgtagtgatgctagtctatccctatagaatttctaggacctattggagaagaaatactttagtaaggatatttggccttattaaccctagtaaagcttgatgtaaaaaatcataaggtgactaaatgcatgagaattggcttgaaattcagcttactagtaggaggcattaggacataactttcccctgcagatttgaaggaataatgctagacagcattaagtagtgagaatgcttactactcatatacctccttactgtctctccctaagactttgaacatttttagtctttagacacactacttttggccctattcaatgtattactatttatgtacaagatagtaatacattagtacatttaagttattaagtaacccaggcaaaggaagattttatactgtacatgtctgaggctcagtgctcaagggattaggcaagttacatgagtttgtcaaagggaaattcagaggagaagtttacacagtagccagaggaaggttaagagtcttagaatcaggccccaacagaaaattgagataataagcagaatacagacaggggccagaaagcctttcaaagaatggacagaatgtcagaggtctacctgccaactggtaggagattaggagggctgtccagaggggcactgatgccaatgaattgagcctagagtgttcacactgtgttcacattaatggccaaggctgtatctattaggaactcaaaaaatgagtctataagccagaatttcaagggtttcactccctttgttgcatcttttaagccaacatttattgagtacctactttgagccaggtactgagacaggctctagggaattcagaaatttataaaatagggtccctgcctaccaggagcttacactgttgtggggaagacaactaagaaaatctacaattataaaagcatgctgtgataaaattattcagtaagagctaagggagagcaaaggaggaatacctgcattttatgtaggtgtgggttattggtcatatgtgagcaaaaccgaaaataatcttagaaggagatgccactgaagttgaattgttaaaaataaggagatttggacaggtggatgaggaagcaatggaaggcattcaaattagcaggaaaaacatgtactaaggcattgagggaggcaagtgtggcttcttgaaagagccatacataggccagttttgctaaaaatgagagtggaagggaagagattacagaagacaatgctagaaatttaaacaaggaccagatcatgaatggcctttgtagaacatagtagagaaactggatgttaccttggaaacagcaggaaactactgaaggatactaagtagagagtgacatgatcagatttgcattttagaaaaaaagcacactggcagctgtgtgataagcaggggagttaaatgagtacaggagaggtacacagaggggtatacctaagtcagttaataactgacaggttaaataagcccttacaccgggtacttgcatttgtggaatacagagtttgaactccttatctcttcagaattttttagaagagttcaagacattaccaggatgtgatggttgaaggacagtgatttcagacatagccatagattattgctgcataatgtagttggagggctaccaagatgcaggggcagtatttctaccataatgagaatgacatcaaggaagacatcggcctcccacctggccgttatggctctgtcagaggtggaatcctgacttttctcatcaccagcaatgttattagggaaaagcaagaatttgacgtttctctttgggccctatctactgaatatgagtgtttgagatttaacttttttcattcagagaatgaaaaaggccacaaaatccaaacaacctttcaattttcatttataattggtttacaattataccaacatcagggcctctcctagctcaagcagtattgttctatgatttagcttgagcaagaatagggaaaacttaattttagatttgcagtttctcttgagttagagtccacagctacattagtacccacagtttcctttggaagtgaaatgaaaactcaccattacctgttttgaattgtggtctggcagctgagcaccttgacattgtaaatcgagcagagtcacttgaaaggaaataaaagttacactgattttgcacattcatttttttttattgcctaatgctagttgaccaaaatgtattcagccgagagagttgggaaattgattttattgaaattgataagtaaaacatatataaattagtaattacaaaaccataaaatgtttcttataggttaggcatctttatgcatgagtctgatattaattgtctctaatgatggtgccgaattgatccttccattaatattttgcaagttcagctgttatttttggcaccctctgtgaatgtcaacaatttgcttgcaaagaaatgatagcatattaagcttatgtatacaagccaatattatttaacaaggaagtacaatgttgctgaagacaaagctagtttgaagagtaaaggcaaacagctaatcaatctttggttgtgcactattatttaagagggaaaatttaacttaaattttgtttactattaagctcagagtttggttttaaactgtgatttaattgcataacttctagtatgtggttgcctttcatcttgatgttatattcattgaagctttcaaagaagtgcagataggacttatttccatccccaagtcaacatttattgaatttttatgtagtgccaggcaccatactaactgctttcatagagaatatcttattgaatcctcactacacaactctatgagacaagtataatttacatataagtaatctaaactctaggatcatgaaataatatgtccaagatttcacagctattaagtaataaagccaagatgtgaacttcggctgtctgagtctagagaactcactcttaaccactatgctatactgtattacagtttatttttagccaaagctgaaattatcagctaagaagatgattactaccattatgaacaggtattctgggttcagagccaaatttttatgtatattaaaattcttaatccctcctaccctataatccaacttccacttctacataattaccaaagagaaatgaaaacatatgtctacagaaagacttgctaatgaatgttcattgctactttatttataatagccccaaattggaaacaatccagatttctatcaacaggttaatggattgtattcgtacaatagaatagcactcaacaattaaaataggtgagctgctgagatacacacaacatggatgaatttcacagacttaatgatgagggaaagaagccaggcatagccaagtacatactgtacgaatctatttatgtaaagttctagaacaggaaaaactaaactgtggtgaaaaaaatcagaacagtaattacttctggagaggaattgattaaaaagggtacagagtaactttctggggtgatggaaatatttaacttgattgtgatgtgagacacacaggtttatgcatctgtaaaaaacccattgaactatatacttaagatctgtccatttcattctttataaattgtacctcaataaaaatattaaataagcaaacagaataagggcaaagtttaacccttaaaataacttttacatagtccaaatgggtaaagcatatctagttcattatcaggccaggaatccagattcaagggtatctactctgaggaggccagtatgaggctttaaggatgtgcaatgaaattgatagaatgtgcctagccacatggttctaagagttttcacccaaaagacatgagaacaagatatcagggcctaggctgatccccaagaaaattactgtgagctccttgtgggaagacgcagagtttttcatctctgtaataccagtgcttgatacactaggagacttgcaagagtaaagtgagcagcaggacccagtcagctggctgtgatgatagatgtacaagacctgggtatttcagactctcaagtagaagagagccatggaagcaggctgggggctccaaatacgctactgccaattttgctaagacctattcaggtctttgctcaaatgacacctcctcagagaggccttccctgactacttcatctaaaataatcatccttacccccaccatcacactctgtcctcttaccatgctttattcttcttcatagcccttataatatgctacacagttatttgcttacctactctttgtttctagttactctttgtttctaggtacttttattctttgttatctatttactctttggtgtttaatataagcaccctaagagctgggactttatctgtttttctcactattgtatcttcaatacttaaaaaagtgcctggcacatagcagctgtttaataagtggctattaaaagtaacatattagtaagacttgctggctgaaattaaatagtccaggtctatccaagtgagagcagaatctatctcttacatggcataaaagtgtgattacttgtacctagagttatgatattatactcagaaacattggtctgtttcacaaaatgtgcccattgtaactaaaaaaagcaggcaatgatcaagaaaatgcaagtaaaggcctggctatcaggctgaattgagttgcctttagttgtagtttctttccatcacttgggctgtggagttcaaatagtctcaagagcaaagtcacaagctccaatttatctttatgatagaatgtgcagaaagtgctacttttctgtgtgttgacatctgtcagagctagtctcctttcattctaaaagagatcaatccttcatgtgatagaggattatcctctttgccacctataagctggctttgatccctcttatctcttttcctgaaagggtgtcaccattttaccatttctctagcaacctgcagggttccaaacaatgcactattttaatttaaatagagtcatacctactcagccactcacatatatggctattttagtggcttgagccttttcagattttctgaaatgaaatctccaaatatcagattcttaatttaggataataaaagaaggaggttatgctatcagagcaatacatagtgttatgctttttttccccctatcagagtcattccccaaacataataggtttagttttcttcacagtgggaacttgaatttgctcaacaaggaagtatatattgaggttcagccttactagcctcaatgccagtgtgagtcagttcatcttacttcagttcagcaaacatgtaatgaagtcttgctgcatgttattcaatgtgctagataaaaagattaaaaaacagatcaatgaacctttgccctcatgagaatattgtccataagtatgtaccaagcaattggagatatcatgagtaatataaatgagaacatgcagggtaccatgggtacaaacttcaaggagaaaatagtccataggttcaggaaatacttccctgcagaggcaatagttaagctgagacttgtaagataattggaaattagccatggacagactgaaaatggttatatttcccactaattgaccacatctttgattctagcatacatgctagcatacagtcatgccgaagcccattggctctttttcttaagtagataacaaagaactggatgaatagagaatattatgctttgaataagtttattcaatcatttaacaaatggttattaagtgcttactatgtgccagacactgtggtaggccctaagaataagtcagtaaggcagatgaggtgtttgagatcaaagaacttacatctaatggaaggtgaaagacaagaaaatatcaggtaccaataaatattgaaactgaagtagagaaagactgggggtttcctgttaattaggtaggaggtgacatttatgctgagacataaattataagaaggagccagacaagtgagtattcgggaaccaacatcccaggaagatgtagcatcaagggtaaaaacctaaggaagcaaacatttgtcaagctagaaggacaaataggccactatcactggagcatagtggacaagggaagagcgtagatagagatgaggtagacaggagtcagttcatgtgtagttttgtgaacttagggaagtattttggattttatgctaagtgggaagggaatcccttagaacttcactgtccaatatggtagcaactattcacatgtggacattgagcatttaatatgtggctagtcaaaattgacatgtaccaaagatttagtatggaaacaggaatgtaaaatgtctcacaaataattattttatggactacatattgaaatgacaatattttggatatactaggataaacaaaatatattagtattgggttaaccaaaattatctaattttacctgcttctctatactttaaaagtgtgggtattagaaagtttaaagttacattagtggcttatatttgtgttttacattacatttctgttggacaacactgccacagaaggtttcaagcaagtaagtgatatgatattatttctgatcttttgaagatcacaggggctgttgtacagagaaaggattggaagaggcaatactggaagcatgggaattaattaagagactttttcaacagttagaaaaagataatgctggcttgagctaaacagatagcagtgaagataataggaaaaggtacagcttatgatgtttatggtaggtagagttgattttatttccttatagtttggctctaagaagatgaggaaaaaagtttccaaagaaataaagctttggatttttagcttgaacaattgtgtatgtggtggtaccatttagtaagatgaaaaagagaggagagacagtttctgattgagggtagaaatcaagagttctgttttggagatattgagtttgagatacttgctagatatccaagttgatgagtcaagtaagaaattgaacataagactctgaaatttgggaagaggtcggagctgaagatataaatttaggattcctaagcatgtagctataaacaccatctgtgggaaaagaccatcacccagtgacagtctgtagagaaaagaagagggccaaggacagagtcctggggcatgatatcataaagagtttgaataaaaaaggagaatccaacaaaggagatagggaacatctggtgagttacaggttaaaaaggagtggtaacaaagaacacaagtatagaaagtgttactttaagaaggaagtggtcaactaacttatatggtgttgagaaatcaagtaaagtgaggacagagaatttctatttggaaacatagaggtcattggtgaccttggtgaagtatgggtggcagaaggcccattggagtgaaatgagggggaggatgtgagtgaggaagtggagacagtgaatgtgacaactttttcaagatttgccttgaaggaaagtagagaaatggggcagtagcaggagaagaatatggtaacaagggggaattttcctgtgtgtttgttttattaaaatagaacgtacaccagtctcagtggctcatgcctgtaatcttcacactttgtgaggctgaggtgggagggtcgcttgtgcccaggacttcgagaccatcctgggaaacatagtgaaacaccgtatttacaaaaaataaaaaatcaaccaggcatagtagcacacacctatagtcccagctgctcaggaggcaggagaattgcttgagcccaggaggtagaggctgcggtgagctatgattgcaccactgcactccagtctgggtgacagagtgagacccccatctcttaaaaagggttggagaaaatactagagtattttattattttatttatttttgagagagggtcttgccctcttatccaggctggagtgcagtggtgcaatcatagctcattataacctggactcctggactcaagggattttccctcttcaacctcccaagtagctgggactataggcatgtgccaccatgcctggctaacatttgtgttttgtagagacagtgggtctcactatgtgacccaggctggccccaaacctttggcttcaagtgatccttctacctcagcctcccaaagcactgggattacaggcatgaggcactgtgcccagcttagagtattttaaatgctgacagaatgatcccataggaggaggactgattacccaagagagaagggataattgcaggagtgccatcttgagaaatctagatgcagctctttaattggaacagggacacaccatccattgtaacaatagaaggcagagagtgtgccaagatactatgtgtacgtggagtgggagagtgtggggtaggagtgggaggacaggatagggagatgagctcttgcagctgacttgaagacagtggagaaggtgtgaaatattttttaaaagtgcagaagtaaacatactagggaagtgtaggaacatctctaggcaatgttgtgtgccatttgagagttgtagccatgcatttaaagcgaggccaatctgcacagttgtatggtctccaaaaactttctggaacttgaaggaggaactaaaagaagcggcttctaataaattctatagctaaggtcatcgaaggttacttattttttactttatttaggttgcctgatattcacttagtctggcctgctaaacatggacttttccagtatgcgtgggtgttacaacagaaacctttatgtttgcttacaggctcctcctttttctacacagtggtatgcatactgtgactacatgaaaaccagacatccaagtggagacggaaaaatttccccaaacttcctttagttctagtacacattctgacttgtgtatgtgataatacccaatgacattttcccctatgtacaaggcaaacctttaattttattcctggtgtttccaatttcttacttagtactttccatttaatctttcacttcaacattattacccctctcactcataacatttctttttttttttctgcataagacttttctaatttgtctgctgtttctaattcttttaagtatctttgttcctctatagctcctctgtccttcctcaacttctttttcctctttcatttccttctcaaagcctttatagattcaatccctagcaaatcatatatgggtatattttcattgtgctattcctttcatatggaatatattctctcaacaaggtacttactagtatttcttaaaactttctttttgcaaattattttcttgagctagcctaagctccagaggaaggacatctgttactactatggaattgtaattagaagtctactttccatttatagctctaaattttaaaaaatcccttgaggttagtgacttaacagaaaatagagaattgttattggggatttgggacagtataaagacaagtacaagctggagatctttcatgggtggcactgggagtttggggcctgtttgccctctgctaagatgatatggaccctacctgagattattatggcagtctaaaagtactgattgtgctgtcatccatctccagactcactgttggtaccttattttattcatgttcaaaaatggtattatgattccttcactgaccctggcttttttctaaagaaacactcatgtgctcaataattgcattgactaaagtacaaaataaaataaaatttgaattagtaaaggttttaaaacactttaaaaaggtctaatctctggtactttttaaacattctaaaaattaaaggttacattaaaatggtgcctgttgctgaaaacattacactagtcctgatgtgttatatgaagtccatagaactacaggttggttagaattaaattatagttattaaagacaagaatctattagtattgaattccagatataatgagaattttggcttgctgccttcctgccttcagcctccataaatggggcattttaacccctagcattgtccaacacccaaagatcaatctggttcctaatcagaggaaatattaatagaaaggtccactggagtccttagccttgcagtaagtcatccttcttctattctgcctcttgcttttccttgtgaccaaattcctgctttgtactgaaatttaagcaaatgggttcctatttttcgtttaccaccacttgctttccttatcttgtgcctgacaccctctggaactgccagctaaccttttggtgccaggttaccatagcatttggtcctattgaccccttaagatgtcttacgttgcctaatgttggatcttcttgatgccaactacctatctgattagacttcctaacattgcctctgctatgatttgcacagaatacctgtagtattcagaggagtatatctagtctccaggattctgaatatctcctctctggtctattctacagagagtcattctcttttggccctttgctatagttaatcaatgtaatcatttacaaaggaactgagttcttttgcttcattcagtaaaaaataagcaaatcaagatgaaaaagctggccttcaggaggctcaacctgctttatcattgaggtctgtcttccctgtatttgaagctttttaaataaaccattctaaccagaagagagaagatgaaacagttaaagctcaaatcaaacagactcaagaatatttaaataactgctttctaagggaggaaaccaaagcaaaggcattaggagagtgttgattcttagtagaataaacttcatgggtaaattgggcatcttttaaagtgaagctctgtgactatagttctaaccatgggatcttaatagatggatacaccaagcaatgtgacaaggacatggtaaagggctttcctattacacagtaggtaaactcaggggagaaaaagcagaagcaattcataggctcaggtttgcatatcaaaagaatgaaagatgatgtgaaaagtgagggtacttctgaagtgaacagaaatcaaaatctagttaggttggtaattgggaccaaagtgaaagcaaagggggtaaaaataaaagtgatgagtttctgcagaacgaatttcggaagattgcagcaagagttgtgtgaaattgaatgagtgcaagcaggaaatggcacagaatagaaatgcaaaagcattaaacctccttcaatgggatcctaagagttctgcctgttatccaccaataaaaataataggagataaagagcccttctatatctgaactgctatatacaaaaagcatggtagaacaaagggagagctattcaaggaataaaacatcaagtttacagggagacaggaaaatataacagaacaagtttgagtgtaaaataaagataagcctgacaaagaaggagaatgaaaagaagagctaacatacatatgatgccttgaaagcccatccatttcataattttggtttttgaatgataggtagaaatgaactccacctaaatagcacttttgggatctggattgtgtcctacatattttgaaatttctccttgatttggggaatgaagtcttggaatcctttttgaagtcacgaaagaattgaatgttttaaatcttataaacgatggtccatgaattctctgggaaagaaaatcttcaactttattttcataatggtggcatttatattgtttacatacaataccttccttcctagaatgaggaatgtcagtagccattatcccaacccccctaatatacccccacataccaaagtcattatgtgttaatcctataggaaatgggcaatttttctgaagagattctaaattaaggccttttaaaatagagtattcttaaggagtaaaaatggcttaaagaaaattgatctgtgacgctgtagaagattcacagtttcagtgatctaattctgtaaacaccatcataatattatgtcatgcataatttattattgaaatcctgtgtgagaattctaaggttttttcatgtaccagagagttgctgagattggtaaagaaatgggttaactgtttaagataatggtattactctggatgggaggatgcaatcaatggggtttctaaatattccttttttttcaccattgtggaggtatttatatgtaatagatttgcttttacatcagtgttgaggagggaaaccacccaggatatgcttatattatattccttcccctttagtctctcccaaatatgcaatgcacagctgtttttaaatcaccattcagcatgtcattcaatttttattactctacattattataagtatccagtaaaaataagagtgaaatctgatgtggcttctaaaatcaatgagctatcatagaattgacaaaaattttggttgaaatttagagtacttaattatcacccaaaatacagatgctgaatttcatccttgctccagatgcttcttaaaatatcaaatgtttgagatctttcatttatagatttggttttacaggtgaacacaccaaagtttagcaatttttcacatcatatttatgttatatcctctctctcacgtgcatgtgcatgcctccccctcccgaaaccgagggttatagaaagataattactttttttatcctctgtgtatttttgcataattttcttccccatgttttgatttctctggagcaagtttctattagtgctgtcagtctgtaactgggccacttagtaagagtgggagaaggagacttttttcttctgtattacatcttccatgtgattctgcaactctgttttagtcatctgtccattcacgcttgttactcatgttatttttctcttcgtttctgtcttccccattccccacctccaggccccacacactcagatccatacttgcagaggtcattcctcctctcttccatgagaaataataattgacattaaagtagctaatgtttattgcgtgcttgctatgtgccagacatcattctcagaactttgcaaatattatttcatctaatctatgtaattggcttttctccaattttatttcaaaatttcaagaaggttatagaaatgtaaggcaacaaaaagggaaaaatcagacatgtcactcctgagatttccttttccagggcttgaagaatccttacacataaaagatgtttatagttccagatcatctatccaccaccagaaagggcagcccattcactatggatgtctcgatatcctgttttcaatacacacatctctgcttgtgaggcagttttaatgctccaagtcatcagaaaaggagagtgacttggtttcaaatgatgagtgaccaagataagcagtctgaagagtgggttaaaataaagtaaaatgctttgacaggaagaggtcaaagctggcagttgtgttttgaaatcttattaaaagaggctgacatcactaatatgaaagaaacttctttcttgttttttaaaacttttacgatgcatgaggtagacttctttttcaaaaaaaattcccatcttgagtccttgcaatatacaggaaacatgcagttaatgaaatgagaacaggttgaatttgtgataaaaattggtgtctggctctctgagttcagcaatataatttcatttttattagagtcttacctatctttaacattgaaaattatgctaagaatgaaaattttgaggagtatgtaccttacaaggttaagaaatataattttatttttatcaaattatgctcacattttgtgttaaaaattcactgaacgatgaaaatgttgagagaccctgaatcctattttcacctatttttaataaggatcttgtggtacctcgatactgatgtattactacaatttgccttaaaatggtgttcaccatacccctcttttacatgttaagaagtttcatctgcacaatgtgagatgatgttatctaaattcaattcacacatttggttcaaggttaaaatatccccgtccctcagtgaggtgggggaggaaaactgctttgtttaatgttaatggaaaaatttcacctgtgaaataatcttcaaactgtgaaattaaatcccccacgtatgttctatgctcatgccttcagccttcctccctctacaccgatctaccctgtctctggattcttttaagaaagtatttgaataccatgttgcatagagggcaaatcacaaaatctgggcaagaaggattatttatatgacttttgtgaaacctattccctctaaatattgactctccaactagattgtaagtttaatgaggagaagaacaaagattttaccttcctgtagcctcctacaatgcttcgtatagggtagtgcttaataaatacttaatgatattgatctgaaatagccagtttagttggtcagtaacaacccagaccacttaataacttgattgcctataaacatagatatatctatgcaccatggaccaacaacgtgggcatcacctgggagctcataaatgcagaatctcaggcctcacgccagacttacttaaccacgatgtgcatttgaataagttctccctgtgatttgtatgcacattaatgtctgtgaagcactgctccattgcattaaggattaggcactttaccaccatgaacatttctttctttctcttatatttcttcttgtatgtacctctttccccctcttctgcttatattataggcctactagttccctctacctttttagttcaccatgtatttccaagttttgtgaagactagtcctcacaaaaattctctgaactcttcataaagaatagtcaatatctagtcatttctacttcctcagctagttttgttaaaattatacaaacttaaataacaggggagaatttttagccttctcagccttatgttccctagaaaaatgttacctatagtttcgttcagaaatcatagattacaatattattcttttaaagtaatgagcagagttttggtagggaaataaactctccaaaagtaataatttctgattctcatagctatggaatcttacgttttgtatagataaggggcaaagcaagtaagggaaattcgttctgtgatttcagacacatgggggatttttatctttacctaatgtaggtttttgctgtgttttttctctgtaaaagccatggtgcttcaaaatttaatgagattatatgatgtattatcatcatttgcaaatgcaattatcagctgcgattaatcctgctaattccgagaaagccatattgggtgttatttttcccctcctcgtgggtatttgtgttgctcttactttatgaactttgatcagaactactgcagaaaggagggggaaagcaaatgggatgtatgaaataaggctttttatgactggttttatgtagacatttatgagtgcctaggaggaaacatctcacaaaaattcacttcacctggagagaaaacaatgtaaatattagtatatagatataatatatatattactaacaacttgtagaagaaaaaataatactggatatttcttgttgaattcaaacatatgttttattaatttgaagcaacatcagctccttgtatgtaactttctcaggatattcatttaggcattacatgtcaaggaagatgcgaatgactaatcctagagttctgagctctactgaagaaatcaaatggtaagtctcaggcaattactgtatgcatttgagagtaaatttttatcccaccagattacagatgagttcatcaattattgagcacttaagctcagctggaatcctatgaactactgtttccaagaattaagcaagaacacattttgagattgtgtcactgttgggttgcagttgagacaccttgctattaccatcatctctaccaccacataggtaggataactgcactccttgttagatcctttaaggcttgagatgagtgggttagaattaggacctacaattattaaatttcaatctaccagtggttttaactcttccttggtcaattgtgagaacaatcattgcaattatagtcccctctcaaggggctggcagctgcctttcttattccccacttgtgatttacttttataactgtgtttaatgcctgccaacaacttatatccccaactcttccattagtgaaagtcttggtaaggtgctgaagcagatataaagataagtgagggggataatgaaactgaaagaaatgaagttacttgtctttgattgcaaaatataatgggagaactatgactaatgagaggtgctcagttatttattgaacaaacagttcttcagacttgggggaaatttaaaagaataattcttcatcagaaacagctttggaatgctcatatatatagtcctacattcttattttgtagatgtggaaactatgtcccaaaccatgtgatttgtccagaactaaactaaacctgggtcatctgatacaagccagtgctgtttttccagcataatatctcaataaaattccataggccagctgtatctacaactatttggctcaatatcgaagtataacttctttgggctgaagaaggaaactccatcctaatttaaatcctagtgatataaataggatttaggatttaaattgggtggcaacagagcctgacaatccttaaggcttcttccaatgctaagattctagacataaaatccaccagtgtcaaaggtaaaaatgattcatgctaagcacagtgccatacacactagagctctgcgcctaccttttaaggaagatggaacattcaattactacataatcatgtttttcttgaaatgtactttttaataagggcaattctgtaagagtcactgtgggaaagtgaactgataatgtagatatactacaaagatctagtggtgagatcagaaatgatccagaaacctggagcaagtgagaagagaaatgccaagaagagaaaagtctatagtaagaaactacaaaggcaaagtagaaaaattcagaatcgttttagcactataaacactatacattgacgtggaattggttacttactattgagaagagaattgccaagggcaatactatctgtcttagtctgttttcagctgctacaaccgtatactacagattgagtaacttataaagaaaacaagtttattttggctcacagttatggaggctgggaaatccaagagcataatgttggcatctagtgaggatcatcctatagcagaaggtggaagggtgagagggtgaaagaacataatacagaggaaaagggagccaaacttctgtgctaactacactcactcccacaataatggtattaattcatgcatgaggatgatgaagatggagccttcatggcccagtcacctcccacatcttaacattgccatgatggcaacccagctttaacatgagtttttaagtgaacattcaaactataacacaactctttcaaagtgacgagtatactttctaatcaaaaagagaatttttttttcagtttcatataccataggctatttttcaatgtatatgtcattatacaaaaacaagaaatggggaaaggatttcctatttaataaatggtgctgggaaaactggctagccatatgtagaaagctgaaactggatcccttccttacaccttatacaaaaattaattcaagatggattaaagacttacatgttagacctaaaaccataaaaaccctagaggaaaacctaggcaataccattcaggatataggcatgggcaaggacttcatgtctaaaacaccaaaagtaatggcaacaaaagccaaaatagacaaatgggatctatttaaactaaagagcttctgcacagcaaagaaactaccatcagagtgaacaggcagcctacagaatgggagaaaatgtttgcaatctacccatctgacaaagggctaatatccagaatctacaaagaactcaaacaaatttacaagaaaaaaaccaaccccatcaaaaagtgggtgaaggatattagcagacacttctcaaaagaagacatttatgcagccaacaaacacatgaaaaactgctcatcatcactggtcatcagagaaatgcaaatcaaaaccacaatgagataccatctcacaccagttagaatggcgagtattaaaaagtcaggaaacaacaggtgctggagaggatgtggagaaataggaatgcttttacactgttggtgggagtgtaaattagttcaaccattgtggaagacagtgtgacgattcctcaatgatctagaactagaaataccatttgacccagcaatcccgttactgggtatgtacccaaaggattataaatcattctgctataaagacacatgcacacatatgtttattgcagcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttgtcactcataggtgggaattgaacaatgagaacacatggacacaggaaggggaacatcacacaccagggcctgttttggggtggggggaggggggcgagatagcattaggagatatacctaatgctaaatgacgagttaatgggtgcagcacaccaacatggcacatgtatacatatgtaactaacctgcacattgtgcacatgtaccctaaaacttaaagtataataataataaaatttaaaaaaaagaaaatagtgtttttatctctttgtaatactgttttgttaggtgtaactttctaacactgtgtgtttaatggagtattttcctctcagtatgtgtgacttcttatgattctttgcagaaatctctacctactaccttaaagaagcttagctttgagatccacaaactctctggaaaataatctgtacataactttttaattaatttttttatttttaaaatttactgtataatatttaatcatttatcttgtgtctgtaagggttttgtattatcttgtgaaatgatttttgtcatcttttatgtagagttttgtttttgtttttagtcaaaccattttaaaagcaggtagggctcaagagtaaataaacaattgcatatttgaattgctcccctgaaagttagggtatattctattaacccagaaatgccaatctgacatagtgcaaatagaagtttttcccaaaatagtgcttggcaccttggtaatgtgcacatttcctcctattttattacctactgtggtgcaagggtttcactctcattttgggatggactctgaatgtttcatttgcatgccttttatggtggtaacagacgataatttttttacagatacagttttgctttttatcatcatttgtttctcttctacaagacttttaagttggctagttacagactatctgcttcttttaatgtttatatattagaaggtttaatagaagaaatagaatgtcactgtcgtaattggccatttcccccaccttaatagcattccagagcaaagtttctttagatagcaatgctaagcaaaatgcatttgtgcagcttcatctttgattcacccattcttataccatcatgaatgtttttgaaggtctttgccaaataatcttgccaaaggctctaggcctgctgcttggtatttgctgcacggactgggcctgaggaaaggtgagctaaaaagaaattagctgaaataatgagataattctagaacactagaaaatttagaattaacaaagttttatggtgttggataagtcccagcttcaaagcaatttctgaccatagcatttaaattatttcttaaaaaaatctcaatttatttacagctccatagtagagactataggaagtagagagactctgaggataagttattctcctgctgatgtgggccattgccacaggatgggtggagaggggacaatattgaaaacttaagagtaagctcttgaatgaaagttaggggtaaaatttacttggaacttatggcctttggttaagagagtggacttgactccaaatcctggctctgtcctttactagttgtgtgactttgggcaatttacttaacttctataagcctgcttcctcatatgtaaaggtggtaccaacaattcaattatataaatatattatcaaacagtgaaatacctgctatgtattaaatgttaataaatggaaaatggcattaatatttaattctcaatatttattatgattcccccaggtttctcctttcattaaaatatctctgaaaaatgtttcagcttttcttcttgctttttagttgcttctttaaaaacaaaatttattgaggcataacttatataccataaaaaccacccattttattgtatagttaaatgatttttagtaaatttgccaagtttttcaaccataaccataaaccagttagagcattttaatcacagctagtccttggcatccactgtccactttctggccctatggatttgcatattctggtcaattcatgtaagttgaatcaaataatatttggcttatttcacttatcaagatgttagaaaggttcatcaatgtgtagcatgaatcagtacttcgttcctttttatagttgaataatattccattttgtggatataccatattttgtttatccatttattagttgatgggcatgtgggtttgtttccattttttggctaatgatgctgctatgaacatttgtgtgctagtccttgtgtggatatacatgttcttatctcttgggtatatatctaggagtggaattgtgatggtattaatattaatagtagtatttactactatttcataattcacctgacaattagacagttacatagattcctatggcaaaacaaagtaagtaacttcagatgccccttaaaggagcattcctcaaaacaacataaatcagttagctcttaaaaaaattaaaagattcctatgggaaccatctttaatcacaggatagatcatttaaagactttttgcacatcacttttgggagaattcaaaagataatgttttggttttcaaacacctcaagttttgtcttgtctacacttttgtaagatacccatctgaatgtcaataggacatatgatgcctcagaaaggcaaagatttaccagtgattaatacagggtataaataatggtgtctgaatctgtgcatcaaagcaaggaagatagatcttgtgacatccctaccttttttccctgggatgcacaaatcagtccttaatagaagggggagagaggatgaatgctttcatgcctgtcaatggaatgaaatacaattctatggcaaggaaggatacacagtggttcatgcacagcaaagacatcagggctttctaggttttcagataagggaccatattcagatggccctcactttaagcaataattgagttcttgaaaataaatcaatgcagatattgcgggcctattattaatgtgtattttagtagcaactgggtgctagtttgtagaactagtcctcaaagcacaggcaaggctaactttctctttctctctctctctctctctctctctctctctctctctctctctctctcacacacacacacacacacacacacacacagagagagagagagagaataataaaatgcaaaattatcaagttctaatttatgttacaataaaatttcaacaaagggtaagttaggttgcagcactcaggttaattggtcaatgaagtcagattttttccattttcttttattgtagtttctctgctttataatcatttccctacccacatcttttataaaaaggaaatgaggtattctgatttgatctctggtggtaaaactcatttatcagtgtgccaagtgaaaaggatttagtaaggttagatggccgttgagcagggtttctcaaagtgtggccaggtaactttcttcatccaaatatccatttttatcaggctctctaggtaactgtgatgcacactggtttgggaacactgtagtggagtcttgatattcttatatttgctttacttccaactgtttattaaatgtaacaggtgggaagtaaaccaatgggatattgtaagctataattaaagaaaagagaagagagtatatgtgtgagaggtcctatggcttccatcagagtcttggacaactctgttaccccagaaaagattaagaactgttattggaaaccttgagtgagatctctggcttgagttccattccttttgtgcttctagctatgccaacagaaccgcagcatcaaagagttgcatcctcagggtttattatcatgatggaagggagcagatatcctgatactgttccacaagtactagagagggatgtagaggaactgcattgaaagaggtagcgatactctggtaggcaggaagtataaggtcttcatactttctgcctaccagagacagaggtataatgtcaccaggatcctagagtagaaacatcctagattgtagagggcaagagagttttagtccttgcttgctggtatgggtgaggaaactaaagaggcttctggagagcagtgctccagccctttgtcctgacgattctccttctctatgaagaaatcatctaatttttaaatttccttcccttgaaatacctaatttcttgcccttctgcctactgaaaatcctccttattatccaaagcctaggtctagccttatctcctccacaaactttttcacgatgactctttttccacattgatctctttcttctattgtgttttatagcatataatcagtggctcagtacatattgccttacataaaaagtgttacatgtatttgttttatctccacaattggctcataagctactggtaaacagggcataactgccctgactcctttgatatgaatcaacaaatctagcattataagcaccaggcacatagtgcgtattcagtgacttgaactgaagtacctggaatgtggatggcttatgattcttttttatatcatgagtataagtggagagacaagtagaataaatgagaaaggatgatttcttaaggttttttttagcccttgatgttataaaaatatttttccccagggaacatagcttcactttaatttattttttattgttacataatatttgcacatatttatggagtacatgtgatgttttgtggcatgcatagaatgtgtaatgattataattctcttcttaaaactgtatatgttccaagctaaggttctctttctttcttttccttttctatatttaagttctgagatacatgtgcagaacgttgaggtttgttacataggtatacatgtgccatggtggtatgctgcacccatcgacccgtcatctacagtaggtatttctcctaatgctatccctcccctagccccacaaccccccgacaggccctggtgtatgatgttcccctctctgtgtccatgtgttctcattgttcaactcccacttatgagtgagaacatgcagtgtttggttttctgttcttgtgttagtttgctgagaatgatgttttccagcttcatccatatgcctgcaaagggcatgaactaatccttttttatggctgcatagtattccatggtgtatatgtgccacattttctttatccagtctatcattgatgggcatttgggttggttccaagtctttgctactgtgaacagtgccacaataaacatatgggtgcgtgtgtctttatagtagaatgatttataataccttgggcacatgcccagtactgcgattgctgggtcaaatggtatttctggttctagatccttgaggaattgccacactctcttccacaatggttgaactaatttacactcccaccagtagtgtaaaagccttcctatttctccacatcctctctagcatctgttgtttcctgactttttaatgattgccattctaattggcatgagatagtatctcattgtggttttgatttgcatttccctaatgaccagtgataatgagctttttttaatatgtttcttggttacataaatgtcatcttttgagaagtgtctgttcatatcttttgcctactttttgatggggttttttttttcttgtaaatttgtttaagttatttgtgggttctagatattagccctttgtcagatggatagattgcaaaaattttctcccattctgtaggttgcctgttcaatctgatgatagtatcttttgctgtgcaggagctctttagtttaattagatcccgtttgtgaattttggcttttgttgccatactgctttcggtgttttagtcatgaagtctttgcctatgcctgtgtcctgaatggtattgcctaggttttcttctagggtttttatggttttaggtcttacatttaagtcttcaatccatcttgagttaatttttgtataaggcgtaaagaagagaactagtttcagctttgtgcctatggctagccagttttcccaacaccatttattaaataaggaatcctttccccattgcttatttttgtcaggtttgtcaaagatcagatggttgtagatgtgtggtattatttctgagggctctgttctgttccatttgtctgtatatctgttttggtaccagtactatgctattttggttactatagccttgtagtattgtttgaagtcaggtagcatgatacctccagctttgttctttttgcttaggattgtcttggctatgcgggctctttttgattccatatgaaatttaaagcagttttttccaattctgtgaagaaagtcagtgttagcttgatggggatagcattgaatctataaattactttgatcagtatggccattttcatgatattgattcttcctatccatgagcatggaatgtttttccatttgtttgtgtcctctcttatgtccttgagcagtggtttgtaattctccttgaagaggtccttcacatcccttgtaagttggattcctaggtattttattctctttgtagcaattgtgaatgggagttcactcatgatctggctctctgtttgtctgttattggtgtataggaatgcttgtgatttttgcacattgatttattatcctgagagtttgctgaagttgctcatcaggttaaggagattttgggctgagacaatggggttttctaaatatgcaatcatgttatctggaaacagagacaatttgacttcctcttttcctgattgaataccctttatttctttctcttgcctgattgccctagccagaacatccaatattatgttgaataggagtggtaagagagggcatccttgccttctgccagttttcaaagggaatgcttccagtttttgcccattcagtatgacattgcctgtgggtttgtcatagatagctcttattattttgagatacattccatgaatacctagtatattgagaatttttagcatgaagggctgttgaattttgtcaaatgccttttctgcatctatcgagataatcatatattttttgtctttggttctgtttatgtgatggattatatttattgatttgtgtatgttgaactagccttacatcccagggatgaagccaacttgatcgtggtggataagcttttcgatgtgctgctggatttagtttgccagtattttattgaggatttttgcatcaatgttcatcatggatattgacctgaaattttcttcttttgttgtctctctgccaggttttggtatcaggatgatgctggcctcataaaatgagttagggaggattctctctctttctgttgtttggaatagtttcagaaggaatggtaccagctcctatttgtacctcagatagaatttggctgtgaatctgtccggtcctggacattttttggttggtaggctattagttactgcctcagtttcagaaattgttattcatctattcagggatttgacttcttccttgggagagtgtatgtgtccaggaattttttcatttcttctagattttccagtttatttgcgtagaggtgtttatagtattctctgatggtagtttgtatctctctgggatcagtggtgatatcccctttatcatttgtattgtgtctatttgattcttctttcttttcttctttattagtctgtctagtggtctatctatttgttgatctttaaaaaaaaccagctgctggatccattgatttttggaaagatttttgtgtctatctccttcagttctgctctgatcttagttatttaaggattgtaggacaaatgcttgtctatcacaagaaaacatttttattaactgaaaattaactgtagctttaataaatttgaactcggagattttaaaaaaatacttatgcaagtgagtcagattttgtttttaaggggaaggagtgattgtccctcaaaggaaaattattgaccacttctatcacacttttatgtttctgaattgttctttgagagagaatagcttttaaaaacatcaaaaactctagatcttaacaatctaaggacccaaaacctttcagtgtacaattatagtattattgaaaaatagagaagaatgcaaagaggttgcataattgagtataataaagagtaacataatagagagtggagagggagtaagagctgagtatgagcaaaatagaactagtaggtgagaggccatgggcaagtagaaacatgtctagcaataaaagtaaaaagaagaaaaaaccataaaatagaaaacaaaggtaagaggaagactgtttacggtaggaagtttggaaaaaagtgactaagagcaaaaacattgctgacaccagtgcattgcacatgttccagcaaatagtggactgcaattaacaaagctgattctcacctgttcttaggtaagctactgaatgcaacacaaagggttactaagagaggcctcttgaccaaaagtggttccccccactacgtgtgcctggaattcccacaattagactctttctttgagttaaggcttggcattttcagaagtcatctcttaaagggcaatttaaatagactggaagggttaaaatacatagagctttaatatctgctatgaactcttcatagattggtctttcagaatacttttaaatgtgccagctacccaagaggagcaaagcactgcatgatctgaactgtctagcctcatctcttcctaatccctaccttcttattacactctagccatgaatgaacacatcatggttatttgttatcctgtgactttttatgtgcattccttcgctcagtatgccttcctcctacctttctatcaactgcagctcaaaaagcatctcctctgtgaagcctcacttcagttgccttctcttgtacttccatagcaatttacatatgccttactttgagcagtattgttgatgtattataaatagtggtttcagtatttgtgttcctctctagaccacagtttcatatccataaaccaaactatgcttattccataatcacacgaatcacctagtaaggcagtactgtgtttaacatagtttaacctctctgcacctcagttttgtcatttaaaaaccagggataacaacaacgataacaaatagtattattgagagatttaaataaaataatgcatgcaagtgatattaccttagtccattagatatttcaagcctaaatatatggaaaaatacgaaagaaaggagttaggaaatttgaatactatttggggttcctgcactaactcacttttcattcccagcaaattaccaaggcccttgtttttttctatttccaacacgcactgccaagatattgatctcttacattccctatgtaactattgagtttaaatagaaagagtaacctaaaaggagattggagcctctcagagtgagatagctaagaaataccaggtgttgctatggctgagaaattgccagtcatctttatcacagttgttgccaattcttgagggcttacttataatgtgtccatgcactaggccaagtattttgtttatggttctctatttttagtcaattataaaccaaggttggtttgtcactgggcaggcatgcaatgggagtatttaagtacagaattgagtagcctgggagaatatggctgtattctttagtagcatgttttgctttcttgcagaatatattttttcttttcttcctttgtttacagaaatctgaagaaaaccataccttcaactattgtgtgaagtttatgtcatatctagaagctagttcatggaaaaagctacaaaaattgaaacactagctctataaaaatcagccataagtgccttcttactggaatgagattactaaggtataattagtagtaacacatatattagcaattagaaagtcagtagaattgaggcatgaacaaaagaccatctgttatgagagaaatatccaaccctcataatcagtaggtaatagatactctgttcttgaaacataacagttaaaggataacaaaggaatgtcttattgcttgctaaaaaatactcttgggaattccccaaaaagagctacactgtaatagtagaagttctgatttttaaaaattgagctagaaataaatctggcaacaatttttctctaaccttatcctgatgttcagggactccctcaaaagtaattatagaactcaactgttcatttttaactaaagtgatttctggttatgattaaaataaactttgaatttaaaatctctctaactcatatataaaattcatataaaggatatttggtttgcctcctgaatataggaatcataagagaccctggagatcaggggaaaggtcccagattttggagccaaagaaacctgaaacctgagtattaaagttctgccttacccatctcatgtgcaatgtgtggccctaggaactgattgtgtttttgttgttgttgtttttagatggggtttccctgttactcaggctggagtgcagtggctcaaactattgtgctcaggtgattcttctgcctcagcctcctgagcagctagaactgcaggtgtgtgccactacagccagctatttttaaaattttttgtagagattggtgggggggagggtctcaccatgtttcctaggctagtcttgaactcctggcctcaaaagattctttcatctctgcctccaaaagagctaggattataggcgtgtatcactgggcccgacctaggcagtgtcttaacctcgttaaaacttaatttccttctctgtaaaatggaagtaataatagttcctagctcagagtgttattgtaagttttaaaggaaatagtgcagtcaagcatttagcagcttctgctgctgttgttgtgacagacagaattctggacagggtggaccagggatttacattgaatgacagtctgatgtctttatttcatggagacagattggtctagcatctgtaaagtgaggattcataacattagtacttactacataaggctatgaaaatgcaaattgattatatatgtaaaacctgcatagtgcctggcatgtatgtagtaagggctcaatgaatgttagaaactattgttatgttttggcacagtgtctggcacctaggctctcaatatgtgttagctcttattgctatctctgggaatctagtaattatcaggtgacagagatgccccagcattgtctagtgttttgggaaaccccacacttctcatggacttgaacagtaactcagcaaggtggacagaggactgaaaaaataaatgacacctcttatataatgtatattagataagggagaatgaagactttatgctaaattaggtgactaggcatacgtttaaagatattccatccctgctttagcatatccatttattttcacataatttatcatggttatttgaacagtgtcagcaggtttctaagacaaagccacactgcaaaatcagttggcatctggtttctcttcagttctaatctgattaccagatctaacttaaggagatagacttgaattatttccagagaatccatgtaaacattccagaaatcccttgagatgtacttaagtgaaagttctggtttgcatccaattgtaatgcaaggtcagggtctccaacacaaatgtcatttcaatcttttagtgattattctttcagtaggagcatggatattagttctagggtgctgtggctctagggccatctgaagggctgtgtgggtcagggaaaattacactgaggaattgtcctacatatttttatctccatgaaatcaggttaaaagaagaacgaaaagagatcagtgagatggagggaaagcccattcttaggtatgctgctcggagtttatgggtggccgtggggcttatatacatataagctcaagaattatagaccgctctgctgtttgcctcactgggtcacttctcagtccatcagcagtgcaattcttcccaaaacaccagccagcactgacaacatctctgccctgagtaattatttagtgtacaggggaattctcaggatatcgattgtttcaggagactcagatatctatgatgttaacccattttcatttgccataactatgcctactctattaagtttacttgttctttaggtgtttttgattatgactaggattggactgcccaaaacaatacgtgggtatttgcctatgataagctaacttgaaccttcttatttcttccctttctttctgccttcctttttaccccatttattcaaatagtaaataatatttgagcatatgcttaccatatgacagaaaggcagaatatagagctggagatacataatggcaatcaatgcatgcatagcccttgcccttagacaatacatttagggtgtgagcattcacatcaaccatataaattgtaggaattggtaagtgtatggaggtaatgcttaatgtatacttctgaaccctctgtatattgttcttatccttcataagatttatgtcagttctcatttcccatgagaaaaattttaaaaatataaagaaaatatagaattagatgcagcatcccatacattatgtatatacatatatacacacattatatatatctatagataaatttattttttaacatacagatttgaaatatttatagactaagtttactgaaactcttgtaaagctaggcagcctagcacttagaaggatgaggggatgtaagaaatgtgactgtttccaaacaattctcttattctcattttgctctcagagaaaataaagaagaatcagattgtataatttctgaagattctgctattttatttttaagtgcctcttttctaaaggattcacagtcacacgtattaaatgacttaaagacacatccttctctcctctgtctcaatgaatagtttggtcaagaaccagaagaagtttaaaacttaacactctaggttactgaggaagtttgaagagtcttttcttggatatcccaggctccttgactttcagctctgtgatttttcatgggtgctaaccacacagatagttggcatgagactgtcttgttaaataggatgtgagagacattgaaagcttcccccaccagcctcctcagaggtagagatgccctcccctattacagtggctcctttggggcctctggaagactgtatttaaatttcaaatatctgctcttagagggctgcgttacactgttctgtctcatggaggaaatggttagtgggcaagcagattttctcttgtggagaatggctcagaaagggtccaaaacctgtgaaatgccttcaggtggatttctacagtttaagatcggaagattctaaggctgctgaatcttggtacttcttgatagcagctgtgaagcagagatgtatatacatgaaaatgaaaaacataaggcactagatgaaagagaaattggtgtagaaaggagatagaatgttagtgacctaatataacccttccctattttataattttgtcggtctgacactgccttcctgtaaagagctaatcacaatataaggattagcattctcaagttatctgctccacttgactgtgagtcctttgaaagtaggaaccccaattttagttgctttgtatcacttgctcctaggtcttgcctgatatataataaatgttcagcaaatgctgggttaaaaaaaaaaggaatgtcatttcaggggtctgaaactttcgaatcttctctcacattctttattttggccaaaggtcttatcagatgtcttccctgatcaccctatctaaaattacaccatcgtgctccagcctcttgttttattttgctatctagcagttataactatctgaagttatactatatgattaattcttattctgtttattatctgtcttctctgatataatctaatactcttaatggcagaaaccttgtgtacgtgtgtactgctgcatctccagtacctagaacagtgtccaacacaaaatagcatctcaaaaaatatttttgaagagtgtgccaagagcttgaggatgttcttccaagtggttttgctgcattaatttttgttatatttggattccaaataatatcagatatgtttggaagataatattaaacatagatgcttagggaaagaaaaatctcttttaattctaggtttaattgctccaaatagtcaataaagtggtaagaagaataaaaaagtagaatagacatttaataagaaagccttttggcaacataagtatattatattttactcttatcggggcaggtggtttttgtaagtacttgtttatttcaaaagggtggtattatttgaattaattcactagttaaaattctcagagcctaaaagtgattttttccatttcaattatctttattttctaaaatattttcaaagacagtggcttcatgctgaggatagaggatgtagttgaagaactgtatgtagctcatgattaactgaaactctgtgaaatgagcctcttcatgtatttggcaattattatacttctttaaaatatgattcaaaagatagaaataatattttacaacataaagatcatttgtcttgttttattgtatgttctgcatctaacagttcacttaacgagaatagtcccttgtgtcaaattcaaattctcatttggcacttttcctatacaaattgctttctgcccatcatacaattttgctttgaagcattctggcaatgggtgatatagggagacttagaaccaaattctgcttttaatatggaactggaaacagtcctttcatcttccaggtgatctttatatcatatgtatacaacactttctttttcaaaagtctaccctctggattcagctatgataactatcgagcacagataattaagaacttaggctcttacaatgtttaaagtagcccaagagagcatagaagttctgttcttagaggttcagaaacaggtgaggactgatggtaacaaaggttgtgaaaattcgacattgctggttttgttgtttagggcaagtggcagtctctgaaatatttactggttgagcagagaatatttgttatacttctccaatcaaaagagaaaagaggaattgttaccaataactgaaagcttttacaactctctaacttccttataaggtatagcttctgggagatgtgttgggcagacttcagtaaaagaagatagcatgtttatgttgacagagatgggtcagttacagatttgtccagggattctcattagttgttatctttctgttaacttctttccaacttctgatgtatgagtacagttgttacagtgtttttcacaattttcttttgttttcttgattaattttttttttttggatagaaatacattttctatgcctacttatagcaagtcaggctttgtctttctgaaccattttctctgtggtgacatttggaaatgaacttacaacgttttccactgtgtattgtagggggattattatagacaaaaactcttttaagatacctttttttgttcctgcttagaactattatcagtttcacaaactctttagtcttcttgtcttaggtaggatcaaggaagaaaagagggaagtttcaaaatactttttctagttctccctgcttattatcacaggagaaagctaaaactttgttacaagtaaatcctttaatataattttatttgaacacttatagcactacttattgggcaaccatgtggttagaaccagcttttttgttttttgtaaaacagaattgaagttgaaacaattacttctgccctctaaataattagactgctatactctcctcaaagtataagctgattagactttatctttgacttcagtgtgtttctggcctgccgctaaatgtcaaattaatcttaaacgcccataggattaatgttgaaaattgttacacattttttattcattcatcaatattgcaatatactccctttttcctctttttgggtatggggctgtaaagtttatttgatttcttaaagcacaaagaacctcattgatctcaacataaaacttattatgttactgcaaaataaacatgaaaataacattgaaaaactgtgttcatatattatttataagaaaaagccatttgtaaatgcctgtcagtgtttcttgtagtgcttccctttttaaggaatccattaaccatgatattgttttatatttgacaaaaactattttatggaagaaaagagtgttgtttaagtaactgcagctgtttctgcagtccaggtgggaagaataaagacatctggtttgtttgaggaaacacattaatgagtctttcagttatgaaagaaaggccctgagcatagggtagaggttgaaataaatgggaactaattgattttcccatgaagataacaacattttgaattttctaccagacagcaaaaaagacaagagttgggaccaggaatctgcggaaaagcattgatgggggaatgggctccagaaacatgatagctggccagcactggaatacaaccatgagaagaactgaagcccgatagtcaatgtctactagttgttacctgctctgtgcagcaatcttcctcagttaggctaacctttagtgaaagcctacaggtttgggtaccctttatgtgaaatgcttgggaccagaagtgttttgaattttggattttttaaaattttggaatatttgcattatatttactggttgaatccctaatctgaaaacctgaattctgaaatgctctaatgagcatttcctttgagcatcatgcaggtgctcaaaagtttcagattttggaagaagtaaaattatactgctttgcagataatataatcttatatttgaaaaaaattaaagactccaccaaaaaactattagaactgataaattcagtaaagctgcaggatacaaaatcaatattttaaaaaatcagtaacatttctatatgccaatattgaacaatctgtaaaacaaaaaagtaattctgtttacaatagccacagataaaattaaatacctaggaattaaccaaagaaatgaaagatctccataatgaaaactgtaaaacactgatgaaagaaattgaagaggacaccaaaaaatggaaagatattccatgttcatggattagaagaatcaatattgttaaaatgtttatactacccaaagcaatatacagattaaatgcaacccctataaaaataccagtgacattcttcacagaaatagaaaaaaaatcctaaaatttatatggaaccacaaaagactaagaatatcccaaagctattctaatggaagaatcacattatctgacttcaaattatataaccaagcaatagtaaccaaaacatcatggtaccggcataaacacagatacatagaataatgaaatagaatagagaacccaaaacaaaatccacatacctacagtgaactcattttcgacaaagatgccaaaagcatacactggggaaaagacagtctcttcaacaaatggtgctgggaagacgatatccatatgcagaagagagaaactaggcccctgtctctcaccatatacaaaaatcaaatcaaaatggaataaagacttaaatctaagaccacaaactatgaaactgatacaagaaaacattggagaaaatctccaggaccttggtcagggcaaaaatttcttgagcaatacctgacaagtaaatgcaaccaaagcaaaaatggacaaataggatcacatcaagttaaaaagcttctgcacactaaaggaaacaatcgtcaaagtgaagagacaacccacagaatgggagaaaataatttaaaactacccatctgagaaggattaataaccacaatataaaaggatttcaaacaactctatagggaaaaaatctaacaatatgagctaataaaaaataggcaaatgatttgaatagacatttcccaaaagaagacatacaaatgagaaacaggcatatgaaaaggtgctcaacatcattgatcatcagagaaatgcaaatcaaaactacaatgagacatcatctcaccccagttagaatggcttatatccaaaatacatgaaataacaaatgctggtgaggatgtggagaaaagggaacccttgtatactgctggtgggaatgtatattagtataaccactatgaagaacagttgggaagttcctcaaaaaactaaaaattgagctaccatatgatccagcaatctcactgctgggcacatacccaaaagaaaggaaatcagtatattgaagagatatctgcacacctgtgtttgttgcagcactgcttacaatagctaagatttggaaacaacttaagtgtccatcagcaggtgaatggataaagaaaatgtggcacatatacacaatagagcactattcagccatcaaaaagaatgagatccagtcatttgcagcaacatggatggaactggaggacattatgttaagtaaaataagccaggcacagaaagacaaatatcacgtgttctcacctatgggatctaaaaatgaaaacaactgaactcatggacatagagagtagaagtacggttaccagagactgggaagggtggtggagagctggctggaagctggggatggttaatgggtacaaaaaatagttagaaagaatgaataagacctactatttgatagcacaacagagtgactatagtcaataataacttaattgtacatataaaaataactacaagactgtaattagatttatttgtaatataaaagattaatgcttgatgggatagatatcctattctccatgatgtgcttatttcatagtacatgcctgtatcaaaacatctcatgtatcccgtaagtatatacacctactatgtacccaatcaaattgaaaattaaatttttttaaaagttttggattttggagcatttcagattttgcatttttgtattaggaacattcaacctgtacatgcaaaagcagtgtgtgagtagcaccatgaggagtcatgcatagtgggttgtattaacatctggagtgagtcagtgtagagaaagaacttatcagtaataatgatgccaagattgctgaagttgatcaaggattgactgggaagctagaattcagaaataaaggtaatgaaaatgaccaagaaatataagggcatatcaaagaaagtgctggattacctgcaattacataagaacaaggacttgagttcttttctttagatattaaaagaaagtataagtccagaacgttagagaagtaggagacattcaatttatatatatgaggggttacgagcataaatacatgctcctggagcatggtgaatttataaatacttatgtatttagattttatatatttttcattcttgtacttggtcagttgtgccgtctttaaataaagctgttcaagatctgtttgcagtacctttgtattttgcttgagtgcaccaatttttatcttagatttatgaagtctaattatcattcaacgtctttgttcaagccctagacacatttttccttgttttctcatatctcaattttcaagttaatgattataatgacatcatgattttatgttaagagtcttttttttttagttgaggtctttttattttattttttattttttatttatttatttttattttattattattatactttaagttttagggtacatgtgcacaatgtgcaggtttgttacatatgtatacatgtgccatgttggtgtgctgcacccattaactcgtcatttagcattaggtatatctccaaatgctatccctcccccctccccccaccccacaacagtccccagagtgtgatgttccccttcttgtgtccatgtgttctcattcttcaattcccacctatgagtgagaacatccagtgtttggttttttgtccttgtgatagtttgctgagaatgatggtttccagtttcatccatgtccctacaaaggacatgaactcatcattttttatggctgcatagtattccatggtgtatatatgccacattttcttaatcctgtctatcattgttggacatttgggttggttccaagtctttgctattgtgaatagtgccgcaataaacatacgtgtgcatgtatctttatagcagcatgatttataatcctttgggtatatacccagtaatgggctggctgtgtcaaatggtatttctagttctagatccctgaggaattgccacactgacttccacaatggttgaactagtttacagccccaccaacagtgtaaaagtgttcctatttctccacatcctctccagaacctgttgtttcctgactttttaatgatcgccattccaactggtgtgagatggtatctcattgtggttttgatttgcatttctctgatggtcagtgatgatgagcattttttcatgtgttttttgggggcataaatgtcttcttttgagaagtgtctgttcatatccttcgcccactttttgatgggtttgtttttttcttgtaaatttgttgttcattgtagattctagatattggccctttgacagatgagtaggttgcgaaaattttctcccatcctgtaagttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtttaaagaagggatccagtttcagctttctatatatggctagccagttatcccagcaccatttattaaatagggaattatttccccatttcttgtttttgtcaggtttgtcaaagatcagatggttgtagatatgcaccattatttctgagggctctgttctgttccattgatctatatctctgttttggtaccagtaccatgcttttttggttactgtagccttgtagtgtagtttgaagtcaggtagagtgatgcctccggctttgttcttttggcataggattgacttggaaatgtgggctcttttttggttccatatgaactttatagttttttccaattctgtgaagaaagtcattggtagcttgatagggatggcattgaatctataaattaccttgggcagtatggcaattttcacgatattgattcttcctacccatgagcgtggaatgttcttccatttgtttgtatcctcttttatttcactgagcagtggtttgtagttctccttgaagaggtccttcacatcccttgtaagttggattcctaggtattttattctctttgaagcaattgtgaaagggagttcactcatgatttggctctctgtttgtctgttattggtgtataagaatgcttgtgatttttgcacattgattttatatactgagactttgctgaatttgcttatcagcttgaggagattttgggctgagacgatggggttttctagatatacaatcatgacatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttactattttgagatatgttccatcaatacctaatttattgagagtttttagcatgaagggttgttgaattttgtcaaaggccttttctgcatctattgagataatcatgtggtttttgtctttggttatctttatatgctggattacatttattgatttgtgtatgttgaaccaaccttgcatcccagggatgaagcccacttgagcatggtgtataagctttttgatgtgctgctggattcggattgccagtattttattgaggatttttgcatcaatgtttatcaatgatattggtctaaaattctcttttttggttgtgtctctgccaggctttggtatcaggatgatgctgacctcataaaatgagtaagggaggattccctctttttcaattgattggaatagtttcagaaggaaactcttctggtagaattgggctttgaatccatctggtcctggactttttttggttggtaagctattgattattgccacaatttcggagcctgttattggtctcttcagagattcaacttcttcctggtttagacttgggagggtgtatgtgtcgaggaatttatccatttcttcgagattttctagtttatttgcgtagaggtgtttgtagtattctctgatggtagtttgtatttctgtgggatcgctggtgatatcccctttatcattttttattgcatctgtttgattcttctctcttttcttctttgttagtcttgctagcggtctatcaattttgttgatcttttcaaaaaaccagcccctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatttccccgtattcattccggagcaggttgttcactttccatgtagttgagcagttttgagtaagtttcttaatcctgagttctagtttaattgcactgtggtctgagagacgttttgttataatttctgttcttttacatttgctgaggagagctttacttccaactatgtgttcaattttggaataggtgtggtgtggtgctgaaaataatgtatattctgttgatttggggtggagagttctgtagatatctattaggttcgcttggtacagagatgagttcagttcctgggtatccttgttaactttctgtctcgttgatctgtctaatgttgacagtggggtgttaaagtctcccattattattgtgtgggagtctaagtctctttgtaggtcactaaggacttgctttatgaatctgggtgctccagtattgggtgcatatatatttaggatagttagttcttcttgttgaattgatccctttaccattatgtaatggccttctttgtctcttttgatctttgttggtttaaagtgttttatcagagactaggattgcaacccctgccttttttgttttccatttgcttggtagatcttcctctatccctttattttgtggctatgtgtgtctctgcacgtgagatgggtttcctgaatacagcatactgatggggcttgactctttatccaatttgccagtctgtgtctcttaattggagcatttagcccatttacctttaaagttaatattattatgtgtgaatttgatcctgtcattatgacgttagctggttattttgttcgttagttgatgcagtttcttcctagccttgatggtctttacattttggcatgtttttgcagtggctggtaccggttgttcctttccatgtttattgcttccttcaggagctcttttagggcaggcctggtggtgacaaaatctctcagcatttgcttctctgtaaagtattttatttttccttcacttatgaagcttagtttggctggatatgaaattctgggttgaaaattcttttctttaagaatgttgaatattggcccccactctcttctggcttgtagagtttctgcagtgcgatcagccgttagtctgattggcttccctttgtgtgtaacccaatctttctctctggctgcccttaacattttttccttcatttcaactttggtgaatctgacaattatatgtcttggagttgctcttctcgaggagtatgtttgtggcgttctctgtatttcctgaatctgaatgttgacctgccttgctagattggggaagttctcctggattatatcctgcagagtgttttccaacttggttccattctccccatcactttcaggtacaccaatcagacatagatttggtcttttcacatagtcccatatttcttggaggctttgttcatttctttttattcttttttctctaaacttcccttctcacttcatttcattcatttcatgttccatcacagataccctttcttccagttgattgcaatggctcctgaggcttctgcattcttcacgtagttctggagccttggctttcagctccatcagttcctttaaggacttctctgcattggttattgtaggtatccattcatctaattttttttcaaagtttttaacttctttgccattggtttgaatttcctcctgtagcttggagtagtttgatcatctgaagccttctcctctcaactcgtcaaagtcattctccatccagctttgttctgttgctggtgaggagctgcgttcctttggaggaggagaggtgctctgctttctagagtttccagattttctgctctgttttttccccatctttgtggttttacctacttttggtctttgatgatggtgatgtacagatgggtttttggtgtggatgtcctttctgtttgttagttttccttcttacagacaggaccctcagctgcaggtctgttggagtttgctagaggtccactccagaccctgtttgcctgggtatcagcagcggtggctgcagaacagcggtggctgtagaacagcggatattggtgaactgcaaatgctgctgcctgattgttcctctggaggttttgtctcagaggagtacccggtcatgtgaggtgtcagtctgcccctactggggggtgcctcccagttaggctactctggggtcagggacccacttgaggaggcagtctgcctgttctcagatctccagctgcatgctgggagaaccactactctcttcaaagctgtcagacagggacatttaagtctgcagaggttactgctgtctttttgtttgtctgtgccctgcccccagtggtggagcctacagaatcaggaaggcctccttgagctgtggtgggctccacccagttcgagcttcccagctgctttgtttacctaatcaagcctgggcaatgcgggcgcccctcccccagcctggctgccaccttgcagtttgatctcagactgctgtgctagcaatcagcgagacactgtgggcatagggaccctccaagccaggtgcaggatataatctcctggtgtgccgtttttttaagcccgttggaaaagtgaagtattagggtgggagtgacccaattttccaggtgccgtctgtcacccctttctttgactaggaaagggaactccctgaccccttgcacttcccgagtgaggcaatgccttatcctgcttcggctcacgcacggtgcactgcacccactgtcctgcacccactttctggcactccctagtgagatgaacctggtacctcagatggaaatgcaaaaatcacctgtctgctgtgtcactcacgctaggagctgtagactggagctgttcctattcggccatcttggctccaccctcttatgttaagtgtcttattaaaaactacattcaccagtgtgttctgtgacacatctaattattcacataaagggaatcactttcaaaaaattggggaaatactgtaagccagagtctacagttcacattaagaaactaatagtctctgagaggtcccacaggggaataaaaaaaattaacatggtttaatgtagctttatttgactatggaactcactttttacctaatacctatttatatcccatggaactaatgttcattaaaacaaataatccaaagtgtttttgcattatctcacttattctcacaaataaaatattaaaaaggatttactggtcaaaggagaaaaaatcacataactccaattacatttaaagcatatttatatttaaagagattacactaaaagcaatgtgtaccttttattccatgagaaattaatttaatctgactgcttgcatcttattctccacttaagtttgctgagcatcttttctttattctccttagtacagtgttaaatatctacagtcatccactgaacaaatattccacagcattgcttttttttgtataagagtcttttatgtttttaatccagtatctcccatagtctacatggttccctctaccaaccatggcctctatggaagatcatgaggtatcagtgtcattcttttggtaatgagacaaaatcaaaagtaactcctcctcccaaatttgaccaatgtctacaagaaagacactttacctgaatttatcccttcttaattctaaatttctggtcacctcattgaccctttcccactcccagcacccaagaacacagacccctgaaacaccctgggagcatagacaatcatggatccaggccatatcctgtcattaagattttagaaatgagaacacagaaagtttaatttatttaatcaagatcatacagctagttaatagcaatgtagaaacagtaatctaaatttttggccacatcttggcttctctggctcatggatcaatctctggtattttagagtttccaaggccaacgactacctcttacaacatacacagacacttacatatatacagaagccaaacatataccacatttggaaaaaggcatcagtgagatatcttacaggaccatttactaaaataaaataaaaattccagaaatatttttcttatgaaaattcaatgacagtttttgtttccacataaggtttttagagaagacttgcttgtctgtcctgcacctgctctaatgtcatggaatgcctgaaagagtctcttggtgtcaataacccacatgttcaagaattccccaaatttcacgaacgttacaaactataatacttttatggcattgaatttaaactctcaacagtgatgcacaaaaattagccatgacagtgcttttggagatattgcagcaaaacatgataataatatacaatacaaagggataaaaaccaaagctcatagatgtctacataatgagatcttctattcagaattactatatatttatcttcaccatattgacttgtctagagaaagtggagaaactctatcttagctgacaagttaactccccatatgcttccaagaaacacggaaatctagaagatgaagtcattcttctgtggatattaacatgcacaattttgcagacataaattttttgagaatctcttagaaaacaaagggagtaggaaaaattagtaagaggatcaaataaaagtgttgtctaagagggctgagtggaaacttggtgggatgatgctcattatcttgatgtcagaattggttgttgaatggaaagataaaggagaaatgatggagaagatggtgatattacctgacagaaggctacaggaaaattgaggagtagtgtgaaagtgatttttttgggaaaactgaacaatatgtattgttgggggaaaatgggcctcaacagagtgaagtattcttgtcacggaaaagatagaaaaagggttgggtagttacagggggacaacaatgccagactggggagtgtggactggatacaagagaatgagggagctcaggatgagcagaagggcggggaagcaatattcattaagcaccttctatgtgccagtcaataggccaggcttcaaattattaccttgctgaaatcttcacagcagccctctaataggtatttatccctgattccatatccatgctctgcttcccctcctattacaatggctgaagaattcaaacccctttcaaaggctagcactgtcatttgtcctctagatcccatcccctccatttttctttttattgaaacattctcaatggtattcaaacatactctgctctctcttctattaaataggcaaatgcaactcatcaagctctttttctcccttgctactgccccatttctctacttcctttcatggcagaacttctcgaaagagtttttcacaatcacttcatttccacacctctaactgacttttgaacacaactagaggaggagtaggaggggacactcattccaaagtgtccaattaagcccaatcctttaaaagtattatgttgtcatgatggctgttaagagcatggtgaaaagatattagaataagatgtggggaatcatgaccgtgagacagagaaagtagtcaaaggttttccaccttttaaaaatgtacttgatcccccactaattgcacaaactctgcccctcagacctagatccacccacagcatcaggcccacacttctggcttcaatccactctattctgtcctctatccactccaataaactgaaacagttcctattagagttcaccaatgaccatcattttgcaaaatccaatggtaacttccctgtcctctttatactcaacctctcagtagcatctgatcctgttaaccatgtcttcttgtaccaccatttctgctggattgctggatatcatactctcttgtttttctcctagtttactgtctagtcattcccactttcctttatgtgttcctctttctctgacttttaaatcttgaactgcaggccactggggcagaggaagcatgcacactagtgcatggtgtttggtatctcatcataccactttggtggaagagcagtggctgtagaatctgtttctttttttaactttgattttagattaaggagtatatgtgcaggtttgctatatagatgaattgcatgtctcggaggttttggggtacagattatttcatcgcctatgtaataagcataataccctatagattattttttgatcctcaccttcttcccagccttcatcctcaagtaagccctggtgtctgctgcagaacctctttctaggtatatgattagtgactgaacctccagtgccctgtctcctggtgctagaggattatttatttatatattgcattaacttctagttacttctttgcacctctgccctctttctgcattttgcatccctacaggactatgccctttggaatttatcctcctgaattcactttttacttaactaaagtagtatattagagaggacagacaggtagtttcaataagggaatatcaatgcctataagctctgttgtcatatcaaggaaaaatgacatatttcagtagaattaggaaatggactttctcttgtttaagggctgtgaggtggtaatttataagggaagattaaaagaacaaagtacatataacttggcttagagggaggtctaaagatctgcaaatatctctaactgcacaaacattagcaagagaaaatattgatttagcttagtacaagctacaaggtgctgtaactaagaataatgaagttaaattttaagaacacagagagaatgccatgaaaatattagaataaaaatagagtgagctatggaatattctgcaaagggaagcttttctaataaagggaaaacagctctgtgagatgaaacaaatcgttgttatgcaagatcagtgacatcctcaactccaagtctgcacaaatgtaagaacactagttttctatcttgtgttacattaattgggatgacagttcctatgcttctcaacatacctataaataggttctgggtcaacttctgcctgtaggtattccttgatcttttaaagacaatgattacccacttaattttttcacttcagagaacatacagaaaaagagaggtccttcacgtcccttgtaaggtggattcctaggtattttattctctttgaagcaattgtgaatgggagttcactcatgatttggatctctatctgttatcggtgtataagaatgcttgtgattttttgtacactgactttgtatcctgagactttgctgaagttgcttatcagcttaaggagattttgggctgagacgatggggttttccagatatacaatcatgtcatctgcaaacagggacaatttgacttccttttttcctaattgagtaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcagtacctaatttcttgagagtttttagcatgaagggttgttgaattttgtcaaaggccttttctgcatctattgagataatcatgtggtttttgtctttggttctgtttatatgctggattatatttatcgatttgcgtatattgaaccagccttgcatcccagggatgaagcccacttgatcatggtggataagctttttgatgtgctgctggattcggattgccagtattttactgaggatttttgcatcaatgttcatgaaggatattggtctaaaattctcttttttagttgtgtctctgccaggctttggtatgaggatgatgctggcctcatataatgagttatggaggattccctctttttctattgattggaatagtttcagaaggaatggtaccagttcctccttgtatctctggtagaatttggctgtgaatccatctggtcctggactccttttggttggtaagctattgattattgccacaatttcagatcctgttattggtctattcagagattcaacttcttcctggtttagtcctgggagagtgtatgtgtcaaggaatttatccatttcttctagattttctagtttatttgcgtagaggtgtttatagtattctctgatggtagtttgtatttctgtgggatcagtggtgatatcccctttatcattttttattgtgtctatttgattcttcttttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccaggtagttgagcagttttgagtgagtttcttaatcctaagttctagtttgattgcactgtggtctgagagatagtttgttataatttctgttcttttacatttgctgaggagagctttacttccaactatgtgttcaattttggaataggtgtggtgtggtgctgaaaataatgtatattctgttgatttggggtggagagttctgtagatgtctattaggtctgtttggtgcagagctgagttcgattcctgggtatccttgttgactttctgtctcattgatctgtctaacgttgacagtggggtgttaaagtctcccattattcatgtgtgggagtctaccaagggacgtgaaggacctcttcaaggagaactacaaaccactgctcaacgaaataaaagaggatacaaacaaatggaagaacattccatgctcatggctaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaagagcatggtactggtaccaaaacagagatgtagatcaatggaacagaagagagccctcagaaataacgccgcatatctacaattatctgatctttgacaaacctgagagaagcaagaaatggggaaaggattccctatttaataaatggtgctgggaaaactggctagccatatgtagaaagctgaaactggatcccttccttacaccttatataaaaatcaattcaagatggattaaagacttacatgttagacctaaaaccataaaaaccctagaagaaaacctaggcaataccattcaggacataggcattggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactcaaacaaatttacaagaaagaaacaaacaaccccatcaacaagtgggcgaaggatatgaacagacacttctcaaaagaagacatttatgcagccaaaagacacatgaaaaaatgctcatcaccactggccatcagagaaatgcaaatcaaaaccacaatgagataccacctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacacacacacgtatgtttattgcggcactattcacaatagcaaagacttggaaccaacccaaatgtccaacaatgatagagtggattaagaaaatgtggcacatatacaccatggaatactatgcagccataaaaaaggatgagttcatgtcctttgtagggacatggatgaaattggaaatcatcattctcagtaaactatcgcaagaacaaaaaaacaaacaccgcatattctcactcataggtgggaattgaacaatgagaacacatggacacaggaaggggaacatcacactctggggactgttgtggggtggggggaggggggagggagagcattgggagatatacctaatgctagatgacgagttagtgggttcagcgcaccaacatgtcacatgtatacatatgtaactaacctgcacattgtgcacatgtaccctaaaacttaaagtataataataatataaaaaaagaaaaagagagtatttgtgtggcacactggatatcacggcagactagccaggggctctggctacatctgaccctgctaaaccactccaaggactgaggggatagatatgttggctcacctggaagcaaatcttggcatactattgttcttcaacacactttttaggaagcactgtgcttttcatttagacttgggaggcagccagtctccaacccccaactcccaatcccttcttctattcctcctgtttcactaccttcttatggctctactgaaataagtcccttccgtctttctctttcctcatccccttctcaaagcagaaaaaaaaaaaaaaaacatgttttgctttgacataataatccaaacaatttctcccaagatccttacaatgtggaaagagagccatagtcagtatatcctgaggaggtaggtaggcatttttctagttctctaggacacatctagcttaccactactgtttacaagtctgagttgaagggaggcaatggtcaattgttacaaacttcataaactgaccaatgaatatttgcctggtccatatttaggttgttcttttcatcatgaaaagttccccagtttactaaccactagcaaaggtttgtctcttaaaagttgctaagtctaaataataacaacaaactaaaattctagaattattgagtctgattttatgagtatcaattacagtattttaattatatattcctgatcatacttaaggctgatgactatttaaaatttggcaaaaagaaaacacaacagtcttagagtactaagccaagttgtaatgctcaggccactaaatgcattaaaccttgtactcagaacacttgtataaagcctggaacacttatcagaatgtcaaaacaatcaggaagataacagtctttgcatctgagagattcagtgggataagtggaaagagcacaggaccaagacttaggagttctgggttctctcaagtcttgttcctgtcatttgcaaacattgtgcacttaggcctaccagatcctcccaagtgttaatagttttgtatttaaagacgaatgtggttagatatggtgaactgaacataggcctgaatctctactccatccctaaaccccactgaaatgacattaaaggaataaaaagggtataactcattaaaaaaaagactgagtaggaaatgacatcagacagggggtggtaacaaaaatttggaagctggaaagcagatggacaagtgttacactgactcagctgaccttgggaaagctaagcctaagcctgaagaggagggggatgcaaaggcaagaagcaagcccatttccaccatagaaccccagaaagtttcaaaagttagaaatatcaaataaattttcaggcagggaagtaggttgagactgaaaacaagtgaccttatgaaatgtctttaaagcaagtagttagacccctagatatctttcccacactgtactcccagataattgaatcctccactcctattctgattggagacagaaggtttactctttggggaggcttaactactcaggctctaggcttaggaacagtaggcccagctgaggacagcaaagatgacttgtactgaaaacagggaaaataagggaaagtctacatagtcaacaatgaacgtcccaatgccctttttccatactcagtttccagaaacaggtagctaaacttctaccatggtatagattggagccagaggacagataactctaagagcaatacttccaagtggaacatgagcctgatagcatgctgacaacttgaatgtgtagttagaggaggttttcaattattcagagaatttggtgatgaattaattactggtatatagaaagctaagcaactgaaaaaaatgagccaattaatgagctccagaaaaattaaaatgtcatacaagcaaagaaaggtaatcataatagagtgagtagctcagctataaataatgtgacataatcaacaatattgtaaacactgaactgatttaaccaactatggtgtatgtgctgggtagaaggggccttttaggaaagtggaattctcttcttataataggaagtcagcaggtactacctaatattgaattttaaaaaataacagtgtaagtgtataatttagatgtgtatgtggaggcaaacatcagaagaaaaagagcagagagttggatgttgtttactttgggagaaaatatatcagcagttagacagaacagagcaggggactgctctttgcattacaagcctagtagtactgcttgacttttattgtgtttatttatttttaagtgacaggtctcactctgttactcaggttggagtgcagtggtgtgatcatagctcactgcagccttgaactcctgggcttatgcaatcttcccacctcagcctcctgagtagctggaattacaggcacatgccaccagacttggctaactttttaaaatttttattttatgtatttcacagagatggtgtcttgctatgctgcccaggctagtcttgaactcctggcctcaagaaatcctcctgcctcagcctcccaaagtgctgagattacaggtgtgagctaccacacctggcactgcttgactttttaaagtatgtacatttattacttagattaaaaaattaatcttaaaaaattattaaatttggctaaataacctttggtctttcctattttgaaaatgtaatgactatgcaaaacattaatagtttcttctgagagcttgaacctcacactctttcatgaaattagatattacttaggaagagaaaacattaagacttccagatcctcatagacttcctagtacatgaagtgctcaagctactcatgtgggttgtttaaactgcagtttaaatttagtttggtgcatttactttctgccacatatatatgactgtttctactttggatattgcatgacatccacatatatgctaatcctgaaaaatagatggaaagcaaatatggcttgaagtaaccaggaattgaaaaccaccatgaatagtgtcagcctgacccaggagagaactttttatgtcccatgaatgactcttaccctatctttcaatagtggctgcactctgctttctgatcagaatttctctctggattgaaacttttatttccttctctttgcttgattcttagcatttactgaaaaacatcagttaccagtgcttacagacatcactagcagtaattatcaaattccagactaaacctaccttttgcttcctagtgaatctaagagctgattcttctctctcccattcctctttgtccagtccctgcattatatccagtgcaatgcatttaaaaaataaactacacttgacttcctaagaaccttggctataattttaaataaaagaggttggtgaccatcagcattatgtgtaagtcctgtttactggtaggtttgagcacagtgtccattcttgtattcttactaattgctattctattagacaccattcgtttttcattgtcctttctctacatcgcctactttacctacataagcactaacctttttttttttttttgggggggtgctagacctagtaaaagggccaacacaagcaatttgtctcaggcatttctctatctcccttgttctgccgccttcctcccatttggcagatagaacctttcacatgattttaaaccccattctgcccgctcccttcactcctgaatatctagaaattccagtaaaattccttccacatacaagaaagcatcccatatccacacctatctcaccctcccttgcctaacagaacttaactccctggatttccattcagcttgagctacgttctttctcatcacatgcagggagttgcatataccccttacatagagagttcttttatttttgaatgtagacttaatttaaatatttgaatttggcttaaaagatgatgcatatctagtagacaccattaaatattattccaaaaagcatcacagctttagcaactcatatttccttcaggctttttctttcagattaattcaaactattaattttgaacctctatgtatgctcggtatgccattttactctgtgtaaaattggcatgctgttttagccaattaaaacggaaaatatttctgtttggttttaattgatttatctatttattcacttactattattttggcaagaaagggagttcacttccctgaactatttcctttggattgagaattcttgatgttaggttgagtgttaatggttttcagtccagctgttaatgatgcaggattcctatgctctagggagattttagaaggaattaagtgtgaatacctcctcacctgcttgtcttctattctaacaagagcttttgctcattaaaaagtgcctgctctagcttaattcttctcagagtgaacacttcaggattatgcaagcaggctaggtagtctcctctgattcaatattcatacctttgaaaagagatataatgtgatgaaaaatagagatgctaactgaagaacaactattatttgctattaccaagaaaaactggatgacattaaagaaaatcccagattaaccatgtgaaaaaacttaatctgggaaaagaaactccttctgggagtcagtagattgagggaaaagaagagagatagaaagaaatggaaggtatagaacaaacccaatgaaagcatggtgactcaacagcctgaagtatctgttttagaaacgacttcccagaccaccactgagaccagtgcgaatgcagaagtgagcaagtaaggaagcagctctgtaaaggaagaaggaatagagatcacatcgcagcaggagtgtccattgtgacagtctaggtaaaagagagagaggaaccacagctgtgaggggacaagttggttcctcaaaagatattaatgaggttttcatgacatgtgtcaggatgcaaatgacaggggaagagtccacttaacaatggagttgtcaaagatgtaaaaatttgcagcactacttcaatattatttcacttacttaatgtattttcatgcttaatgaactaaatcactggactgatttgtttagggcagcactgtccaacagaaatataatgtgcactacatatgtaattttaaaatttctggtaaccaaactaaaaaatataaaataaaacaagtaaaatgaaatttagtaatttaacacaatatagtaaaaataaccattttaccaactaatcaatgtaaaaaatcattgatgggatattgcacattttttttcatgctgatacttcaagacctagtgtatattttataattacagcatatttcaatttggactagtcctatttcatgtgctcaatagtcacacgtggccagtagctgccatagtggacagtgtacatttagaggaactcatttttgcatcactacctatgaagtagtcttgaaaacaaaacaaacaggatatgattaagccactatatctgaactgtccaacaccgtcaacactagcaacatgtagaaatttaaattaattaaaactaaaaatccaatccctcagttgcactaaccccatttccacttctcaataaccacatgtggctagtggctcctctgttaggcaccacagatttacagacttaatgcctttatcttccaaactgaaaattagagaacaatgtctaaatcactggcaatttgtatcatccttgatgaaaacaaacatttcttctttttcatttcattccaaaatccccttttgccctgtcaacttgttcccacctatcccctcaataaaaccttaccatggtcttgcctgcaggatgcaaaattgtttgagagagtactgaaaattcagtcatgagggtagcatttcttactacttatggtttttttttttttcaagtttcatagagacctgtggcatcttgtgtttagaatatatagcaaacctggtaaagagtggtgaggagtggatttctgaaaatgctgacatatctttgaaaatattataatcttagctggcactatgacaattgtagaatgtatggtttgaaaattaaaaagaagagaaatggaaacatatagcaacattcgtttttaccccttcttcatgttaggcagattttctttttcttgtgggtgctctgggcattgttctaacttggtatttgcaagtcaatggcaaggcctgttcagtgctgagggaattacatagtcatagacaattagtcttttaaaaggtctgctgcttggaaatttgccactaaactcagtatagcctcagcacataatgtaaattcttaatgattataacttttctaaattcagcccttaacaaatctcataatagtgttttgaaacttttaaatcaaacataacccaattaggttggtatttgattaaactgaactgccacttcactgaagtgtttaaataaatcaacattaatatgcttttattatagtaaataaagttacttctatgtagttgaaatgtcaatactcacacatagctcttgaaaattaagtactccttgcactttgaataatgaatccagtattaattggggggaaactattgatttctttttataggcctgtggaagtactttgccccaaaactctacaagttcttaattaaaaaaaaatagtaaactaaatatctgttaaattctgaaactactgtcagagttgtccttatagtggttctgattcatggccttttctccctaaaaatgcaacacagactgatccttcaaataataattataaagaatctttttcattctaattgaataaaattgttagaagattcttggatgctttgcttcccacaaaatacttgcactgtgtgtccaataatagattttctctagcagatagtcattatcaaaggttaactagcatcaagtggtagaaaaaatcctgtttctgtccataggtgcagcatggtgaattccaatatctcatctaaggagtaaaaagtatgctttttggaagtaggactcagtacagctttccatttgtcatttctattgctattctacaggtagttgctataagatgatgctacatttttttatggcattcgcagatttacatttcattgatattctatctttatgtatactttagcagtctatttgatttttgactggttgtctgaatcctctgtaggatgagtctcaaagtagcctaaattcttatttaagtactctctaacagtgtgttccttacttttaaaaagttaagcctaaaagaagtctgccttggaactcttgtttactggacatagatgtttacacatttttgttacaagatctttggggtgtcgattttcctcccaaaacctctgtggccagtgcacctttgcctgagtttttgtcctgtgtcccaggtccaggaagaatgaggtacacagacaagtaaagggtaaagaagtcaaagaagagctttactgttagaacagctcagaggagacctgcagtacctagatcctctgaaggcaggccatcccctgagtgttcagctctcagcagagaggaggccctggagagggtggcttttctctgcaggcagattgttcagacatctctgcaggtctctgaagctctcagcagagagggtagctcctttgtgcagctggtcatccagttgtctgtccctcctctgccctctgccctgctccaagttgggtgcttttacggacctcggaggagaggaagtgcgtgctgattggtccgagggaagccatgggtgggcccagagcaggcacactaagtccccattccagtgggtctgcaggactggcagctgggccctcagccttcaggccctccctggcctgaatgtggggacctactggggacccacccctttttgcccaggaatctgtctgcctcctgctgccatttatggccctgggctcagcccaaccccactaccacatcagagcaggcgccaggagaagacagaggccaggcagcggagcagacaccccgagcctgcagggactggggggtcatgtctgcccctgaggtgcaggctgcagagatgcacaggtcctgtgcctcggagggcagccgcagctgcacccagggagcttctgctcagccaactcagaatgggtggggctcctgcttgtccctggcttctgcctggtccatggagtgggaagcccaggtcttcagctgctggtcagccagctgcagctgcatccgagagggcagatccccccaagagcacagggagggtcggatccactacacagtttgggtggccgtagccccgcccaggagggcagggctcctgtctgctccaaagagcaggaggcctgggtctgcagccacggtttgggcgactgcccctgtatctggggagctcctgccctaactcagaaagggcgggcctcccaccggctgcatggagtgtgcagctccagccatgcctccctgcggtagccggtgtgatggcagcagccactgccatcagtttcagctagaacaactatgattaattagaattagcctgggagttgaacaatgagaacacatgaacacagagaggggaacaacatacaccagggcctgttgagggtggaggatgaggaaacggaacttaagaggacgggccaataggtacagcaaaccaccatggcacacatatacctatgtaaaaaacctgcagtttctgcacatgtatcccatttttgtttttgtttttgaagaaataaagggacaaaaaaaaggattagccttgttatgactgacagaaaaccttaaataagagtgacttatacaacgtatgttacttttctcatgcattcaagtgcagaggtacacagcatggctggtatgggctagctctttgatcttgcagctcttccatgcttagcctatattctaaggcatacctcatggtcaaagaggccttcctctagccatcatgtctgcattctacccagcaaggagtaaagggaagagaaggacaaacttttccctttaaggacattctcaggagttgcatgctctgcttccacttagagcccattgtctgggactatctcctggccacaactagccgtaaagaaaactgggaaatatagtctttatgctgggtgaccatgtgttcagctaaaaatttagaattctgttataatggaacacaagggatattgaaagaaaattaggtgtctgtgtaatactgttctctggaatggaactcatggtcagcaaaagactataccgtgagcctggaagctgttgttagaaaaataaagaaagcaactaagattctgttagagctttccaaaagaagtacttaaactaccttttttttctggtttggtattttttcagagcccctctcatcacagcatattaaaactcctgctcctctcatagaccttaaatcccttggatttcagctgtttctttttttttttctttttttaactttaagttccaggatacaagtgcagaatgtgcaggtttgttacataggtatacatgtgccatggtggtttgctgcacctatcaacctgtcatctaggttttaagccccatatgcattaggtatttgtcctaatgctttcgctccacttgaccccacctaccgaattgccccagtgtgttgttcccctctctgtgtccaagtgttctgattgttcaactccctcttatgagtgaaaacatctgctgtttggttttctgttcctgtgtaagtttgctgaggatgatggctagaataatcagttggaaatgcagaaatcacctgccttctgtgttggtcttgctgggagctgcagaccggagctgtttctattcgcccatcttgtcccctcccctcagctgtttctcatcaaaacttcctgtactgcctgaagaagttactttccaattttccaccctagcataatgtatcatttagagaaaaaaagctgagttcttttctgaaatgcctgaaaattttattcttttccattttgcttttttcttttgccacacattaaaacacctctgctgatgttaaagctgcctgtacaaccccaaattaattgaagttttggagttgatcaagtaataataataatagccactgtgttttgagtgcttactctatgccaggcaccatgctatgggtgtcacttacattgtgtcattaagtcttcagaacaactcgttaaggtaggactatagatgaggaaactgcagcccacagagattacataacttgcccaaatccttatagctagtaagtgattgagtatagaatttatacctaagaaaacagagtctagaacctcctcctcccacacaccctgattggttgatattacagtatgtcctcacttaatatgttcatcaatagattcttggaaactgtggctttatgcaaaatgacatataacaaaaccaattttaccacaggttaattgatataaacaaatagagtaaagttctcacagcatatgtctggtcaaaaaaacatcaacaaccttttaaataaaaccaaaacacttataatgttaaacaatgaaataaatgtgagcaatacttacatttttaaaagatttaattagccaggcatggtggtgtgcacctgtagtcctagctattttggaggctgaagtgggagaattgcttaagcctaagagttccaggttacattgagctatgattgtattactgtactccagcctgggtagcagagtgagactctgtctcgaaaaataaaataaaataaataaaaacaagataattatttacccactgattacagtcctgggtggcaggtggccagagcctattctggcagttaagggtcaaagtgggaaccctctgtggacaagacaccatcccatcacatggcacactaatacacacacacacacatacacacgcatacacacacactcacactgagaccacctaacatgcacagctttgggatgcgggagggagccagagtacccagagaaaacccacatagatatggggagaatgtgtaaactccacacagatagtggccctagcaaggatgcatttttttttcatcatgagtaaaatgatgttgctttgatgttcaagaaactgctgtattgtatatggaaaaatctagatctgtgctatctgatatggtagctgttaaccacatatgtctgtttacttttagttacttatttgtttgcttccttaagacagaatcttactatgttgcccaggctggccttgaactcctaagctcaagtcatcttcccatttcagcctccccagtagctgggactacatgtgcataccaccatgtccagcttatttacatgtacagttaaattgaaattaattaattttaaaaaagtctcagtttttcagtcacacagtcacatatcatatgttaattagatacacgtggctagtagctactatatggaacagtgcaaatatgaaacattgctattaccacacagaattttcttggacagtactgatctagataaccctgctcctaacctagatttctttttagcctaaattgtctggctggctgtgtagatatggccaaagagaaataggtgcagcctcttaaagaagatatctgaatttatcattctgccccataaatttcacatttgtaaacaaatatttaagtgaaaaatgtgaattttccttgaatattatctccaaaattatcaacccattaagatatcctcattataacactatttgttatgtatatgtgaatagttcactggtgaaatcatgtcagacatatttcaattctacatagttgtcttagtctgttttggctgctataacaaagtcccatagactgggtggcttacaaacaacagaaattttttctcacagttgagatcaaggcactggcagatttggtgtctggtgaggtcctgcttcctggttcgtagacagtggtcttcttgctgtgtcctcacatggcagaaagagcaagggaggtctttgggcctcttttataaggacactaatcctattaatgaggactccattctcattatctgatcacctttccaaaagccccacctcctaataccatcaaactggggattaggtttcaacatacgaatgttgggggaaacacaaatattcagtctatagcaatagttaatgtctgatataacacagctgacatacatagccttcatggcatctgttagcccttttagcattataaagaataagttggttcttattatttttagcattacacagtgaatgttttgattggcaaaaaataaaataatgaggaacacaagaatacttatctgtatataggaactacacacagtcactctaatctcatcccattggctattttatgatttaatatttaaattgaaatctaaaacgtgagtacttagtaaaaagactggatttgtctgtgaatttgatgtacagtcaaatgcaaaatcttattctttagaattgcccacagttacaactccgaaaccactgtaggaaaagcccccagtctcactaaatcactctgggttttttcctgaaaaagcccagtgggtttgcctagttggaaattctatattaagagactactctggtagttggccaggaaaagagcaaccaaaatgacttaatacactactgcattcaattaggtccacttttcttctttcaaaggtgaaaggagaaacatttgactttaaaaagcaacatcttcctataattcgaatgtctattctttgtgtgcttaagaaaacattcagaacagaaattgcaaatatctcattacaattttgaaagaaaaaaatgacagctttcttctagtgaatattacaaattaatgattttcctacatatatttcttatgaatatatgtagctccaactaaaaataataaaatgtcatattaagaaggcaaatattctcacctccatatactggaagtcttctttgtgctagtaggtattctggaaaatctaaatttgcatttcaatcaaagaacatcaataatcggacagagcagactgatgatctttcaaagttccatttcaatgcacctctgagataaaagaggacttctgacaattttcagcatcctgtattgcattgtctattttgaggtattatgtaaaatccaaaaatatgttttgtcattataaaatccatacctctgaactggtttaaaaaaataagcatcttaacaggtatgataattacagtaccaatttgaagaaatcaagaactttaagattgggagaaacagttaagatcatctaaaccacagagaactcaccattaccattggatgtagtagatcagaccctgaatcctgaaggagaaaatgtggctgtaagtctcagctctgagattatttgtgagactttgtctaagtcactttctcttcccctggacctttgtttttctactctgtaaagagaaattaaacttctttcatatctaaggtctatgtacaatttcttgctatctgccaaaagttaagcagccatttatatagtactttagcagactctacttcagtaaaacactaaattagctagactatattactattaattaaatttggaggaaaaagaggctaaaccccaagcaagctagtatcgggaattcatatgaaaaaatgacttctaggaaatgtttttaggtcaaaacacagtcctagacattataatttttgcatctcctgctctgtagagtgaatattgatgtgcatggtgatgaccatgacgttctgaatggccattattgcccagtaacaatgcagtcctatgtgctagactgcattcacttgagcttcaactcaatttgcctgggccatttaaaaattaaaaataattttaaacaggagttgaaagcaacaaaatgctttctgctcaacttttgttagacaattcaattacctacaatatcctattctgtaagcatactagttaatcaaggttttactgtgtattctttaaactagcaagttagttaattaattggaggaagtgaaatgtttggccaggctagatgtctgcactgatgtaactgcttggattttattgttatgtttagtaaggagcaaaattgcatgaacagtgacatgtgtatgtttggctaaggaaaaggcactttatttatggtgagaatggtcaggctttagcagaagtagttgaaattgctatatgatacccagattatacagtttcccagctgatccagtaaatgatcctgaggcctccttacctatttctaggaacatttattaatgaattatcttttttggtcttatttcctatgccaaacaataatctagctacctccatctatcagagtccccttataatgaaggaaacagcaggatctctattgtggggaaggaagtgaagctgttcatctttgtatctctaccacaaaccacagtatctagcacatagtagatgattaataaatgacaaataaacaagggattatttttgactgattggttattttatttttatttatttatttttttttaatttatttattttgagatggagtctcactctgttgcccaggctggagtgcggtggcatgatctcagttcactgcaacctccacctgctgggttcaagggattcttctgcctcagcctcccaagtagctggaattacaggcatgcgccaccacacccagctaattttttttttttttttttgagatggagtctcactctgtcgcccaggctggagtgcagtggtgcgatctcggctcactgcaagctccgcctcccgggttcacgccattctcctgcctcagcctcccgagtagctgggactacaggcgcctgccaccacgcccggctattttttttttgtattttcagtagagatggggtttcaccatgttacccaggatggtctcgatctcctgacctcgtgatctgcctgcctcagccttctaaagcgctgggattacaggcgtgactcaccgcgtccagcctaattttttgtatttagtagagacagggttccaccatgttggtcaggctggtctcaaactcctgacctcaggtgatccacatgcctcaacctcccaaagtgttgggattacaggcgtgagccactgcacctggcctgattggttattttaggtggtagagtaataattgctctttcagggacagttttgtagtcatcttacattaggtttctcaaacaaattttagccaagaagaaacaacatgttacctgaacatatgtggaaacttaacctcttcctttctgtgcccctgctgtcaataagagaaaatcagccaaatctttgataacaaatgtctgttgtaaagacacatagtagagattcaattaaatttgttaaatgaatatgttggaaacaagggcaacttatcaaataaaggtagagccattttacagacttttttccttttctccagaaaaaaaaggaatgtatgacttagaacaattcagataatatcattgataacatggagaaggtatgcacatggaaggaaaaaaattttctgttaaatatgaacaagacttggcaccaagtgaggaagatgccatgtcagtttccatgatggaagccaaatatattaataagggtaatcacaaaggcagtttttgtcctaattacagttaacccttgaacaacatgagggttggggcagtgacacctcttgcagtcaaaaatccatgtataacttaaaaaaatgtgaatacacagtagatgtatatatttttggggtacatgagatattttgatactaacatacaatgcataataattcacgtcagggcaaatagaatatccatcacctctagcatttattctttgtgttaaaaacaatccaattatatccaattatactctttcagttatcttaagatgtaaaataaattactgttgactagtcatccattgtgctatcaaatactatatcttattcattctatttaactgattttgtactcattaaccatctccacttccaccccacccccagtacccttcagagcttttggtaaccatcattctactctctatctacatgagttctgttgttttaatttttagctctgacagatgagtgagaaaatatgataattgtctttctgtgtctcacttatttcacttaacataatgacctccaatttcatccatgttgttgcaaatgacaggatcacattctcttttatggctaaatattacttcattctgtagatgtaccagatgtgccaaattttcttttctttcttttttttctttcttttttcgagatggagtctcactgtgttgcccatgctggagtgcagtagcacagtctcggctcactgcaacctctgcctcccgggttcaagtgattatcctgcctcagcctcccgagtagcttggattacaggtgtctgtcaccatgcccagtgaatttttgtgtttttagtagagatggggtttcaccatgttggcaaggctggtctcaaactcctgacctcaagtgatccaccttcctgcctcccaaagtgctgggattacaggtgtgaggcaccgtgcccagcccacattttctttatatgtttatttgttgacagaaacttaggttgcttccaaatcttggctattgtgaatagtgctgcaataaacgtgggaatgcagatatctctttgatatattgatttcctttcttttgggtatacctaacaatgggattgctggatcatatggtagctttatttttagtgttttgaggaactgccaaactcttctccttagtgcttgtactaatttacattcccgctaacagtgttcaagggctcccttttgtccacatcctcgtcagcattcattattatcttgttttggatataagtcattttaactggaattagatgatatgtaattgtagatttgggtggggacacagagacaaatcatatcattgcccattcaatatggtactaactgtgggtctgtcatatacagctcttatcgtgttgaggtatactccatctatacccagtattttgagtatttttatcatgaagaaatgttgaattttatcaaatgctttttcagcatcaattgaaatgcttgtatggttttatccttcattctgttgatatgatgtatctcattaattgattagcttttgctgaaacatccttgcatcctttgggtaaatcccacttggtcatgacgtatgatcttcttaatgtgttgttgaatttgttttgctgtattttgttgagaattttgcatcaatgtttattagggatattggcctgtacttttcttttttctattctttttctttttcttttttttttttttttttgatatgtctttgacttgttttgttatcagggtaatactggcctcatagaatgagtttggaagtattctctcctcctctatttttcagaatagtttgagtaggattaatattatttcctcttaaatgttacttttctgttcacatgttggatttctttatgatttaatcttggtaggttgtatgtgtctagaaatgtctcattttcttctagattttttaatttattagcatatagttgctcatagtggccccaatgttcctttaaatttctgcagtatcagttgtaatgtcttctttttaaattctgattttatacatttggttcacctctctttttttcttagtctgattaaaggtttgtttacaccgtttttactttcaaaaagccagcttttcatttcattggtcttttgtattatttttttatttcagttttatttctgctgtgatctttattatttcttttcttctagtaattttgggcttggtttgctcttgcttttctagttccttaatatgctacattaggctgtttatttgaagtttttcaactttttaatgcaggaacttattactataaactttcctcttagtgctactttcactgtatcccataggttttggtatgttatgtttccattttcatttgtctcaagaaattttcatattttcttcttaatatcttcattgacccacttgtcactcaggagcatactgtttaatttctttgtgtttgtacagttttcaaaattcctcatgttatttatttcttgttctattcccttatagtcagataagatgcttgatattatttcaatgtttttcaatgttttaagacttgttttgtgatctaacatatgttctatccttgagaatgatccatgtgctaaggaaaaataatgcatattctgcagccattggatgaaattttctgtatatagcagatccatttgttctgtagtgcagattaagttcaatgtttctttagacagatcttccagaaagaaaatcaacaatgatgaaagtgccttgttgacatctccagctattaatattattgcattgggacctatctctctcttcagctctaatatttgctttatatatctgagtgctccagtgttgggtgcatatatatttatacttgttatatcctcttgctgaattagcccctttatcattgtatagtgacctgtctcttcttacagtttttgtcttgaaatctattttgtctgatacaaggatagatactgctgctctttttggttttcattggcatggaatatctttttccatccctttattttcagtctgtgtctttatgtatgtctcttgtaggcagccaataattgtgtcttgttttttaattcatacagccactctatatcttttgattggagagtttagtctatttacaatcaatgttgttattgataggtaaggacttactcctgctattttgttatttgttttctggggttttttgtagtcttctcttccttctttccttccttcctgtcttccttttagtgaaggtggttttctttggcagcgtgatttaatttcttgctttttatttttgtgtatccactgtatatttttttatttgaggctaccataagacttgcaaatacaatctaatagctgaatattttaagctgataaaaacttaatgctgtttgcataaacaaacaaacaaacagaaaagttctataaactctacaccttttttgtccttgctttttaactttctgttgtttctatttctatcttattgtactatctatatcttgaaaagttgttgcagttattattttcgattgtctcatctctttgtcttgctatttaaggtaagagtagtttacacactacactcatagtattacaatattctgtgtgtctttgtacttactattaccagtgagttttgtatcttcaggtggttacttattgcatattaacatcattatctttctgactgaagaactccctttagtatttcttgtaggacagatctagtattaataaaatctctcagcttttgtttttctgggaaagtattttaccttcgtgtttgaagtatagtttcaccagatatactattctagggtaaaagtattttttttccttcagcactttaaatacatcatgccactctcgcctagcctgtaaggtttccactcagaagtctgctgccagatgcattgaagctccattgtatgttatttgtgtcttttctcttgctacttttaggatcctttctttatatttaacttttggtagtttgattattaaatgtgttgaggtagttttctttgggttagatctccttggtgttctataaccttcttgtacttgaatattgatatctttctctaggtttgggaagttgtctgttatccctttgaataaacttcgtagccctattttgttctctacccccttttcaaggccaataactcttagatttgatcttttgaggttattttctagatcttggaggcatgctttattgttttttattctttttccgtttgtctcctctgactgtattttcaatagcctctcctcaagctcactaattatttcttctgtgtgataaattctgctattaaaagaatgcatcaaaattcaagcaagccccagaatttttctattattttaatctctttgttaagttcatttgataaaattctgaattccttctctgtgttattgtgaatttctctgagtttcctcaaaacagctattttgaattctctgtctgaaagatcacttgtctctgtttctcaggattggtccctagtgccttatttatttagttcattttgtgaggtcatattttcctggatgatctgaatgcttgtgctcacataatgacttcactctccttcctccaagcacacagattatctttctgtgccaagtgctcacctcaggggatggggtaggggtggtgtaggtgattcaagactgtcttctatccttgtcaatgcttatttccttaatatgttgtttgtcagtgtctgcaaattgatgagttaggtatttattttagtctgggtttcttttgtactcattcttcttgagaaggctttccaggtatttgaagacttggatgttgtaatctaagccatacctgcattaggtggcaccccaagcccagtaatgctttggttcttgaagactcacagagataccaccttggtggtcttggataagatccagaaaaattatttgaattaccaggtagaaacagatgccttgttttcttcccttactttctcccaaacagagactccttctctgtgctgagccacctggaggtggggatggggtgatacaagcatccctgtggccacccacagtgactgcactggatcagacctaaagccagcacagcactgattcttgcccaaggctcactgtaaccactccctggctaccacctgtattcactcaaagcaccagggctctacaatcaccaggtggtgaagctatctaggacttttttcttccctacatggtgataagttaccccaggactcaggcaggtccagagatgctatttgggaaccaaggagtggagtcaaaaaccttagaaatatacctcgtgttctattttactgcatcagagctggcactcaaaccatgagatgcaatccttcccacttttctctcccccttccacaggcagaaaagtctcacccatggccaccaataccacaagcctatgggtagtactgccaggctggcacaaatgttctttccatattatgatgttaaaaccaggtactgtggcctcttatctgatttttggttgttacgaagatgctttttttgtgtgtgttgatggttgttcagttagatgttccttgggttagggatgattgctgtaggcttcttttcagccattttgcttcaactcttccaatgtataacttggctactcaaaatgtaaccactaatatctggaaaccttgttaacaacatagttgattaacacatattttgtacattatgtgtgttacattctgtcttcttacaataaagttaaagaaaatatcattcaaaaatcataaggaaaagaaatatatttatttatcattaaatggaaatggatcatcataaacgtcttcatccttgtcttcatgttgagtaggctgaggaggaggaaaagggaagggctggtcttgccatcttaggggttgcagaattgaaggatgtgaaggtggaaggggaggcaggagaagcaggaacactcagtgtaacttttattgaaaaaaaatctcctcctcctcagcttcaaatcttaaaaatgcaagggcaggatcaagatcggttccctttgactcagagtgaatgcaaatctgtggagcttctaaaacctacagaccatatgtactgacactaaataattttaaactgatttaggggactgcatgttatatagttttctggaaacaaagctatgagactgaaactgacagctcaaatataatagttgcatttgattgaaaaataaaactaaaatttgctgttaatggaatatctagcccctgaagagtattgagtcaaatttaaataactagaagggtccaccacatcgtaattgtttgagggttcatatgacagacatggaaatggttctgtttggtttctattttgacatacaatagatcttcttggatgggttttgctgacaacctgtggttacaaaaacgtctcctgggtggtctgagacttcattccatgtttatagattatttatattaatttatttctattaggctcaaatactataattggcatctcatcgtaaaaagcactagtttctccctctggttaggcatcccatctgatcccagacagaataaaaagtgggcaagttgtaggggaacatggaatgaggacaaaaatgattttgagaaaaatcaaagattgggaatagagtctcaattgaataacctactggtagtcttggaaaatagatagaactgatgagtatgaagaacattgcaaaacgtacaaaatattttcagtgttcaaatacctaaaagctctcacttttatataaaatgctggcagtggggttgtgttgcctatgctattttaagaaatgggttctaactacactttgttttaatgtaattgttgttttgcaagttccgctgagtaagacctactgcatagaagatgtcactttaggcaggagttacattaaatttggtaaccaagacagaatacctagctgttgggtgatgattctttttaggtttatctgtatgtttatctctctcccttcccctaccccattccttacttcccaactctggagggggattcttgaagtggttttcagatctgtcttggtttaacacagtgggtaaaagggaggttggaataagctgaacactgcaagttactggtggtgggagacgggctatagctgaagggaggtgtgatgactctgaatgggaagcaggctgaacctcattggctcagaaatgaaaggctttctgtttcaaaacacttataccaacattttcctttctgtcctcactcccagaattcaatctcttccttgcttctccctaatacttcagggagacaattgcctttgttctggtcccagaacatatcttcatcagtttccctagtcatcctgcctacttaccacatctcacccttgttgcctattaattttaaccactttatatccaaaattatacttgatttactgagtaacagttccttgaaacaaaacctactacagtagtaccaactgtgatagtgactaaactcaaatgtgtcctaagagcagctactgacattttgactgacaaatatgattgttataagggatggagaagtgtattttgtcagttacatatatgcctggacttactagccccatgaaaatgtgtttttgataggtgtctcagagttgtgaaattcaagtaccaacttgaatttaaaaaataccaatgtggcttgtgggaactctcagtaagtctgtacactcaaataatcaatgctttgatggtgggtagtcttccctttgttatcatgctcccctttctccgtcgacacatattttaagtgacatttattaaatattattcttcatcatgaaggaggcaaattagggcagagtataacaaatagcatcaggaatattacagtgaactttgctttaaagctaagacagacaaggcaatagagttctaaaaggaatgccaaaactctcccttcccagaatcttctttgaaatgttatctgagttaatgccccatctctttaaatatggcctggaagtggtgtcaggagggtgctttaagaattttagacttcggttaagctgggcagattggttggaactggtgaattggaaaggaataccaatttggcaagtttatgtttcagcatgccacacaaagttaaaaactgcactttgttttaatttaattgttgttttgcaagttccgctgagtaagacctactgcatagaagatgttaccatgtagtcatcagtctctaggctggttgttcttaactgagggtatttaggaaactttaaaactcaggtaaaatacctgcagagacacacacacgcgcacacacacatacacacgtgtgcgcgcacatacacacatgcacatgaatacacatacagagaccctttccatctcctttccacctatgctggaggcttggattcagtagatctgaagtggagcctgagcatctgcattttaaatgctccatagtacattccaatgtacagccaagactgaaaaacccctggctcagacacttcaatttggtctggagtttgatgtcctgtaggtgctttattgtgcaacaaacttatttaacaagtactatttgtcaggcactgttccaagcattctataatagctactcatttaattctcataccaaccctatgaggtaggtattatcatcatccctattttgcagatcaagcgaaagagagatacagataatcttctatcttaagtaaaaagacataaaaactatgtcccattgaagcatactattaagttaattgtatattaaagtgctgtgaacattgtgaaataagtacatatgattaactgagggtatttaggaaactttaaaactcaggcaaaatacctgcagagacacacacgcgtgcacacacacgcgcgcatgcatgcacacacacacatacacgcatgcacatgaatacacatacagagaccctttccatctcctttccacctacgctggaggcttgtggcattaaccagagtgaaagaagacaccttggtctggtttatgaatactgaggaatacatgaatcatctttactctcgatatctttgaaaacaagatgaatagctaaagagtaggctctccagtaaaacttcactctagaagatgagaaaggagcaataagacacaagtcaaacatattataacatgtgaatgtttattaatatcattaaaatatatgattgggtcttccttttttgcctttttataaattaagaaaaaccctggtctacttgatgaccttaaaatggactccaggaataataatgatatgatctattactagcaaattcagcaaccaaaacttcagaaaactagtccataagttcagtattctgtgtttattaatccatagtgatgtgtcaacctttacaacacagtcttttattagtaaagttaaatcagacagaactatagatacaaaaacacctaggttccagtctcagccttgagactaatgtgttctacgttctttcccctctcaaagccttagtttcttcatctgtaaaatggatgcgtttgccctagataatctctccaaggtctctaccagtataaaaagtctataaatatgttaagaactattgtgacaggaagctcatggcttttgtttcttcgatgtaataatttgttcctgcctatctcctgggatctctgagtgagcattggttagaaagaatgttgagctctctggtggacagctgacttctcttacccagcagaaatgaatctgtcaactttcattaggcattgtcgggtagcatcatgctcagtgatagattgtaccagaagtagtgttaggttgacatccaattataccaaggttctaaaaaggtagtctatttcactcttcttaaaattcctgagaatttgggatgctgcaaaacacgtaaaatggttgataggaagcaaaaaattgtttgccatgcattttaatactttcattttgaggctattgaagctgtatatggtcgtattatcaatagaagtgccttaaaaaattgtcaaggttagaagaacaggtttctggaacacctcacagttgtgatcacaactgagccttgtgcttttagccaaattgctccctggcctgttccccaagatggcacaatgtcaggagagcttcctcctaaggaaaatggcccaagaaagaaaaaagataggggtggtggttaggaagtgaaggaggcttctcctgatttccttgaccttttaaacagccataccatctggaaacagagtgggcagcacatcacacagagtgggcaaccacagagtgggcagtggcaaatcagagtcatctggactacatgaataattatgtggacatttaaattcccacccaataaaatccactttacatttataataattttaaaatattaagtgaataaaaatattaatttttccaaactctgcaagccttcatttggatttggctgtataaatctggcctgaagataatttctttctatttaccaacatagaaaggaattcaaattatgttgttaaatgaaacaagcaagttttataacacagttttagtttgattctacgaaaacaatgtagtatattttagaaaaagaaatgggaacattatgttgtatggagcaagggctgggaattctagaaattctagataactttatctttgttatatatttctatatttcatttttatacaacaaaaacattttagctttacatcagattaaaacaaaataaagtcttgttttagaaaaaaaagtaagggatatttgagggctttgggggtaataattattttcttccaacaggagttgaattatcagaaccttttcattatcaacttttgtccttaaactaaaagttaaaatctattattctcattgggattgattttctgtttcttgctttacctcaacaacccttttggcgaagatccattgaataattcaagaattctttctaaggtataaaacaagtcaagatggctagccccagctccttggtcccttgcctgggtgagaaagatctcagcacagcttcttttgctgggcatagaatggcttttgattttcttgatgtggctgttacctgatatttcaagagttgctctgaatatgccttggtaatctcttggtctaggcaggccaggctgaagagactattttgctcattgtagaatagtatctcataaggctccttattatctgggcaaaaccaaaaatctgctactctgcctctggccccagcagagccttttctaattaatactttatttggcagcagatgttttctgtgtgccatacactgaggcaacagctaagcagaatcccttaagtgaagatattccactaggaagggcaccttcccccaacccttcaggcttctctagtttgctcaggaaggtcttccttattgtcatatcttaaggcagtctatttttcttttcataattggcttactctctaaatagttactgtgttttctcaaatttctaaagccataaagagtatgttcaccttttataataccagcactttgggaggctgaggcaggtggatcacttgaggttaggggttcaagaccagcctgaccaacatggtgaatccccgtctctactaaaaacacaaaaattagtcaggcatggtggtgagtgcctgtaatcccagctactcgggaggctgaggcaggagaattgcttgaacccaggaggtgaaggttgcaatgagccgagattgtgccactgcactccagcctgggcaacagagtaagactctgtctcaaaaaataaaaataaaaaaatatatatatatatttatgtgtgtgtgtgtgtgtgtgtgtgttcaccttttaaacaatataaaagtatacagaacaaaacatgaaaatccccctttgtttccttccccatcttcaatggtctgatatacatctttccagttccctttctatgcatttacatacacatgtatacataaatatatatgatgtttctttgcatccactaaaattttctgcaaggttgaaagtgttctaaatctgtgctatgcaatatggtagctacatgggacagctgagcacttgaaatgtgactagtgtcactgagggactaaatttttaattttaagtaattcaaatttgtttaaatttaagtttttaattggcaacccaatgggaaagaagaaatgaaattttctctgtagacaacaagatcatatacatagaaaacccctaaagactccatgaaaaactgttaaaatgaaaatggtaaaagtgcaggatacaaaatcaacacagaaaaatcagtagcatttgtctatacaaacaataaactatctgaaaaagataaagaaaataatcccatttaaaataaaatagaaaaaatacttatgaataaatttaaccaaagaagtaaaatatctttataccacaaactatcaaaattgaaataaaaaaatgaaaaatacaaatacatgggaggatatgttcatggagttgaaaaattaatattgtcaaaatagccatagtacccaaagaaatccacagattcaacgcaattcctatcaaaattccaaggccatttttcacagaaatatacaaaaaaaaatcctaaaattcatatgaaatcacaaaagatcccaaagagccaaaacaatcttgagcaaaaagaacaaaaccagaagcatcattctatctgatctgaaaatttaccacacagctatagtaaccaaaatagcatggtagcagcataagaacacttatacagaccaatggaacagattagagagccaaaaaataaattaatatatttatggccaactgatgtttgacacaggtgctagtaatatacaatggggaaaggactagtctcttccatacgtggtgttaggaaaactggatatccacatgcagaagagtgaaattagactctcacatcatatatgaaaatcaactcaaaatgtatcaaagacttaaatataagacctaaaattgtaaagatactggaagaaaacacaggggaaaagcttcttgacattggtctgagcaaagattgttttggagatgacttcaaaaacacaggcaactgatatagtttggatctgtgtccccatccaaatctcatcttgaattgtagttcccattatgcccatatgtcaagggagggactgggtgggaggtgattggatcacaggggagtttcccctaagctgttctcataaaaatgagggagttctcatgagatctgatggttttataagtgacagttcctcctacacacactcttttcgcctgctgccatgtaatgcatgcctgcttccctttctgccatgattgtaagtttcctgaggccttcccatccgcagaaccattagtcaattaaacctctttcctttataaactacccagtcttgggtactatctttataacaatgtgacatcaggctaaaataggaaattagtaccacaaagaatggggtactgctataaagataccaaaaaatgtggaagcgactttggaactgggtgacaggcagagttggaacagtttggagggctcagaagaagacaggaagatgtgggaaagtttgcaactttctagagatttgctgaatggttttgtccaaaattttgatagtgatgtggacaatgaaatccaggctgaggtggtctcagacggaaatgaggaacttattgggaattggagaaaagatcactcttattcttttttttttaaattattactatactttaagttctgtggtatatgtagaggacgtgcagtattgttacataggtatacacgtggcatggtgctttgctgcacccatcaaccagtcatctacattaggaatttttcctaatgctatccctcccctagctcctcactccccaacaggccctggtgtgtgatgttcccatctctgaacacatggaacaatgaatccatgtgttctcattgttcagctcctacttacgagtgagaacatgtgatgtttggttttctgttcttgttgtttgctgagaatgatggtttccagcttcatccatgtccctgcaaaggtgatgaactcatccttttttatggctgcatagtattccatggtgtatatgtgccacattttctttttttttcttttttttattattatgctttaagttttaggatatatgtgcacaatattcaggtttgttacatatgtatacatgtgccatgttggtgtgctgtacccattaactcatcatttagcattaggtatatctcctaatgctatccctcccccctccccccaccccacaacaggccccagtgtgtgatgttccccttcctgtgtccatgtgttctcattgttcaattcccgcctatgagtgagaacatgcggtgtttggttttttgtccttgcgatagtttgctgagaatgatggtttccagcttcatccgtgtccctacaaaggacatgaactcatcattttttatggctgcatagtattccacggtgtatatgtgccacattttctaaatccagtctatcattgttggacatttgggttggttccaggtctgtgctattgtgaacagtgccgcaataaacatatgtgtgcatgtgtctttatagcagcatgatttataatcctttgggtatataccctgtaatgggctggctgtgtcaaatggtatttctagttctagatccctgaggaatcaccacaccgacttccacaatggttgaactagtttacagtcccaccaacagtgtaaaagtgttcctatttttccacatcctctccagcacctgttgtttcctgacattttaatgatcaccattccaactggtgtgagatggtatctcattgtggttttgatttgcattgatggccagtgatgatgagcattttttcatgtgtttttttggctgcataaatgtcttcttttgagaagtgtctgttcatatcctttgcccactttttgatggggttgtttgtttttttcttgtaaatttgttggagttcattgtagattctggatattagccctttgtccaatgagtaggttgcaaaaattctctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcccaggttttcttctagggtttttatggttttaggtctaacatttaagtcttcaatccatcttgaattaatttttgtataaggtgtaaggaagggatccagtttcagctttctactcatggctagcccgttttcccagcaccatttattaaataggggatcctttccccatttcttgtttttgtcaggtttgtcaaagatcagatggttgtagatatgcggcattatttctgagggctctgttctgttccattggtctatatctctgttttggtaccagtaccatgctgttttggttagtgtagcttgcagtatagtttgaagtcaggtagcgtgatacctccggctttgttcttttggcttaggattgacttggcaatgctggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggttcttcacatcccttgtaagttggattcctaggtattttattctctttgaagcaattgtgagtgggagttcactcatgatttggctctctgtttgtctgttattggtgtataagaatgcttgtgatttttgcacattgattttgtaacctgagactttgctgaagttgcttatcagcttgaggagattttgggctgagacgatggggttttctagatatacaatcatgtcatctgcaaacagggacaatttgacttcctcttttcctaaatgaatgccctttatttccttctcctgcctgattgccctggccagaccttccaacactatgttgaataggagtggtgagagagggcatccctgtcttgtgccagttttcaaagggaatgcttccagtttttgcccattcagtatgatattggctgtgggtttgtcatagatagctcttattattttgagatatgttccatcaatacctaatttctggagagtttttagcatgaagggttgttgaattttgtcaaaggccttttctgcatctattgagataatcatgtggtttttgtctttggttctgtttatatgctggattatgtttattgttttgcatatgttgaaccagccttgcatcccagggatgaagcccacttgatcatggtggataagctttttgatgtgctgctggattcggtttgccagtattttattgaggatttttgcatcaatgttcatcaaggatattggtctcaaattctcttttttagttgtgtctctgccaggctttggtatcaggatgatgctggcctcataaaatgagttagggaggattccctctttttctattgattggaatagtttcagaaggaatggtaccagctcctccttgtacctctggtggaattcagctgtgaatccatctggtcctggactttttttggttggtaagctattaattattgcctcaatttcagagcctgttattggtctattcagagattcaacttcatcctggtttagtcttgggagagtgtatgtgtcgaggaatttatccatttcttgtagattttctagtttatttgtgtagaggtgtttatggtattctctgatggtagtttgtatttctgtggaatcgatggtgatatcccgtttgtcatttttcatcgtgtctatttgattcttctctcttttcttctttactagtcttgctagcggtcaatcaattttgttgatcttttcaaaaaaccagctcctggattcattgattttttgaagggttttttgtgtctctatttccttcagttctgctctgattttagttatttcttgccttctgctagcttttgaatgtgtttgctcttgcttctctagttcttttaattgtgatgttagggtgtcagttttagatctttcctcctttctcttgtgggcatttagtgctataaatttccctctacacactgctttgaatgtgtcccagagattctggtatgttgtgtctttgttctcgttggtttcaaagaacatctttatttctgccttcatttcgttatgtagccagtagtcattcaggagcaggttgttcagtttccatgtaattgagtggttttgagtgagtttcttaatcctgagttctagtttgattgcactgtggtctgagagacagtttgttataatttctgttcttttacatttgctgaggagtgttttacatccaactatgtgttcaattttggaataggtgtggtgtggtgctgaaaataatgtatattctgttgatttggggtggagagttctgtagatgtctattaggtccgcttggtgcagagctgagttcaactcctggatatccttgttaactttctgtctcgttgatctgtctaatgttgacagtggggtgttaaaatctcccattattattgtgtggtggtctaagtctctttgtaggtcactaaggacttgctttatgaatctgggtgctccagtattgggtgcatatatatttaggatagttagttcttcttgttgaattgatccctttaccattatgtaatggccttctttgtctcttttgatctttgttggtttaaagtctgttttatccgagactaggattgcaacccctgcctttttttgttttccatttccttggtagatcttcctccatccctttattttgagtctatgtgtgtctctgcgtgtgagatggggttcctgaatacagcacactgatgggtcttgactctttatccaatttgccagtctgtgccttttaattggagcatttagcccatttacatttaaggttaatattgttatgtgtgaatttgatcctgtcattatgattttagctggttattttgctcgttagttgatgcagtttcctcctagccttgatggtctttacaatttgtcatgtttttgcagtagctggtaccggttgttcctttccatgtttattgcttccttcaggagctcttttagggcaggcctggtggtgccaaaatctctcagcatttgcttgtctgtaaagtattttatttctccttcacttatgaagcttagtttggctggatatgacattctgggttgaaaattcttttctttaagaatgttgaatattggcccccactctcttctggcttgtagagtttctgcagagaggtcagctgttagtctgatgggcttccctttgtgggtaaccagacctttctctctggctgcccttaacattttttccttcatttcaactttggtgaatctgacaattatgtgtcttggagttgctcttctcgaggagtatctttgtggcgttctctgtatttcctgaatttgaatgttggcctgccttgctagattggggaaattctcctggataatatcctgcagagttttttccaacttggttccattctctctgtcactttcaggtacaccaattagacatagatttggtcgtttcacatagtcccatatttcttggaggcgttgttcatttctttttattctttttttgtctaaacttctcttcatgcttaatttcatttgtcttccatcactgataccctttcttccagttgattgcatcagttactgaggcttgtgcattcatcgtgtagttctcgtgccatggttttcagctccatcaggtcctttaaggacttctctgcattggttattccagttatgcattcatctaatttttttcgaagtttttaacttctttgccattgatttgaacttcctcctttagcttggagtagtttgatcttctggagccttcctctctcaactcgtcattctccgtccagctttgttccgttgctggtgaggagctgcgttcctttggaggaggagaggcactctgatttttagagtttccagtttttctgctctgttttttccccatctttgtggctttatctacctttgatctttgatgatggtgacgtatagatgggtttttggtgtggatgtcctttctgtttgtcagttttccttctaacagtcaggacccttagctgcaggtgtgttggagtttactggaggtccactccagaccctgtttgcctgggtatcagcagtggtggctgcagaacagcgggtattggtgaactgcaaatgctgctgcctgatcgttcttctggaagttttgtctcagaggagtacccgggagtgtgaggtgtcagtccgcccctacttgggggtgcctcccagttaggctactcgggggtcagggacccacttgaggaggcagtctgcccgttctcagatctccagctgcatgctgggagaaccactactctcttcaaagctgtcagacagggacatttaagactgcagacgttattgctgtcttttgtttgtctgtgccctgcccccagaggtggagcctacagaggcaggcaggcctccttgagctgtggtgggctccacccagttcgagcttcctggccgctttgtttacctactcaagcctgagcaatgcggtcgcccctcccccagcctcgctgccaccttgcagtttgatctcagactgctgtgctagcaatgagcgaggctccatgggcataggaccctccaagccaggtgcgggatataatctcctggtgtgccgtttgttaagcccgttgggagggcgcagtattagggtgggagtgacccgattttccaggtgccctctgtcacccctttctttgactaggaaagggaattccctgaccccttgtgcttcctgggtgaggcgatgcctcgccctgcttcggctcacacacagtgcactgcatccactatcctgcacccactgtccagcactccccagtgagatgaacgcggtacctcagttggaaatgcagaaatcacccgtcttctgcatctctcacgctgggagctgtagactggagctcgccaaattttctttatccagtcatgctggagaggttgtagagaaataggaatgcttttatactgttggtgggagtgtaaattagttcaaccattgtggaagacagtgtggagattcctcaaggatctagaactagaaataccatttgacctagcaatcctattactgggaatatacccaaagtattataaatcattctactataaagacagagagacacatatgtttatggctgcactattcacaacagcaaagacttggaaccaacccaaatgcccatcaatgatagactggccacgttttctttatccagttcttgtgatggtttgctgagaatgatggtttccagcttcatccatgtccctacaaaggacatgaactcatccttttttatggctgcatagtattccatggtgtatatgtgccacattttcttaatccagtctatcactgatgggcatttgggttggttccaagtctttgctattgtgaatagtgctgcaataaacatatgtgtccatgtgtctttatagtagaatgatttataatactttgggtatattcccagtaataggattgctgggtcaaatggtatttctggttctagatccttgaggaatcaccacactgtcttccacaatggttgaactaatttacactcccaccaacagtataaaagcattcctatttctccacatcctctccagcatctgttgtttcctgactttttaataatcaccattctaaatggtatgagatggtatctcattgtggtttggatttacatttctctaatgaccagtgatgatgagcttttattcaggttggttggccacataaatatcatcttttgagaagtgtctgttcatatccttcacctgatctttgatggcgttgttttatttttcttttaaatttgtttaactttatagattctggatattagccctttgtagattccggatattagccctttgtcagatggacagattgcaaaaattttctaccattctgtaggttgcctgttcactctgatgatagtttcttttgctgtgcagaagctctttagtttaaatatatcccatttgtctattttggcttttgttgccattgaatttggtcttttagtcataaagtctttgcccatgccaatgtcctgaatgttattgcctaggttttcttctagggtatttatggttttaggacttacgtttaattctttaatccatatgagttaatttttgtataaggggtaagaaaagagtccaatgttggttttctgcatatggctagccagttttcccaacaccatttattaaataaggaatcctttccccattgcttgtttttgtcaggtttgtcaaagatcagatggttgcagatatgtggtgttatttctgaggcctctgttctgttcattggtctatatacctgttttggtaccagtaccatgctgttttggttactgtagccttgtagtatagtttgaagtcaggtagtgtgatgcctcaagctttgttctttttgcttaggattgccttggctatgcgggctcttttttggttccgtaggaaattgaagtagttttttccaattctgtgaagaaagtcagtgttagcttgatggggatagcattgaatctataaactactttggtcagtatggccgttttcatgatattgattcttcctatccatgagcatagaatgttttcccatttgtttgtttcctctcttatttccttgagcagttgtttgtagttctccttgaaaaggtccttcacatcccttgtaagttgtattcctaggtattttattctctttgtagcaattgtgaatgggagttaactcatggtttggctctctgtttgtcagtttttggtgtataggaatgcttgtgatttttgcacactgattttgtatcctgggactttgctgaagttgcttatcagcttcaggagattttgggctgagatgatggggttttctaattacacaatcatgtcatctgcaaacagagacaatttgacatcctcttttcctatttaaataccctttatttctttctcttacctgattgacctggccagaacttccagtactatgttgaataggaatggtgagagactgcatccttgtcttctgctggttttcaaagggaatgcttccaatttttgcccattcagtaagaaagtaagggatatttgagggctttggggtaataattattttcttcctacaggagttgaattattagaaccttttcattatcaaattttgtccttaaactaaaagttaaaatctgttattctcattgggattgattttctgtttcttgctttacctcaacaacccctttggcgaaggtctattgaataattcaagaattctttctaaggtataaaacaagtcaagatggctagccccagctccttggtcccattcagtatgattggctgtgggtttgtcataaatagttattattttgagatacattccatcaatacctagtttgttgagaatgtttagtgtgaagggctgttgaattttgttgaaggcatttcctgcatcgattgagataatcgtgtggtttttgtcattggttctgtttatgtgatggattatgtatattgatttgcatatgttgaaccagccttgcatcccagggatgaagctaacttgatcgtgctggataagctttttgatgtgctgctggatttagtttgtcagtattttactgaggattttcgcatcaaagttcatcagggatattggcctgaaattttcttttttttgttatgtctccgccaggttttggcatcaggatgatgctggcttcataaaatgagttagggaggattccctctttttctatttgttggaatagttgcagaagaaatggtaccagctcctctttgtacttctggtagaattcggctgtgaatctgtctggtcctggactttttttggtcagtaggctattaattactgcctcaatttcagaacttgttattgctctactcggagatccaatttcttcctggtttaaacttgggagggtgtatgtgtccaggaatttatccatttcttctaggttttctagtttatttgcatagaggtgttcatagtattctctgatggtagtttgtatttctgtgggattggtggtgatatcctctttatcattttttattgcatctagttgattcttttctattttcttctttgttaatctggctagcggtctattttgttgatcttttcaaaaaccaggtcctgggttcacagcgttcaaactttactaaggatcagactgcttcctcaagtggttctatgatctcgggtatactgaatgggagatacctcccagtaggagccgacagacacctcatatgggagagctctggctggcatctggtgggtgcccctctgggttgaagcttctagaggaaagaacaggcagcaatctttgctgttctgcagcctcctctagtgatacccaggcaaacagggtctggagtggacctccagtaaactgcagcagacctgcagcagacgggcctgactgttagaaggaaaactaacaaacagaaaggaatagcatcaacataaacaaaagtacgtccactcagagaccccatccgaaggtcaccaacatcaaagaccaaaggtagataaatccacaaagatggggatagaccagcgcaaaaaggctgaaaattccaaaaaccagaatacctcttctcctccaaaggatcacaactcctcgccagcaaggaaacaaaactggacggagaatgagtttgatgaattgacagaagtaggcttcagaaggtgagtaataatgaactcctccaagctaaaggagcatgtcctaacccaatgcaaggaagctaagaactttgaaaaaatgttagatgaattgctaactacaataaccaggttaaagaagaacataaatgacctgatggagctgaaaaacacagcacaagaacttcatgaagcatacacaattatcaatagctgaatcgatcaagcagaagaaaagatatcagagactgaatatcaacttaatgaaatgaagcaagaagacaaggctagagaaaaaaagaatgaaagggaatgaataaagcctctaaaaatatgggattatgtgaaaagaccaaatctacatttgattggtgtgcctgaaagtgactgggagaatggaaccaagttggaaaacactcttcaggatattatccaggagaacttccccaacctagcaagacaggccaacattcaaattcaggaaatacagagaataccacaagatagttgtcaagtatctactttgtcaagtagagcgaccccaagacacataattatcagattccccaaggttgaaatgaaggaaaaaatgttaagggctgccagagagaaaggttggattacccacaaaggtaagtccatcaaattaacagtggatccttctgcagaaactctacaagccagaagagagtgggagccaatattcaacattcttaaagaaaataattttcatcccagaatttcatatccagccaaataagtttcataagtaaaggagaaatagaatcctttacagaaaagcaaatgctgagattttgtccccaccaggcctgccttagaagagctcctgaaggaagcactaaacatggaaaagaagaccggtaccagccactgcaaaaacataccaaattgtaaagaccatcgacactatgaagaaactgcatcaactaataagcaaaataaccagctagcatcataaagacaggatcgaattaacacataacaattgttgcctcagagggtgcaagtcccaagctttgacaacttccacatggtgttgggcctgcgggagcacagaagtcaagaactgacatttagaaacctctgcctagatttcagaggatgtatggaaacacttggatatccaggcagaagtttgctgcaggggaagagctctcatggagaacctctgctaaggcagtgtggaaggaaaaaatgtagggtaggattcctcacacagagtccccaatggggcactgcctagtggagctgggagaggagggccactgtcctccaaaccccagaatgatagatccactgacagcttgcacagtgtgcctggaaaagctgcaggcactcagcaccagcctgtgaaaacagctggggaccgggggtgccccaccttgcaaagccactggggcagagctgcccaagtccctgtaagccaacctctttcattagcatgacctggatgtgatacatggagtcgaagaagatcagttcagcgttttaatatttagtgagtgcctcacttgattttggatttgcatagggcctgtagcccctttgttttggccaatttctcccatttagaacaggagcatttacccaatgcctgcaatcttatcatatgtaggaagtaactaatttgcttttggttttgcagcctcataggcagaggggactagtgttgtctcagatgagacttcggactgtggacttctgagttaatgctgaaatgagttaagactttggggtactgttgggaagatatgattgattttgaaatataaaaagtacatgacatttgggaggggccagaggcagaatgatatggtttggctctgtgtctccatccaaatctcatctcaagttgtagtccccataatccccacatgtcgagggagggaccagctgggagatgattggatcatggaggcagtgttccctaggctgttctcatcatagtgagtgagttctcatgagatctgatggttttataagtgtttgatatttcctcctacacacactcttctcttgcctgctgccatgtaagacgtgcctgctttctcttccaccataattgtaggtttcctgaggcctccacagtcatgcagaactgtgagtcaattaaacctctttcctttataaattacaggcttgggcagtatctttatagctgtgtgagaatatactaatacagcaaataaagcaaaaatacacaaaatatcaatctaaaaatcttctacacagcgaaggaaacaacagagtgaagagacaacctatattgaaagaaaatatttataagccatacatctgataaggggctcatagccaaaatatataagcaactcaaaaaactcaatagcaagaaaacaaacaacatgattaaaaatgggcaaaggacttgaatagacatttcttaaaagaagacatataaatggcaagtaaatacatggaaaaatgctcaacactgctaattattagggaaatgcaaattaaaaccacaatgagatatcacctcacaccagtcagaatggctactataaaaaaggtgaaagataaatgttggcaagggtgtacagaaaagagaactcttgtatatcattggtgggaatgcatgtaagcacagccattatggaaacttatatgaaagtttctgaaaaaactaaaactagaacttccatatgatccagcaattccattcctgggtatacagttaaccgttgaacaacatgggagttagggatgctgactctcacggcagttgaaagctcatgtataacttttgactccccacaaactttgctactaatagctttctgtttactggaagccttactgataacatagttgttaaacacatattttttatgttatatgtgttatttagtatattcttaaagtaggctagagaaaataaaatgttattaaaatcataagaaagataaaatatatttactattcattaagtggaagtggttcatcataaagcttctcatcctggtcatctttacattaagtaggccgaggagaaggaggaagaggagggggttggtcttgctctcccagtggttgcagagttggaggaacatctctatataagtgaacctgcacagttcaaactcatgtcgttccagtgtcaacagtatttacaaaggacatgaaatcagtatgtcaaagagatatctgcacttgcatgttcattgcagcattattcataataaccaatatatggaatcaacccaagtattatcaacctaagtatttacctgtggaagaatggataaagaaaatgtgatacacacacacacacacacacacagtggaatattattcagccttaaaaagcaaatgaaatcctatcctttgtgacaacataaataaacctagaggacattatgctaagtgaaataagctatgcactgaatgacaaataaggcataatttcacttatacatggaatctaaaacagttgatctcatagagccagagagtagaatggctgggggtggggaatgggaaatggggagatgttggtcaaagggtataaagtttcagttagataggaggaataagttttttgagatctattacacaacatgaaggctatcgttaataatcatgtctatttcaaaattgctaagacagtaaatttcaaatgttcttaccacaaaaagtgataagtatttgaggttatggctatgttaattaccttgctttaatcattctacattgtatatatatgtgtgtgtgtgtgtgtgtgtgtgtatataatcagattgtaccccataaatatatacaattataatttgtcagtttataataaaataaataattaaaaaataaataaaatttaagttttagtagccatatatggcaattggctatcatattacgcagtgcagatcaaaatagtagggaccaggaacttagaaaacagcaacagtgtgagaaatataactatgggtactagggtaccagtgttttactagagatgcatcatctcactttatcttcacaatcctattattaacagatttttaaaaaaaccctcaggcatagagaattttagaaagttgtccaagacagaaggcattagagtgtggattcaaattcagacaatatagctccagaaagtacccccctgagtttaagcatgtgggaaatcatgtgataaactggaaatggcataagttttggtatagagaaaactaattttggatcttcatcctgccacttattggactctgtgtgacattaggcaagtcacctatcctctctgattctttattataaaacctataatatgggactcacaatacttctcaccatcaatgggatatacactttaatatatcatatgttatttccccctcttccatcttccctatcaaataagtttgcctttggggcaaaactacctatagtaggggatgttttcactggccatgaaacagattaaaattaactgagattaaaacagatcaaaattaagcaaacacattattccttgtgggccagggcttattatcacagaattctagatagctgagctaattgaagggcaaagaagtctctggaactaccacactgaatgtaaggataaaggcaaggagcagtttggtctgctgcagattaattggctaatgcctatggtttgtaatcagattgtggttcaagttctagttctaataattactacttgtgtgaccttgggaaagtcacctaccctctttctctctgttttctcatatataaaatgggggtaataaggaagttccagagactttcttgcctttcagttatctcagctgtctagaattatgtactaattacatgttgtcttgtaacctttgaggaaagataatatgtaaagtctatttccctgaaattcagagctggagttgcttttgtgttcttgatttcttcaattttcttatctctgaaaaaaatgttggcacttctgcctatgtggtttatgaatcctgccatagttcgattagagtaatgtatttttgtaacacatttgaaccacatgcttgtgacatactccattgcatgactctttcgttaagatctactggaaatgtcagagtctctttaaaggcagttgttaaacattaacataagaatgtttgttaaactcttccagaaaaggatactatgtaaatcataacatcatttaaattggtcaaccactattaattcaggctaattgtggaagagtccaagctgaactgctgataaatctaaagagtacagtatatataaaggagtgctagctagctggtgatgagtaagactcatggtgggcctactttaatgaaagatatcattcatttgtaattgtaatcactataataatggagtggaattaaagtaattgaaagcacagtttggtctattaagtagtttgaatattcctctagcatttctgtttattccattaattttcttagcaatatcctttcatagatatatcctttcatagatattgcaaggtcaacttaagcccagcctgggtccaaatgatcacaaaacttgagtttattaggtccacattaatgaggacttattataatgataaatctataaagatcaaaacctggggcaggctatcggttatgctatctcttatttaattgctttggtttttttctattataaatttcacctttcataccactctacacatgatgttgggattagaacagtctcctgagaacaccataactaaatgtgtatgcttaaatagagacccacttattggtgccagttaatccttaatgaatgtaacatcaataaagtaggtaataaaaaaagttaaattttattgctaatcttaaatcctactttaaggagaagaaaaaccttaatgctatggctagagttgagtagcactagattagcattggtgtacattaataatgaaaatagctgagccccattagtgtcacttaaagttttgtgaattagagatatggccctacaaattaaacaccttgaatactgaatgggggaataattattatttaaaaagttaaaaccttcacatctcttctaaaggaaaatttttcattggtatagaattacataccattcactctacagtatgaaaaggatggaactttgcagaccataaaaagtataataaaggagccactaaaattgatttttatttaagcagattactagtgttttcttccttaactggaaggagtgccctgtactcctccaacctattttcagccatgatactatttctacatgcataattagacactgacccctttgaggaagtttaaatgtcccttattatccccaacctcaactccaaaacctttttcagccaagcaagagaataggaaatatatagaaatgaatgtgcaaaactttccaacatgtgtgcatatagaacaaattgtgaggtcagtgaagtgagtccctattttccttcttactctgtatgcttctttgtctccaaccatgcccaacccagtagtttcctctgtagcccagggtcttctacgtcaatgccctaaaaaagcctgcactccccttccccacctcattttccatcccctactccgcctccacaaaacttacttgttctgagtcaattttatcagatccctgctgtctttcaagagtgttattagtagtagtaatggcagtaggaggaatcatactataacaaggaaaactaatagccagtgtgagtataatgactgttatattatgctccaggcactctgcaagcattttacatccagtacttcatttaatcctcacttttacagatgataaaattgaggcttagaaagagtaagtgtcttgtctaaggtcccacagtgaataagaggactcactcttgtttgtttgttgtagctcttaactgctacaactctatactgcctacatagttttaggaaaagcagtaagagttaatatcccagaaagcattttgaaaaaagttaaaatggttgttccctcctaaaccatttgtagttcattatcggactttgctgtattgtcttatttttaaagtagggggatgggagagagtaaggaagagggaggaaaagaaaggaaggaggataaagaggaagaactgactttcaggccagaatggatactttgccttagtcaaacatccgagtacataatatctaggcttcttattctccttgacaagatgcaggccagtaatgccatgaaactggcataaatacagttgtccctcagtatctccaaggattggttccaggacccccacatattcccaaattcttgcatattcaagtcccacagtcactgctctgtagaacccacatatatgaaaagttggccctctgtatacacaggttttgcttcctgcaaatactgtattttctatgtttaactgggggaaaaaagtatgtataagtagaactgtacagttcaaacccatgtttttcaaggatcaaatatattccccatctccctttcccatccactcacaaattcctggtccaatcacttgtggctgaggtagcaggattggtttcacacaatataaataatagcacattgtgtgagaaaaaaactgtgggacactttccttaaaagttctatacatacagacatagcaggcctctgaggttacctcaacttctcttagagcctatcaagtacaaatatgtatgattctcttagggcttaattagtgggtggacaatataaaagttgaggacatcctccaaatgacagaaagggtggccttatctcaggaatgagagttcttctagccctaagactaatgccatgaaatatttgctactacacctttgcttctttctcatttccaaatccagtactctctcccaggtacactctggggtcttattggtttcatctaaagttcctaatcagccattaatgattctggctccctgaatgtaaaatttcttttgttttctttaatatgaactgtgaggactcaggatccagctggccctagatacttagggaaactattgagctctgctttggtggcaattgccttggctagttgaaagctctgtttagttccccatctgtgtttgtatgtgacttatataaattagttacttttgaaattgcaggtggttttaaaacaaaaactcgtattctaagtaaaaggataagtgagggctataccttctgaaactaacctgaagtaagtaatcttgtatcagtttcctgatcatactctagctttcttctccaactggagtgaccctttacaagacatggtctgaagctttttgcaaagacagcctcttctcaaatgtatacctggcagtaattttcccatgaatggtcttgatgctaacaatgtctgattcatctgcctttttattctcttctgttactaactcactagaaataatctctgacaaagtccacatgtatgagaattagccttagaacaagagaagccaagacattggctattagatgttagggtgatcaaccatcctggttttcccaggattgttccaagattaacactgaaaatcttgtgtcctgagaaaaaccctagcccaaagcaaaccaggatggttagtcaccctaccagatgtacatgtaggctatatggtgtattagaaagaacactggtcttcaaaagtctgagcccaagtcttactactgtcacttattatgttaaccatatagtcttctattttttcataatacttatcagaattttaattttgtattttgatatttatttgtttagtgtttgtctttctcattagaaggtgagccccatgagtgctagagtcatatcttgtttgttccccattacaactccaacacttacaatgcctcacaagaagtaggcactcaacacttatccattgaattaataaattagtaagtcacgactgctctagttttccattttctcatccataatggagacattacttacttccagtagttgtgaggaattgagacaatgtgtatgtaaaagagacaatgtgtgttttgtaaaccatacacaaaacattattaatgatggtacttatgatgtgtgcttgataataatatctgtcttttattgaggaacctattcagtggtaggccttttcaatgttttttttatttcattgttatcgtccttcatataggtaggttggtattttatccccattttagaaattagaagattgagtttacaaagaattacggccaactacaaggctagagggcacagtctccaagactgcactcacttctgacaccaactgcaactttggatgattcccaaaaccactcttatgtaggataaatcactagaaagactcatagaacttactgaaagctatcatactcatagttatggtttattgcagggaaatgatacaaattaaaatcaaccaagggaagaagcacatataccagaatccagaagtactaaatatagagcttccattttcctctctctgtggagtcaggacatgttactctcctggcatccttatgtgacagtgctcatggtgtattaccaaccagggaaacttacatgagccttgttgttcagagtttttattgagactcgattacctaggcatgactgatcatttgcccacatagttgatctcagtttctgggtagactgataccatccaatccaaagctcctactccaaatcacattgttagtatctgtctatcataaggcccctaagcaaataaaaattacctcctgggagctgagggcaaaggccagacctcttttggagcaattttaaattctttcttacagaaaggtgcagagaggtcaatcaacttgccaaaagttgcacagctggcacatgtacaccctagtcagcctccctctagtgcccatgctattattttccattgtgtgccctgtgtgcctgaaaaacaatgcagttttaatgtgctataaaataatgtataaccctatacatagaataaagaaaggcctaactggaagtaaaaaaaaataataggcagaaattgtactactttctcatctacctttttcctctcatagctctcaaatttgaaccttcctttattccttgaaccataacataggcccatacttggaaaagtgcaaagtggacaaaagtgggtagaaagtttgtctagggtatgcttccactctaccaacctcccctcttgtgcactagggcttataaataccctcatatgtgcacacatgcatgcacacacagaaacacacacacacacacacacctcaactcacaaaggggcctattttttatggtctgtctaaaaaattcaattttatgtgttaaataaaaattggaaatccttcctacggccatttgcttttaaatatgagcttcttaaacatagaataactatgatgacaaagaaattaacatcatttgatgagatttataatagggatttgtggttatagagtctccctgtgtctccaatcacagtatagccagccatcccatacatttgtgtgctagaagctggagaagggtgtggaaaaatgacaagtaataacaggagagggaaacaagaaaggaaggagggatactctgaagctctgaagtaatctgtacctattcagaagtggagaacagaattcaaggggccacattacatggaacatcatccaaagtttagataaaccagagtaagcctagcgaagactgaaagagaaggcaaagggtttggtacagccattttatttgttatcttttagatggaggagaaggagtgcaaaattatagctaacctactacagtggctagcagtagaaacagcacagaccttagagcgaggcacaccagagtttaaattccaactccaccgttaactatgtggccataggaaaattattttgcttctccaaccctcagtctcctcacttgtataattgatgctaatactaaaacacatctcctaggacccttaaaagagattaaataaggtaatgtatgcacagtatctctgaggtcagttaccaggtctttgaggtcagtattgcctggaatccttacttggcaatgggtagaggtgcaagtctgatgactagagcatgtgctgagccacctcctcagatgtggcaaaatgtgagtaaagctttgttatcctacttggtacaatggaaatatcttgcattatggggtcaatacattcaggtttcaatccaggctatgctactttcaagctatgtgacctacaggaaaatgtttagcctctctgtgactcagtttccttatctgtaaaatgggtaatagcacacatagcttgcaagttctgtaaaggacctatcccaatatattgctttcttatgctccacagtgtttccagagaccaaagaaagagcatcttcataaacagatagatccaataaaatattttcatgtaaactacatatcatacatatgcatatatatacaagatgtatatgtataaaaatatatacatacattgaaaaaattctttccttgagtaatagtggcaccaccctagttgaaatcaattgaccataaatgtgtatgtgtgtgtgttttctagactgtcagttctactccattgatctatgcatctatccttttgccagtattgcactgttctgattactatagctttgtaagttgtgaaatcaagaagtatgatactgcaaattttgttctttttttcagattgttttggtcattgagtctcttgtaattccacatgaattttaaaattaacttgttcatttctgcaaaaaaaaaggcagttggaattttgatagggattgcattaaatctggagatcactttaaagagtattgccatcttgacaacattaagtcttccaatctatgaatacaatgtcttacagcttacttaggtctttaatttcttttggtaatgttttacagtacttagtgtgcaggtcttgcacctccttgattaaatttattcctaagtatttttttcatgctattactaatgggattgttttcttaaattcattttcagatccttggatgctactattaatatatatttttgtataccaatatcgtatcttgcagctttgctaaactgttagctctaatagcttttctgtggattcctgagtattttctatatacaagatgtttctatatgcaaatagatagttttacttctttttttccaatatggatcatttttattccattttcttgcctaattcccttgcctgtcaccctgtacctccagtacaatgttgaatagaagtgaggagagtaaaaattcctgacttttttctgatgtttggaggaaacatttcaatcttttaccactaagtatgcttctagctttgtgtttttaatagattacctctattggattgaggatgtttctgtctattcttagtttgttgagtgctttttattatgaaaggttgtcagattttgtcaaattattttcctgcatctattgaggtgatcatatttttttcctttttattaatattacaaagctacagtaattatgactgtgtggtaatggcataagagtaggcataaagttcagcggaatagaattgagagtgcagaaataaactcatatatctatgtcaatttttttttacaaggatgccaaaagcattcaatgggaaatcaatagtcttttcaacaaatagtgctgaaacagctggatatccacatgcaaaagaataaatttggaccactttctcatgccatatacaaaaacgtaaactagctcaaagaggtagatataagagctaaaacaataaaactctcagaagaaaacataggcataaatctttgtgatctttgattggacaatggtgtcttaaatatgacatctaaaacacaagcaaccaaagaaaaatacataaatgagacttcataaaaattaacaacctttatgcatcaaaggacactagcaagaaaatgaaaagatcgcccacagaatgggagaaaatatttacagatcatatatctggcaagagtctagtatccagaatatatcatgagctcttataactcaacaatgaaaacacaccttaaatttttaaaaaggcaaatgatttgaatagccatttctccaaagatctacagatcaacaataagcacatgaaaagatgctcaagatcatcagtcattagggaaacacaaagtaaaatgacaataagatatcatttaatatcacatggaatggctataataagaaaagaaaaagaagtattggtaagtatgtggagaaactgggaccctcatgcattgctgatgggaggtaaaaatgtatacccattgcagaaaacagtctggcagttcctcaaaaagctaagcctagagtgttatcatatgaccctggcccaccaattatactcttgggcatatatccaagcaaaatgaaaacatatatttatacaaacacttctacataaattttcatagtagcattattcatattcataacagccagaaagtggaaatatcccaaatgtccatcaacttatgagtgtataaataaaatgtgttataaccacacaatggagtattttgacataaaaagggaattaaataatttatacatgatataacatggataaaccttgaaaacattatgctaagtgacaaatatcagacagaaaaggccacatattgtatgatttcttttatatgaaatgtccagaataggcatagagacaaaaacttggttagtggttgccagaggctgggagaaaggggaaatgggctgcgactatttaatggacatgggtttctttttgaggtaatgaaaatattctggatttaaatagaggtgataactgcacaatctcgtgaatatgccaaagccactgaattgcacactttaaacatacaaattttatgttttatgagttatgtattaataaaaaagttaatttttaatccaaaaagcactttgagaaaaaaattaaaaattaatatgtgtcagaaaaaaatacggacaatacaaaaatctatcacttgccctaactcttgccaggtgtatctgtgatactttaggctgcccaaccagcctttcacaagctgtagcagtttcaagatgccagggctggcagggcacagtggctcatgcctgtactcccagcactttgggaggccgaggcgggcggatcatgaggtcaggagatcgagaccatcctggctaacactgtgaaaccccatccctactaaaaatataaaaaattagtcgggcgtggtgactggcgcctgtagtcccagctaccgggaggctgaggcaggagaatggcatgaacccgggaggcggagcttgcagtgagccgacatcgcaccactgcactccagcctgggtgacagagcgagactcagtgtcagacaaaaaaaaaaaaaaaaaaaaaaaacatgccagggccccctcagagtattggcccaggtccaagctaattcagactgtgtgaaccttttcttctttctttacaacagaaattagcaagggtgtctcatttccaggaggggaagtacagaaaagagtactgtggttatatatctccaaagttagctaagatgaagctgcagattcaagattaagcaacattaaatttcagctgaaattgtatatctgtctgctgccactttataaaatttttcacttaagatgacacaaaagcctatttattgagttgtgtacaccattaaagtttaaaagtttgacatgcatatgctgttttttgtgtggcagtaattaactgtaattgaaaaatatcccattttttatggttctctgaattttcagtgatcttttcccctccctccttcctctcctctaactctgactgcttcaccataacataatcctcccctgccccacattcaagctactttaatagaaatgtaagcaatttaagtagggtacccgttacgtcacaaggttttaaaattattaaggctcctactctcctagtcgggtctatctttgagatatgtgactttatgcctggaaccatgggggagtggagctgggaaatatacccatcacatagaagaaaagggctctgttctataatattccttttgtccatctcaccttctctaagaatggaacataaacctcattcaagaaagatgtgtgaaaaacacttctgagatagcatatagtagaagaagtgtctatgccttcatcaggatccctgagaggtgaaatgtcctttttatagctggccaattctgaattttaatattatctccttcaaggagactcaggcctccttgctaaagcacagcttataattcttccacttgtactttctaggcaggatttttataactagatctacttttcttcatcagtctcttgctttctggcttcactcatttcatctccggttctacccataattcttggctgaattcccacttgatcctactactggtcataacctaccaggaaaaatccccatgggacatcattcactctgaaatatttttgtcttgcctcagagtcacagaaatttcgtcacctaagcaaggaaaatatattttcaaatagtaacatggtgtctgcctggacacaatttaaaataactcttaggaaaatctctgatcttgtattcccaaatatttggatatattttgatctgcaggtcttcttcatgctgttcatactttgtatgaaaggagtgtgcttcacaaagcatcagactgaatacaagaaaatcaatacgcaatctgtgtgataattaattaaggtgccagaatgaatgactttttcttccccttctgatttgggtcagagtcgtgtttgatttgggaagttgtccattttcaattatggtttgttctgtgttctttttatgtgaccagaatgaatgactggcagaaaatcatgttatggcaaaaatctatgggataagtttaacacgctgaagatgtggtttggcaaaagttatttccaagaaaaggctgataaatcagagtgagatcgtttaggagaaaggcatacctacatgtataggtaagactgtgatgaagccaactttattctctgtgcattgttttcagttttcacatacagtcattaagcaaacatttggtgagcaaatactctatgtcaagcattgtacaacgcactagaggtgcagctatgtataagaatgttgtgcgttcagaaaatttctaacaagggagagcaacattaaacaaagagtcccacacataattcattaagtacaattttttgtagtgctacaaagaagtatacagtagttccccattgtatcagtctgttttcatgttgctattaaaaaatagctgaggctgggtaatttacaaagaaaagagattgaattgacttatggtcctgcaggctgtacaagcatagtacaaacatctggtcagcttctaatgagggtctcaggaagcttacagtcatggcagggggtaaagcgggagcaggtacatcatttggcgagagcaggagacgggtgggagaggtgccacatactttttttttttttttttttttttttttttgagatggagtctcgctctgtcgcccaggctggagtacagtggcgcgatctccgctcactgcaagctccgcctcccgggttcacgccattctcctgcctcagcctccttagtagctgggactacaggcgcccgccactacgcctggctatttttttttgtatttttagtagagacggggtttcactgtgttaggcaggatggtctcgatctcctgaccttgtgatccgccagtctcggcctcccaaaatgctgggactacaggcgtgagccaccgcgcccggccgccacacacttttaaacaaccagatcttgtgagaactcactcactatcatgaggacagcaccaagccattcatgaggaatccacccccatgacccaaacacctcctaccaggtcctacctccaatattggggattacatttcaacctgaggtttggaggagacaaacatccaaacctcatggatttttggatgatgacaaacatcatcccttatctgtgtttcactttccatggtttcagttattcatggtacagtacaataagatattttgagagagagagaaaaatagaatacattcacgtaacttttattacagtatattgttatagttgttatagattttattattagttattgttgttaatctcttactgtgcccaatttataaatgacaattcatcatagatctgtatgtagacgaaaaacatagtatatataaggtttggtactatccacagtttcaagtatccactgggggtcttggaatgtatcagccacagataaagaagaactactgtaccttgtctagctggatttttccataactctaaagttactattcagactaaagccaggaaacatccagaaagctttctatggccttctgtacatgaaggctaagggcataaataaataatggatggagggattccttctcagggataaagtgagaggtctggtgacctcagtttggggtctagagtatcagacaatgtgccccaaccaaagaaagcactcaataatgtaatgcagctcattcccagtccaaagctcagcttcctttatgcttattttacttggtgagaactagttctcattgaacattgcccagagacaggttgataatgatgatcaagaacaggctgttagtgaactccagaggtggtagggctgatgacagacctaattctctggcaaggggatggccttaatgtctattaataataattctggattgcttggtgttaaaaatatcaggatgattgaatgaaggaggctagagaacatctataagtgaacagggtcctattcattctggatgatataggcatcaccagcctgaaggcaggggacctggaacagatctcttcaggtataagattctgtgaagtttaacttgctgaaggattaacactcctagaagaatggctgaatgccaattccactttccttaaatgtgcattgaaatagtacttgctggtgccaatttattcttagctctgtgggcctgcccatggatatttcacatagaggggaacattacttatatttgatgcaagggtcccagcctaaaggtgctcacagttttcataactcaatttagtgtaattatactcaacttagggaatgaacaactcccgattcctctccccagtgggcacatgattaattggcttagtgacgaaaaaaatggcttcaacacagacctaagctctagtgggctcccagaagattaggttttaaatttcgatagagtttacttggccctctgtcattaaactgggataagtcaagtttaaaaaccaaggcctttttatatcagcaagggcagaaaaaccctaaagtaaggacaagagtttatctagcatatatgccagacagatgccaaatgccagttgactagcacatctttatggggaaggatgccgcattttaataattagccccattttagaataattggcatgtagaatctttttgagatcctttggagataacattttttaggagtcattctgattctatttgcatgttaagcccttaccagtatctacttggtctgggctgttgcaaatgtaatgatcttagtcatgttcagtcatttgtgtaaccaatatactatatacgtaagtgtatttgtagccatctgagcatgaatgcatgtttcactccctttgtgagaatttggagatgttaaaaaaaaatgggcgtctgtaggaatggtgtatcccctttggcaggtatatgttgccactccacttacatactctgagaactctacaatcagggatttaaagacattgcttctgttaaatgttccctctaaacatgtatgtctaactgggggtaatgctttgcaaagaacgtatgctctagaaaagggtggtttcaaaatcagttattgccactcagcctgcagtcatcatttagctgaatgcaggaagcagggcttttttacgtttgactcttccataccattgtgacccccatgcctaattcaggaaatgatgtggaatagaaaaattaaatattttaaaatgcgcaatgtgtggagtgtggagagagacactatttaaagaacacctatagggaattcttagtcccatctagttttcgagagtagtcatgcagaaagtggtaaattatacatttagctgggcccaagtttctgaggagtcaggtgttacaagtctgatttcatgtcatcctcttccagtttagctgactagtctaacccttcacccacaccaattgtgctctctgaaggatttcagtttagctgtatgctaggccaggaggtaaataaaggcagataaagttatggcatccagttgcctcagctcttgaaaagatttgattctgactctaccctccccaacacaccgcacaaatgctatatcattctccttcatcctgtacaaatattctgtttctgacaacccacatattctcaactgacttactagttatttagccacttatattaatcagggttctccagagaacagaaccaattgtgtgtgtatgtatgtgtgtatatacatatgtgtacacacacttacataaccaatgggctacatgttagggcatttgtggctatctgaacatgaatgtatgtttcagtctctttgtgattgaaacataaacacatgtatgtacacatgtgtgtatatatgtgtatatatataaagtgatttatcataaggtattggttctcattattatggaggctggtaagtcctataatctgctgtctgtaagctagagaataggctattgcaataacccaaaatgaaagctgacagtgatatgaacctggtgctggcaatagaagtggtgaaatgtggttggattccacatatattttaaaaacacaggcaacagtatttgctgatgggttggaatgaggggtaagaaagatagtagtaaaagatgatagcatggccaagcaaaggaaaggatcaagttgctccttactataatgaggaagcctggaagaggtttttgggggtggagaaattttgagcacagttttaaacatgttcagtttgccaccttttcaatattaacatacaaattagatgtgtttggtgcctggaacagtgcccagaatgaggcccgtactcagtaaatagttttaactgaatgaattaatactctttaagttctctctgcctcctctcagttacaaccacatcatctcaccaagttagtctgcttcttcattataactgattctcacatttggtgttaagtgagcctaaaaacacaactgatgatttcctttgacctctttctaagataactctacttagtctcacatactttctattttctgggagtgtcaagaaggccctgtttgctctggtttcccatctgtgagcaagaaaaacaggtaggaagcctgttattaatcttcttgcatcaatacttacattgtaaacctatgccgccatctttcattagtcacagagaagactaattacattgactagactgatgaactcagtatgcaaatgttcatgtaataagatggtctgcccaattttctcctgcagttattcaaatacctccccaatgtatagcaaagccagaaagtcctacggttcactaatgttaaaaagtatatatgtgtgggcttctgggcctatggatacataaatatgtaaaattggccatctttacaacttgatggtggtcaaagtagaactaggctagggtactgggaccaagaaaggcagttaatgtgtatgagtgtcccctaagggtatgatatttgacagggatttgctaaccaggactagcacagactagtcattacaacctgaaggaggcacagtcatccatgaagattatttctgctgtgctgagggtaagctgaagataaagggtgttcctggtcccataataaaagagaaacaatgaattattttgtataaggcagttttcaaacgcctgggtaaaagtctaccctggtggcttcctttcctgaagcaatggcgttaatcactggaagttaactagcaggtccaataactgtagtcacaataatgagaacctggcaaacagtattttgttcagaggagtctgagcttcagggcctgtcttcattagtgggttctagtttagctgagagttgtgggctgagcagaacttcaagctctttctgagccccagaccagctatagtctcagaaaaggattttgtgccattaaaggtgggtcattagctataagcgttttatctccaccaagaggggtaaatttcccactgattattgtgctctgttttggagaaagtttcagaaaaaaacactagtgacgaagctttatagcagatgttgggggtggagagttattttgttattttttgtgtgcatgtgtgtgttggcaggaaggtataagatctaaaaattaaatttaaaaaacataagaattggaaagtaaggaacaaatttattgaaatctggtgagtgtaactggatgaacaatggatgtaaagatgaacagcttctcatggccaaactaggactagagctcttagctggactctggagcagtcagggcacagaaagaactcactgatccctaggcaaaggccaatggtgctaggggaccagagagggaagatttgctcagcaactcattcattcttcattcatttattcatttaacaaacatttattgattagtcactctgagctgtattggggcctcagtctacattgatgaatcaaacaaacgtgacctgtcccctggaattcacatcccagtggctgaaatggacaaatatgtagggaaaaaatacagtaataaaaagctgtgataaatgctattgaatgctgaccataaaatagacattgcacaaggagatttaatctttccacttcaaggcaaggatagaccctgtcactctctaacattttttaattacttgaaatgatttaattcttaaataatatatttattttctgttttctccaagtacattgaaagccccctgataacaagtcttgttcacaattacatgtcttgttcactgcagtgtctttctcagtgctcaataattacttgttaggcaattgaatggatgaattttttattatcttcatgttaaccctgttagatgtgaaatacaaaaatcaattatgcccatcttatagatgaggatatgaggctttggaatggatctggatttgggaatcagcatcttattaagatataactactactaataataatgatttattggatgctcactatgtgtcaggcagtgtgctaggttccctgtgtggatcatgttattgaatcctcacaacagctctgtgacatagatgctattattatcccctttatatacatgaggagtatgaggatcagagagataaagttactcattctagatcaagggggtgacagtccacaactaatttgaatgtctgttttgaagacctaggctcactccacccactataccagagtgcttgcatggcctttatctgttctacaggagaatgccaggcagacactgtttctgacttactttactacccgttgggctcgttagtttggtttgagtacagaggaggaaactagaaccagttagttccttatggttacatagtcttttatgacagagctaaggccagatctagggcttctggcttccaggccagttttctttgatgtgaccacgtgatctcttttctcagtgactttgaaatttaatccctcctataaaggtttcctttctgaatggggccacaaatattaaaagctccttgtactttcagaaacttgaaccttatacatgatacttgtatatatctgagcagcccccaattcgatatttcatattgagaaggaagaaaatgacctgagcaaagtagaatcaaaattctcctcatcctgaaaatctaccctcagctttgtagtccgccaaataagttcctggacgatttgtggaagagaagtagcccaaaagactgaaaacaaaagcacactgtataaagacaggtaggcagaatgaaataactaaagattcaccggtgcagagatagtgaaaaagcaaccccctcttcagtatggatttcaggagcctcaatgcatgaaagtcccatgattttcttcttaaaattatctttgtatgattcttaagtttgaaaatgtaaaaataacaagaataagaaaatataaaaaggttatggcaccaactgtttgtcactggttcatttattactatagctgtcacctaaaaatgtatgaagaatgtgacatagaagagctaagttcaggtgagagaacatattcatggttaagagcatggcctctggagccattctacctgctttggaaaccgggctcttccatctactggattggcagccatggaggagtcattttatctttttggacctcagttacctcatctataaaataagtactagttggataatattatattactatatattatatatgatattatgtattctgtttttcttaggtcattttccttcttgtcaatatgaaatatagaattggagtctactcagaaatatacaagtgtcatgtgttaagtttaaggtgctgaaagtacaaggagcttttaatatttgtagccccattcagaaagcaaatctttgtaggagagattaaatttcaaagccactgagaaaagggataagataaaatagtcgtgctgaggaaaataatattatccacactaatacctacaacctagagtttctgtaagtactaaatgggattacaccaataaaaggcttagaacaatgtctgtcataatagtaaatggtaataatagtttttattacatgggggaaagatcataaaattaaaatttatttccttatattctaccatgcatttcacatttattgatctctccttctgggccaagcagtgtgctaggcacttgacagatggatgagatgcatcccctgccatcaaggagtatccaatctaggagaacacagactcatacacaactgattataatgatatgtctattcccagtaagcatttccaaccacaggcattatttgccatcatgtatctctttctctttatcacattgctattcagcatacagaatgttaaagaccagatggtgttaagctgcccattttaggactagttgtaaaagttcactccttatctcacatttaacacattatcttaatgagaaaaccattcacaaagcatttacggagtacttactcttagttggtaccttgagaaggatataaaaaggagtgcagctatggggctttgggaaaagcaccagacttgaagtcagaaatcttgagtttgagtcagggctttgccactgatcaaattgattgaccttggatgagtcacctaaaaactgtgtagctgagaatattaaatgaactagaaaataggaaaacagctggctttcaataattttccagttattcagcctttcattttttcagtataagacacaagacactgacgaattaatgaatgtcagtaagatggacgaattcactgtaaaagatatcaaagcaattttgtgattaacatagctttctcctgacacctagagaacccaaatgataaagtggggagtttgaagaagtaagcagctgagtgcttcaggaggattcactagtggtaggtgcaggatggctttttggctggggcaacaatggagggtcaccacttttaatgaattcattctttttgagaatatttagaaagcaataaaaggtcaaatctggcatctcatcctcccatccattatcacgtcactgaaattgacttttgctaagttcaccaatgactttattgtcaatgaaaccaatggtcacttctgaatcctgattttatgtgactgtttagtagtattctccatagttggccactctgtcttccttgatacagttacttccttggacttctgtaacacactatcctgatatactttacaggtgctttttctcagtctcctttttgagcccttcttctattatctaaaaattatatggcagaggtcctcaaagctcagttttttctagaccctctttattcttaccactctaccctccctaaattcagttaccatgtatacataaatgggccccaaatccagctctgctggactccagactcacatagccaactgccttgtcaacatctgcatctggatgtccacatcctacaggtatgttaaactggacatgtcacaggatgaatttatcaactcactaccctctgcaataaccttgactgtacttgactatactcctcttcattcctcccaaatcaaatgcaccagcaagttctgtttttgttgttgttgttggttttgtttttgagatggagtctcactctgttgcccaggctggagtacagtggcacagtctcagctcactgcaacctccatttcctgggctcaggtgatcctcctgtctcagactcctgagtagctgggactacaggcctgtgctaccatgcccggatttttttttttttttttttgtatttttggtagagacaggtttcaccatattgcccaggctggtctcaaattcctgacctcaggttatcagcctccgttggcctcctaaagtgctgggattacaggcatgagccatggcaaccagccaagttctgtcattttttgcaccaaaatatactttggctatgttaaagtctcttaatcttctctgccaccaccttagtctaagcctcagtggtgtctgagctagaccactgcaacattctcttaactgaattcagcatatatactattgccatttgcctggatgatattttacaaacgtaaattagataatttcatgcccttgtttaaaacttttaaaataggtccccattatccttagaataaagccccaaataattactatgctctataaggccctgcatgaactgacctgtgtccatatctctgacctcatcttgtacctttctcccatttgctctcccgcttcactctacaaacatattgggcttcctgtctcagtgcttcagcattctctttctctctccctttcttacatttcagatttcagttcaaatatcacttccaccaggaagccttgcctccaggctagcttagtctacctgttttgtgttccatagaaagctgcactctctctttttccctctcagaacccattttcttacttgtttaatgttttccttctccattagactcttaagtttcatgaaggccagaactgtgtctgtctaattcaccaagcacgatacctggaacatagcagatatctttaaaaaatgattcttacacaaatatccaaagcagcatcattcataatacccaaaacgtagacactgcccacatctgccacttgatgaatggataagcaaatgtgatatatctatacaatggaatattatttagccatgaaaaataataatgtattgattcattatacaacaaaaatgaaccttgaaaatatataataaagaagtgagtcaccaaagatcacacattgtatgattccatttaataaaaaaaagtccagaataggcaaatccatagacacagaaagtacattcatggttgccaggtgctgagaagaggggaaaatgagaagtgactgtcaacagtatggaattacttttggggatggtgaaaatgttctaaaattacataggggtgatggttgtacaactctgtgagtataataaaaacaactgaattgtacactttaaatgtgtgaattttacatatgtgaattatatctcaataaagctgttaaaatgaattaatgagaataatataaactatagatctgacaacgtagaaaaatgctgagtgacttttaatttacgagagagcaaagaaacaagaaatagtaaagcttcatctcgtgaattgcacacacttatttcatgcaactgcttttacctccttaggaaccggcaactgaaagagaaaacatgggtcctaaatttggaaaggacctcagagattatgtaattcaactatctcactctacatatgagaaatggaggtgcagagggaaagtgactctacaagttcgcacagcaaattcatgaccagacatatacgaaagcctttgtctcctgagtctcatttcagggttctttccatgatacccagccaagtcagcttccttaagagtttttccagtagcccttcacaacttccgtttacaaagtagtaatccctatctgcaagggaagctgtgagatatagtttctgttagtaaggaagaaagggagaacgaccctttgggaggcaacttgtattttctgccacaagttcttttgcggaaaattttggattggccagtatttagatctggaagaatccaatgttctctgctgttacctctgaagtcagcatgaacatttccagtacagtgtgaatacaatagccacacatggaacccctttcatgataaacatctttagccccagttgagagtctccacaattcctgagcaatttgcatttggcagggctgtgtgcaagacattactggctcaaatgaatgtaaatttactttagaaacaaatcaaggtaacattcactatcctggaataaagaaacaaggtgaaagatccttttagaatgcaaattgcaacctgttttgtaaaaatactgagtgacagcaggcacagtggctcacacctgtaatcccagcactttgggaggtcaaggtgggcgggcacgaggtcaggagtttgagaccagccttgccaacatagtgaaaccccatctctactaaaaatacaaaaattagctgggcatggtagcgtacacctgtagtcccagctactcgggaggccaaggcaggagaaccgcttgaacccaggagacagaggttgtggtgagccaagattgtgccactgcactccagcctgggcaacagagcgagactccacctcaaaaaaataagtagataaataaataaaaataaaaataaaacatggagtgactttacttgtctttttaaaaaaataaaagtttaaattttctttcctacaggttttttactatatctaattacactggctttggaaaagagttgataaacatggataatattttaatttaaaattgtttaaaaatgtggccaggcatggtggctcccgcctgtaataccagcactgtggttagaatgtaacaaaaattgcaggaattaaaaaaaaagaaaatgttttttaatcattcactttacttttgagcctagtggttttaataggatgtaattaacaacattttccatgtttttctatttgttttctctgcttgttgcaaactacctctttaaagtaaaattgtattggagaagtctagggtacagtggcctcttctcttgtagtttgcaacaacttttccccaagtaaattgatactaatggcactgaaaatacctggaagcttgatgtctagaggacaaaaaggaaagagtggctgcttcttccctatatactgtatgctaacaaagaaaccaggtctgcagaatccttttaactttcttgacttagtttcatatcaaccccaaaagtcatgtagtattgaccatttgcagaacagagcaatgacaacaattcctccagataagttaattatctgcattaaagaatgcctcatgtttcttgatctactaataatattagataacatgggctattccaaggcattttaatgagtaccctggcgatgacagtctttgggaaaatatttctgacttctaattaactttaaaagtttccttgggcattttttctggttgttgttgttttgaaactgagaatgaaagaaggaaattatatggtagacatttaatgcattctttctgaatctttctgtagatgacataaattaatggctgttctcatttttcatgctcccatgcatgaaaagaaagaaattaagacaataatgttatttaactattataagaggaattcatctttgatcagaattatccagagctttctacctctggcatctgtgtactttactgagacacctcctgggccaatgaaccaactcaagctctgccaaatgtaaatgtttaaattttagtgattccggccccaaatcttactgtctatatccacagcattgggagaacacccttttctgaagcataagaaattctattacccagcagcctgggataagttaaattagtcagtagacaatttcactacaggagtatctgcctctaggaaaaccattaattttgtttaaagtgactgtgtcacaattattgaggacttttcaaatttttctattgccagagagtcttgcttaaagagaagaatgttgattgactacataatttttcttgctcctctcctcctcaaaaaaatcacacacacaaatatgcaaatatgtacagatatttaactcaattttgactgacctttcaataagttttctggataattaaagtagggcctttataagttaaaaagataatcaaaactgtggtactggacttatgctatgcacgaatgacagtgtctcacataaaggtattatatagaaaaatgaacagaaaagtgaataacaaattgtacgaaatgtaaggtgtgtggtctattaatctaaagtacaacaatctcactgaatatacgtatcagcttacatttttgatgttatgtttcagtttgcatttttgtgaacatgaaatcctcaaatgcaacataagtctgtgtgggtcaagtcggccatcctcactgcacacatgtgcgaatgcaggcatcccctgaatccaaaattgttacaaaagaaactgctaaagtagattaattctgcatgtagctttcttggtgcccttaagggcagcaagtattcctccagggaattatgtatgttcactcttcattgttttcctctaaagggatcatattatcagtgaaagaccctattggtcccaggcctactttagaagtgtcttttaaaagattgctaggccttcctaagaattaaatagaagaaaaaggcagtctgtacagatctcacctctggtaaccaaaagcaagcatctttgcagctaactttgcttctgttgcaattgatacagggacaaatggctgtaattatataggggaggataccaaatctctatttagagaccagagctctattagcagtgcattttccagggtctgatgactagtaaacaggaaataagcctatctaccttgaatgagcacagctatccccctggggagttccattaaggataacagtgatgatggtatgtgccactactgggcactcttctatgcagcgcatgctaagtggaaatggcattcttttctcagactctctgctcacttcctgtactgtatataactgcattatgagatcttgggtgtccttctacagaggtaggaccaagtgttctttcgaggattgagagaagagagatttggaggtgggacaatctagccaaataatcttagtcactttattattcataaggatgttaaccaagagttccttagtagcaaaatgagattctttatgttgtcagttttccaaaatatattccacttctctctgtctcagagcaggccttttcagagtagaacattgtgcctccactgaatggtaccttgctttggctttgaagtctctctatcattttgtattcctaactcctctccccaagtctccatctatctgtcctgaatcctctctgacagtcatcttattgtagattatatatgaaatgaaaaccaactagattttttcagttattgctgttgcttgtcattcctttttcttctccatattctgacttcagatttgaggaatggctacaattcttgattatctatgataattgtggggcccatgaaagctatttattcaaagcacaatgtagaaaaagggagggctttagagttgcacagctctacactgaaatcctatcactatcccttactagttaactgattttgggcatattaagttctctgagccttgtttacttcctctggaaaatgagtgtgaaggactaaatgtttatgctccccccactaaaatgtatatgttgagattctaacccccaaggtgatgatatgaagaggtggagcctttggaaggtgattaggtcataagggctgagccctcatgaataggattggtactctgaaaacagagacctcaaagagttccctaagctcttccgccatgtgaggttacagtgggaagatggttatctgtgggggaggaagccctcatcagacaatgaatctgctggcaccttgatcttggacttcccaacctgccgaactgtaagaaatgaatgtatgttgtttatgagctacccagtttatggtattttattatagcagcctgaacagattaaggcaatgagtctaataagaatatctactgtttggagttttaggattgaaaattattcccctttgcatattctgagttaggagccactctttgagtcaggcaaatggagatacaaatgtcaatttcattattaataaagttgatttaaaccggagactgattactgctactactttcctactcatccaccttgaattccaaacttacccagccaggcagtcatagacagaactgtgcaactgtggtcttgccctacaacgggaaatccttccccaaaaactttactaatggctaggctgggaatttacaggttctccaaaagagagactgaaaactcataagtgaatgaatcatacctgctcagtcccttctttcaatgttgccaagcagctttttcccctcttcagttaggcaggagtggtgagggatgacttggaattgctcctcccctattctttttcttctctatggaaacttgagcagtgaggcacaagagttgtcttattaacagctaggattagtgtgaggattaaatgagataccacatgccaactatcttatatagtacctggcacatgatagaagttcagatggacaatacaggaatcaaaatccagcattactcattagccatgtggttttgtgtctggaatttgtgggttcttggtctcactgacttcaagaatgaagctgcagacccccgcggtgagtgttacagttcttaaaggtggtgtgtctggggtttgttccttctggtgttcggatgtgtttggagtttcttccttctggtgggttcgtggtctcgctggctcaggagtgaagctgcagaccttcgtggtgagtgttacagctcataaaggcagtgtggacccaaacagtgagcagtagcaagattcattgaaaagagcgaaggaacaaagattccacagtgtggacggggaccagaaccggttgccactgctaggttgggcagcctgcctttattctcttatctggccccacccacatcctgctgattggtccattttacagagagccgattggtccattttgacagggtgctgattggtgggtttacaatccctgagctagacacaaaagttctccatctccccactagattagctagatacagagtgtcgattggtgtatttacaaaccctgagctagacacagagtgctgattggtgtatttaaaaaaccttgagctagatgcagagtgctgattggtgcattcacaatcccttagctagacataaagattctccaagtccccaccagactcaggagcccagctggcttcacccagtgggtcccgcactgggccgcaggtggagccgcctgccagttatgcgccttgcgcctgcactcctcagcccttgggcggttgatgggactgggcgccctggagcagagagcggcgctcgtccgggaggctcgggccgtgcaggagcccatggcggttggtggggaggctcaggcatgggggcgctgcaggtcccaagccctgccccgcagagaggcagctaaggcctggcgagaaatcaagcacagcagctgctggcccaggtgctaagcccctcactgcctggggcttgtgggccagccagcagctctgagtgcggggccgctgagcccacgcccacccagaacttgcgctggcctgcaagcgcgtgcgcagccctggttcccgcctgcgcctctcccttcacacctccctgcaagtggagggaagccggctctggcctccgccatcccaggaaggggctcccacagtgcagccgcgggctgaagggctcctcaagcgcggccagagtgggcactgaggccgaggaggcaccgagagtgagcaagggctgcaagggctgccagcacgctgtcacctctcagttttaggtaatttacccaacctttctgaacttcccttgtttgatctttaaaattaaggtaataacaattagcttgcacagttgtaaaaattagagaaaatatctgtgaagggcctggtgcatagtaggtacttagtaaactgcaactattatcattatcatgatccagttgtataaattgatttgtagattgtgtcctgcatttttttttcccatagcagattgacatagcagtgctcacatttatcaatgggaatagtcaagggttgaattggtaaaagtgtagctgagaagcaagtccaggacccaaggcaagcattctgggaatgtaagaatttctgtggctcatccatagagcagcaaacctacatgtaaatattttagaggtgactgaagtttgaaacgtccttttgtaatataagtatatttttgaagattaaaaaaatatttgttttgcaaagaacattttttcccatatggaactaattttttggtaggaaattagacttgtagagacaaggttttcatgcctttcattcttttcaggcttacaaagtatttcctatctggaaccccagttcttggccaatttaatgttgctgacaattgtatttggtaggataatttcagtttcacctaggttcagagaataattgccaatatatttcggaaagactctcttaaaatgttaagtttttccctagagagcaatctagtacaatgaaatcttcttgaaatattatttgccaccattttagaccttccagtttggtgaacgtattactgtcatacttcattactgtgtatttttggtgtacctttcacatcaaaaccaccattcaaaacattttgtgatttaaaagtacaaagtcttaaaaaagaacatagcacttcttcttatcagaaatccagcacagatgagaagatttattgtctgatagtcaagattggattgtgcagttgtttgtgagaaaccagtggatttgatcagaaatggaatgagtatactgatgtggcagagagaatggaaaatttgggttttgggtttttgacttttttggggaaaatgtctctaaaacattgttttcttaacaaattaattctaatggaaaggtagtaatcatttaggtttaaccactgaaacaaacaagttgctttcccagagttgacacagacactcaacaggtgagtgaatgggctctgtccttgaagctgtgtccccacccaaatcttatcttgaattgtagtttccataatccccacatgtcccgggaaggacctggtgggaggtaactgaatcatgggggcagttacccccatgctgttctcatgatagcgagtgagttatcatgagatctgatggttttataaggggcttttcccccctttgctcagcacttctccttcctgctgccctgtgaagaaggtgcctttcttcccctttttcttccaccatgattgtaaggttcctaaggccttcctagccatgcggaactgtgagtcaattaaacttcttcataaattacccaatctcaggtatttctccatagcagcatgagaacagactaatacatattgctcataagagggactgagtgagagtaacccagctacactactgtataaacaagccagagcttaagggatattgttgagatcattaatatcatttaggtacatgaagtacagtgacccactttctaccttccagaactaggcagaataaagatagaaataaactcttcttttaaactgtctctgttagttgttgcctgacagacttgaagtcaatgttggacccataaacctcaacaaatattcaaagggaaattccaaaatagttgtttaaagtggctaagttttcaccccagtgtagagaacaaaatagtctgtatgtactgtgactgtgtcaagaaaatatttgaggtggcattatcaaacaatttaaatgtggtctttgatgatccagaaacaaaaaaccaccagagaagtcaatctgttattccaaaggtcagggccatcagccccagtagctgaaaaaaggaaataatgcaaagagcttctggtcctagggctgatcaagtgagaggaaaggacatccccaggaagccactcttctgtattcttggctcagaggcagctggtaatgccaagtgagttacatatttactccattcacaaatgtgcaagtaaattgaggccaatttgtgttaggattaaatttattccaaagaggtgctcacttgagtggtcctagcaagccagccatttttagttacttcagctctatgggtaagtttaggaataccaaactagcaaattaagaaggaaaaaaaggaaaaggaaaacatgttataaaaatctaaaatctccatggacttttgagcaatttctgttgttcttctgaaatgtattgcttttcatttctccagatttgatgtttaaatgatagctgacaattcctgtttgggaaaactcatgcacagatagttattaccctgtaagaagagatgtgagcgtattcggaaatgttcatcatgtgccatagctcaaaaaacatatggtacacagccccaataaaaatgagatgcagaaattaaaatgggcgggtgcttctggtttttgtttgttaactgcaactatgtaggtctaaacttcatggttttgtaggtaagttactgatacagtggttagccgtgccagtgtcttggggacaagccttatggatcccagtattgcagaaaaaccaggctcagtgcagttgttacatttcacaggacacactttgacctgtgatgtagccaggtttttagttacaagctccatcataacagggctctgttgtgttttgtacagttcaataaatcaatttgaacagatacatctcttgttggaaagaacttagatactttttttttaatgagggagcaagcatttgaattgaaggatttgaatacaaattgaagtatattcttacatgtcttagagattatatgattgcaaaaaacaggaatcttcacaagttaagcctagtaaaggagaatgcattttagggtaaaggaagtctcatggaaccccaactcatgggggattagaaattgtcaggcagctagctcatctttccatctcttgctctctgtagcaacacaatctgtcatctctgcttctttctgcacagcggctcgatcctgcattctacaaaatggcttcctctgcctggctcttaatttctacttccccacacctccagctcagctgtagctttaggttgttgttgcacctattctggccctaaatgtttttgacctaatgctttcggtgcccaataacttctgacctatttagtctttgttttctctttgttcaaattttcaagaaaattggattggcttttgccagtcaacaattgattcactcccagcatgtgtgtccacttaggcagtgtttgggggaaaaagtgttaacaaaaaatgtacagctgtaagcaatgtagtttaaactaaaaagttagttggatactgtgaaatgactaatgtatcaaatacatccattattgtaatgataatgatgataacaatgactatagtaattaaattactatagtaatttagtatagtaattaaaacagctacatttatggaactctttgtaagcttattatatagacttatttaatcttcacaacaactctaaggagtaggtattattactgtcccagtttttactgatgggaaaatttaggcacaaagaagtgacttatccaaggtcacatggccattaagtggttgaacaagcctcaaacccagacagtctgacactagaattttgatgctctactgatgattctgacactgttacaatgaatttgtgaaatgtggggctgcaagatagcttctttgtgaagaaaaaggaaaattcatttaaaccagcaaaacctgtatgatacatactagatatatatatttagtccctccaatatcctttacccagggagaaagggattaggatctcaagaaatatttgtgtctctatgtgggtggaaagagaagaattactctctcatctgagttattttagtacttttagataaatgaaataacctttaaatattcgtgatcagagcattacccaattgtctctttgccttcatatttatttgaattcaaattaaatctgccttttagcaactatcgagaataagatctggcactttggagtggaagccaaaactggtatgtatgtgatgttactgccctcttcccaagccaccattttattgctcttctgggaatccagttaaattacagctgctgatatattgtggactgaggatctaaattcaggctttgaccaagtcatgggctggtttctttgggcaatatttcacttcctgttttatctgtgctgtcacctaaatttagcacttagactatactccccgatgtctgcagaagttttaaattattttccagtgatgcataccgtgtctatgcagaattgagtgtgacagatttgcagtaaaatcctggagctctccaactcctttttaaatgaattagatcagtagctctcacggatttgacttggaatgggttgtaaggtgatgtgtttcctgcaaaactgattgagttctctttggtgtccttttttttttcctctgctgtgcattttaccatttggtggactaatcagtttcttaaaagcaaaagatggatgctgccttctaaaccatgggaggtgtcaaatgcctgctgcattaagaccctttcccctacttgcaggaatgatagctatgggcagaactgtaatagtgttctaaattgagaaatcttgaataagacataaatctaaattccacacctttcttttttaatgtgggcttcaacaagcgtcagctataattggtagaacagcctgacctattaatccatagataaaaatgattcaattaaagagaaatataaatattgaaggtaatgtaaaaccaaatgaagcacatcaccgaatttatgtgcaaataaattaacttgaataaaaattctccagtacatacaatgtccatatgctgtcttggtaatgctataattaagtcagagagtcatgtcatactggccttttccatctgctctgtgatctgttaagggacccattcaaacagaatgacagctgacctcaaaatgatacactctactactgccattttaacagggctgttggttatgcacattttgtcttcatttatactgggctacgagtgtttttccattaaatcaagtaaattggagcatgtggttttctattaaataggtttatttaaaccaatattttattttctgaataaactttttttttatttttcagaagcaattgattgtattggagacatttttgttttgttttgttctaaattcaagtggtgttagaaagaaacagtgattaagaatagcaaaataaaggcactcttctctttttccttctaattcttgttattcgatcaaagcaaagtggttaattcttggagcctcaggatgttgtgtatgtaattgacacaaaagatgtgtaaaagaggagccaatatttataatactaattgatttcatttattttacttcccttgtgtatgcctcactgtcattcttgccattatcttaatgttcttgtttccaatagcactcagaaaagtcattttaaaggcaggggatctggagcacagatgtgtcaggtgtaaaggctctcctccacagagacattcaaattggctaaaggaaaccccacggaatagtgcagctgaagatccagcatttgtccatctgtttatatccaggttaccttgtgacagtctatttaatttctggtccctggagtgtctctatttcaatagtacatgcatatttcttttattagaactgcagaaggggaaaattggtaactcttggaaccaggatgacctttagaagattacatttttgttttgttttgaacaaataacacaagttctacaagagggtttgctctagtcaaacactcaacttcttagagggaattttaaatgtctcctatttggccttggaggaaaaaaggaagaaagaaataaattatacttgcaatacaacagagagtgcttagaaaatgggtttaaaatatattacaatttaaaaactttttaaagtaaaacccaagccataccagagacagacagtatccatagagtgaccaagactgacccacataagaggctggagaattacaaaagatgatcatcagacagatgcccattgctctctggggaatcttgaccttggcatgttggtttctgaattaattcagagaacctaatttgccaatgtggaaaagtcacataatacatggtatcttatttataaataaaaatccagatggaatttcttagtaaaatgtatttaggtaagtctacaagggacaaggaccatattcttttacttatgcagtctagaaacatttgctgagcatctaatatgtccctggcattattttagcttcaaatgatgtgttagtgagcaaaatgaagtctgtgctctcataaagctaacattacagtgtgggggttgtgggaaggcagacagtaggcaaacctgttatctgttctgtacagggcccaggacccattaattagccttgcatctggatgttggttcaaagataaatatttatgaggctttcctgaaattgtaaactttatacccaagagcatcctgatgagctaaaatgaaattgaccacatatactcatttcaatgaaataatgtttgaaaaatttcctttcattttgcccaagtccatatagtactttattgtagtgtggtgaaaaggatataggattagattctgccaagaaacttttacctgaggtatttatatcccagtggagagaaacaatgatgcctaattaaaagataaagatagaaaaaaggggcagagccagagaaggaaaaatagggagtaggggtggaggtagggttaggaaaactttattcctgcaatattctttaaatatataagaatttattttcatatcagggcaatatcctagtagcttagtttagttggtgagagccccacgttaggatggcatcatagttaaagattcagttcttatttgaaccagttagcttaaatctatcccatccctttaacccaaccagtcatgatacgaatatcagccacaaatcacaagcagttgcacattttccacactactggaaaaaaagaatgaatcaaacacatcttctttctgtatgatcagtgaggcatgagaataattggtagattgatgatctgagatgtagttgatgagttagaaccatgaattctgccagacctttggaacaaagcatattaaatagtattttttttgtgggtgccaatggcagtggtaacatgggagaggattatttaaaattgtgtttaaatattcaaagctgtatgtgctaggtatataagtgaactagtatttctcttcccttaagtaacctagagataggactacatttatcaacgttctctttttatctccttctgcagtcttccttcaaaacctacaggcttttaaacaaagaccctccatgactcttatcaacatatctgttcctgggcctctcccaaaatgatttagagataaattgcctcaaacctggcttggtttaatgctataatccattatggttccttttggaggtagcaaattctcatcaacttcattcttattaatcacctatctaaatgtagcatcatcagaacaatttcagaggtttttaaggcacaaccttgacttcctgtcatttgtaaattggcttataacagtcctggcactctgctaaagtgcttaactggtcattattcctccttgtactacatagcctttatgctgccagtagcccatctcgcctttctgatgtcccatcatattacctttaaaacagtaattttgtttttttgaactttgtgatggggggttagagtaggtcataggctatttttgagaatctagagaaaacagaaatctctacacaggagaaaatatacatgaacatatggttttgtgtacactttcaagggatttgtaaacttgtgaagcccatccatatacctcagagtacaaagtcatggcgtcaagattatatgatttacaaacatatttaattgaagtaaaccccatatatgcctatttataggctcataaatgttataacatttttatttttattttatttttccatctaaacttcctccactcagggtcagatttgcattgtggtctgccagcttttctagtcttctttgactccctcctcattttctattacaggaatttcccttaatgacattcttgcatgttcaatcctttcttggcatttgtttctcagagatcctagactaacacattcttctactacttctataaaaagatactatcatattataatatttttaggactattaagagaaggtgtctatttctgttttttccatttctttgaatttcactttaaatttttttcacctgctttgaaaaacgtgattgttcattaagttagccacagtgacaagtgtataaaatttgaataaaatgttcctggtatgtttttatgattcccaaatgcattttctttctcctttctttccctcctttcttttctttctttccttccttgcttcttttcctttcaattttatttaaagattttttaaatgtatgttacaccttacaaaatcatacatttatctaaggatagtctgaaattcttggttccaatgacatttcatttgtgtatggtactttctttaagctgcttgttgttgatttccaggcacttaaaaaagagaatactgtttgttaagttccaatatatttctgtgttaaaggtacaatggttaatgttatcatttccatgagtgaaaggggttgtctgttttattttctaccacatatattcccagaacttagcacagtgcctggcagaaaaaaggtgctcaataaatgtgtgttgaacgtataataaggcattagagcttataccttgaaaaaaacttaatgttttaaaaagtcatttaattatcctaatcccacaagcttcttaaatgttcatccatttttcccaaagtcacgtgctaactctttactaattctgtctaaatggctattgcaatgacaggtatcccagggaaggaaggccagtcaaaataacaaaatatctttaaaagaatgaaactgtatttcattcaagcacagaaattataactaaactaataaaaactgtttcaatagaagttctctgattatgtttaagaaataggtaataatttattacttttttctcagttgatatttacaaaatacagttgacccttgaacaatgtgggttttaactgcatgagtccacatatacatggttttttcttcaacgaactcatatcaaaaatacagtattcacaggatgtgaaccctgtgtatatggagagccaacttttcctatatgtgggttccacagaactgactatggaaatcgagtagagtgggtcctggaaccaattccccccgtgtatactgagggaaaactgtacttaaaatcaatcctctctgagaataaaggcaataaataaataaatatgaaaataattctctcaagtatgttaaaaatagtcctagaaaatagaattccagaattagaagggaccttagaaactatgtagttcaagtttttatccagtgtaagaaattcttagacagtacccctctgtaatggcagaacatgctatttttgtaggtagtctatctcattgctgagaagttcttcctaaacactgaggcaaatcctggttgtctgtaattttcctgtacttgctcctagttaagcctctgtagccatacagaatcaatgtactttctcttccatttgaaagtgctctatgtatttgattatatcaaatggatgtcacagatttgctattgatctatcatgtaattctataccagtctatactacctggtgtctgggaaatttcaagtaaggaatcagttggaaaaagccatttggagattaaagagacatccacagctttctctctgatctgccctctctctaggaaatcacctcccatgactcattgctcataaggatgtggatatgaaatcatgctagcaaacatccctgcataattgacactggctattccctatgtagtaatttgtttactatgttccttttttcctcctacatatgttggaaagcaaactttaacaaggttcctttctgaattcttataagttccaagctagtttcttttgttaaggattaaataaaatttccattcagctatttgctaaggaggtgaaattatgtttttagtgtttggaatatagcaggtgaatcaaggtgaattaatacgccattgaaattagttgcgaaaaccattctctttatcttagttctcattatagatgtgtaggtcagtaaggtttgtgtcataatgtaggcatcaactgtattattttctgtgaataccgacaaaacatttctttagtaacaaatgtaatcaggcaacataccagatattcagtattcttcccaagttgattgggcattgcttccagtttctgccagaagagcatcaccacatattacaagaagcatagccctccactctataacctttgatattttgcccagaaatgttgagagttggaaatcaattacaatatagcaaaaatgtatgagcatcagctaaagcttcatctttgcttccttttttctctctgaaaaattgagtctggtgattcttcagtttttacatgtgtgctatagagactcctaaaagagcaagcaaggaaaggaatttaattgctaaatgcacttgagtagatctcagataagaacaggtaatctttgaagttataaagcagcaagagaccaataactttttctctaaccaatggtttcgatatttggaagattgacaggcttagagacactttcttattccagcaaaagaataaatgtattgccagctacctccccaaaggctgtcaaccaagtatttgttcaatatatttatcatggtttattattttaatttatgcgtaggtatctgcattatgtcctgaataagtcatgtgactgaggaccatcagtggctagtttgagcatgagtgtaagttgcatgtggtagttttgtaggataacacatttttaggattggaagaaacagaacttttcagtttccaactatattagactaggaaaattatacacttaaaggaacaaactggcttgtccaaattcacatggctggttcataggaaacacagtggtagaactctttatgtgactctagttagaagtccttatccaaaaataatggaaaagaccaccaaaataatttcttcaggtttttataccaaatctgaaccttgccaaataagttgtattaaactaaagatttcttgtatgtaggtcattatttaatacctttaacagtatttcacaaggaaaatgcaaacaaactaaaatgcttcagtttggaagagacagacaaatgaaaaaaatttttattgagaattttaaaataggtaagcaaaaactacaaatagaaaacagccagagtatacatacatattcagtttaatctcctagacttcattccatttagaaatgtgggaaattttataatacatatagtactcagagatatttttgtgagaatgcattgtgatttggtgtgtatgcttacaactaaattgtaataatccaaaggagtctgctatctatctctaattccttctgcttaagtaacatgtaccaacccttaagcagtggctaaggaaaggacatgacagaactcttgatcctccttttttatgtccctgggcttcttcctgccaggttttgctgaaatatctcctctttgccttaagactgttattgctcattcttatttgttgtttattttttatgtgcttgcccaaaaattggtctgtgttatgacttttttcattctttcccttcctattatgttgccgtttactaccctcctacatcagaactacttgccttccactactttgaaacaatattaacaacatgatgtgtatatctacacaactttctatatgcataagcatacacaggaaattttgtttgttttacacaagtgaaattatgctatgtacacttctctgcactctcacttaatggtacattttggaaattccttcaagtcatttggtatgatacatataactcatattaaaaaaggtatagtgttgtgagctctgggtatatcacaatttattcaaccatttccctggtgtttactgactccatacatttgataatattattgacccaccgtgttctttctttttcttctgattctatatagtttatgctctgactgacccactacttctagctcttgcttctagttttccttgcattgccctctagtgatttcttatatttaggccttagttctatgaatgaattgtaagcttcttgaagacatacatgtttcgtatctaatattagctatagtacaaaacaaaatgtgtccacaaagtaagagtgttagattgataaattggccatggtggagtagaagttttagagctgtgaatctagactagggaagaatagaagaatctcagagccttaattaacttttctgttgtgttgttatttctgccaaacatctaaattttttccaaatccaactgagagtatatctcttctatgaagatatttaattctgtgaagtttttagtctctaataacttatgttgtcttagtccattgctgctgctataacaagataccttagactgggtaatttataaacaagagaaacttgtttctcacaattccagtctcacaattccagaggctgagaagtccaaaatcaaggctgccagaagattccaggtctggtgagggcttgctctcagcctcatagagggaaacttcttgctgaatcttcatatgtcaggaggtgaaaaaagggacaaacttgctacctcaaatacttttataagggcactaatctcattcatgacggcagagccctcatagcctaatcaccttccaaaggcaatacttcttagtaccatcaccttggggtttaagttccaacatgtaaattttgaagggacatatacattcaaaccatagcatatggcaccctctcagatcattgatttttgtctcatccccctgctgactcttaggcaacatggttgatttattggcagaatagaaagactgcaggggtttttagatcgggggtcattcctaatctcaggtaactctgcaactgctgctaatatctggaaccaggaggtatctcaaatgatatatcatctaatttatatattgaagatggctgggattaaagaattccttagtatgcagcccaataccacaagcctattgtgaaataggtgatccttcttgaccttttttggtgtagatgccctcaccatccaccaaagcccagttcattaaagcttgggcaactcttctgcttagaacccttcagtggttctccaaaacatccagattaaagtgcaagttgattaatattgaaaacaagactcccacatcatcttttctcatcccacctacgtattcagcttaatctttcaacacttctgttgctgctgctggtgctaataatgatgataattctgatgataacagctaatgttttactgagtgttttctgtatactagacacatgtattttgtatttgaatcttcacaaaacccctataaggcaggtacttttgttatgcccattttacaaatggataaatcaagcttcaaacaagttatgtaacatgatgtcacaaggctattgagagaactaggaatgtttgactaaaaaatccatgttcttaaccactattccagtgctcctcaaatattgtgcacagtaatcccattgactgcttttagaaaaacatgattttcagacctcactcaagagatttggattcagtagatcaagatttagggccaagtaatatgtgcatttacttagcacctccaggtgattctgatgtattaccgccgaccatttgagaagtactattctgtaccaatgcctctcaaattttaatatctgtatgaatcaaatcacttggtgaccttattatccctgctgatgctgaatcaatagaattagggtagggcctgattttctgcatttctaacaagcttccatccaggaggatgcaaatattattggtccacagattacacttgagatagaagtcctatactacatgccttagtgataaaatgcgagtttagcataagaatgaggtatatttcagttaagtagtgtgttatacaaatagatatatccctaaaaaactcagacacaaatcttttctgtcacttgaattccattttcacattgactttcaggatcatttcagagttactaccattatttatttttagtagatctctagtagcctaccacttcaactttgtcagtcaagtacttagtaagtgatgacctcttaagcaaacactcaagtaccctagaagagcttactagaaacagaaagcctgtcatgagtcctctaataaagtggatattctttttgttatataaatacgaaatttgaaaagaggaaaagcaaatgttagatttctagatctgaaaaggaccggagaaacaatttcattcaaactgaattttacaggtaagaaaaggcaggcaagaatgggaaggtagtgtaactaaatttacacaggggattagtggcagagctggaactcaaattctagtcttgttggagtttttatttatttgttcttgttggttggttggttggttgtgttttgaaagcatatccttaattccatcttagcttcagtgttggagatctgtacttctaagctgtatttaaggggaaagggcaacaattacagctgtttttcctaagtaaataggactctacatcggggttagcaaactttttattttctgtaaaaggccagatagtaaacagtttagaccttgtgagccataaggtctttgtcacaagtgctcaattgctgtcatagtatagaaacagccatatataattatatataacatattaatatataaacaaatgagggtggttgtggacactgaatttagaatttcatataatttttacatcatgaaatattattattttcactttttaaaaaccatttcaacctgtaaatatttttttttttttgctcataggccaatacagaaacaggcagcatactggatttggctcaatggccataatttgctgacacctcctgtaaattagtttagttcttccaaacgctaatataatttatcctcaagttgagcaggtagttcttgaacattacatagaaaacaagttagctattcaaagttcactggtaggattagtggcattgcatgaattttgtttactggaaaaatgtaacagtcagaaagagatacacattagcttatgagtggggatatctgctttgctgaattatttctaatctccagagaggaaaagtaaagcccaaggcgtaggcataccataaaacaatttgtttcatgatagccatagtagtctttttgactaaaagggcattgaaattcttttaaagacttctgtgaattggctgccatgctctgtgttactctctggtgggtataggaaatttgctgaagtcttaatatgtcctattcctttaattcgtggcagggaggcaggaaaatgaaaatagtttgaaagcaactgaagtatagatggcacttggtcaaataccaaaggtttcaatgaaagtcgtcttggttcattgtcagatcatcccaaagaatcaagaaaaaaaaaaaagaaaaagaaaatgtcatattagcatagttgttttgcaaatgtcggctttaacaatgctcaggttacaaagttgatgctctaccacatatttatttattttaatttaaaaaaaacacagttggaaattcaaccagaatgttgtcaaatgcattgagccttttaaagttttattgaaaatggtggttaagctgcttcctctcaaaaagttcatttaagataatttcgccatttaaaaggaggtgaggatccttataataataatagtgatcaaactttgaatgcagagttctttcaaaaaatagattttcaggggaaaaaaaacacaagaacaaatttaaccattccagtatgatagtttcacagactgcccagcttttggataaccacctgcaacagaaagatagctaagaaaagaggacaatgtgcctggatggtttcccactctatttcctttccaaaacaaatgagttcccttatataaagttatcctataagagaaccaaggaaagtattcttgttagggatgtatatgaaagaaataattaaaatctgagtctatttaccagaagagattatgttgtttcttctattctttatattgtgattaaagtagagagaagacatttttgggcaaacttactagggggagaagtgcacaatttgaagtttcttggtttctcaaagatggaacttaattgaaatcaatatgagaaaaagcaaaaaatagaaagtgctgttctgaacagaagaaacttgaattagctaaaagtgtgatatgtgtagcgttccttgcagtgttgaaatgtattcaataaaaatgtttctatgaagtaacatcactttccctatttcactggcaacagttgagattcggaatcaccaccgttgtttcttttatagcatccactggtaaatctgatgatatctataactgtctaaaaattataccaaaatgttgaagtggagatgatagatttcatttttctcagttaacacattatgagaaatattctgtgtaaatataacctctgaatcaaattcttttttctgtactgattttcataattttagagagatatgtaacattatttttattgatttttaatagactatggttgatagcaccttagcattgtttcttttccctcttcatttctaatttttgtcaaatggcacattataagcagataaatgtacttgcaacttaaggaaattcaactttaatattttctgtatggtaaaaataatttttatataaataactgcttcaatttatctcttcttaattttagcatttaagtaatgcatctgatgtgtgtgtgtgcacacatgcacacaccccaaatgtctttcaaatgaatttgctcacagaaccaacaataacaataattacaaatattataatatttttgttttagttcaggctgctataacaaaatactttagactgggtaattactaaacaacagaaatttattgcttatacttctggaggttgggaagtccaaggtcaaggcaccagcagatttggtgtctggtgaggacctgttcctcatatatggggacttctatgtgtccttgcctggcaggaggggcaaactccctcaggcctcttgtatatggtaactaatctcattcatgaagaatttaccctcatgacctaatcacctcccaaagactccacctcttaacaccatctactttagggattaggtttcaacatatgaattttgaggggacacccgtagtcggaccatagcatttttatagtataccatcacagaaagacctgcaggtattttcttatcagaaaataagacattctatcacttttctattttagtaagatacattatagctttgtgtttgtaaaattgtctttctaatctcagactgcattttatttccatttgctgtttgacctcttcagcttttgtgatttctgatgccacagactgcttttattaactttaaacatttacttgtgatgccagaacaattcaaaattgatttagtcatattagctaattatctgatcaattcagtgagcaaattcaattcaacctcttttttgatagaattagccaatggcttaaatgaaatttcttatcaaataaataaaagttgtagaaccagtagtcatgtagacacagccatactatgagctttcttccttaccccatgttattgaactattgtaatatgttgcacattcattcattcaacaaatatttactcattgccaattatgagttgagcactgtgctaagttctacagatatagtaagtatctctctctttagtatgtttacacacagaattattcaagagtagtcacttagtttttcctactctatcaacattgtggttttaatagccatgtagggttcatttagttcaggtacttaatactactgtctacaggagccagatatctgagggtgaggagagactttatgaacaataaaaagtagatgattatggaggcccaaactctataataaggactatatacagtttacaaagtctatacaatgaattctaatatcagcttccatttgttcttcagaaaggagctagtactagtcctggccaattatggatcttcttgtgtgtgccttatgtttgtacctaatctcagagtctgatctctacctttttcttttcttgtaagatccttcattctataacttaatcgttggcccataactccagaaattactgtgaaattgctgtattcctgcatctccaactagagtttgctatctctgtggtctcactacatggatcaaagttgttctgacggtgataaccaagatgacaaaggagtgctactttggaaaagccatatcttacttggattcagagctacaaaaaaaaaaaaaaaagatgcccacttgcaacattgctatttgtccatcccattttctgagtaatacacttaaacatattcaggtaatagtagttactatttaatatatttaatatgtatgcattgccaaaccttgtggaatatactagcatgagaaatctcatcctcatccttttacttcacttgttctctaactattgtagtgggtgactggtggttcagtagttagagcagccattaaatgatctggtgtgtttataagattctcccacaaaaacttgtaactattatttagtttcaatttttcaaaggctgaccaaacatcaaaattagttggctgtttatctagattaaaataaaaggagaatgtcaaaagcaaatctttatgccattcaagcatttcattatccatttgcaggctgcatgatagggaaagcttcattttgcaatagcataatacagataattgctaatgaaatatatttgacactactaatatatgatggtagaatgagactggagaattaaaatgtaaggtccttgagaatgtgagctgtatcttaaatcatattttccaaccctagtaactgcacagtgatgggcacataaatgctcaaaaattattacgtgattcaaaaataccaaaataattatgttgataattggatcctgctctagcttaggggtttcataaggaagtttgagaaatagccaccttttatagtcttccacaaggagatatgttatgcagatgcccagatcccccaaagacaactgcctttgcacactgtgtcaagtgggatttagggttttgaattactggttgtccttctgctctactgaaaccttaagcagaggttctaaaaacataagctgtagatttgggactaactctgcattttggcacttgggattactatcacagtgaaacatgggagagaagagttccacagatggccaagcaggcagtatcattagctttaatgaaatcagctccatgtatgcccaataaagcgtgggatgaagactaatcacaagcatcaaagaagatagtgttttgtgactttgtgcattatcgaatgtattcaagtgttaaaaagatgactattcattgcacttgaatatgcgtctaggttaatttttttttattgaaaggaaatttcattaggatagtgtttattcacattgatccagctgacttcagaatatggttatatatttttctgcatccaactgctattataagacccaggcttatattagattttctctggtattaattttgcttactttgacctttatttcctgttccacctgaaccctcctttctggacagttgcgaaaggatgccataaatatcctccacaaaggcacgtgtaaatgtgatcatattttcgtgagtctttgctatgtgcagtgcacaaatgctatgaaataaatgagcacttggatgactatagtgagtcacaccattaagagggtgtgctcaagtatagtgtttgttgatatgcacaaattaattctaaagagtgttatcataatttgctcatggtatatgtattcagattctttggaagaactgaagccatcattagaaaattacagtattatctcaatattttagttgacaggaggttgtaacaacaaactttcccattgtcttctaactcctcttcattgtatcactgactttgtgtactgcatagcaagagataagaggagcaggaatagagaatgggtaggactaatgtgaggaaattttctggagaagtccatttcaatgttagcttgtaaaatgagaaagatatgtgtaaggaggcagtagaaccaaattaaaatgccctgctacattcttttatgccttggcatgaagagatcttgggcagagataaagctatacaaattcatatggataaagtcatttccctatcagaagccaccccatgccctgccaagtaagccaagttaggaatgtggtatctgagtcattgtgtgctttctgatgggagaatgaagacttatgagaagagaatcttgatgaaaggagagggcagaataccagatgtcctaaggcaggtagagagagtagacagcactgtaagaggatggcctgtctttccacatataaagttgtgttgtccaatgtaatagctactaactacaggtggctatttaaatttaaataagctaaaattaaattcaattaaaaattcacttccttagtctcagtagtcacatctaacatgctcaataattgcatgtggctaactgctgctgtattagcacagatgtagaacatttctaccatcacagaaatttcccttggacaactctgttctagagcaatgagcagaaataactatttgacacactgggggctgggaggtctctagagagctatgagtgctgacataaccagaaaactattttttggtgaataagtgggaacaccaatggtatcaaagtgggaatcaacatcacaaacaggtatatatttcaccatcctggaaaataaaaatgcaactctgtaatgctttccactggaagaataaatatgaccatatatttcaatgaaggtgattgagggtttcttcttcattttttaaaaatttgtgttgatttggtctgatgtttttaactaaagacacctaaatgacttaattgttaaactgtcatctattttagtctcatttcctatgtgaaactagttgtcatactcccctcaaaatataatctaggccaggtgtggtggttcacacctataatctcaacaacttgggaggccaacatgggaggattgcttgagcccaggagttctagaccagcctgagcaacatagtgggacctcgtctgtacaaacacaataaaaaataaaaattagtcaggcatggtggcatgtgcctatagtcccagctactcgggaggctgaggtgagaggatcacttgagcccaggagatcaaggctgcaatgagccatgattgtgccactgcactccagcctgggtgaccgagtgagatcctgtctcaaaaaatatgtatatataatttattcataggcaaggattgtgatacagttgttcccagtaagtccttattgaattaaaaggaagctgcctgcctatgcttggtcagatgacagccactagtattaagtctccctttgcaccattcctggctacctcaactgatcaggaagaaaatccatttatttcaaataaatttgaaaatattatatttgcttgaacaaatttgtttcaaatgctgccttacaggaattaaggcattcatttattttttcagtcttttattcaataatggagcacctttcatctttgaggcactatcagcaggccttgtggactttatgaggttaaattagtcactctttgccctgaaggtatttataatccaatgacatataattaccaaaaaaaaaaaaaaaaaaaagcagaaaatgaaaaatcaccaaaaagagaggtaaaggcaaggtgttataagaaattagaggaagaaagaactcctttggggttgggaaactggaaggagagctgctattgagtacctactatataccaggtttttagcctatgtaattccactgttatgcctccccatgttcaaaaggttcattctgttattgaaatcatccatttttagtagtagctaaatatgaatattcttagagtccagtgggtagtggatagcatttcttgactttgtaacttgcagaaagtcagcctcaaatcagcatttgggagtaccttacctcttcccctttccacctctctgctgtcttcctagagttctggctccatcatgctagtggcctatatggtggaagcctgtgagactatcattcctggatccatgctggttctttcagacttccacagagataaggttacatgcctttagattcatgataatgaggcatctataaagagaaataaatctctctcatactaatggtgataatttattgtgtaaaactttgccttggggtgctaaaaagaacgtttaccatacataaggggtaagattggaaaggaactatagagcacagcacttccgcctgctccttctcccagcattcacatgtattatctcatctaatcagaaagattttatggaagacattgaggaatgtagatattgaatatggtaagacactgtgtgtaaaaggacaaattcaagtgccaagtttgttgttgttgtcactgcttgtttgtttttttgttattcaatcaagcatattacacagaataaatcatatatagattaattctgaacagtgagtcattgagtttgaaaaaggggggagaatgtggaagggatcaatgggacataatgctgcagaagttggtaggaagttggctaggttgaagagggtctgaaatgccaactaagtggcttttcttagtttgggatgctaaagcaaagtaccagagactgagtggcttctaaacaatagaaatttatttctcacagttctggacactggcagccagagatcagggtgccaacatggtaaggttctgatgagggctgtattccaggttgcaaattgctggcttctccttgtgtcctcacatgttggaaagagagctagcgctcatgtctcttttcataagggcactaatcccattcatgagggctctaccctcatgacctagccatcttccaaagacctgacttccaactactaccaaattgggattagatgttcaacatatgaatttttaagggacacatccagtccattagaggttggaaattattccatagaaaacaagtagccaaaccgtcattgaatgcgactccagctttttaaacatgatgcatattgcttgttctccctttttatgaactaaactcacattcacacagacagatgtcatctaacacagtgggagaggaggatgtgtggtagagctgcctacttggttcattcagttaccatcaggcatcgaatggttcacatatgctaaggggaggagagagaaacaaaagaaataaaattgatgacctccgacctgaggaagtttatagttcaattaaagaataggttgtggctacatttaacatgagtgaaaaacactgtagcagaaaatgttattgaatactccatagtcattctccttttaccttcctattagaactccaattttgttgttggcagcaacctgccttctcagatttgcttacacctaaggtggctgtgtaacagacttctgcccaatgacatatgctgagattaggcactacctcttccggctttccttcttttcttgactagaatgcagacattaggctggaagtggaacaaccagcctgggaccatgaagtgacaagtacaaagttggcaatcaaatgccaaagatagaataaaaggatataatgaacctggaacgtgaatggcattctggcacaaagcagccctggtctgtttacttctggcttttttgttatgtgagatgaaaaaatcatccatttgcatcagccgctgagattacattttctgttactactcaaagccaaatgcaaaccagttgatacaatactcatggaatagccaatcccagagtgcaaatgaatatgcaaatgcaaagaccctaaggagagtttatggaaaaatttttcagctaggtgtttgaaggattaaatgaataatttcagatgttcaatagcaaatgctaatgcagggttgtaatataaaattatgttcatgagacgaaagcatttaaaggaaaccaattgtgaaataaattagtattaggggtatgagaaatggatgtggatatgtagaggtgaagaggtgccagtggtggggaggagcatcagaaatcatggggcccaaacagcaactagaaaagcttccaacctcgttatcccaaaaagaggttgcaagggaatgacctggccagaatagaagcccttgccctgatattcacatccttatttattctgataaatgaatctataatgtgtctcaggccaagcctaaatgaatgccattctttttcattagtaagttatttaaaatcaatgttttcgttaaaagaagctttcagatgttactaatttaaatctcattaactgcttactttattttccagagttcaatctaagctgcatctttcatttagattttaagctataggctatatgtaattctacaaaaatgccctagatagaaaggaaggagtatttgaagcccacaggtgaacattagtttagaaagcttcaagcattgcaagtctttgaatgaggtttacctttataggctacttaagggatgtcaagcagaaataactggtggtatcatagcttacaatgctggggttgggggctgagatcttttctccatcttaaatttgcaactcaaaaaaaatttggttacaattttttatgtgtagcactaaaggcacactactgtgttccagagaaaggcaacctcagatctcatttttgatgccatgtttcagaatatttagttttaaatagagcccccaaatgacattataaagggcatgcagcttaaggcaagctgtcatagagactaaaaatttaatacagttttcctctaaaagtggttggctacaagcgtaacagtggcaccctattattttctttgcataaaattaacatatcacaaccaatagttattttcaattatgtggcatcaaatgaatcttaagagattgaaataagatccatggtagctttggaggatttctgcaattgacagtttgacacagcatggcttcagattatgtcaaaactgacaaaagcatgtgtagcctgcttaaaagaatattttttcaattctgtcttgttggaaatacttgccatgaagtaataataatacctttaatatgcaaatgattataactgcatttattacactgtcaaatggaaactcaaataccagctctttgttttacaacccagcacatcacacaaaataagagaaatgactgctttcatcatagagttcataagtggaagaacaaattctcttttccctgaggttgctttcattttctctcagatatgttctttttccacaactctgaaaaaaaataagaatttagttgatcactgaagcattctgacattcagattttctccttagtctttatctccatcctgatgatcctatatgtgtccaacacttttgcgaagaaaaattgcacctttgaaggggactttacagtaaagtaccccatataactatctttattcttatccattgtttgatcttactgctcatttttaaaaacttcccaggggtctcattttttcctcatcacttaaacaggaataatgttttgtgctgttcatttctccagcaacctccacttcattcaccttggctcatttcattagccaacagtccctgaagcactgccatcttccactccttgctggagaggccctgcctggatgcggtggtttttccaccattaggcacatgcggtgggaggggtggagaagcagggggaagtagtttcttcgtatcttcagtgaagatactttaaatctgtgacatttttttttttagctttcacattcttttttttcttttattattattatactttaagttttagggtacatgcacgtaacatgcaggtttgttacatatgtatacatgtgccatgttggtgtgctgcacccattaactcgtcatttagcattaggtatatctcctaatgcatccctcccccctaccctcaccccacaacagtccccagtgtgtgatgttccccttcctgtgtccatgtgttctcattgttcaattcccacctatgagtgacaacatgcggggtttggctttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacagtgccacaataaattgacaaatggggtctaattaaactaaagagcttctgcacagcaaaagaaactaccatcagagtgaacagacaagctacagaatgggagaaaatttttgcaacctactcatctgacaaagggctaatatccagaatctacaatgaacacaaacaaattcacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaactacaatgagataacatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcaaggatctagaactagtaataccatttgacccagccatcccattactgggtatatacccaaaggattataaatcatgctgctataaagacacatgcacacgtatgtttattgcagcactattcacaaatctgtgacttttgaaagatgcttccagcatatgggccttctctattttctcacagagacactttaattcagaacattaaatacttaggtctccatcataggtgggaattgaacaatgagaacatatggacacaggaaggggaaaatcacacacaggggcctgttgtagggtggagggagaggggagggatagcattaggagatatacctaatgttaaacgacgagttaatgggtgcagcacaccaacatggcacatgtatatatatggaacaaacctgcatgttgtgcacatgtaccctaaaacttaaagtataataaaacaaaacaaaacaataaacaaaataaaaaaaaaatacttaggtctcctagtgtacatcctgtactccatagattacagtcagagtctcctttcaacagatgggtgtgtgtgtgtgtgtgtgtgtgtgtgtgtgtgtgtgtgtgtgtgtgtaggggggtaaattcattgtctttcctctgttttttcacttcccccatttgcttctgccaatctttcctgtgctcttggctgatttcccttctcccattggtggatctagctacttactaacaccaatacttcatcattcccagtactttatttctttggattattctttactatgatttttcctcccatctacctatggtaggtaaatgagcagacttaccttcaatatgggaagattctgggccaagacattttgttctttcttttcactccgttgaatcacagttcaaactcgtagttaagatgtaagtcttctgcttaaacccttcagtgactccctgttgtttacatgataaaagtgtagctccttagcctggtaaagatgttcaggactaggccttagtaactatcttctgtctctgactatcactcaccatcttcttactttgctttttagtcatgaagaattgtttctacttttcccatgtaacccaagtgatttgatgcctctgtgtctttgttcacagtgtttcctgtatctggaatatacttttgcttattgtttggccaataatccatccccaagtcctgcctcccatccccaatgcctgccaattttagtagtacatagtaactgctaaaattgtattggttgaatgattgaatgaatgaatgttttttgtacatctctcaacttttctcagggattctttcactgagtatatccacacaccctcttcaccagtccaaggagctagtcaggtacctcttcttgcccccaaatcaccctatattccccgccatttataacacttactataatgctgtgagcttctctaaaggcaaggaccatattttattctgctgtgtccccaacacatgaaagagggcctggctgaggacggatgttcagtaaatgatttttgaacttaaatgtttcttgaacctatttcctattttggtgaataagaatcagcaaatcccttgtcaagtaaaacctaatttctgcttttctaacaccaaaccagtctcctgaagccagaagatctcttaagtcctttgaatagtgaccactattttagatattaaactgaaatagagcatgtaaaatttcattatgaaccgtacagtgttatactgatgagttgcattattatctgttttgtacatgtcaaatgaaacttctcagaccacttccaattaaggctggggccctgtactttcctacttcttccttcccctgtttcctgtagtccctaaaaaccctagaattcccctgcaatcggtagttgagtacacagaaggaggcaggttggttaagaactgtcagagttgagattatttactaagaatagcattagcaggggtctaactttattagattcaaaattgcccagctgctaaggtggccctgcagactcaaagtaacacttaacagattcaccagataatcccagcatggccacttacttttaatctgctttccagtctttcagagagataggaagtccccctctatgtccctgtggatgtcgaatcatttatttggggggcctaggtttactacagtgatccagcctgcactaatgtcagaatcctctcctttgctactaaaactatatagtacctctcactcatatcctaaaaaatccaatctcggctgtgaatgacattaaccctgttctaccctgctatggtttgaacgtttgtgtcccctccaaaatcatatgttgaaatcctaacccccaatgtgatagtattaaaaggtggggactttgggaagttattagatcaaaagggtggagccctcatgaatgaggcaagtgccctcataaaagaggcctcagggagcttctttgtcccttctgttacatgaagacacagtgagaaggcaccatctatgaagcagaaagccctcaccagacacaaaatctgctggtgccttgatcttggacttcccagcctccagaactatgagaattaaatttctattgtttataagccactaaaattttttgtcatagcagcttgaatggattaagacctgccccttcctgcaaactaaatatatcctactctgctttctaggattgtccagggggttctattcccattcctactgaccttatgccatattcttctggctctaaatttgcattctagaccttcccagggccttgccttcttattcctgttggccaaagaaagtcttagaaaatttcagaaagcatcttatagccctggtttataagagggtagaaaaaggttttcagccctactcattccttctacctgagtagcctagagtttaccaaattttcttatatggctaatataaatatttgtatcttatactaaagaaactaccctttctggctttctagtaacttaattttttaaaaaatatagcgactttattgagatataatccacataccatgcagttctgccatttaaagtgtacacttcagtgatctttagtatattcacagagttatcttaccaaaccaaatttgcatctgtccccctggtgcagcaaaaccaaacagtgacattgggatttgcagtgagaaaaaatgagacatttattgcaggagaccaaacaaggagaattagacagctaatgcttaagacctgagcttacctgaaaacaggtaagggtttttaaaggttgggaggcagaagttataggcaaagtcataaatcattacatagaagctacattggtttggcgtaaaaaggcaggacatcttgaagaagggtattataggtcatagattttggatttaaaggttttctgatttgtgattggttgagtaggcaaagttttgtctaaaatcttggggtcagcagaaagaaatgttgagctctggcatatgggtgtgactttctccaggcccctcaggaagacatttagaacaaagaagggatgtcagggtttagtcctcagtttccccagagctgaagtctgtgtgccagtggatggcattttccatttgatgggggtctgggtttctgaaaaacaactcagagacatagttaacatgttatctttagtttctataggaaaccaaacattctgtcactctaacttccttggctattattttaagctattattaccttctcacttatcaggctgctcatttacttctcagggttagctcggtgactagaatttcccttgaaggtacagagattttcctttatttccatgcatgaggggaggacaagaagaacctaagaggggtccctgcttgtctcagttgtgtaatcattaccacaatcaatttaggaacattttcatcatgcccaaaagaaacccaggcctatattaacagtcatcacccatttcctctcaacacccctccaatctcctggcaaccatgaatctactttctctttctatgcctgttctggatatttcatatacatggaatcatatatgtggacttttgtgccttctttcacttagcataatattttcaagtttcatccatgttgtagcatgtatcaaaacttcattcctttttatggctgataatattccattgtatgtatatgcatatttatatcatgttttgtttatccattcatctgtttatggacatctacattggttcaacttcttgactattatgaataatgccattatgaatattcatgtacaagtttttatatagacatatgattttatttcttttttgtatatacctagaacgagaattgctaatttacttctaaaattaagacccgagactgctatagaaaacaaacatctactatgttctctaatgggggtggagggaggaaagctttgccattcccaccttgtaaatcagtagggtaaacaaacctaattattaaaaagagttgctcttttcctgtctttagagtaatcaaagcagagcattattggtacacaagccccacgtcaggaggtaattgttttattttttgtgtttatcaaaagtcaatgatatattgacatttgcattactagtcatcctgtttcaaagtgagtgatgaaacactcttctcctaggaagctatttttttttctccatatatggacagagctaattaacaaatggacctatggccacctccatgctgtgacacatattctatattctcaggagcctgtgcatattacaattctggtggtaagtgtaatgtcgtaactttcattttatacctgaagagcagtggttggttgacagcatacaaaggaacatatgtgaaaatgtactttactagttggattttgtgaatagtatgttatgaatttgtcatgtagtagatttcatgaaacctgtatgttttaaaaaaatttccagcattttattgatatttagaaaatctgttttggtgccaagaaatagaagtgcaatctcttacaggcaggtgcaagggtgaggaatatagtgatttatagtttctccttaaagagggtttctgagttgccatttcacatccattcatggatttaaaattgtttttctgaatcttaggcatttttaaaaggaaatctccttgaatagcaagaaaattatcataggtcttgctattatctcaatatttgtgtccccctaaaattcatatgttgaagcctaatcctcaaagtattggaattaagagttgaggcctttgggagatgattaggtcatgacagctcttttataaggattagtaccctaataaaagaagctcaaagaatcttgttcatcctgtctaccatttgaagacacagcaagaatgtgccatcttgaaagaagagagcagccctcagcagacactgaatctaccagcaccttgatcttggacttcccagcccccagaactgtgagaaataattttctgttgtttataaattacccagcctgtggtattttgttatagcagcacaaatgcactgacagaggtcaccagatgcacatgttctttggctctgtatacaaggcttttaaaaacaacaaaaattagctgctcctgtagtacgatgctcttatctttggtttctttatgggagaggatctatggaatctttttaaatgccaacatgaatttaaggtatatctatatgtatgatccccttggactgaaatttcacttgagtaacctgaggacctagaaagagtaacataataaaagcccttaaatgaaagttctacaaaatctataaaaaatagcgagaatagaggaaattgagcagcagacttaacatctagttcaagtcctagtctgctgcttattaggtatatgacaatgaatatgttgcttaactattctttgccttagtttcatcatctgtaagtaggggtagtaataatagtacctacctcatgatgttgtggagatcaaatgagaacatgtatattaaggcggtatacaaatggtaaaacatggccaggtgtggtggctcatgcctataattccagcactttgggagggcgaggtgggtggatcacctgaggtcaggagttcaagaccagcctggccaacatggcgaaaccccatctcaactgaaaaatacaaaaattagcagggtgtgttaacaggcatctgtaatcccagctacttgggaggctgaggcagggagaattgcttgaacctgggaggcggagattgcaatgagccaagatcatgccactgcactccagcctgggtgacagagcgagactccatctcaaaaataaataaataaataaataaataaataatacaaatatgtgtttacataattattttaaaattgatttatattttaataatcataagaaagcaaggtcctatggtatgtggattgaggtataggggcagcctggatttacatgaatttaaattttcgtcagttaacacaagttcctttcaaaatttaggcttttgtttccctttacttcttcacagtaacatatatgagatgaagacactcatgtatcagattagttcaacatcaatatagaatcatcagccaagcagggacatgacatcaaaacaaactaaacactagttaatgaagaactagagcatgcaaatactattatcaaaagacacactgtgtcatcaggacttgattttggttattctctttggtactgggtcagagttcaacctttaattttggtctgccagtgaggtggagtgatagcaaagcggagcaacctctactttcaaggtcctgaggtacaagcctagtttcagctacatctgtttccactaggcccattgagggttaaaaatctatctgttcaaatatttcactggagctagaaatggcttgtttaaagggcccacaggtgcctttctttctctatacagtgcattctttttggtgtatctttgcttcttggtcttgttaaacatcttcattccttggtgtaaatgaacagctgtctcagtagaaaggagatttgctgtctgtttcagactagactggactgacagttcttaggctgcctcagccttaggggaaagaactaagtgatttgtctttcatggaggttaataagcacttctcttgttggttggtttgtgtataaacggctcaggctttggcacgcaatctgtcacggatcttaataaattaccctctgtttatgcacttagaagtaacacttgtattaccagtatggcaaccaaatgttgaagtaaatcaccacacgtgacaaacagaccttaaatcatttgcccaactatttccttgacctgtcttggaatgtgaggaaatggaaaaaaaaatcaagtgataggaatgttttgcatttgtggagaaatagaggaaatccactgtagttttaagggaaaatatgcatagcaactataaatccaaggagattgtttaggtgtcactatttcaaagtttgctatatattttcaagttgttaggaaatatttctaaattgtgtctacttccctgtcttgataaaaagttgatcaaagttaaataaatctttctataatgctgggaaatctcatcgtgtccctgagcatctttactgtacaactgtggtgcttggtgtctctggaccactgctttgatcatcagtgaaatatgtctaggatcatagatggagatgtaaaaggtttaggaaattgagctgaattgcgttgagcacttcattccttggaagtatttttagtaaaattactaccatgatttttttctatgtgacttgacattttttttaagtggaacattcaaaacatgacttgagagttcttttagttgtgatctggctgattaagattttattctattagaataattagagagaaaaagggaggtagagagagagaaagacataatattatattaaccaaaatggtgtctactctacaggcacatttacgatgtagaaggtttttctgtttttttttgttttttcgtttttttggtttgtttgttttagtctagagatttatcatagtagacaggagataattcaactaaaaggaaaactccacttcctctattttattgactattgaagttgggagcaagatgacaaacataaataataaaattgggatagtacccagaacctatgttgtttcaacataggctttcagttttcattagaaagtgggcaatatgcaaatgcccatcaatcaacaagtggataaaaaaactacagtgtatatatatatatatgtgctggaatactagtcagccataaaaaggaatgaaataatgacatttgcagcaatctggatgagattggagactattattctaagtgaagtaattcaggaatggaaaaccaaacatcacatattttcactcatatgtctgaactaagctatgaggatacaaaggcataagaatgatacaatggactttggggacttgggggagagggtgggaaggaggtgagggataaaagactacaaatacagtggagtgtatactgccctggtgatgggtacaccaaattctcacaaatcaccaccaaagaacttactcatgtaaccaaacaccacctgtaccccaataacctatggaaaaatggaaataagtaaactatggtatcactataaaaaaagtgggcaatatgattacacgaaaaagtcttattcccagaaaaaatattttttcaggtatatactgctgaacatgaatgcatacaattcttcttatgaaagaattttcaggtggttgactctctttctatttgtagtgcactgaatgtgctctatggcccataaaaataacaaggaaacttcttattatttgatactgcattattctaagttgcctctgcatagcaacaacttcttcctttgttgtttggtaaattctcaaatcaaattaattgagacattttatgtgccctataattcatttagatcatacatggtgagcattacatgcaaaatcttctgactatccatatgtagtttacatgggccttattcaaaatcacttaaaagtctagtcagaaaactttcaaattcctgaatatcacgaatctaatttaatgagtttgaatgtcccctatgaaattcacattgagatttaattgccattttaacaatattaagtggtgggacctgtaaaaggtgattaggccatgacagccctaccctcatagtgggtatatataacaccattatagtgggagtgagtatgttattaccagaatgtgcttcttataaaaggatgagtttgcccctgttttgtctctctcatcctctgtttgctcttctgtcattggattgtatggcaagaaggtccttgccagatactggccccttgatcttgaatttcctactcaccagaactgtgagccaaaacactattgttcagtgtaaattaccagtctgtggtattctgttatgggtgcacaatcatactaagacaatcagttgattgttttgtttatttagcttaaatgctgactgcaagattttttttttcttgagacaaagttttgctctgttgcccgcaaatttgacgtgtgtgtgttagttctctttcaacatatattaataccagattgactttgaatagttcttccaacttggagttcttttgggaaaatgagcaggtctctgtaaaggacaccttgtgaactagattatgtgctaatggtaaataccattttaacatagctaacatttattgaacttgttttatattacagccacatgacgtatataaacttaattctgacaacaactcagtgaggtagacattgttttcattacttccaatagatgaggaaagtgaatcacagggtggttaaataaattgctcaagtttgcacaggttcaaagtggcagacctgtaatacagactcaagcactctgactttagttttgtaaagcaaaaaatatccgagacagattttaatcaatttaaatagaggcttattttgccaaagtgaaggaccatggcccatgacagcctcaggaggtcctgagaacatgtgtccaaggtggttgggttacagcttggctttatacattttagggagatggaacttataggcaaagacataaatcaatacatgtaaggtatacattggtttgtcccagaaaggcatgacatcccaaagcaggggcttccaggtcataggtggattcaaagatctcctgattggcaattggttgagagaattaagctctgtctgaagagttgaagtcagctcgagtgaagataaggggtgttgtggaagccaaggcttttgtcatgtatatgaagcctccaggtaacagacttcagagagaatagatggtgattttctcttatgggaccttaaaagggtgtcagactctccaaaaatgacctagtaagggaaagagattctttctctacagaatgcatatttcccccacaagagacagcttcgcagggccatttcaaaataggtcaaagaagtatatttgggtgtaaaatattttgatttccttcagggcctgctatctgtcatgtgatgtgataccaaagtcaggttagaaattggtatcttattgctacaaatattctgttttatcggtattaagatctctgttttaatgttaatgctggtcaattgtgtctaaactccaaagggaggaggctataatgaggtatgtctgaccccacttcctgtcatggcctgaattagtttttcaggtttctttgggatccccttggctaagagagggatcccttcagtcagttgaggggcttagaattttatttttggtttacagtatctacactttcaatcactgaatcatatgacccagcaatgccaccatatgttatagtagagcaccattatatcagaattgttggttgatcctcttgtgccctttagcctgtgtcccattttgtcctctcctatccttggtgccaaacacctatttcctacatttccttaccatcagggcatgctatatcctgtgcagatggctttggtctttaatagtagcatcttgatctcctaatagaatcagagttgtcaagtttgttttgttttgttttctcctttattgtgtttaactctctgtttgttacactctattatttctttctattgttcctgtgtctcctccactggatcctcttttcttgttctcccttttatttttttcttcattctttctctttataaatgcatttataatcatggctccagtgaatacctctgagcagctttctcgccaacctctatcaccagctgtaatcatttttataagctcttttctctctaaccatgtactatatcctgccatgagctcacttagcctaaaacaaacttatcaccctctttaccaaaccagtttgacactacctttaaaattttaatggcacgattcagccttaaaacttccaactcatttgttattcaaccttcttgttcctttatcttgtcaatcatcaagtcctgttgatccttctttggtaatatatctcatccattaattcctttgtattcccagggcctgaatattttccaggcctcattatatcttgcttgtaatagtataataatctaactagtctcctggcttccatggtgcttaccccctagtgtctttccccatttcatatcctcatcatctgttccactgagggtagagagaaggaatataactataataaattaaagttaaaataagtagaaatagaatagtttgaagtcagaggagcaagctgtcattgttggttgagataatcagggaaagctttaggaaggggatggaatttagaatttatataaataaagaggtctgaggagggcatttaagattggggaaaactgggtgaacagaagcttgggatggaaatgtaagaagtttggggatacttagtaggcctggctgagctggaccattattgtaggaaaaatgaggttgaaaatatagtctgggctctgattgtagggatccttggataccaggcaaaggaatttaaaatgtatcatgtagaaaatgggtagagacatgatgaaattggcatttcaggaagatgaatctggcagctgtgtgtagggtagattagtgggaggagagactacagagagggggcctggttaggaggttgtaatagggttcagatgtgagttaatgatggctttgaatagaacgacagaacagaactgatgagatggatgcagatgtgcaaagcattatggaaggaaatttgataaggtttccttgagaggctgaatttgcaggcagttgggagaggaaatgggagggttggactctgggtgaccaggagaatatgtatcaaaatgttcccatccttcaagcttcagtgcttcctcctctaagagtacttgtcccaacggagcactgtgagcaagccactttgactgtaatagatgctcaaatagaattaaggaaaagcccactccagctggcagtgactttgcatgctctaaactcctagacacctattgactctacttttagtaagcacttagcatacatgatttctactaaactagcttttaatttgaggatgttttacctctacagtgagagagatcaggagagttttgagggcagaaatcatgctttattccttagattcccacctacctagtccagttttagacccatactagttgttaaaaatattttccttgattgtttcctttcatcctcttagggggcttggattgatcatctcacaggtatactttcctatccattattatgctgatgagacttacagtttaaatacattaccacacctgagcctcaggtacttatagaaacttttcatgtcccatcttcatagtctcttttccttttccagtgcagtttactgagtctgatcacgatcacgtattttgtgtttcagtaggtgcttgttaattgttggtttactttaagattcctggctgtggtataagctctgctacatagctaatgcagctttagttccatctgcatattttagcaacactacacaaagtgaatgtattggcacaaatgacagactttgttggtttaattttgtaaactgtttaaaatttggttcatttcttttcatttgcaaaatatttttattcaagtgtattatatagctattcatctcagaagaaatttgctattgcttgaaaaatacagtttgctttatgatcccaatattataaaggttcagagaaaagaatatctctacaaacaaaatatttatttgatctcgagacccttctcaaatacattttattcgtatctgatcagaatttctagaaacatacaattacacgttaccttaaattggtaagatttaatgtatttgacagtaattcccattaaaggaaactgttgcaggactctctctcctatgactatattagagccctgaattccaatgccagatctgccctttaatttctttgagaacttaggcaaggcacttggcattcctgggtctctttctcccatctataaagcaagagtattgaacaagatcacaagatcaccttctatgctagcattaattttggtttcgagttagcaaaaaaaaaaaaaaaaaagatctttcctttttttaaaaaaagcatatgccatgaaaatttcaagaactaagggcagattatgccccaacatacacagtcctcatagaaattggaatgggggacaggaaagccatcaggattggaggttattttgtctcaggatctggctaactacaaagctctctctctctctctccttttccccacatatctgcaatattctctttctactgctgacttccttgtatcttcagcttacatatggcccagaaaagttctatcttcaagtcccccatgtccttctaactcagccgctacaattatcaggctcatcctctcaattttcaattataaaattcaagagagaaaataattgactcaactcattttttaaagccagatcttgtaaaacatagattggctggtcaggctatagaatgaatgcatttgtaagaattgttcacaatggtccaattagttgtggccagtggaggtgggaggttgattcatttggaactgaaatgagagttaaggattgcaaaagttatattctagaaaagcacttagacagataaacaggtactctgaattgcacctaatacatcttccatcactgaaattctgttaatcaaaaagtattatttcttattgaatgacaaaagagatggtgctctaatggttaggatttcaggaattagtcagcaagtaggagagattttagttttgttattgttaaaatataaattccaatgtaaaagtaagatatgcttccagctgttattatttatctttagaatgtatgagttttagcttcctttttgaaaaggtgagcattggattcatagaaccaacttgtttaaaaaaagagtagaactatggggcacggaggaaaagcttcatctacagtaaggctgttttttacatcttaaccttaaaaatctaggcaaggacccaccaggcgccgtggctcacgcctgtaatcccagcactctgggaggctgaggcgggcggatcacgaggcgggcggatcacgagttcaggagatcgagaccatcctggctaacacagtgaaaccccgtctctactaaaaatacaaaaaaattacctgggtgtggtgcgggcgcctgtagtcccagctactcaggaggctaaggcaggagaatggcgggtaaacccaggaggcggagcttgcagtgagccgagatcgcgccactgcacgccagcctgggtgacagagcgagactccgtctcaaaaaaaaaagaaaaaatctaggcaaggacctcaataatgcatctcagtcttcacatgtccaaaactgaacttttgattcttacctttccctcatctactccttgtcacttcttttctttccccaccaaatggcaattccattcattttggtgcagacacgaaacctgagttattttttatttctctatttctccaataccccacatccaattcatcatccagttcttgaaaatatattccaaattttatcatctttgccattgctaccttgctagttaaagctatcatcatcttttactgggactattgcaatagtctgtgtgatggcttgttttgggccacataataaaatacgtaaagtagattttcagggggtggcttgaataggaaaagggaactcttttagagagtcacataacatatgggttctggtcccatttcttctattaactagctgtgcaaactggggcaagtcagttcacctctctggaacatgaaggggtttctaatggatctctttctgtctcggcattccgcaccatacttgccctcatcaccttgcttctgaattccctgctgtgctttctactgaccatctggagggaccctctcttcacagcatccagtgctccaggctggtgactgtgggaaagggagttctactatttatggtgctcactgtgtaccaggcattataccaggtgctttatgcacgttatctaatttaaaattctccataactatatgaagtaggtattattttattcccattttggagatgaataaattaagctctagatgcattaaacagcttactcaagttgtaaagctaataagaagtggatcagccttttccaggctgtttgtaaaaggaatatcattctgttttctagaacttggagcttcgagggaagttttgactataaaggtcaagagtggagatgaggaaaatttcaagtgctgatgttattcccattcagattgagaagccaagcaaactggaaatcctcatctgtttctgaagattcctacagaagtctttccccacctcctctaccaccaaaacaggaaacaaggcagggagacagaaagaatgggataggaaatgagatatgaaataggatagggaatggcttggtttttctgtaccaaatcccctatgggacactctttttgtatagaaatgaactaatgtgcactaacttggtggaaatgggataagaggtcctgaatctcataagtttccaaacacattctggaaacacattgctttccacacaaattactgtaatagatggggaattttaagttccaaactgaaacagtggaagaaccatttgggggcagacatgtaaagcacttcaggctgactccttctcttcactccacataggtagctgttcactctgctttctgcaagacttttcatgctctctgacatttggcttaatctgataccagagaataggtgattattttgtcatcaaaaaagtagaaacattgaatttgaagggaatttaaaattcgtgtagcccaggcctttttcctgagaggaaacagattacatgggttaagtgacttgcggttactcagctaataattagatacagctgacttaaagaacccccccccccactccaccccatttttttgtggttgtttgtaacaaaaatatttgctttcacaaagcgtaatctattggggcctgacctagtgatccaatctgaggcctgtatgatttgaacatttgataaacactagagctcaaagaaagccttcaccaacttttgttgcctggatttctttccctcaaaagttgatgagaatccatataactgatgaatttctttgcagtccgtttacgggtgtgtgattaaatcccaggtttctcgtggatgattctgagcttgcccatgctttaaggactcattgatccctgcatttattctacagcccaatacaagcagatatggaaattgtcctggcatcctggatgcattcttccatgttatttttattatattatatgatgaaattttgtaaatatgtttcctacatccagggatgcctgcacaatttaggggcactcaaaagaagaatgagagaatggacttagaattatgtgtaatatatattttattgtgctcatatatttagaggccttccccatttcaattgtgcaaatgcttgaaaaagtttctctggaaaaaaaaatatattaaaacagtttacccatctacacttcatttcattctccccaaaactaatcatctagaatttaaaataaaccataaatctaagagagaatgtaggggagagggaaggagatagaaagaagagggtattgattgagaggttgattgatttttattgtgatttatctgaggtcaccaaaaaggcatctaggtttctcattttctctgcttttaaactggacaagtctacccatttaattcttccaaatacaaggaagaaaactaaacagaatatcttattgaaaatttgcgcttctggtcaagacatgaaaatatttgcaatggtccatctggattgtaatctctagataggtagacagtgttcctttgaattgtgcatggtggcagggcacattggctcacacttgtaatcccagcactttggaaggccaaggtgggaggattgcttgaggccagcagtttgagaccagcctgggcaacatagtaaaacacaatctctacaaaaaataaaaaacaataagctgtgcatgggagcatgtgcctgtggtctcagctactcaagaagctgaagccggagggttgcagtgagccatcattgtgccactgcactccaacttgggcaacagaatgagaccctgtctcaaataataataataataataataataattgcgtgtgcttaaaataactcactacttaaattgctaatctgttttagaaagtacatcaacagattactgtgtttttttctcattcacttgaatttaaaattggatttttggtaacaagatatgaggcaaatgggtacaacaactgtacagtataaattgctccaggtgatggtgccatagcaaaattattacaggcagattcaagatacaaaaattatttatttgacagcaagcagaatgacaaattactcagaggctgtgtacatgtgcttctataattgctcataaattattatggttcatgttaaaattcaacgagtttgcctagaccacatggttttattttaaataagaaagtggcaaattattagcaattgggaaatgtaatctgcagtataaaatcattacactggaacgtggtaattttgtgtgcaactttttcatttgctatcgcctatctgtcaaaatcttcattttgtaacagtttttaagattatggagcttgcaacagaaaaatctgccactcgaatctcactaaaatattatttgccataaattagagttaattataaggtggatataacttggaccctctctgaggggatttagttactggatggcataagatacttttcctcatgatgtggctttcctggctttggtcctaaaagcggtgttatgggagacttcaggtgacttacctcttcatagcttcttgaactaagtttaatgattggaatacattttcttagcccaggaataaatgtctagtttttcaacccagtctatgcccactcaccattgttagatgacactgtaattccagagttacataataatataaactagttgtcatacttacgctacaatggcaagagcacttgttatagagtcaaacatggagttgtaacttactgtatgacataagtaggttgcatagctcctctaggcctcagtttcctatataagttgtaataccgtgaactctctgtctaccatccatgactgctgtgaggaagaaaacaaaaagccatgggaaagtgctttgtaaataaggccccatagaaatggaagacattaattttttgctgaactgaaaatcaattgctttacaatattattcagagtatatgtggtgagggaaaattttggaacttaaaaagcactcaaatcaggcacagtattccagggcatgttatgtatagtggccacaatcttctaaagagaaaataaacacaactttccttaagcatttatttctgagtttcaaataatgttaggacaaagatgtttcatcatttcatgtaactgaattattatatatttttaaaatgcttaataagagaaatataatgagtgcttttttataagcatttatacatacacacgcacttacgtacacatacttaggaaaacgtggatactgtgtaacaccatgtatggagggtgtgttagtccattaggtcttttataacaaaaatatcatagactaagtgtcttgcaaacagcaaacatttatttctcatagttctagaggctgagaagtaagatcaaggcaccagcagatttggtgtctggtgagggtctgttcttcccattcctcatagacagtgccctctagttgtgtcctcatgtggtagaaggaactcctaatcacctcctcaaaggccgcacctcgtaattccatcatgttgggagttacaattttaaaatatgaattttggagagacgcaaacattcaaaccatagcagagggacagttaagcaattgtcttggggtccctttaacttctagatcagctattgcaaaactatgacccaggggctaaatctggctcaccagctgttttgtagttttactggaacacagtcatgctaatttgttacatactgtctatggctgctttctcactaccgtggtagaattgagtatttatggcacactatggccaaaaaagctgaaaatatttatcgtgaggccctttacagaaaaagtttactgattcctgttctatgctttgctgaaaaggctgctcaaaaagcctccctcgcttttgccatttcaaatgaaatgcacatttcccccttgatgtgcaccaggtttgtagttacttattttgccaaaagaaagaatacaaaagggtcaactgacatgactccgggttttgcttttggtttcttccatttatcttctcaactttccccataatcaataagaatagtagataatcttcactaaatggagttttcttgaaagtttggaaggattttatttttcatgcaagtattttgggaaggtgaactgtattttctagaacctttgatatctctgctaatatgtcgtgcatattttacattgagttagcagaatctgcaagtatgataccacaacaaatacattctgtgctttttaccttggtttctgggagctcctgtcatttctgtatctctaggtcttgagagtgtatggctgaacaacaccccattcctaagaagatggtcatttcaggctcaaaaaagagagtagctacttatagttaggcttggccctaagtaggaagagactggcccaaggtcctttcctatgtaaacttgtctgtcatgtcactgaactttatctaaagacctgccatttgattgcaccccctccactccacctgagtactacagaggagagttaagagaactcttccaaaggttatctttatacagtagcaatactctctacaaggtatctcagcagctgacgaattagacatttattttaatgagttgaagacattcatgtgttcttgtcaacagttaaaggtaggaaaaaataacctaaaatgatttcaattgcctttggaaaaaaaaaaaacaagcagaaatcttgtattatcttggaattcactgattctgagctgacagcagattgctcagtaatcgggctgtgtctcagaagcagtgatttgattgagttctcatattcttctttgaatgagagatgttggtaagatggaaactggcctgagctgatcccaaaacttaccagactgaattatggttaaatgtgttgagagtgaccaatgtgttgagggcgaccaatctgttgaagtttgcccaagactgtctgtatttaaaactgaaagtcctgcattctgggtaacccttcagtctcaaggaaactggaacaagttggttaccccagggggactatgagataaaataatagctcgaccttgatactgtgcaaagaaatgtgaataagataggtgaaataccagttagtgacagaagtgagaaatgctattaagcaaaaggaacagggcaagaacaagagctctcttaagttattgcaatggttagcatacttcaggggctcctgacttaaccatatcctcctttaagtactttcaattcatgctctatatctgctatggattgacattatagcatagtgcttaaaacctcagccttgggaatcagacagtgtgggtttaaatcctggctctaccactgataagctgagtgagtttgaacggattatatacactctctgcctttatttcaccatctgtaaataaggttactaacaacagtagctgccttgtgaggcttagggagagattaaacacgtcattttaaatcactttgaacagtttctggaacatagtatgtgcttagtgttagctactattataatatttaaatcctgttttattcttctttgcacatatcactaccgtgtaggtgtctcataggcacctccagctcaatgtatctaaacctgaactcttcatccttgtccccaaactgctccttctcctgtgttggctctttcagtgaaggaaggaagttactttagattattctggaaggaaggaagttaccttagattattctgcaaaccttagattattcttgattcttttctttccttcaccctctacatacaggaaattatcctttgtactccccactgaccattcatttattctttattatatattcttccttttattataaaacatttgagtgccacccactgttccataaaaatttgggagcttaatagtgttgccactgaagcagaaacctaaaagccatgagccctttccatagttctccacatgcaatctcttacaagtctgatctacctccacatcacttatatccctatctactctactgttctctttgctacttccttggttcaccttcacttttttatctcaactatggtgacaatttcataaatgatctctgtgcttctagtcttgacctcttccagtctttgtttcacgctactaccagaatgatctttgtaaaaagctaatcattagagatccttcaatggctccacatggctttcaggataatttccaaacttcttgacttactatacaaggcctttaaatgatctgtctcctatttacttcactggtatcttctaacatttacccatatgctctagccatatggaaccacttgtaatttcctgaatatgtcacattgtttcaggccttcatgacctcataattgtagtttcctttgcttgggatgtcctgtcctctgtattcatctagctattggctcctcatttttcaaaatttagttcaagggccaattcctctgcagatccctctttgatcttccaatctggctcagtagctcccaagacacctcattctttctttcgtggtatattgaagatacctctggtatgcttaatggttaaaagcatagccttgggagcagtatccttgaatttgaatattggctctcacacttaccagtaaagtggccttggatgggttacttaatcctcagtgtccttgtctattatatggagaaatcatattgataaaaactacttgcaaggattagataagttaatacacgtaaagtccttagaatagtacctggcgcatggtaagcccattgtattatctattaatatcatcaccacaagtacttatttaataatcccactagaaggtaagcttcctgagacaaaggcccatatattatttgacagtgtagccccagggcctattccagtgcctgacgtataggtgctcgataaatgttgttgaaaaatgaaggaataaataaatgaaataaagaaatggagaactgaaatgccttccccctccaaaagcaattaacttcccaacccaccaagcgccatttagcttcatatacctgcaagagggagagactagtgactttagctggtccttatttttacatttgtaacatctactgtgctatttggaggaaagtatgcaggcttggctccattttcaaatgccagaagtttttgccttcactatcactttaaaccttgtgaaaataatcaaaagatgatactgtcccctattgcaaaagtgaaattctagcaaatcacaaaagaataaacggtgaaaagtcttcttaatcatggagctagctgtgctccatcctgctcattctggacacttggagagatgatttagagaatttgccagattgcagattaatcagaaagcacatgaactaaggtgagtgacagcacagtaagaagaacatctctgcttcacataaatggagacaaattgacttacatttgaggctgtacagttacacaggagaagtcttcttggttgtgtttttaaagtggagtggggaaaagccatcaatttgattggcaactcttgtataataaaaacttaaactaactacaagaccatttttataatgccaccaaatgttatcagccttattataaattattacattactttcatctatttctctttgtcatcgttactactctgtgggatttgatcttgcccttcttcaaccagataactaggcaagctggattaatggtccaacttctctcatctcttatctgaacctacaatcaaggagtccccagatcatcaactgaagtagtgagatagcagtttgaactctgatattcagatatagtgagatgggggaaagggttggcccaacactctgtgatgaagagatgggaatatttatcattttatgaccaacaattttctggccctgccaaaggaatttctgcctaaggaatgatttcataactctgagtcagctatatgggctgagatgagattttcaggagatatttttacctttacttggtcaattttgtttttccttcttcagacctgtttatcatggacttgttccatttgcaaaaccacttttgcattgtagctaatgatggcaaagcacctggtcgatttggttgattcagtctactggtgagtcactttaacaggagatgactccccgccattcccaaaaaaaggcagttctttgaaaacagctttggaagggctgtaaagctaagagagcatagcaatgcctcctccccccgcccacccccccacatacccacatccatgtggcttcacttgcagtagaagtggcacagcttcattgcaaaactgtaaagctggggaagtgtgtcttcaggagaggcagggaaagaacatggactttggagtcagagataccctgttttgccattttattatagttgttattattatcagttgcatgattagtatttacagagtatttgtaggtgccaagatctaagtcaaagtcttttatataatttgcatttcattctgtaatgacccatgagaaaggcactattataattccccttgtataggtggggaacctgaagcacagagaggttatcttaattgttcaaagtcgtacagccaagtcaatggcagatcctgaattcaaacatcggtatatctgattcttaacatttttcttctgtttctctaacaaatacatgaacttaatgaagtaatataatcctgagtttaacaaccattatgtcagagatcggctacagtgatgccaacacattgatccatcagcccttgggatagccagacaggcctgggatggccagccacattggtctgctagaagtcttgtcattttatcccaatgaggcaatacattttatagttttttatgtgtacgattacatgaaaaatttgggcagcaaaatttaacttctacgagtgtcagtgttttcctctaaatgcggggctattcatatgttttgctaaggttttggtgaggattaaatgagtcattgtattagccagtgttctccagagaaatagaaccataggaggtgtgtgtgtgtgtgtgtgtgtgtgtgtgtgtgtgtgtgcacgtgcatgtaaagagagagagggggagggaaggaggaagagagagagagagaaagagagagatggattaaaagtattggctcataagattatggagactgacaagtcctaaaatctgcagtcagccagctggataccctggagagccagaggtgtaagtttcagtccgaatgtcagcagtcttgagacagaggaagagccaatgtttcagttcaatctgaaggcaggaaaaaaaaagattgttccagccctaaagcaatcagacaaaaggaattctctcttactctgacttttttttttttctattcaggcctttaatggattgtatgaggctcacccacagtggggaggtcaatctgctgtactcagtctactgattcagatggtaatctcatccagacacaccctcatagacacgccagaataatgtttgaccaaatagctggataccccatgggcctgtcaagttgacacatgatattaaccatcacagtcaactaacatgatgtttgatatgtggtaaggacttaacaaacgatccctcccatcaggtccccttctttgatgtttataacaactctacactgtaaacagagctactctttattttacagataagaaactcatattatacccaggtatcttcaaatcttctatccttttaactataccatataaccttcatgccactttttgtcgaatgatgttacttaataaggaccagagagcccctatgggccaaatactcctttcctttttccttctttcagctctacccaattaaaagtcactatccagagtacaatttattcagcaggtttgtgctgggtgatgatagtgggtattggcttaatttgataaaatagtctatgctaatacataataatgatatctctgctaggagttttgtcatttctagagtacaagacactctaattcagtgaaaaaaaaaaacaaccatgatccctgaagtctctaaaaggtggtacaaagcaagtaaagcacttttggttgagaaactttcagtttctttctttcttttttttttttttttttttttttttttttgagacagagtgtgactctttcacccaggctggagtgcagtggtgcggtcttggctcactgcaacctccacttcttggctcactgcaacctccacttcccaggttcaagcgattctcatgcctcagcctcccaagtagctgggattacaggtgcatgccaccacacctggctaattttttttatttttaatacagagagtatttcaccatgttggccaggctggtcttgaacttgcgacctcagatgatctgcccgctttggcctcccaaagtgttgggattacaggtgtgagccatcactcctgggcccagattatttcaaactgaattagactttatggatggtagggatttggtggagtgggtggggaggtaggttctgcttgttcctcctataaattgagttggtcctaggtagtcaggaagaataggctttttatgctgtagctttgaaagccaatggacatcaacaaggtgtccatctcaggtaccttctcctagccacctgataatattaaaatcaatgtcatgaaggatcaaaagcaaatagccacaatttctaacttgttataaaaagcttccatgcagcttgataataatgaccctctaaaaaaatgtaaaacaaagggagagagtctttggaatcatttgtatttgtcagctaaaaaacagtgggcaaatatcatgataataggaaaaaaatacaaatgagcatataaaaatatttataatatcttaagatgagattatcagaatagttaaattatggttgccagtatgaactgaattatcacttctgatattatacattatttccaataatatagatgatcattccttatattaaatatttcaaatgttataaattatattaccaataagaataatcactgctaaagttataaatcaaattgtacttactattactaatattgacaataactaatacactagagctaactagatgatgttagatactgtttgttctaagtacctgacatgtattcattattaaatacaatgaccccatgaagtagtcacaagtgtcatttgttttgctgacatggaaactgaagcacagaaatgttaatatgacttccccaagaaaacttagctaagccataacaggagtagtaagtggacctagttccagcacccaagtccttaaccccatgctatactgccagtcaagaaatttcttttctagccttttctagtatctcactccatttaagaatctgtagaattaggcaaagagtagtgtaaaaagttcaagaagaactagacttcatgaggatttcgatgaagccctgcttctttcatttttaatttttgaagtaggattcagaaaagtttagacactggccagaagtcacacaacattagtcaaggtgcagccagagattggagcctgtgcctaggttcccccaattatgaaggtaacaggcagcggtaaagggtggtagacttcccctggagatgttcagcttatattccttcatggagttgttgagccagcagactgagataaaagatgcaataggattttaaaagaaagttcagttttgggaggagtctaagaccctctatgaggccccacctctgctaataaaaggatgtccaaatcttttgagaattcaccattttggtctcaaaattgaaagaaaatggccctatttgatcctgggagttgtggcatctatggaggcagacaacacttcgagtaggtatccccacagtgtctctacagaacctgtgacagagacctctggggcccatggtaggagaagtttcccaggatgtgaatgcagaagagccatgtgtcactgaagatggtcacacacagggatagagagaataggactgtggaaatcaggaagaaggtggggtatgtggtaggtgacagaaacagcaggtcccccgttcaaggccagcttgctccctttggctctcaactccacatccccctgtagcatagggagtaaggctaggtttatattctgaagggcagtcttttccccctgccctgtattttggaggtctatggaggcagttgatctaccttccatcatatagaatgtggcacagctgggaacattgatcttaatatccccatttgttcctgtccaggcttcaagcctgctaaactcagtacggactcaaatagtcaaaaactgcatgttgtgggtgtgtgtgggagggtggtgggggtgggggtgctggacagaccttattaaacacactcccattaatctctacctcaccttacctggcccgcttacctgcttatgtcagcccagaacatatacacccagaagagtggagactagtgctggtggaacagggaatgcccctccatgtccacctctaccactggcagttcatgcatcagaaaatctttccagaggagtcacgatgtgacagtgtcaaatcatagattcctttaaatccaacccttctctggctctagatggagtgagaaaagaatcagctatgcttggccagtcttgggtgtatatttggaggaaactcaatggtcaaaatgcccccatggcatgtgtggaaggcatgagggtaaagggtttgaacagagcaaaggcagcaagggcaagaggctgagaacattatggacaaaacgaatcatcctcctgaatggatgaggagaggaactgatatgtggggccccctcaggggcctgataacctgtggaggagaaagggaaggaggttggggattaagaagttatattagttttctattactgccataacagattatcacaaatttagaagatttaaataatacccacttattagcttacagttttgtatgtcagaagtctaggagggcttacctgagttctctgtttagggtttcaaaagtcaagtgtcagccaggctcagctcttacatagggcttctggggaagactccactaccaagctcattcaagttgttggtagaattgctgagattcttgtctccttgctggctgttagccaggagctatgctctattcctagttgagtttgctggcattccttctcaagtgtcccccctccatcttcaaagctagcaattttacatagagtccctattgtacctaagattttttctgacttccctctcttctgcaactcgagaaagctttctgcttttcagtgcccatgtgattaggtcaggcccacctgaataatctccctattttgtggtcaactgagccatataatgtaacattaccacagaagtaatatcctgttcacaggttctggagatgagaatgggggcatttggggggtcattttagaatttctgctacaagagtgtttatggagttggagggcagggacttagtatttcactaggaacaccaagctccaaagactcaccccatattcttagccaaatcatggtctagaaccttaaactttggttggagagataggcgtagggataagatgatgggcataccctgttaatggtaatctcttaataatttgtggtctaggtggtgatgttgggcctcagaaactgaactacaatgactaggggtgaggacagaaggtccttaagattctgggacttaagattttcccatccccaagtcttctaaaaacagagtatgcagagctgtcctccccacctggccacctacatggaaatattattcacccctctggaatttcatgataagacctatgtggtagggacatttctgatgtctctccaggctcactcatgtctcagtcacattaaacaacctagcgatatgatgaataacaactgcgggtttgcccgtggatggttcaggacagagccaggagcaatgcggaagccaacaggaaaatgaggtctgatatctaactctggttttctagagggaggagagtttccttggagaagggaaagaaagtagccaggcctctgttgtctggtgggaggaaggtacactgaatctggagctcctcatagcagtgttcttaaccttggcagtctgggttgtgttactgtcaaagtttctgcaggatgcccatgctcaatgacagataaataattaacaagaggaggctgtggcctggcctaggtagttgtgccctggtaacccatactcccttggttttaccctctagagctttctcacccagccgtctgctagcatatggagttgatgttgaggtgttatacctagagttctaactgctgcttctttttttttttttttcttgtttgagacagagtttcgctttgttgcccgggctggagtgcagtggcatgatctcggctcactgcaacctccgccgcccaggttcttgcaattttcgtgcctcagcctcctgcgtagctgggattacaggcacccgccaccatgcctggctaattttttgtattttagtggagatggggtttcaccatgttgcccaggctggtctcgaactcctgagctcaggcagtccacctgtctcggcctcccaaagtgctaggattacaggcgtaagtcactgcacccagcctctaactgcttcttaagcagacttccaaccaatccttttttttaggtctcatctttaccctcctaccacttctagagggaacccctgcctctaatcctttcctatgaggagctgacaaattttcaaatctccaccccattaacaaatctcccttgttccttctctcaattcctcattcaccctcattcatcatcatcattcatcctttcataacccattccctgcttccccacggatgaagactcactccattctcttggcaatcttccaggccatatcagttgagctggaccttatccaagtatatattggacacatgcaggctggaagtcttaacccgctgtttgatcttgaatattggctgcataaacagacataaacaactggctgttgacatgacatttttcctttgagcagggagggcagggagggtggatgaagattgggaggatggtaccacagctggagagaaaagggctgttgtcatccacttactgagtacaaggaagagtatctttctttacccttttgcctttttaaattttgcttactctttttacctgggctagtaggaagctaagagccatattgaatgattaaaaaaatttttgaggaaaatttattgtgtaccaacactatacaagatgcttttggcctgagctatttcatctgagtctgctgccaacataaggagggacaaattaatccccaccctcaccctgtacgctctggctgagtcccgaacatcagcaccttcaatgtcacccactgctggtgcctttgactgttttacacatgagaaagtggggaactcttcttcttcactgatataacaataagatcgctataatttgaataaaatactagttatgtgtgataattattcctatcaatacccatgaaagtagtagcggttaagagaaaggaacctggactcaaactggttgtgggacctcaagcaaggcatttaacctctgtctcagtttgctcaaattaaattgggtatatttataacatctgtcttataaggttgttgtgaggattaaatgagtcaatgaatgtaaagcacttaaagcagtgcttaatacacagtgaggagttaagaaactgtactattattatcatcattactatcattattactactatttaccagcttataaatcacttaaacttgacaaaaaccctgtaaggtgtaaatttctccctaatttacaagaaactctcattcctcacagtagcattaattccaattatagtactaacaaatgcaaatctcaatcctcacagtagcattaattgcaattatagtactagcaaatgcaaataataatagaaataacagtgatgcttcataattatgtccattttacagatgcatgccaagattatcaggagtgatattaattatgattatgctatcaatagagtatgttactgatattccaaaatcatcttaatttaacaggtaagagcagataaaacaattattcttatattggtatccattattaggatagttaccaaaataacattagcaataataataatgataacgttaactaggtaatataattttgccatttcccagagtggaaaacaccataccagcagtaccaggaatggcagttactatggttttttttaaaaaaatactgtattcaaatactgcaaataactgcattaacattttacctcacttattctgattctgacaagatgaaagggtaatatcaggattcctttaacagcatataactaatttgttattaactatatttattagtaaattattaattaaaactgtgctgtacttactgtaatacttgtaatgattatgatatacataacaatacataatatataatgatattgattataacgattaatggtatgaccatttagttatgacctgaattataataattgatgctgtaaaggtgaaattattaaataatataataataacgtaaacacaaataataatgggtgcagagtaattatactcagttaacaaaaagtaaagcgtaatagaaactttcctggtagtacttcctggttaactaatattataatattatgatattaatgtaaccaccaataatagtattaaggatatactagaattaggcccctttcactgcagagacagtcagtacatgggcacagttaaatatatttaatcctctaacatcaacctaaatgcatatagtaacatggaatatcctgtaactacacccatttcccagagggaaaaaggtgaggccagcatactgggtagttattagggcactaacactacagagacacaagttatactcaggaagtatgctatatgtggccatttcccagcaggaaagtctgggacagcttggccatgggtgatgccccttgatcagcctcataatgccatacttctcattcaccccaatgcatgcccccagtcctggccccgagaagctttccaggatcaccggcatcctgagagccccagtcttacctcagccttcatccacagagcatgctgccttccgaaggtcattgtcaactggcacctccactgtgccagttgcataagcacttcctcctcaagggcacctactgacatgtactcccaggtaccccacagcaacaccaccccatccacctgtggggagagaaggggggtggggctgcttctgggggcaagcaaggaggagtcctccctctttcattaccacccctccttgacattaacctgggtgaggccatagttcaccaggtggactatgtgaatgaatttgcagggtggaggaagtgctcagggtctgggagctgctgcttgagatgatgaaggaggggttttaacccactgatccctttgtccaatcagatctggaattaatccaagaatcagtaaatttcccttactcccaacctatttgaacagatacatgaagaacactagctatcagtgagtcatgtagctatctgagggaacagtgtatagcaggggtcttcaacctcctggaccacagactgtggcctggtaccagtctgtgtcctgctaggaaccaggccacacagcaggaggtgactggcaggtgagccagtgaagcttcatttgtatttacagccactccccaattgctctcattactgcctgagctctgcctcctgtcagatcagggacagcattagattctcataggagcacaaaccctgttgtgaactgtgcatgccagggatctagattgcatgctccttattagaatttaatgcctgatgatctgtcactgtctcctatcacccccagatgggaccatctagttgcaggaaaacaagctcaggtcccactgattctacattatggtgagttgtataattattttattatatattacaatgtaacaataataaaaatgaagtgcacaataaatgtaatgccctagaatcatccccaaaccatctcctcccccaatccctagaaaaatcgtcttccatgaaaccagtctctggtgccaaaaattggggactgctgtgtagaactaggcatggggcacagccattgcaaaggcctgtaggctagaagctgctttactggttttatgaactctctgaatggccctagaatgtacaaatttgtgtgacaaataataaaaatacgtaccaactaacaaagcttttcccaaccctatctggctctactccctcttttaagtataattacaattttatataagaaatgtttatgtttataatattttatataagaaatatactaggatgaatcatacaaaattgtcaatatttgaactttctaaacaatttacctttcttgatacataacaactgtgtgtatttatggggtacatgtgatactttgttatatgcataggctgtgtaatgatcaagtcagggtatttaggatatccatcacctcatgtttttatcattttgatgtgttggacacattttaagtccacacttctagctattttgaaatacaaaatacattgtttttagctatagtcaccttattctgctatgaaaaattagatcttgtttcttctatctaaccatatgtttatacctattaaccaatctctcacctcgccccacatacacccttccccaactctggtaactatcattctacttgctacctccatcgagaccaattcttttagctcccaataggagtgagaacatgtgacgtttgacattctgtgactggcttatttaacttaatgacctccagtttcatccatgtttctgcaaatgacaggatttcattcctttttatgaccacagagtatttcattgtgtatagataccaaattttctttatccagtcatctgttgatgaatacttaggttgattccatatatttactattgtgaatagtgctgcaatttacatagcaatgcaagtatccctttaatatacggattccctttccttaggataaataaccagtagtgggattgccagattgtatggtagctctgtttttagtttctttttgttttgtgttttttctttggtaaattgccatactgttttccataatggctgtattaacttacattcctaccaacggtgtataagagtttccttttctctgcatccttgccagcatctattatatttttctttttgatgatagccgtcctaattagggcaagatgatatctcactgtggttttgatttgcatttccctgatgattagtgatattgagcatttttcatatatctgttagccatttatatgtcttcttttgagaagtgtctatttgtgtcttttgcccacttttcaatggagttatgtttttttcttactgagttgtttgagttccttgtgtattctggattaactagtctcctatcagattaataatttataaatattttctcccattcaacaggttatctctttactctattgattattacttctactgtgaaggagttttttaatttaatcaagttctatttgtctacttttgttcttactgtctatgttttagaggtcttagccataaattctttgcctagactaatgcccaggagagttttccttaggtcatctcttagtatttttagtttcaggtcttacatttaagtctctaatccttgttgagtttctccttgtatttggtaagagataggaattcagttttattctgcatgtggctatccaattttcccagcaccatttattgaagagggtgttcttttcccaatataagttcctgttggctttgtcaaagatcattcgtctttaaatatgtagttttattcctgggttctctcttctgttccattggtctgtgtgtctatttgtataccagtgtcatgctgttttggttactgtggctttgtaatatattttgaaatcacgtaatgtgatgcctgcagctttgttctttttgctcaggattgctttggctatttcagctcatttttgggttcatatgagtttttgggttgttatttctaattctgtaaagaatgatgtcagtattttgataaggattatattgaatctgtagattgctttgggcaatatgtttattttaacgatattaattcttctgatccatgagcataggatgtttatctatttgtttctgtcaccttcaatttctttcaacagtgttttacagttttccttgtagagatcttttacctccttgtttaaatttattcctaggtatttttttttttttgtaaatatagtgagtgggattgctttcttgatttttttttttgcctaggtcattattgatgtataaaaatgctaaattttgcacaccgattgcgtaacctgtaactttactggattaattgatcaaatcaaagagttttagtggagtctttaggtttttttagatattagattttatcatcagcaaaaagggacagttttacttcctcatttccaatttggatgtcttttttttttcttctcttgcctgattgctctggctaggacgtccagtactatgtttaacagaagtggtgaaagtgggcatcctagctgggcacagtggcttacacctgtaatcccagtactttgggaggctgagactggcaggtcacctgaggtcaggagttcgagactagtgtggccaacatggtgaaaccccatctctactaaaaacacaaaaattagccaggtgtggtggcaggcaactgtaatcccagctacttgggaggctgaggcaggaaaatcacttcaacccaggaggtggaggttgcagtgagctgagactgcaccattgcactccagcttgggctgcaagagtgaaactccatctcaaaaaacaaaaacaaaaacaaaaaaaaaagaaaagaaaaaaagaaaaaagtgggtatccttgtcttgttccagattttagaggaaaggctttcaacttttccccattcagtatgttgtcaactgtggttttgtcatatatggcctttacctttattaatttgagatgtgttccttctttgcctagtttgttgactgtttttcatcataaagagatgttgagttttatcaaatgcttttttctgcatttattgagacaatcatatggcttttgtccttcagtctgttgatgtgtcgtatcatgtttattgatctgcatatgttgaaccatccttgcatccctgatataaatcccacttgatctcagtgtattatctttttgatgtgctgttggatttcattgtctagtagtttgttgaggatttttatgtctatgttcatcagatatattggcttgtagttttgttgtgtccttgtctggttttgctatcagtgtgatgctggcctcatagaatgagttagggagaattccatcctctttggttttcttggaatagtttcaggaggattggtattagttcttctttttatgtttgatacaattcagctgcaaatctatctgttcctggggttttcttttttgggaaactttttattaatgatgcaattgtgctactcattattgttctattcaggttttctatttcttcctgatttagtcttggtagcttgtatgtttccaggactttatgtatttcctctaggttttacagtttgtgagcatacagttattcataatagtctctgatgatcttttgtgtttctgtggtatcagttgtaatgtccctcactttatttctgattttgagttttctctcttcttggttcgtatagctagtggtttatcaattttgtttatcttttcaaaaatccaacttttcattttgttgatcctttgtattatttcttagtttctatttcacttagttctgttctgatctttttatttctttccttctgctaatttggggcttggcttgttcttgctttttagttccttgaggtgtattgttaggttgttcatttggcatctttctacttttttgatgtaggtgtttactactataaacttcttagtacttcttttgctgtatcccgtaggttttggtatgttgtcttttcatttttatttgtttcaagaaattttttatttccttcttaatttcttcactaacacagtggttgttcaggagcatttgaacaacttcatgcatttgtacaacttccaaagttcctcttgtttattttttgttttattctattgtggtctgagaagatatttgaggtggttttaacttttaaaaaaatatgttgagcctttgttttgtggcctaacataccatctatcctggagaattttcaatgtgatgataagaatgtatgttctggctgggcgcagtggctcacgcctgtaatcccagcactttgggaggccgaggcaggtggatcacgaggtcaggagatggagaccattctggctaacaaggtgaaaccccgtctctactaaaaatagaaaaaaaaattagctgggtgtggtagcgggcgcctgtagtcccagctactcgggaggctgaggcaggagaatggcgtgaacccgggaggtggagcttgaagtgagccaagattgcgccactgcactccagcctgggcgacagagtgagactctgtcaaaaaaaaaaaaaagaaaaaagaaaaaaagaatgtatattctgcaggtgttagataaagtcatctgtaaatgtttgttagatccatttgtttaaggtcctatttcaatccaatatttctttgttgatattttggtctagatgatctgtctaatgctgagattggggtgttgaaatccccctcattcttatataggagtctatctcttcctttagatctaataatattttctttgtatatctgggtgctctggtgttgggtgtatatgtattcagaattattatatccttttactgaattgatccctttatcattttataatgaccttctttatctctttttattgtttttgacttaaaatctgttttatatgatgaaaatgcagctattcctgctcacttttggtttctgtttgcatggaataccttttccatccttttactttgtctatgtctttatatgtgaagcgagtttcttgtaggcagcacgtagttgggtcatgtattttttttatacattcaaccagtctttatcttttaagtggaaattttaatttgtttataatcaaggttattattgataagtgagtattcctgtcattttattaattgttttctggttgttttgtatgtgtcttggtcttttgtttctctcttactgtttatcattgctgtttgttggttttctatagtggcagcagtgggacagacagatggataggatcttggactcctggccagcatgtgtggcatcagcaataatagtagtggtgatgggacaacacttggactccctggcagcactcactattgttagcaaggatgggaggacagtctgcagcccccagctgggtgcatgcaggtgggtgcaggtagtggggatagtggcaggctgggtgggctcatcctcgggtctctggtaggaatgcatagatgccagcaagggtggactgggcatggtggtccctaggtgcctgcatggcatcctcggcactgtggcgagtggagggtggtgtttcagactgggtgggcctatctctaggtcccccagtggtgcacatgggcacagattgtgataggcagggcaggatgacccactgtggtgggtgcagagagcctaatgtcagagtgcatgaagcacacagtggttctgttgctgtaggatgggcggtggggagtaggcgggggggcaatggttggtgttacttggagcaactccaagccagtgggcagctttcaggctttggagaatatttgttgtggcctctggtggcagcagcagcagcagttgtatgcagggaaagcctgtcctcatggtgtgttagtgcacagcagccatgctactttggggatagaggttgctgtcaatggcagcatccccaggcaagtgggtggctttcaggccctggggagcacatgcttcaacgtctagttgtggcaggagtcacaggtgtggtggcagcagtgtgtggggagaacttgtcatcaagtcacatgctagtgtgcaatggccctgctgctggtgtgggcagggtttctgtcaacagcttcagataggcagctctcaggttttagggagcatgtgctttggctctctttgtcccaggggcagtctccctgacatgttacactgctctgtttcctggagtataggaatctgtaggggctagaatgttgggaaccctgccacactgccaggcccagctggcattgcaccactgaagctctccaggtgaatgcagctggatgtaactggggctccaggggtttggagatgcagggactaatgtcagcacagaatccagtctcttgagggctggctctcaacatggcaccatggcacagtttcttaggtctcaggggatgtctgggatccaggattagctagcaccctctgtggagcaagctgtcacatggtctcctggaagctccttacattagtgccaggttccaggaagattcagggtctctcctatggctagggttgcaggagatcatggtgggaatgtggactgctggggtcactcacttacccttcccccacattggagagtctctccaggcttccagcctatcctagccaagcaagcggcctcactttcctttccatccttttcttaggtgtttcctgtcacttctttgttgaaattcagcattctctcttaggtgttctctttgaagtgtaattatgtactattttggttcttctttgtggaggaggtgagtgtttgatacctctagtaagccatcttgaatccttcctgaatatttgcctttttaacttaaaaaaaatttcatataattaaactattgcagttgacatataaatgtaattatatatatttaattataacaatatgtattatatacattatataacaacataaaatatttgaagagcacatgatataaatacatacacatttataaattatgaatataatatgcaattgaatacatttaaataatataatttataaaatatgaatatgttgtacaatctgtaaaatattggaatataagttattataatatagcatataccaagtatacatatgataatggtatatagtattattactgtatactatacatgtattatttcgtagtattatgtaaaatgaatatgtttgaaaatataggttagaatatttcataatgcccttttactgtcatgaagtgaaatttataggtaatatgactcacctatgacctaaatttgaaaaaaaatgtaatgaatttaatataaagatgaaatataagtaatttagtttgaactaatatgtattatatgtaaaggcttgagaggtacagtagaataattaacaaaataagtatataattaacataagcagtagtagtggtagcagtaggaataggaaagccttactgagcattatctgtgtgtcagtccctgttctaagtactttcaggtgtgtgatcacctttacgtacactctcttagacgtcagttgactggaacacatctcagaagaaccttcagttaactgacatttattcccacctacaccctctcccttgtaagacaagcttttagtcactaatatctttttttcaagatacttatctatgtatataagagcctaaacttgaaataaatagtggttatctcaaggcaggggtttgatatgaggaatgaggataggactgtgtgtgctgaataaaggagacattagctatatctgcaatgttttatttctttaataaaacaaagctattgaaagtgaattggaaaaaagttagcattattaattttgaatgatgaaatcctgagaatttttaatattattcattttagttctctgttaacattgaaattttaaaaaataataaagaaaatcaccaggagactttccaagtgatcacatatgcagcttatcttcccaaccttgaaactcaccaactcagataatccattttaccggtactgggttagaacttgtctggtttagcaccttcatttctttaaggagtagaaactggctttccttaaattgggtatcttgttaatgaggcagaggtggaaagataactcagattttctgatctccagccagctctctactattttcagtaccttggcatttgggtccaggatgatgacctcaaaagcctgacatatcttcagtcaagccacaaggattttattcgcttcacaattctctacttattgggacagaaaagtggattcagatgttttagaaaagatttctgaaaatccaaaggttaatttccagctaatgtgaaaattagttaaccaaagcagttcactccactagcccttaattatgtgagttatcgcaggatgagaatttatggattcagcactgtatatccacaggttccacatccatggattcaactaagcatggatcaaaaatattaaaaacaatataacaataaaaataacccaaacaaaaatagaatataacaactatttacattgtattaggtattataaatactctagagataatttagagtatgtgaaacgatgcgtgtaggtcatatttcaaatactacaccattttatatcaaggtcttgagcattcaaagattttattatcttaatgtaggggagagggtcctgaaaccaatcccctgtggatactgagggctgactataaacctgaattcagtaagacctcctaagtttctgatctaggaggtactgaggggagatgaagagtaaaaagaaagaaagaaaaacatgagtctctgaccttgactaaagtgcaaatcaataaggtaggaaaaccaagatgccatttgacacctacttaagctcagagcatgactaggatttggttgggatatgcatggaaggtgggaaaaatggtatgaggatgaagacaggaaagagctggctgagcaaaggcccacagcataactgctttctgacaaggttggataaggtgagacagggagggaagtcagcctgtctagagcaggaagtttctcttggagagtggtagacagacacttcgatagggtagggctgatttgaaagggtgtgggtggtagactttgtgattttgactattcagcatggaatcacgagttctggagtacagttgtagcagagaaattattttgttattcctgtttgttagatgctagctaacccaattaaaaaatgagcaataactgaacaaacatttctgaaaaacacacacaaatgaccaacagatatatgaaataatgtcaccataactaattaccagagaaatccaaattaaaaccaaaatgagacatcaccttacacctattaaaatggctattaccaaaatgataaaagattgtgttggccatagtatataattttaatgtagcaaacccccacagtgtgaacatgcctccctattcagcttcctctctgatgactgtctgccatcatgctatacttcaccaacccttaactgcttacagttttgagtacacactctattcctcacctttgtacctctgctaccacagtcctcttcatctggctgaactctatctggttctttagactcagcttaatcaatatccaggagcctacgcttaccctaaaatgacttttaagaaatgcacataaaaaacttgtaaagcactgatacatagaaaaaaaattaccataaactcttaaccctaatgtgagcattataactgtttgattattttccttccagccttttaaggcctattttatttaaacaatagagattttattgtacaaaattttgcattctgttttttatttgatttgacattatcctttgagcattatcccatcattaaaaaaatatttaaatggccttataatatattccaccatgttggcttacttcaatacatctaattattcttctattaaaaaaaaacagattgtgttggcaaggttgtggaggaaagggaactcttgcacactattggtgggaatggatatttgtatacacacacacaatggaatactattcagcctttaaaaagtagaaaatcttgttatttgcttcaacatggatgaacctggaggatattatgttaagtgaaataagccaagaacagaaagacaaataccgcatgatcttacttatatgtgggatctaaaaatgttgaacttacagaagcagagactagaatggtggttacaggggtggaaagtgaggaatgggataatattggttaaagggtacaaagtttcagtcgaacagtaggaataatttcaggatatctattgcacagcataggagctatagttaatatatacctgaaaattgtgaagaaaggcgatcttaaatgttatcactacaaaaaaataattcatgtgaggtgaaggttatgttaattagcttgatttaatcattttacaatgtatacacatagaaacatcatgtcatatatcatatatatatacaattttatttgttaattagaacttaataaagacaaaaaaagaatattgaaataatccaagcaagacatgagaagcacttagatagtcttcagtgtctttaagaatagaaaggaagggaacagatttgagtaacttcagaaatggcaaggcttaatgttttatggaaagggtaggaggtggtcagtgagaagagaaagtcaagattcagggatgactccacactttttggcttggatgactgtggacatgagaggtggggcagatttggtaggggagagaagctcactgctgagcatcctggatttgaagggacagtagaaaccctgttacagggtttggtgggcagtgctactaccctgtctcccacaggcacattagcattaacatcagtgcatctgattgtcttggctagtgtctaattcccaaggagactcatcaggcctcaggaaatcagaagttgaggagctggttgtaatgcctcaccatggcttcactttcagaatgcattggaggctcattcatgggataaagatgaaaagagtgatcttgacaaagcattgcacagattctataatgagagggaaatgaaaatggttgtcagcccattattaagtgtaataactaggttgcaatgagatgaaggacttcatttaggcagatctttcccattgatgaatagtagggggtaaaagtgtgaaagggaagcatataatccaattcataaaatatgtaaactgaacagaaatttctggaaaggtatttttaaaaacttgaggcaataatcattcattgtatatatagagctggagtgggaaatctttctattgatggacaatgatgcacagatgaaattttaaaaatcagtatttttttccactgacagaactttattttaaaaaaaatgacaaaagctctgtctgtacttctaggctaggagaaaagaggcacaggtgtagcaacaggggcacaggccactcacattttagagagtttgacttgcttgtgcctgtggagtgcccatttgaggcagacggagtccactgtgctgggtataaacaggaagaaacttttcttagatgggggcatatctgagacagaaatagaaggcattcaactcccacattaaaatattaggaaaaagagcacaacattgtattcaataagtaaaatatacacaaatgttaaaataaacacaactatatttctgtttttttaagaggaattgactgaattttatttatttatttatttttgagacagagtcttgctctgttgcccaggctggagtgcagtggcacgacctctgctggtgtgcagtggtgcgatctctgctcactgcaacctctgcctcccggtcccaagcgactcgtgcctcaccctccagagtagctgggattacaggcatgccccgctaatttttgtattcttagtagagatggagtttcactgtgttggccagactcgtctcgtactcctggcctcaagtgacctgcctgtctctgcctcccaaattgctgagatcacaggtgtgagccaccgcacaggctcacacacaactatattcttaaatataatggtaggatgggataatcattcctagatacttaattttaaataaattgttatgggtcagataaagttttccaaggtctagatctgacctttggaggttacgtcaagaacatgaattattaataattaattactctgtaaacactgtgtataattcatagataaataattagcatacattaccttacggctattcttcccacaatggttattatttgggaatatgatgtccctcacctggaaatgtctactcctggagaggcatgaactctgtggaatacatatgacaatttggatagcaccaagcaaattttaatcttttactagctcatgggctgggatgaagaagagtataggaggcaggatatagaacacataatgactaagattataagttctgtgtctaacttatttgggttagagtctgaattctgccactacaacttgagtgaccttgagcaagtcacttaaactctctgagctttctttttttcttatcagtaaagtggaaataacaagagtccctccctcccaaagttgacatgagaatgaaaggagaaaaatttgtgcaaaacacctagcacagttcttggatgttctattctaagggctcaatgaaactcatagctgctgctgctgttacacttttctgtgctgggtcattcactgggtggggggatgggggtgtagcctggttccccagtttgagcaagatcgcagctgtattctcaacttttggcttctgtcacctacaatggtgcatccccataggtgtgctgtgattcttctcaagcaaccagcagttggtcaatgataaatccttagttttaaagcttatgtggggaaaacatgtaaaacaaaaacttggacagctcgccctctagtggtaattttatgaattgccccccaacaattgcccttttagctcacaggaaaactgatagtaaaaatgaatgggattaagtttacatagttgaaacacctggtttaacaaatgaatttgttaatcacaaacacataataagctagtatagggtacacatgcttgcatattttctcaagtgctgattagccattatacctaacaagggatttccaatttggggaaaaaaaaatccagaatcagcaattctatacatagttatatatcctgtcccccaataaataattgtacatagtcattagagtctagttttattgcactcaatgttctttttttctaaaataatgttataattgttgataataacaacttatcctcttacaggtatgtataaacttttcacagggttttgtttttacaacagatagatgcggcaggatttgccttcctggttgtactgaagaggaagtaggaggcttatctataaagaggccaaatgagtttgcttgggacacccagggcactttgcaggggactgcactaatttttactcctaggaatctcctcctggcaaaataaattgcatagatgctggcatgttcctttctagtctttagatgctccttctttggaatctttatgtcaaactccctaaacatacattggttgtacagatcagaatgaaaatgattaaaatagagatacgagttttatacaagtggctttcttcactccattataattgttttggagaactcagatattaaagcattttgtttgtttgtttgtttgttttgagacggagtctcactgtgatgcccaggctggagtgcaatggcacgatctcagcttgctgcaacctccgcctcccaggttcaagtgattctctgtcttggcctcccaagtagctgggactacaggcatgcgccaacatgcctggctaatttttgtatttttagtagagacaggatttcaccatattggccaggctggtcttgaactcatgacctcaggtgatctgcccacctcagcctcccagaatgctgggattacagctgtgagccactgcacccggccgatattaaagcattggtacccacaagactaaaccaagagtaataactttttgagccttatagaaatctaagtcaagggagtagtgatgagaatcttaaaaacctgcaattgttcttttaaatactgaaattgctattcataagacttgagtgaacagagaaaggataatataggaataggaggtgttttcaaatccagggacaagaatatttataatcatactcactgattgtgaaacaaagggcagacatacattcacttatactttcagtgggttcgttccgtagcaagcttcagtccaactgcagagtttcactattcaggggaagtagtgaaattcccttccttcaatgcctccattcacatttgtggctggtcagggagatacagttatcaaatcacctgtgggagaagccaagctatctagtcaacagtcttctcaggagccctgcaaggagcttgcttaaataggtaccactggaattgtgaacagtatagggctggatacctcctgtggattgcaggcttgtgcagatgagatcaagcgcaccagttggctccctctatgggctactcagttccactgcggccccaattgatcagtagcctgcacctttgtcagctgcatcacagatgtattcattcagtatttgccaaatatgtatggagagtctacatgcaaggggctctggaagtatggcatgtgattgcaaactcctgatgacagaaatctgacttgcatgcattacttttaatggcacttggcaaattcagttatatgtgacctttcatctcttcttgcccttttgtgactttctgacacctctaagctcttccctcttaacgtcagtgttcaatccctccatgttgactgatcacctgacttttcaggcctcttacctcagcctatacttcttagttgcttccctagtcccaaatctaaaaataaatgtgctacatccttttctacctccttttgtcccactcttggtttattaagaatagcaatccaataaaaattaatcataccaacttgttggaatctagtaggggtctaatactctaatttaggtttaaggctacaatgccttagctcatggaaattgatttctactgatgagagtgtagtgtgggaaaatatttggtggcacgtaggcattcatagatccgtgttatcatacctctggtccattttaatgggaaaattccctgagatctcttgaaatatgttgtaaccttacactgcaaatactaagggaaaagaataaatggggataacgtttagaaattattttctccattattgtattgctgttctctggctattgactaccttataactaaatactctgatacctaaggcaagggaacagaagaaaagagaccataaatctattaagtcaaatacatattgctcacatggcccttaaagggaaatgaattatcagtgtacgctccaggtctgcatgataaaactaattgtaatggcaattaaatgtcttacactgccattgagcatgctcgctgtgactctggagcagatacattgattaccttcagtacttaccatgtcccatcacaaataggccaaagcagactgttaacattgtaaaagtgtagaattatgcaatagatcacttagaagacttagaagagataactaaagagatttgggaagcaaattgaaatagcatttcaatttttttttctatcaagtaggtaatgatagagtttgatgctattttgcaaagccaaatttgttaattcaaaaatatttgctgtgcattttaggattaggggaaaacaaaaactgaaataatagtttaaaaaaatattcccgtggggtttattttgtttctattaaccaacttttgaaaaacaagctgtgagaaaatatttattttctaacatacttatatcattacctctcagttgttttaatgcatgcaaacagtatcacagataatttataaaaagaataatataaaatccatttaaagatgataaaacaataaatattaaagttgtatttgatccagaggtgtatcactagtaatttataatgatccagaaagttcagcaaattcaagtttccttcttttccttcttgaaagttttgcagtgacaaatgacaagtaaatgatccaatagcaaggagtgaatttaaaagactcctgagagacaaccagtgatcagtacatatttagtctaaaccactgtaccttcttagctttaacagtgtacagtgatcatcagaatccatagtgatgaatctcatacctctgaatcctcgaagaaagtttagatgcccttcactatcaatttaaagggagttatttatttgtttgtttgtttatttctaatgaatacttcacatactataagaggagttgaggcagtgtgtaataacagcccacgtgcagcaggccagtgaaagccaaagtcagagagagagatcagaaaccagagttcaaaatctttcttgggccataaaaccctttgaaaatctgaaaaaaaagggctatggaaaatttccccagaaaagtatacctgtgcaaataggcacattgttttgccaactaccttgaagcccatgcaagcatcttccccctgggtgtccttgaaccctagttcaataatccctcatatagagaaagtgaaatcctgaggtaagatagttattacacttaaacattgcatttagctctgagcttcctgtcaactgaagttaaaagattaaacacgctgggttagagttctcaacatctaaaaaaggaagcagatcagttcacaaaatcataagtgaaacatataattttaaaatggcaatgtttatacatttctctgagatgattgttttttaaagggtaatcaagaaaagtgaaaggatacagcgtattttgatgacattttttgaaaataagcaaattagaaataaaatagctatgctaattatattgaccagcatatgcgattggccacagcatttcatttttaaccgttctggaaaataaggaatttactgtacatgtctttctttaatggtagatttgcctacctaatattatttgattacagctgacagtaatataatatattcccatgagcactcggcagctaagcagaaagggaggcctaagggtataaagagaaattgacctatgattaaatatatgctattaataggtcataccatagaaaactggcatgtatataacagcaaataatcactttaggtgcctactacttccaaccagagcatttactttctcaaaggcaaataatagcacaattgttattgtcacaattataggcataggcagtatagggtagaggttaagaacacaatctggaatcagagactggtcttccaccacttattagctgtgcgaccttgggcaaagtcatttaacttcttttgtctcagtgtcttcatttgtaaaataagaagaaaagccttcatctcaggaccgcttctaggctgtgtagaggtctcttggaaatatttgttttgtggggctcctgtctatataaacaattcgagtcacctaaaaccagtatgtcagcagcatcattctagtagtccaatttcataggctaatgtgatggatagcagaagcaaacaatttgcctggctactctgctggaattaggacctggccatggtgccacaggacaaccctataggcatgagttctggagctccttgaagaatctggtccaccccaagcagaaggtggctgtagaatattggaagataccccaaaggcacaagactggagcaggggctgtgcttactaaggtctaagcaagatacaagtctatctcataggattactgggaagattgaatgaagtaatctatgtggagcacttaggacatgttggtgatgattactgctcacactattagtgtcaacaatgctcactgtatcttatacctcttctgattttctttcagtggatggctgcattgactggtcagtggatctcaagacatacatggctttggcaggtgaaccagtccgagtgaaatgtgcccttttctacagttatattcgtaccaactatagcacggcccagagcactgggctcaggcttatgtggtacaaaaacaaaggtgatttggaagagcccatcatcttttcagaggtcaggatgagcaaagaggaagattcaatatggtttcactcagctgaggcacaagacagtggattctacacttgtgttttaaggtgagtgttgtgtgaaaacattgcccaatcacatggctgatagtcttttgagtgggacttgagtacatgtaggtatgcctcatgttgtataatggatatgttcttgaaaggttgcagtacatgtggagcttcagtaaattccagttctaattatctatcagaactacatagcaaattcctattagattttcataaaataggattcccatttactgtgtgtgcttatttaatttagaaaattttgtgactcgggccgggcgcagtggctcacacctgtaatcccagcactttgggaggctgaggtgggtggatcgcctgaggtcaggagttcaagaccggcctgaccaatatggtgaaaccctgtctctactaaaaatacaaaaattagccaggcatggtggcaggtgcctgtagtcctagctcctcaggaggctgagacaggagaattgcttgaacctgggaggcagaggttgcagtgagccgagatcgcgccactgcactccagcctgggcaacagagcaagactccatctcaaaaaagaaaaaaagaaaataagaaaattttctgactcatttcttccctcactccacccctgccgcatggtcttatattaacaattagttttgcatacagctagttgactcaattatcttgatatctggccacgaaaatgatctaaaatatcattttggccatggtcttgcctttcttgttgatgaaaaatagtttcaaatgcgtctagatttctcagcaaatgtactactgctgaaatccttcatagaatttgcaatgcaaatttgagtccactgtgtctaaataatcaacatcgagctctgtaaatacacagtcatcctgagtttctgggtactatagtggaaagatatcacagacataattcttgcttgcaagaagtttacagtaaaaagcaatatgttttttcccttagggattctacagtatgttctcccttccccctctaccccagtgatagaatctaggatctagcatctagcatctcaaatagagactggattaggtattgaagtaggtagctgagacgacctttaggccacctttcaattctgcaattttgggagtctttggtcttgctcaccagggacctgcactctactatttgattttaactccttggaaatgcagacctttcctatttttgtgtcctgtgaactttgatgccaaagctatgtcacttcctcatcaaaagcacttggaagcccctggcgaggtctcattgttcaaaagcccaggagaacaaggtggtatataaatagagagccttctggatgctctaagaatcacttttatgtgtaggggaagaaaatggagtgatgggggagcaaatggtgagtttagtctctgtttgtggtaggcaagatcttcaggatcttgggagaacagcagtcattctgatcacacccttagtgttaagcggtattttctcctacttgggcagctcttggcaaaattgagaagcagatgtaattcagctttagtgactgacactatattccctagggtgctgctactctttccttgcttatctcctctccatcccacactgtcattaaaaacccaccaatcaaaattatctctcttctcctccccctgcaccatttgctttttgtttgttgttttcacaaatttaaagttttatttgcaaagcatcagtccactatgtacaagtgctaagcttacaatgaattattaaacaaattattgctacttccccaggcctgctaatgtcttcagtcttgttacctcccctcttttccattctccgctctaaccccattcctttactcctagcaataataacaacttagtgatccctacatgcatttcccctactgttttaattatacaaacatactgacatggctattttctcctcattgttttataaaatgaaaggagggttatagatttctctgcattttcttagcttagtaaaaatacatggtataaatctctccaagtcaactgatagctttttttttttacttttattttaggctcaagggtatatgtgcaggtttgttatacaggtaaactgcatgtcatgggggtttggtgtaaagattattttgtcacccaggtaataagcatagtacctgataggtagttttttgattctctccctcctcccactctccaccctcaaggaggccacagtttctgttgtttccttctttgtacctatgtgttctcattgtttagctcccacttgtaagtgagaatatgcaatatttggttttctgttccttattttactaaggataatggccatccacattggtacaaaggacattcttatttacagctgcatagtattccatggtgtatatatatgtaccacattttctttatccagtctaccgttgatgggcatttaggttaattccatgtttttgctattgtgaatagcactacgataaatacatatgtgcatgtgtctttatggtataatgatttacattcctttgggtatatacccaataatgagattgctgggttgaatggttaaatatataatattgtatgttgcttaatattttatgataacacaagtcagtcaatcatttccctattgatgagtatacactttgtttccagtattttgtccctacaaaaggcgctgtaataaaaatccactatttgcttttcaataaactttaagaagtcttcgatttacgtagttattgcaaagataatatagagttcctgtacactttatatccagctttcccattttattaacatcttacatgactatagtacatttgttacaattaatgaaccaatagtggtacattattattagctaaagtccatatattcttcacatttcttcagtttttccttaatgcctcttttctgtttcagtatccatctctggtagcgcattgtatttggttgtcatgtctccttaagcacttcttggctgcatcagttcctcagactttcctcatttttgatgaccttgacagtttgaggtgtactggtcagatagtttgtagaatggtcctcaactgagatttatctgatatttttctcatggttagactggggtaatatgttttgaggaggaagattacaaaggtagaataccatcctcatcacattgtatcaagggtataaagtatcaatatgactcataactgttgatgttgactttgatcacctggcttgaggtgatgtttataatttttcattgtaaagttactttttttttcttcctttccatactgtagtctttggaagaaagttgttattcacagtccacacttaagaagaaatatctacataaattatttcaaattcttctgcatggaaatttgtctctccctttccccacttacttatgtgttccatcatttatttgtatcagtatggactcatttttatttatattatacaccggcttgtaatgcaattctacttaattttcttgctcagattcttccacctttgcccgtgggaagctctttcagttggctcatttgtccctttgatataattctatcattgtggagtggtggttgtatttttttttttttttagcatttccttacattgtagaaagatgctccaggtttatcttatatattttgtgccccagttctagaattagccatttttccaaggagtcctgtttttttaatggataattgcattagaaacctagatttggttgctaggtatgctcattgctattggggtgttgttgcttctaagtcttctcagctaacagtctatttgcttttaaacaaagccatagattgtgaaggagtactttagggatagtggaacttcccaaggtccctgaagtcctttcctataggtggctctctctttcaagtacatttcagattggccttttttatgtctattttggataccatatgagtcagaggttctcaactcacatctagaccaatagaagataaaagaattccactaagattggaacataacttgtgactttttaacttttgtgcagcaagccttagggagctattgggactgatagagataggtggaactgttgaatattacctctcatgtgtgccttagtaaggaaaaaatgtttggaaatcactgttctaatagaatcaaccaggcttttatcaactcagagatacataaatctattccaggtatataagtgaaatagctagcatatgtctgtgaataatgaacctgtttttcatatctagtagtggccactgacttctactatgtgccaagtgagaaattccgtccatataggtgattttatgcaattgccaagagtgacatttattgtgaaaagggctcttaatttgacaatgtcagtattcacctaaaatctccagttagataccactttaaggtaattacgaatgacttttctatgttttattgatctcattaaaagttactctactgatgtcactgtgattaaaaatgaagatatgaaatatttagtaatattctccacccatgtgaatgacagcaagaaaaatttactgtttgtgacctttcagtggccacttggctaatgaataatttttaaatttttccttggccagactcaagagtgattagttgaatttcccagcataataatgggctggtaatatgagaatggtagaggattaaatcatattgtgagagacggtgccaatcgaagaatcacaccaatattttcaatggaggcatgaattaataggataaaaatgataaaggtaatcttatttgacaaaatctcacatatcattttctcaacaacttggaacaaggggtgacttaagctgtgaatgaagatagatatagtcatataatcctgcattgaattcacagatattgaaaagaatgattggccaggtgcggtggctcgtgcctataatcccagcactttgggaggctgaggcaggtggatcacatgaggccaggagttcaagcccagcctggccagtatggcgaaacccggtctctactaaaaatacaaaatttcgctgggcgtggtggtgcacatctgtaatcccagctactcgagaggctgaggtacgagaattgcttgaatcgggaggcagaggttgcagtaagccgagattgtgctactgcactccagtctgggtgacagagtgagactccgtttcacacccacacacacacacacacacacacaaaattaaatataattgaacatctgtaaaaacctaacatttagggataattatggctgagtgcagagaatcagttagaggttcaaaattattatgaccatttacctctgcaacgaggtaaacataacaaggagttcccttataaaatgggagcataatcccaatatttttggtctctaatagtcattgaaagaagtgaggttctcaaaatctgaatgcctcacaacatctttctgaacagttccttagtatatgtctagccaggaggcacaattgctttgatttcaaatgtgaataatcaattcacagttgaatgattattactccagcaaaacagcatcagaagaaaagttgagggagtggatacacttgaaacgaaaagcatagcatgttgctaatttttgaatctgtatggtgggtacatgaggattcatcatattgccctgtgtattttttatcatgtttgaaatagtccataacaaaaaaaagaagaaataaatgtaagtatacagtaattttacttgattttattgtcacttaaatgatcctggcctataaatacctaggtatcatatataagcgagtatttttatttcagtcaacaaacattcattgaatacatatcatgggactcactttatggcatattgcaagaagacctgtgtctttagaaaagaaagtgatgctctagtctacatcagacacaaagaaatggctcttagcaccttccactctcctaccctacttcccatcgcggttacctagagattttcaaggacagtgaacatatctcataattcaattccaacttaactattgatccgtgaaaagttaagtgtcaacaagtcggttacccaggtagcaatttccaggagagcaggtagtttcttgtcagaaaaatgaaagcctggatcttatagaattaattgacctcagaaaagatcaagaaagtgtagcaggatcttgagacagcaggaatttcattcccgaaatgaaatgtaattagttatttttctatctgtttttggttataagcaggggtctctgattccattatttttatggcaatttgataatctacttgttaataaaattatataggaaaatttttacatagcaaagaagtaaccattttactttattttcatttcattagcattaaattagatatgttgtaatgtttagaaatataaccatactattgtacattaactatgtaatttcaacttcattcagtttgtttactggaaggaagcagatgcttacagtttagtcagcaggagtacctgctttgtaagaattaataggttatatttgataaccacaaaagaagaattgatctcaaatagtcactgatgagttggttaacactgttatttatatatactttttagtttaatcccttgtataattacacaatcttaagtgacttggttttatggctatcttgctcagaatcaaggttttaacctaatgcagggttgtaaactcaaaatcttttcagaggtcaagaaggtaatgtaatgagtgtggcaggccacctgaaacattttggagtgttggaagttgtagcaatcccctccataatctcatttcatgcattctactctattgccactacctcctatttttctagctcatttttttctataccttacctccaataatctattgattccacccaaccatctttctcattgatctcacatgttttccactgtaccttgttctcttcccatctagcatagttccaattcagtggatcaatcattataatcactcccatatacaccctcttgattctcttaaccctttctcccttcatcttactcgcttgtgaaaaccacaacactgtttaaacctaactgtccatctatactatgcctgcatccttgcagctaaacttggctgaaggaaaatatataataatgttgactggtttcacattaaattcattgtcatggacctcaaattgacctttaatgctaccaggtagttttattttatattcttagaccattcagtctcccatctgcctagatgactattttatatcatctccactcctcagatctccaatatctcctcccccttgcttccagtttcacagagaaaaaaaatgtagtcaggaaaaaaacttccactacatctgcccacctactggcatctatacctacatattctgccttccagcctgttaccacagatgaactggccttgcttctatgtaaggcaagtcacttcatgtgtacaccagattctatccctatttgcttacccaagaacatcacctgagcaattctcctctctctctcccatatcatgaaattttctatttctactggatcatttccatcagcatgtatacagatcagtatttatgccatctaaaaaaaatcctctctactccactttcctgacagccactattcccggtttcttgctcccatttggaaaaagctactttaaagaattatctggttatggtatcatggttgtttatataagtccaaacccttcaaactgtacccattaaatatatgcagttatttgtgtatcaattatatctcaataaaactatttataaaaaaaagtgttgtctgcattcagttttgagttcctctccacttattctctagtaaacccattccaatcaaaattttaccttcaaactcttccaaacctgctcttataaaagtgtccaatgaccacaacaatactaaatccaatgggcatgccagttttcagttctcctattacttgacctgtaatgtcatgtggcatagttgatcactcccttctttttgataatgcattctttacctgacttccagagaatagtactctcttggctttcctcatactctatcagttactctttcataagttcttttcctggctcctggtattctttctgaccccttaatgttagaaggcactagggatataggcccaacattgccagtttttctgatgttttgaaagctgaataattgtgtgaaatttctcaatttttaaatttatgggatcctcctgcccaaaaaagcccatactcagattcaaccattgaactcagttctcatactctaaactaataggttctgactccaacattaacctagagagcgatggtatagtcatcttaaagtaggactgcagcaggttttatctgtatcaaagtgaagcaggaaaatcaacactccaatggcaagatagattaaaggaaacccgccactctccctagagtacatttgagcattcagtagtagagtcatatggtgtccctttatgtggcaactggcccaattccagcttaatcccttgtgtggctattggagtcttcaaaaaatgcactgatcagtataggggtccttattgctagctacggtgtactgaaataggtattctatcaagaggattctattgctataaagtgctgcttctcctccaccttccttcctgtcaatgatcaaacagcaactctttaaaagggcagaggactgaagatgtgcaataactctagtcccaggcatgaaaagtaacttcagtgaaaatatccattcaatgcttatatggactaatattgtgcctatcactatggcgaacccaagagaaaattatgacacagcatctgccttttagcagttactaaaggaggaattactaagagttactgaactagctaggactcttctatacctaacactgtggtgcaatcttctatattactattaatactactgtgtcctattaggagtatggtctctggagctggactgcttggagtcaaatctcagttttattacttacgaattgtgtgaccttgagcaatttatatgactactcaggttcaaccaggggactcacagtttgcaaactctgaactattggttctgactccaacattagcctagggagtgatggtatattatggctgtgtgacctttgccttgcttttcctcacatggaaaataaagacccatttggttattcaacttaaaatattttgaacacttgaattaggtgttgagtaaatgcattgaatgagagattaaagtaatggagcttccattctagagttgggaaaacatataaataatgcaatcacaagactacactgggtaatcgtaattctacagtggtgagagtgaagaagggtcatgttaggggagtgactgactgagaggccactttcagttaggtgatcaagaagggcttcacagagaaagtgacatacaaactgagacctgaatgacaagaaggagccagtcttgtgaaaatcttggggcagagtattccagtcaaagtgaatgccatgtgtaaaggtcatgaaatgggaacaggcttgattcgagaaagctaaagaaagggctgggtgcagtggctcacacctgtaatcccggcactttgggaggctgagacgggcagatcacctgaggtcagaagttcgagaccagcctggccaacgtggtgtaacccctgtctctactaaaactacaaaaattagccaggtgtggtagtgcacgcctacaatcccagctacttgggaagctgaagcaagagaatcgctggaacctgggaggtggaggttgcagtgagctgagactgcgccacggcactccagcctcggcgacagagcaagactctgttaaaaaaaaaaaaaaaaaaaaaaaaaaaaaaaaaaaaaagtgctaaagaagggcagtttggttggagtgtggtgagctggggaataatgctactagataaggctggaaaagcaggcagagaacagaggacagatgctgttgcatattgtggaccagaataaaaagttgatttttaaattagtaatcagagataaaatgagtatttatttttgttaaactggagagtaacatgatccaatttccatttaaaaaatgattactttggttgcctggcgagaatggactacagggggagaagcaagaagaccaagttgagaagcaattgtattagttgaggagagatgtgatggtagcttggattgtggtggtagctataaaaatagggagacatgaatgaatcccagatatatattgaaggatgagctgataggacgtactgatgtcctggatgtgagaaaaagctgaataaaggatgactcctgttgcttttgactgaagcaactgtgtgaatcatggtgctattaactgagagagaagacctggagatgaacaaagatcatagtacctacctcagagaatgttgatgagcacttatcaccaatactgacatagagtaagcactccatacattatctcttatttctacttttactaccaccaccactgctactactagctataattttttagcttttattatatgaaagtattgtgctaatccttagaataattcaggaggtaggtcatattattgaagatgataaaactgatacttagagaagtgaagaacttgcccaaggacacatgggtagtaaatgatggagctgggatttggaaaggtttgactccagagctcatacacattatcagttttctctactgtcttctcaattattatctgttttcactgttctttatagtaatctgtatttgtatattacaacaaatgagatatggttatttacattaattcttgcctatataaagttctgtgcttctgtgtgtttttagtttcatcagtgaacattattgtctggtgatgaggatagaattttattgattaaagatggataatagaaggcaatgaaatagagattccaagttcatgaaaagtgatgattaagttaaagcaagaattttcagagaactagtcttcttgttttaccaagtttaaaatcctttgtgatcacttttcagtttacatatgcagaagtgcttaaaagttgttttccaccaaagaatagagatgaattttgaagcatatatatccttaaatggctctttttgtctgtttactctgacttcaaaacctctaatatataagactcgtgatgaatcaattagagaaacatatacatcagtatatgacaaagtgctagaatgaatataatcaggtgtcataaatgtatggttatctttttcaaaaactcattgcatgacactacttccctccattcaccttaaagttgaaaatgttcatggtggaacacaaatgagatctcattccttcctaactacagttttgttttgtttttgtttgtttttaataaaagcgatgtttttcagccaatatccttttaggtctcaggtatttattattcattaaacaaatatttattgagtacctcctgtacagagggtactaaaaaaaaagcaaaagtgaatgatagggctcctgacttataacaaattaaaaggggaattaggacatgtatacaaatcacaatcaaacaagcataactcccatgtggttcatcattaaattgtatcctagaaaacatagtctagcaactaaacatattttttaaagtctgaggatagatttaacgtagtcccttgaaaaatatcaaaggtaagcccatttgtaacccacagcaacaaaaatcattgtttgacattactatcactcctagtatctcttgtatgtttcagctgcccagaaacctctctcattgctcctcttgttacctgctaaaaaactcttcctggaatgcatcccctataagtttcttctctttttgccctttctcatcctctagcacttttttcctttcaagaagctcttttttgccctttccaatgtaatttaattaaactagcagtgcttcttgcaattcttcagctctttctgcccattactcctattctgcacaataaaatctcaggaactaacctgccataccaaggatctttgtaaaagttgttgcatttaaaaagaccaatgcagtgaaaaagagaattatgtttagaaggcaagaagaagggaaaagctgcaaacacttaacttgatggcttttattccatcatacatgagggaaagtgatacgtgctataggaaagataaagtaatagtacagtaaaaagtaggaaaaatagcttttgtcttatagaatcgtgcttgcttcagatggctcttgaggatctaaacaggtggtgatagtagaggtcttcccaggcagataaaacaatgtcccagggcaaggaggtagtaaaacatgggccatgcacagggaaaaacagggaggtaaatttggtcggaacctggatttatcgaggcgtttttttctgagtatgaacctaacaataatacttgctttatgaaggtttcagatgtttttgaaacatgagattttagacattgagcaattcttagaaaagaagctaaaagactcaactaatgagcaccttaacttgcagtcaggtaataaggcacgttttttgcagatgatgtttccacagagaaaatgtatatttaaaggaggcaaattcccttctatgacctgaccttcattaaagaaaggcagtgctgctgactaaagcgttgttagtcttagcatgtactccaaccagttttctcacaggtgttgataaattcacatggaaccatccccactctctcaccacaccgaagagtgatccaccttggtaggatggctcattaatattcgatgggtatagtctgtatctataaatatgagacagagaaaagctaagtgagaggggtaatgtatatttccaccttggggccttgatcacattcaagcaagacccaagccaatacaaatctacacactcgtttccagaccagatctcactcttcaacactaaggcaatatacacttacctgagtatagagatatagtatatacatttttaattttttattcctgttaccctgatcccatcagtgccttccctttacttcctacaaggaaagtggcttgaccatgtttcatatttacattattatcttttactcttgagcaagagatctctcctccttttaagctcaatctaaagcttgccacttaagcaccatgcacactgtccacacacagggcagcctttccatacatactgattgttgacttattggctgaaaccctcagatcagtagggtccagacgttttcattttgctcacatgaatctttttttagtatattgttttaccaatagaaatagatgacaggaaggcaattttacgaggtgacagtccaaataataatattggcaacgccagtattttacagcagggtacaaagtcacagaaaattctgatttttaagcatttagggaagcttctatattaggtaatgtcactatatacacactctgctcaaattttgactttgatcccacatgacatgaaacaaagataaaaaaaatcactgctgtttctaaataaaatatagtttaattttactttccattattttagagacaggtatagccaagtttgacttcctggcatgtggatgggtgatcagaaaaaaagaggtcaatgaaggcttccctggtttttgcctttcaccacttcacttgttgttatctcaaatggcaagcccagagaggaccattacagcttttctagaggtaaaactcactgtttttgaccaaggcattggtccccatgaaatatccatccccttccctcacccatcagagctgggcctttctcccagcagcattgtttttaaagctgtcttcctctgtaactgcccatctcactaagcatgcttactcaagggctcaaaggtcaggtcagattgcttctgctgggtttgtagaggatattcagtgatggaagtagaattaatttttatgtattaaaacctttcctctggacttacagagaaaaaaactttaataggcataacacaggaaatcatgaaaatgttaatatctttccataatcctgccaaatataaaacccaaatccaagcaaactgatttaatgttttactgaaaaaaaaagttatgaaaacaatttgtacgaccagagagataagtgtctggttcccttcctggaattattcaccttcctttctagtgccccctcctagggtcccactgctctcccctttgattttctttcagttgggccctaccccaatcgtgttttttatgcagcttgatgatcctttcctccccctcctccagtctccaccccatcccctaagttattcctaaaggtaccactgtcccaccaccaccctgaccttataggtccttactaaccctcaggtgccttgtctaacagacacaaaggcaggaaaccccttgggttcccacccccttaccacacagtgtctgctctccttttcccttctgttccagaggaagaagtggcctttccaaacccatccacctagtaaattaacttctttatattgttttgtatttctgtgaacatttaattactttactgtcacaaaacacaagaatataaagaagtaaaggccctctatctcatgccccctactctacctcactccaccctataccctaatgtcccactgcctaccatcatttgacccctgagcctaccctccctaggttactcataatgattttgccctctagtggacattcggcaatatctggagagatttttcgttgtcacaatttgggtggggtgggaaatgtacactactactgggcatccagttagttgaggctagggattttgctaaacaacctacaatgcacaggatggcccccagaaataaaaaagcatatggccccaaatgtcaagcatgccaatattgggaaaccctgccctagaaggatatagacaagcccgagaacatttttgacgagtacaaactctttaataactagttagggaactggccccaagtcctgaatgactgtcatagattcaacaggaaacaaactaatgtcacatctagctgctgcagagatgtcccagggccatgacagcttcttagtcactaggtccacatgccccaggtgatgtccaaggctcctccatttgtgtctcaatctggttcaggtctaactcctctccatccttccacctgttagctaaaacatacatgtacccccgatcaacacagcttacagtcatcaaagggatagaaggagaccaacctgccacccaccttttgaccccacccactcctatcctcccccacctcacccctccctctgaaagttgatttcccactgggatatgtttctgttctgtttcacatttctaaattcactaagagctttgtagctagattttcctcctacatttatcatggtggtgggttggaagagaaattccctcaggatgatggcatcgtgcttttgcccatggtctaaaccaggaaaccctctgagcactatcagttgctgactcacctccttggcagtggcaggagttctctgttcaaatctgactgtccctggttctgctcacttgggattgaggaggattctgctgtcatgagagctgtagagtcatagcagtcctcgcctggagctggtgctggcatcctctgtatgtagccctgaaggattccctcaggagtagcaaagcactgccatgtcgatttgagtcaatcataaacctggggttaaccccaggcctgttttgattgtttgtcatgatataactcactcagatcatgaatgaactttctatccagttcattcctagagactcctggaatgcaggaatctccactactcaccataccctgatgcaactccccagctggttcgaacatattatttgatggtctcttatttgcaactgctctcctggtaccaatttctgacataaaaataatctgatggggaggcaccaagatgaccgaataggaacagctctggtccacagctcccagcgagaacaatgaagaaggcaggtgatttctgcatttctaactgaggtccccaattcatctcaacaggactggttaggcagtgggtccaacccatggagggtgagcagaggcagggtgaggcgtcacttcacccaggaagtgcaagaggccaggatctcactcgccaagccaagggaagctgtgagggacaatgctacccagctgggttactacgcttttcccacagtttttgtaatctgcagatcaggagatttcccttgtgtgcctacaccaccagagccctgggtttcaagcacaaaactgggcagctgtttgggcagacactgagctagctgcaggagtattttttcaaaccccagtggcacctggaacccaagcaagacagaaccgctcactcccctggaaagggggctgaagccagggagccaagtggtctcgctcagcaggtcccactcccacagagcccagcaagctaagaaccactggcttgaaattctcactgccagcacagcagtctgaagtcaacctgggatggtcaagctttgttggcggagtggtgttcgctgttactgaggctttagtaggcagttttcccctgacagtgctaaggaggctgggaggtatggactgggtgaattcaccacagtgtggcaaagcggctgtggccaggctgcttctctagattcctactcactgggcagggcatctctgagggaaaagtaaaagcccctgtcagggacttacagacaaaacccccatctccctgggacagagcacctcagggaaagggcggctgtgagtgcagcttcagtggacttaattgttcctgcctgcctgctctgaagagagcagctgatcctgacaagagggactctcccagcacagcacactagctctgctaaggaacagactgcctcttcaagtgggtcccggacccccatgccttctgactgggagaaacctcctaacaagggttgacagacacctcatacaggagagctccagctggcatcaggttggtacccttctgggatgaagcctccagaggaaggagcaggcagcaatttttgctgtcctgcagcctccactggtgatacccaggtgaaaagggtctggagtggacctccagcaaactgcagcagacctgcagaagagggacgtgactgttagaagaaaaactaacaaacagaaaccaacaacatcaacatcagtatcaaggagccccacacaaacaccccatccaaaagttatcaacctcaaagattaaacgtggataaatccacagagatgaggaaaaatcagtgcaaaaatgctgaaaattccaaaagccagaattcctcttctccaagtgattgccactcctctccagcaagggcacaaaactggatggagaatgagattgacaaattgacagaagcaggcttcaggaggtgggtaataacaaactcctctgagcaaaaggagcatgttctaacccaatgcaaataagctaagaacctgataaaaggttacagaaactgctaactagaataaccagtttagagaggaacataaatgacctgatggagctgaaaaacacagcacaagaactttgtgaagcatacacaagtatcaatagccaaactgatcaagcagaagaaaggatatgagagattgaacatcaacttactgaaataaggcatgaagacaagattagagaaaaaagaataaaaaggaatgaacaaagcctccaacaaatatgggactatgtgaaaagaccaaacctatgattgattggtgtacctgaaagtgacggggagaatggaaccaagttggaaaacacacttcaggacattatccaggagaacttccccaacctagcaagacaggccaacattcaagttcaggaaatatagagaacaccactaagatactcttcgagaagagtaaccacaagacacataatcgtcagattctccaaggttgaaacggaaaaaatattaagggcagccagagagaaaggtcaggttacctacaaagggaagcccatcagactaacagcagatctctctgcagaaaccctacaagccagaagagagtgggggccaatattcaacattcttaaagaaaagaattttcaacccagaatttcatatccagccaagctaagattcataagcaaaggagaaataaaatcctttatagacaagcaaatgctgagggattttgtcaccaccaggccctgccttacaagagatcctgaaggaagtactaaatatggaaaggaaaaaccggtaccagccactgcaaaaacacaccaaaatataaagacctctatgaataaactgcatcaactaatgtgcaaaataaccggccagcatcatgatgacaggatcaaattcacacataacaatactaaacttaaatgtaaatgggctaaatgccccaattaaaagacatagactggcaaactagataaaaagtcaagacccatcagtatgctgtattcaggaggcccatctcatgtgcaaagacacacataggctcaaaataaagggatggaggaatatttactaagcaaatggaaagcaaaaagaagcaagggttgcaatcctagtctctgataaaacagagtttaaaccaacaaagataaaaaaaaaaaagacaaagaagggcattacataatggtaaatggatcaatgcaacaagaagagctaactatcctaaatatatatgcacccaatataggagcacacagattcatgaaacaagttcttaaagacctgcaaagagacttagacttccacacagtaatagtgggagacattaacaccccactatcaatattagacagatcaatgagacagaaaattaacaaagatattcaggaactgaactcagctctgaaccaaatggacctaatagacatctacagaactgtccacctcaaatcaacagaatatacattcttctcagtgccacatagcacgtactctaaaattgaccacataattgctagtacaacactccctagcaaatgcaaaagaatggaaatcataacagtctctcggaccacagtgcaatcaaattagagctcaaggttaagaaactcactcaaaaccgcacaactacatggaaattgaacaatcttctcctgggtaaataacgaaattatggcagaaatgaagaagttctttgaaaccaatgagaacaaagagacaatgtaccagaatctctgggacacagctgaagcagtgttaagagggaaatgtatagcactaaatgctcacaacagaaagctggaaagatctgaaatcaacacactaacatcacaattaaaagaactagagaagcaagagcaaacaaattcaaaagctagcagaagacaagaaataactaagatcagagcagaactgaaggagatagagacacaaaaaacccttcaaagaatcaatgaatccaggagctgattttttgaaacgattaacaaaacagatggaccactagctggactaatgaagaagaaaagagaagaatcaagtagacacaataaaaaatgatacaggggatattaccactgaaaccacagaaatgcaaactaccaacagagaatactataaacacctctacgcaaataaactagaaaatctagaagaaatggataaattcctggacacatacaccctcccaagactaaaccaggaagaagtcgaatccctgaatagaccaataacaagttctgaaattgaggcagtaattaatagtctaccaaccaaaaaaagcccaggaccagacggattcacagccgaattctaccagaggtacaaagaggagctggtaccatttcttctgcaactattccaatgaatagaaaaagagggaatcctctctaactcattttatgagggcagcatcatcctgataccaaaacctggcagagacacaacaaaaagagaaaatttcaggccaatatccccgaagaacatcgatgtgaaaatcctcaagaaaatactggcaaacaaaatccagcagcacatcaaaaagcttatccaccacggatcaagtcagctttatccctgggatgcaagcctggttcaacatatgcaaatcaataaatgtaatccatcacataaacagaaccaatgacaaaaaccacatgattatcttaatatacacagaaaagtccttcaataaaattcaacacccctttatgataaaaactctcaataaactaggtggtgatggaacatatctcaaaataataagagctatttatgacaaacccataaccaatatcatactgaatgggcaaaagctggaagcattccctttgaaaactcacataagacaaggatgccctctcaccactcctattcaacacagtgttggaagttctggccagggcaatcaagcaagagaaagaaatgaagcgcattctaataggaagagaggaagtcaaattgtctctgtttgcagacgacatgattgtacatttagaaaaccccatcgtctcagcccaaaaaccccttaagctgataagcaacttcagcaaagtctcaggatacaaaagcaatgtgcaaaaatcacaagcgttcctatacaccaacaatagtcaagcagagagccaaatcatgagtgaactcccattcacaatgactacaaagagaataaaatacctaggaatacaacttacaaggggcgtcttcaaggagatctacaaaccactgctcaagagaataagagaagacacaaatggaaaaacattccatgctcatggataggaagaattaatattgtgaaagtggccatactgcccaaagtaatttatagattcagtgctattcccatcaagctaccagttactttcttcactgaattagaaaaaaaaaaactactttaaatttcatatggaaccaaaaaagggcccgcatagccaagacaatcctaagcaaaaagaacaaaactggaggcatcacactacctgacctcaaactatactacaaggctacagtaacaaaaacagcatggtactggtacctaaacagatatatagaccaatggaatggaacagagacctcagaaataacaccacacatctacaaccatctgatcttcgacaaacctcacaaaaacaagcaatggagaaagaattccctatttaataaatggtgctgggaaaactggatagccatatgcagaaaactgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactccaacaaatttacaagaaaaaaacaaacaaccccatcaaaaagtgggtgaaggacatgaacagacacttctcaaaagaagacatttatgcagccaacacatgaaaaaatgctcatcatcactggccatcagggaaatgcaaatcaaaaccacaatgagataccacctcacaccagttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatgtagaactagaaataccatttgacccaaccatcccattactgggtatatacccaaaggattataaaacatgctgccacaaagacacatgcacacatatgtttattgcggcactattcacaatagcaaagacttggaaccaacccaaatgtccaacaatgatagactggattaagaaaatgtggcacatatacaccatggaatactatgcagccataaaaagaatgagttcatgttctttgcagggacatggatgaagctggaagccatcattctcagcaaatacaggaacagaaaaccaaacactgcatattctcactcataagtgtgaggtgaaaaatgagaacacatggacatagggaggaggacatcacacactggggcctgtcaggggatggggtgtgaggagagggagagcattacgacaaatatctaacacatgcggagcttaaaacctagatgaagggttgataggtacagcaaaccaccatggcacgtgtatacctatgtaacaaacctacacgttctgcacatgtatcccagaacttaaaaaaaaaatctgtccacccactcaagttagctaaagaaaagaggttctgtgtaaaggggattttcatgtagcacaactgtaggaagtgaaaagtggttgtgctgctgctctctccatctctctggagtcacaggatgattcctctgtgcctgtctgctccctggaaccacgtactagtgactcccaaagacacttgcctctggaaagcacccagttctattcctccacagccagggccaagcctcagcagtggcctcagcaaccatggctccggtcctggccccaactccaagtggcctacagcttcattgctcaacatcatggaatcggcctctctgttcagagtgtctagcatgaaaaatccatttggctctggatgggccaaatatccactcctgctccaatcatctaaggcctagatgcgagtagagggtggggtgttatacacatggttgcctcttttaccagacactagggcagggagagagcgagcgagacatacacaaataaaagctgcagcacttctggggtattgagtgcaagtgctctggaatacaaagggggtcaccaaaacatgtctgtctccatgtgtctctctctccccaccccaatctatacctcccctggccaccaccccacttctacacctctttcacaacccctactttcctccccctcctccagtcaccacccctatctctgaagttattcgtaaaggtaccattgtctcacctccttcccccactcttcccagccttcttcccctaccaccccggcccccgccaccacaagcctgccctctgaaaattaattcgccatcgagatatacatgcttcggttctattttgcatttctgcactcaatgaggtttttgcagccagattcccttcccacagtcgaagcaagtatccctccgtgaaaaattcacagcgttacaccaagggcagtcccagtcccctggcctgcgatatactggaggtctttgctgatgaggttcggagtatctcctgtctcttgggtgctcctgatggtctattctgtggggccccccatcagaccacaggctagtatcaaaggcctcccagtcggaaggcagctgaggcggaactggtgctgtgactgttgcttgtggaggggatatagtgggtatgtctgagaaggaggaaaaagggcttgagtatgagtatgagtatgaggcagggagctggacaggaagaggttctgatgaggctctggaccaggggttcgtggttccagagaaataagatgtggctgtttcgaccgaccggagatctccctccttctgcccccaataggtgtacttttcctgatcagcatctccaaggagctgcaggaggattctctccagcttctctgtggtctccatggaggcagccctggcctccacgtgggggaactgggtctccatgggggcagccccagcctccacagggggagccatggcctccacaggggcagccacaacctccaacatcccctctgctcttcttctgctccttttcctccagcagcaccagcagcagccaccgccgcctcttcttcctcctcagctgctccttctgtgcaaacccctccggcagtggccaggcctggccaccctgccccctgctcccactcatggggagacaccagctcctggagagaagtgggcagggctgaggtgtgttctgggggcaaggcgggagcactaagcagggtaggacggagctaccaggtgggaagggcggggcagggcgaagccatggagcagggtggagaggggtgggaatggggcagggcagtggtactgggcagggaccagttgagggatcttactgcatggagcggcttccaactcaccttgtctctctctttctgcacctccacgaggctggtctgggccattcttagccgggaggccgcctccttgcgttccgtctcctgctgctccctgagcttcttcaggtctgatgccaaggcctgtgcggctgatttgtgcagtttggcgaagccgtgcagccaccgcaccctgtgcctttgtagctgtgcctgcctgtgggcaaagcgcactcccaaggccaggctgccccaggtgcaggcctctttgacctcactgggcacctcgctgtcctccagtatggccctcagcttgtcttccaccttctcccaggataaggatatattctcaagatagaactcggggcctttcgtgtgcctggccattttctcgttgatgaaggccaccacgttgctatgccggaacccgctactggggtcctcaggtctcaaggccatgatcgcctaggggtttaacggtttcactagccctgtgtggatggagcagccaataggttcctttcctcccccttagcccctcccctcatccatcttctcccgccctcttgtccccgccctacccgctctgacaagaccgtcctaatgaccccctgaccggcttgtcctaccctaggacacctcccaccaggcctcacctcttcagccagggccagaggaagtacaggccaaccccgctgtcttaacacgcccgaagagagaggaagatctctctccctcctaaggttccagggaaaggaagactcagggccaacgtcggcttttactctgggactgttccaatttccagagataccaggagtggaagggagtgagtgaggaaggcccctgccactccattgggatttaagggaacctgtcacatggttgggagcccttaaaggtcggaagaaacaggagtggtcagaaaagacttagaaccaagaaaattaagcccttataatcaagtcaaaaaagtcccatgtatccctccctcttgacaatggtttgtcccatgccaacggctagtagggacccccctagaggttgaagggggaataatgggtatgttctagaacacgaaaaagcccccaacccatgaaaattctgcagttcattttccagactcctaaatcctagtatacaggttagtgacctttttctgaaacgggcaagatagcaggcatttgaggctttgtgggcaaaagattatcccaactacttgtagcacaaaagcagccataaataatacctgaagaaatgaccatggccatgttctaataaaagttcatttataaaaccaggcagttggcatgatttggcctgtagatgtcaaactcccaatctagattcacatttcatacatgtcctacagacacatacaatcagaatgttcatgatatgactcccccttttccctgttaaaagaaaaacgttagacaacgttaacagtttgtttacacataaacaacaaccaaaaaaaaaaaaaaagaaaaacgagtcatgaatttgtcagtactcagaaccagaagagtttcagagagctattcccagcaacatgagaagtgaatttttataggctgagtttggacacaaaagagaaaaatcacctgattggctacagcaaggcatttgccttatttggacatggtcttgtcacttgactgcctgtaattagctggagcctggctagttgtgtttggctgaaattaggctgtcttttatacagcttatgttaagtttcagtctgtttacatgctaagttagtttgcggtttgttagataggaactcaaagtatggaaacagcttcaaactaatggcctcttgcttattttaatatatgcaggagatgattcccctcctaaattcctatgttgtccaatacagaaacctcaaaatcaaatttttaagttacctacccttcataccgacccttaaaaacaagtcaactaagagacaaaatcttgttgctgtgacctcagaaacttctaagacatccatgcccacttagggaatgtccatgtttcttctcaaataatcttcctgtctttaatttcttcataatccctaatcacttcctaatctttcctatgatcatgtttctcttaagcttaaaatcatttgatggatccttgtggcacactccttgtcctgacattagaatctcaccccaggataccattctaatttaactctctccacaatgttatccaccatcatttatgtacctaagggactaagccatacagggatacactgattttggcgttttaagttattttcccttctgaaaaatcagagcattcattttttattatatgggcattatgttctattctatgaactacatttaaaaagacaatatttcttctctaagggtcctatgtcagataattagagaggaaaaagacaataaatcaagcattaaaatattacctaagaaggtagttaaaccccagaggcataaagtcccaccatttaaatgctgtttttagatgctgttttgtgatttctttccttctcagcttgtatattttatttatcagccatcagtggaaagggttcatgttttggcttattctagagtgacttctacagaaagagcatccagaagataatgtagaaaagagaatggtgaggaaagggggagagactggagtcaggaagacccattagggagatgctaaagcaattcaagaagtaaactaaagcagtggaaatagggatggagagaagagtgtagagagccatttggtagatagaatgcatagggatgtcagggacaaggatgagggaatgctgaggataatgcccaggtttctggtataggggactaagtagatagccctgttattgactagttggagaatgaagaagaattttttgggatgagttcacctttagacatattaacattaaaatacctgttggggccatgtgtggtggctcacacctgtaatcctagcactttgggaggctgtggtgggtggatcacctgaggtcagtagatggagaccagcctagcaaacatggcaaaatcctgtgtctactaaaaatacaaaaattagctgggcgtaatggcgcacgcctgtagtcccagctacttgggaggctgaggcacaagaatagcttgtacctgggaggcagaggttgcagtgagccgagatcatgccactgcactccagcctgggcaacagagtgagattcagtctcaaaaaaaaaaaaaaaatacctgttgggcatcctggtggagatacttagtaggcagtttgatatatgagtctagaacttaggagagacatcagagctgaagatgtagtattgagaggtgaaagctgtatttacagcagcggttgaaataactcagggacagaatatggagcaagaagagtagagggctgaggacagcaccgtggcctgccttcatggatctcctcctttctacagctgtgtgctaccattggtgattttatagttgtcccccttactcctttgtgttcttgtctactaagttcagaacatcttttaccttatctcttttattccctctataatactttaaacatgaacttcagtttgtgattagttgtctctttatactgccattctcccacttccgcttataaacacttttaagaaattaaaagtaaattgtttcttttagcagcctggaggagggagaaagtgaagacagagaaacctgttaagaggttccttcaacagtgcagacaaaacatgattagggcttgaactgtggcaggacctcgatgagatgtcagataacaagagatttttgacatacagttagcatgacttgttaaccaattgtattaatatatgagaaataaatatgggtgttggagcggaaaatgattttgaggcatttgacttgagaaactaggttttgtgacaagtgatgcctcaaatcgtaatagatatgaggaaaaatagactatagagaggagataataaatgcagttttggattgacaaatgcctttgtgatagttatattgaattatagttgaatggctgtactgggctggaagttaggtgagaggacaaaactagagatatgtattataaatttgggtgttttcagtgctcagtttgtggctaagaccttgtgcttcaataaaattgctggagatgaaggttggaaggagagaataagcaggacaaaaaaacagaggaaggaatcccgaggtcttggaaagggtagcagatacctttagggataggataagggagaacaagcagtaggagtagtcagagaagtagacaatcaaaaaagggagatattttagacctaaggagaaatttggaaggtaaaaagagtgttattagtttcatataatgcacagaggttacataggatgagggtgaacaaaaggtcattagatttagctaataagatatccttagtgattcaagtgacgagaatcaatagaatggtgaggcaggtgccagatgataggagatcacagaatgaaattagaggaataagtagaaattttgaatactgactagtctttcaagatctctgacacagtagagaattctaccaccaggagtcagaaaatagatcatggaagcataggatatgacagcttatttggtgagacaactaagttatacaattttcaacacaaagacggggaaaataatctgatatttactgtatgaagaaaggtaatcatatgtaaagaaaactctgtgttttgcattgtgacccaggaaataaggccaaacctttgtgaattctatgatagtaactatgaaataacatattgacagatgcaaaaatatcagtgtaatctgatatttacagagaaagagtgaggaagtgagaaatagttattagagtcagtgaaattggttggggaaggatttctggaggagagttatgttcttgttcttaatagaaacatcagggttctccaaagatttatgaagacctttctgtttgtagcatgatgtgtctcagattaccattcttaaaattgtcttcatccaaacaagaaagcaggaatcactcatactatgatgtggacaatggtggtgtcagggaacctttcaaatttaccttcgttattaccttacctttatccacatcctcaatcattggtagtcagattttgaacaagctgcctgtacccttaggtggcatattgcaactgcctttcccttaggaatggtgacatgagctcaccactagaatgatccacaattcttagttatatgtaaatggattgctacatatatatgtactgtatacttttttcttgagtaggtttctaactttaatgtacagcctccaaataaattatagtttgctttgaattcaaggtgaagaatattttgatgacaaaaattttattttgagtgagtagtttttaaaatatacataatgtttactataaccttgtccacaagctacttttttaaaaaacaattacaagaagaagaaaacaaaacatctttgattcactttatgggttgggttgggaatcggtagatagcatgataatagtggtgataatgttaaaggaaattagtttttattgagtacttagtatatgccaggcactgtgctatgagctttaaatgaactatctcattgttaggagagaattctccatggggcttttgcattttttacatgtctgtgagcagagtatcctttgccctggattatcttttcaaaggtgtatgtatagaaaacatacttttattttattttattttattttattttatttttttttctgagacagagtctcctctgtcacccaggctggagtataatggcacgatcttggctcactgcaacctccgcctctcaggttcaagtgattctcccatctcagcctaccaagtagctgggattacaggcacccaccatcatacccggctaatttttgtagagacagggtttcaccatgttggccaggctggtcttgaactcctgacctcaggtgatctgcctgcctcggcctcccaaagtattgggattacaggcgtgagcccccgtgcctggccagagaatagccttagaagatagaaatagtgtctatctctagagcaaaaggcaggtttgcttatagccttggaaaatacagttagtatctgcctctggaacaaagggccgacatgcttatggcccattgtaagaaatttgtgtttcttaagcttggggttcttctgtaatacaacccaatacttctacaagtatcacctgatcctctttgtattatcctatgggaattgagtttgtgtaagcaacacaaatactgatactttggctactgtcattgctccaattaactgtttattatttctgacctaggattctggtgtcttctaccagcttccatgaaactggcaggctaaatttttagtgcataagtaaggtaaaatttcagaccctttgccattctttcttttcccttttttttttttttttttttttttttttttgagacagtgtctcactctgttgctcaggctggagtgcaatggtgtgatctcagctcactgcaacctccgcctcctgggttcaagtgattctcgtgcctcagcctcctaagtagctgggattacaagagcataccaccatgccagctatttttttgttttgtatttttagtagagacagagttttgttacgttggccaggctggtcttgaactcctgtccacaagtgatccacccgcttggccacccaaagtgctgggaatacaggtgtgagccactgggcccagcccccgttaccattcttaacacttgcataataaaacaaccctattaagttagctgcttttattattctcattccacgcataccaaaaactgagatttagtcacccatgcaaagatccatagataagacattatagagctgggatttgaacccaagtctaactctaaaagctgcattatcaagcagtaagctactcaagtccttggattaaccttttatctgactgcatcatgaactataagaaagttatgcttaaataattctgggttgcagattaccagtgtcctgtcaaaggctgaatgttcatgtcagcaggagataagaacagttaaaaaacacaggaaggggaacatcacactctggggactgttgtggggtggggggaggggggagggatagctttaggagatgtacctaatgctaaatgacgagttaatgggtgcagcacaccagcatggcacatgtatacatatgtaactaacctgcacattgtgcacatgtaccctaaaacttaaagtataataataataaaataaaaaaattatgatatgtttatgcccccacaaatccttgtttgtttaattaccaggtttacaccttacggaaaaaatgtacataaacttaaaacctattatattgacatatttacaggctagagatatcatctatgaatgatggcattctttgttctgttttgttttattttaaaaaaacaataaaacaaaaatcccggagctctttacaactgtacaagcctagaagtaagatgatttacttaaagactaaaagtgacaaaaatgagttcattcaatagatcctgtatccccaaacttcttcttattagcatagatatttttatccttatattaggtttacatctgcttttcaatgtatataaacagcatgacacatagcaggtgcccattaaatgtcatttgaatgattctaaagggttgtgggtcttcatagaataataatacacagttcagggctttggccatcttggtcttttaatgcattaacattgcaagtttgcagttttatgtaattatttatgcagacatctgaaagtcccctttccaatcaagcttaaaagatttttcaataaaactttcttttcttttttaatatttgcaatttaaacttttttaaataaggtaaaatatacatatgtaatttaccatccttaccattttaaatgtacagttcagctgtaataaatacatgtatattcttttttcccccttatccccctttactagaaaaccttatttttctaatgatttttgagaaatagaacttatcaaagggcttgagatcttgtttgtttattcatttgttttccttccttgaatttgctacagtatcagttgctagttcttatgttttaacgtcagtcttattcaatgactgtagatcgattaattgatgttatatgtagcaaatcaattcaccttataaaatttcagacagtaaagcttgttttagtttccttatcattagatggtctctgaaatttacaaggaaagtattttgaagtgaggataagacaatcgaataaatcagttaggaaagtttcaactatatcctgaggcattttatctagggcttttgattttaggtacaagaaagatccctaatttatttagattattttcaccagcttagtcctggtgatacgacaagttcacatatgctcaaactctaaaacaaaactttataatatgggcatgttttataaatgtgagttagaaaaggaatttggatgtttcatgtgtattttaaattatgagttttacttttctccccagagaacccaagattgatcaatattttcccttagaaatacatctgggtaaaaagttctaattatgacctaaacaagctaacattaaacctttggaatagaaagcaaggtttatttataaattttctaattctgtgctatgcaaattaacattattccttagatgttatgttacacatctgctcttctttctatcagcttcctcaagttggtacggataaccacaagttagtttgactgttgagcaatgttagcatcaagttctgagagtatccaggggctagcagccaataaaccttggttctgaactactgaccagctacgtcagcttgacaaagttctttgtcctctctgtgtctatgttttactcctgtaagggatacttaccctgcccattttccagggttattgggataattaagtaagataatacacatagaagtacttggaaagattactaacatgtgtaattgtaagttgttgctgcagtatcattgcaaaggccttttgcctacattgagcctgaatgtgttccttgtcttcctcaggatgtgaagtagggagagaaaaaataccatctccattcttgcacactcgtcagtctgcctcctcaacctcacatagctctaattgtacctaatgaaagtaacatttttaggtcccagttgcaggaaatattttaaatagaaccagcctggggcatttttcaaaataaaatctaaataatgcaagattgttagcacgaactgtgccagggctggattacacaactaataaaaatcaacctgagtttcagactgtcaggcagcattgattatacctcccccaggtcacctgaggtgatagcaggactcacatcagaccttgtctttaagttctagggacctcggtcatcctcaacgacttcatactaggacttgttcatgagttaacaaagcagtttgtcagcatctattcacatgtcagcatctattcacatgtcagtgaccacaatgagagtgtatacatactgggccctggcttaaagttgtttgtggctaaggattaggaaggacacacttcctccttcaactcatcagccatctccagggtggcttccttgcctttaacaccaccccaaatcaatacaaatgctgctgacaccatctacgttgtttatactttggagaggtcagggaacgaacacatgaatggctcttgtcttgtgcctggaaacctggctttgaggtctctgggctttgttatagaaggcatttgtctaagaagctcccagaagtaaattttttgtttgtttgtttgtttgtttttttgagacagagtctcactctgtcacccaggctggagtgcagtggcacgatctcagctcactgcaacctctgcctcctgggttcaagcgattttcctgcctcagcctctggagtagctgggaccacaggcgcgtgccaccacgcctggctaattttttgtatttttagtagagacggggtttcattgtgtcaggcaggctggtctcaatctcctgacctcgtgatccacccgcctaggcctcccaaagtgctgggattacaggcgtgagccaccatgcccggccagaagtaaacctttttaagtggagcttttactacctctttgacctccaaggttctagcctctgcctagtagttagtactcagagtgcctggaagttccttcctgccttagctgctttctcttgatacacttctttttgtgcctaagtcaatgtatctttttgatcctctcagacctacatggctctctggtattagaccttttgcccaactgacctcttccagactgtttcctgtcaagtagcacttctaacccagcagactgttttaacccactgctgccagtgtgttgtttttatattgctcatgattattatatcacatgtaaattataagtattatatattagatatgtatattatacatatatgcatattagttatatatgtatacatatatattaattatacatatatataattattatatatatcttttaatatatttaacaatgctggcaatacctacaattctaattagagatacaattgtttgaatacctactttttgatagatcctgtattaggtattttacatacattattttatttaatacttacagtgatctgaacaggtcaggtataaaaatgtaaacctgtttttactcatagttttataatgaaaggaaatccttcctcccaccttcaatggagccaccataaacagcttcttatcctcatgtttcaggtgaagaaactgagactcagagaggttaaacaatttgtccaaggtcacagaactagttgagtctagtgaggcttagtttaaagatgatgctttgttaagaaaccactatatcagattggtcctctactttagtctaccctattttctacccagggataaatacatctgggacagttagcttctttcagagcattgaacatttcacctgcttctattattgagatctctggtcaacacttctccttctgtggaggtataacataataattgaaaattttttaacaagtatgtctctttcacctgtatgagtgaacaccatggagcagatatgatcaaagtcagtaacatcaagaactgttcagaacactttggatatccagcagagatgattacctttcttctgtgttagatactttttaaataactgtgaccatttagcttccctctatcccctgcccctgccggtcattcttgtctttcagatgtagccaatatttttaattctttgccaatatgctgctgcacaaaacttggctaatcttcctcctagtggctatccacaaatacctgcaaattatccgggtcatacttatacaaggaatgtgatatttgacaagccatataccttcatctgaaggaatgtgatatttgacaagccatataccttcatctgaagaaagggggatatataccatatgggactgatacaaaaatggaaaaaaaataacatgtctctcaaatagataccttttgatgcccattcatttaatcaactaacgtttactaagcatctactatctattcatttagatcccagggatggtgtaattaacaagagcaacaaattccttgccctttttagtgcatactttaacaaataaacaaatattagaagatcagataagagcaagtacaaaggcctattgtttgaataggcttagtgtgttcaatgaacagagaaaatgccagtgtggctgcaccctaatgagtaaaggagagaatgttatgttgagctagatcatgtatggccttgtatcaagcaaggagacttggaaatatttaacactgaagtgtttaaaaaatggtgaaaaagagctcaattgattgagctaaattgatttacccttcttctctgagattactactgttgtggctttagcttcatggcatttaaagaggctgtccaatgtctgacaagaacataaatgtttctttcacttaatccccagtgggcatatcttatgacctttgtgttccaggaacccatgtagaggaagaaagaaaagcaaatcccacagtctacatagtgtgatggggttgcatctaaacatcagaattggagtgctttgatagtttccttctcagatgacacaggcctgggcatagtcaggggtgcttgccagaaattaactttaccagaagcctaagtaggagtcattcttattaacttagtttgtaaacccaagaggcatcgccatctggattcctgtgttttgcatgatgtcggggatataaaatttcaatgagtgactactaagcagtatgaacagtgccgatcatttggtactgtctgaaaattattggttggcatgctaatcccatctgttaggattgttattactcagttataaagcacttggtttgaattgccacccttggcaattttagttttgacagcacgtatcccttgatgtttaaaacagatatggtcctgaaatgtcttccataaagtaaaattgaatactccaagatttacagctgatcttcatagtgttatcaggctgcttctgatttcttcctcacacttttccattttcttttgtgtttgacatcttctggaatccagataaggtagggtagagaaaggtcatggattatacatagaaaaataaaggcagaatttgtatttatttatatttattgtagttagttagattaattaaatatgtttattgaactcacattattgagaaagtgttaaccaaagtacaagaagacagaatttttgttcaataaatacccttctgtaatgtgttagccaattaatgcccaatttctaaagtggccttatgataacattctgtgttgagaattctttataatgctagtgctggttgatacaattaatcccaactgaccagactctagtaggatttcttctttataaaagcccaaaattcaacacctggcacatcttagtgagtaccttaaaaagctgaatagttggccaggcgccgtggctcatgcctgtaatcactttgggaggccgaggcgggcggatcacgaagtcagcagatccagaccatcctggctaacagggtgaaaccccgtctctactaaaaatacaaaaaaattagccgggcgtggtggcgggtgcctgtagttccagctactcgggaagctgaggcaggagaatggcttgaacccgggaagcagagcttacagtgagcagagatagcgccactgcactccagcctgggcgacagagcgaggcgccgtctcaaaaaaaatctgaatagttaacaggtaaattaacctgtaagctaacagatatcctctgtatgttgatctggtttttagtatatattctgtatcaggaaatattggctgagaaaccaatagtaaaattaaactatccctgtagtaactgttaaaggactggccacagggacagagcaaaaatggctacagctccagttatagagagactttctcacaggtttttattatcagattttcaacatagcaatatttattgctgggaaagaagtcagactatcttacagtttggaagatgggtatagcttctctatgtagctctgtggctacctcatggccacaaatatccacattagcaattagtttcatatcttctagtcagttgcagcataaaactgctctgtgttgctttgatgtttttttctgatttctaggcaaggtcctaaatggaaaagccaatactcttgaaatatatagagcacaaacaaagttgtaaacacccaataaagccattttgttatttctctgttcctacagaaactcaacatattgcatgaaggtgtcaatgtccttgactgttgcagagaatgaatcaggcctgtgctacaacagcaggatccgctatttagaaaaatctgaagtcactaaaagaaaggagatctcctgtccagacatggatgactttaaaaagtccgatcaggagcctgatgttgtgtggtataaggtaactcagcatggtgtcaaattcatattttacctcagtcaatagcagtcttggggatgaggaaagggagatttttttactagtttttggtattagatatttcactgagaagaatcaacagatccataactaaataattcagagctgtgactcttatgtatcactggtttttaatgcaggtgttagaagcaatacgcctttctccaactgctaaaagtagaatctccctccagcctgacagcatataagaactaatgggaagaagggtaaacatttaaataacacttgaaagaaattatttgggggacacagaaatattatttactggtgggaacaaaggcctgccattacaagtagtagtacttataaagaataacaactatcataatggtctactctgtgaaagccacaacagtgaatgcagaggagagaaatgggcccagtacaggatgtataaacactgctaaggttaagtttagctggaaataaaccacactcaaaggttgaacagaagagaattgtggccaggtgcagtggctcatgcctgtaatcccagcattttgggaggctgaggcgggcagttcacctgaggtcaggagttcgagaccagcctggccaatatggtgaaacctcatctctactaaaatataaaaattagctgggcattgcagcacacacctgtaatcccagcaacttggaaggctgaggcaggagaaccacttgaacatgggaggcagaggttgcagtgagccgagatcatgtcactgtactccagcctgggcaacagagcgagactccatctaaaaaaaaaaaaaaaaagaagagagttgaatgaaaggattatttacaaaggtttgggcaggcttgaagaaatcaataaaggagcaagctgttgattatcacccctagacctgcagtgtcaaggggaaggagcagtgtcactggaacctggcaagagtggaggaagctgccaagagatacagccttaaaggaacatatgagggtggcagataggaagggagtgggtaggataaataccctaaccatttataactcctgctctctgtttatttgctagttgcttccctctcctgccaccctcattcaaactgaaacagaagccagggggcagaggcaggagatagaatcaatagtgttctgcttttctgagcatagagtagagcagacaagcgtggataattggatctaggggaagaagcagataataaccacacaaccttccagctatgatattctagcagctaacctggggcccacggtcttgtaacagaactaagtcaactctcttctgtcagctctgaaccacagcaattgacacactgaagttttatgatgtgatggtagatgaccaggaaggttttctgcacagatgctgtgtgtactgttggaaccaaacacacataaaaggtggagcaggttgtttctataggatctgacagaccctcagttcctagggaagcttaatccctaactcccacagctgtcatatgcctttacatttggaagcctctccattttcacacctagggaaacttaccaatagacaccaagaacatactctgtactagaacgtccaggtctcaatgggaattatcttaatgaagacaatattgtgacagataaaaaggaacataatgtttattatgcacaaacatatagactacaggtaatttggtgggtttatgccatcatcaacctcatttgtatttattaagcacttattgtgtgccattcattgtagctaaacttgatttcaacattatcttgtttaaatctcagtgcaactctgtgtgataggtgctattatcctaatttaatggagaacaaaaccactgaggctgagagagatgtgacctatccaaagttacacagtgaacaaagcctgattttctattcaaggcagtgtgactccagaattcattttcttaatcactaccctctccggcaatgggcctgggactaaacccagccttggtcatatcttgggaacttttgtaagatgccatgctggtgcagtggagcctggccaaagaaagaaaaagaaagttttattttaattttatggttgaggaagggaaggtgacctgcccaaagagttagcagctgggagtgaaatccagataatcaactttcccttataagagtaattctactatctcatcttactttctgctaacttctttcttctccttttctcatatctctagacatcactatcatccttacatactcaagcaatttactgcttggcaaatgccacttctcactcttccttagaaatggaccaacaatggtgaagcaacaggcctttccagctctgcctggataatatttaatatttctataatattttacagttgataaatgatcatcataatgttagctaacatttcctaagtacttactgtatggcaagctgtgttttaggtgcatgagatagattaatgcaattcttagaactaccatataaggtaatattatctctattttatagaagaagtgactggagactcagacaagctaagtgggttagcaaaagtcaacagtagtttgtgacttgcagtttggctactagccccactcttagcccctacagtatactaacggattaggataaaatactagaatcagaagttaaagagtacctgaagctcaggatgtattgctaactcttggttctcatacaaggtttcaagtaaatacctgaagaaaatgtaccaacatattaggaaaatatttctttttcagtcagtatttggatagtctgccttgcctactttatagcccatgtattttctttttttatttattttttaaattttattttttattattatactttaagttgtagggtacatgtgcacaatgtgcaggtttgttacatatgtatacatgtgccatgttggtgtgctgcacccattaactcatcatttacattaggtgtatctcctaatgctatccctcccccatccccccaccgcacagcaggacccagtgtgtgatgtccaccttcctgtgtccaagtgttctcattgttcaattcccacctatgagtgagaacatgcagtgtttggtttttttgtccttgcaatagtttgctgagaatgatggtttccagcttcatccatgtccctacaaaagacatgaactcatcattttttatggctgcatagtattccatggtgtatacccacattttcttaatccagtctatcattgttggacatttgggttggttccaggtcttttctattgtgaatagtgctgcaataaacatacggtgtgcatgtgtctttatagctgcatgatatataatcctttgggtatatacccagtaatgggatggctgggtcaaatggtatttctagttctagatccctgaggaatcgccacactgtcttccacaatgattgaaccagtttacagtcccaccaacagtgtaaaagtgttcctttttctccacattctctccagcacctgttgtttcctgactttttaatgattgccattctaactggtgtgagatggtatctcattgtggttttgatttgcatttctctgatggccagtgatgatgagcattttttcatgtcttttggctgcataaatgtcttcttttgagaagtgtgtgttcatatccttcgcccacttgttgatggggttgtttttttcgtgtaaatttgtttgagttctttgtagattctagatattagccctttgtcagataagtggattgcaaaaattttctcccattctgtaggttgcctgttgactctgatggtggtttcttttgctgtgcagaagctgtattttctaccaggctgagcaagttttgctctgtctatagcaatataaagaagaggatacatttgtccagagtttattctggtgctcattcaaagttagaaatgtccagtgtgttaaaagaaaaatttcagccaaattaaatttaaaagattaattgagcaaagagtgattcacaaatcaggcagtcttctgagccagagtaagctcagagactccagtgcagccaagtggtagaagaatatttatggacagaaaaaggaaagtgatgtacagaaaatggaagtgaggaacacaaacagctggattggttatagctctgtgccttatttgaacacggttcaaacagttggccacatttgattggtcaaaacttagtaattggcacaagagtaggctatggtctatttacacctccacttgttatagttgacagtgtacagagaaacctttaggcctaacttaaaatatgtaagaaagcagctttaggctaaacatgatttaacaatttcccccttttattcatcctctcattttgagagattgaccaaaactttagtcattgatgtcactatcaccatcataaatgtacttatttggccttgaaacccactgaaaaatagcagaacagtgggttgtgtaaggtgtgaacaaggacttcaggtcattttttttttttgtaagggttagagtagaggataacttcttagtctggaacatcctgtttacaggagaaaaagacaaaacccagtctgttctaggatatatgtgtttccttaaagtcttagtttgattatgttacatttagcacaagtgagtcccttttggttttgtctggtctgttggggcctagtgcatgacatgagctgagtccaaaacaatggcctcccataattttgtttaaaaattcccccctttttgtcaggttctcacttaggtgagagtgtgccactctcagttaccgtcattttgggtttccaggtctcagcaattcattcataggttatgatgccctcatggtcacacatttccttcagctattggcattccaattgaatagacaacatttgccattcttgagatggctgaatgcaaacgtttaaaacttttgagagaatacagtacaccaaggggactactattatgattgtcaggaggataataccaagagtttggagtatgccccttacctagggtcaccaggaaccaaaccaactaaaatcaaatagatcaaagaatgagctaaagagtctactcactttaactaagcagtctcttcattaatctcctacactgaatctctataatacctgatgggatatatttctccacaggccacaagcaccagcagttgcacagatacttctgatacttctctgtttagccagtaagtaatctagagcaattctattatttagcataattttcacaagagaatttaaaatctgttgtgtaaccatagcctttacagtagaatcagttatagagcctatcataagggatacatttctaattattccatcttttactccacaccatggaaaaaagcacttaacaaatgatgcctttctagaagaatgaaggactcccggcaatgttgtctttaacccatgatgtagattaaaaggagtgaaccaacattctgtttctgactatcaggcaacgtatgtaccattaaagttattcacctacattgggccttcatttttcatctatcaaggcatacggttatccatgtataaggctggttatccatgtataaggctggccatttttttttctggggagaaacttccctgggtagctttaccttaagggttctaacgggtgtatagttccataagtgtggagcaaccctccctcagttgtgagattataagcccaaggttcaatgtcccttagctttgctgcagtgtggatggcaaaggaagtccttctctgatgttctcggaagatccagtctttgagttctagattgtgaaggggttgattgtcttcagttagtgaaccgtaaaaatcttttattcctggtgaaaatacattgtgacgtaataatctgttataacatcacccttctcgcaaggaaaagctttgatacaaccagaaaacatacattgaaaatgacaattgaatgaaatccctctataaatgtttaaatgacccatcaggtagctgaatgtatctgaagatttgagtgtcttcccaggaatacgggtttgacaaattaaacattggttataaactattttagcaatgtacaagtcaccacaacaatatatatttaatttggattattttatctttttcatgagtcatggaatgcagaacttttaataacaaaaactttaaggactcaggaaggacaaggcagctgccctggttctccatgagtccatacttaacattggtcttatgtcctcttgaataccaattgtttctccaatttaggtgcgtagcactgataactgatgggttatcataggtcatttgacttagaccatggagttcattcaaattgtgtatctatacaattttggtattggctgatttagcatgataatctggcaaagtgtcttcttggtattcaattaatttttgttctacttgggttagcagttatataaaccagtcttttcattgaagttccaggaattcttacccagtccaaatgatatgactctaaagttatgagaaacccgtattcaagagtgcttttcagggtcctttccaaccttctaaaagacaccatatttctaggattttgcatgcttgtgaatttttcagaaactgcatcagaattaagcaattaactagcaatgacttcaagtaaagacacagttgacaaggaaatttggttatttctgtggtctacaataaattaacataataaccataattataattgatatcatatactcagacagtagaattttagaaatcccataacattttggaacatatattaatgaaattcattaaaatataacctaaagaaggttaatgattatttctggctgggcgtggtagctaacgcctgtcatcccaacactttgggaggctgaggcaggcggatcttttgaggtcaggagttttagaccagaggctgaggcatgagaatggcttgaacacaaggggagggtggggaaaggttgcagtgagtgagctgagagcgcaccactgcactacgctccagcctgggtgacagagtgagactgtctcaaaacaaacaaataaacaaacaaaaatttcttattttgacggtgcttcccatgtaacttaatatatcaaataatcctgtttacctctcttttggatgcttcaggggccctctgtagcatcctaaagttagtggtcaaaagagacttaatttcgaaattggaatttgacttggggaagcctgtcaaatatgttaaatgtttaaaacatttgatattatgaaatagaattccatgtcaccataaatcattcattttgccaaaataatgactcaaaaattttaaagatgtaaaaacctttactcattgatagaggaaagacttagctttccaaacaatctgtctcttgtctttcccttctttctcctgtagtttattcaaaaggcaaacaaaaatctttcattattctttaatattacatgaaaatctcattcaagaaagaaagccaaatttcatccttgcattagtatactgttaatgtcaaccccaatttttaataaaacctagtagacaaatctatctaatcttaatcagttttaccataaggtgagattcacataaatcttttataacccattacaaattttcattaaatagtagatcagtgctctaagaaaacccttttgtgcttttatttcaatgttcaatttacaaaaaaactgaacaataccccctttaaatttagccaatatgttcacatgtagaatttctcttacaagtttaatttttcacaatcttccacaacttgctcaactttcagctttatcctatctaacctaaatcgtcatttaaccctttaatctaggcacaaaaatccacattcccatgccttcttataatcttttaccaaaagcctacttcactttcctcacacattttgcatgtaaaactctttcttcagtagtctcaattacatgttagaatctcaactcttagcaatttttatttttagtgaaaaacccggtaaggaagtgattttaattatgtactaggtgtggggcctaggacaacagactgaagtgcaggtaaagtccaactctttccatcatagctaggggcatggttaactccatgtgtccctaggccttatctagaatctaatggctctaaagcaggtaagtctaacaattttcaaaagtcaaaggagcagtttatgacatcaaagcatttagcaaacctaatatccgacctgcctaatttagaccaaatgtctttattttaccaataatcttataaaactgtgtttatttcccaaagattactaaagtcatgtgaactaaaagacattacagtttttatttttctgacaaaatatttgatttaagcacttattccttttaaaccaattaatcagagctttttcgtataaacatcactcacacaacacatacagacagaagaaaatccattacttgtaagaattttcatttgtcagttttaaaatagcttttctttctcccgttcagtctatcaatcttccaattactggtttcactgaactaagcaattgttgactaggcaacaaatttgtatttctaaagggacaactgttaggtggaaccacaaaaaataaaaatttatatctcataagcagagagcaagattttggtctaaaaattatattattgtttgctcaaaccaggggcaaaacaaaaacaaaaacaaagacaaaaacaaaacaaaaaaaacagtgctctcatgaaagttccatcaagagaagatggccagaaaagcatctcaaccaaaagtatgatttattatgtaaatttaaaggaatgggccgggtgctcaagcctataatctcagcactttgggagaccaaggcgggcggatcacatgaggtcaggagttcgagaccagcctggccaacatgtgaaactccgtctctactaaaaatacaaaaattagctgggcgtgatggtgcatgcctgtaatctcagctacttgggaggctgaggcaggaggatcacttgaacctgggaggcagaggttgcagtgagctgagattgtgccactgcattccagtctgggtgacagagggagacttcatctcaaaaaaaaaataataatggtgatatgatttggctctgtatccccacccaaatctcatcaggaattgtaatccccacatgtcaagggagggacctggtggaaggtgattgaatcatggagatggtttccctcatggtattctcatgatagtgagtgagttctcacaagagctgatggttttaaagtgtggcacttccttgctctctctctctctttcctgttaccttgtgaagacgtgccttgtttccccttcatcttctgccgtgattataagtttcctggggcctccccagccatccagaactgtgaatcaattaaacctactttctttataaattacccagtctcaggtatttatggcagtgtgaaaacagactaatacaaatggtaagtttctaatgtacataagcagatatccctacaaatggagatttcatatatatatgtgtgtatatatatatatatgtgtgtatatatatatatatatgtgtatatatatatatatatattttttttttacaaaagagttttaagatagtcaattaaattccagaaagatgtattttagttcaatagggttttctttttaacatagctactgtttcttagctaaaattactgagttcagggtaatgggtggagcccactaaagaatagggccaacaaagcatgcattgtatgcctagactcagcatggatagatctgtaaaaagaagcatgcctattttacctgagggcctaacttttataaacatcttatctaggataactttctttccaccttttgggtgggaaaataactaagccaaaaggttagcagacttaatttttaaaaatcagttagttgcttaagatttgtatttgccttttataaagtctttagataaaaatattgaaatatttttagaagcttctgcatgtcaataggcatccctaggtgagactaatttgggagccctcaatcaaatgcacttcagtgcattgccattcatttggaacgttccactctaacttatctttagtgagattttgcgatttcaataagactttgctgcttgaggggcctcatacttgtgcgtgtataagccagaaggaactcagttcttcagaaattaaggatcccatttttacctcaaatattgtcttttttctcagattcccttgatcaacttagccagtgtttgttttttcctacttaagcatgcaagaaaaataaaacaaaggggtagaacacaaaaatctctgtgaatttccaaaagccaaattttataccccctgcaatattgccatttactactaggttctttctgacccaatcagatataagaggcctctaactggatccaagccagttaattaccagatccaatctgatcctggacctagtccgctttctgccatgacttccaaacctagtttggatcagaaatttgctcaaagaaactcagagagctcaaaacagaaaaccatggagctttggaatccaagagagaacttaaccacgatccccagttgttccaagagagtaatggacacagtgggtctggtgggtacctcacttggtcattcaatactccttggggtcattagaagctctactttggatcccacttctggtgccatctgttaaaagaaaatcttcagctgaattaaatttaaaatactttaattgagcaaagaatgatttgcaaatcagtcagcctcttgagccagagtaggttcagagactccagtgcagccgtgtgttagaagaagatttatggacagaaaaagtaaagtgatgaacagaaaatggaagtgaggtccagaaacagctggattggttacagctcagcatttgtcttatttgaacacattttgaagttggccacatttgattggtcaaaacccagtgattggcacaagagtatgctatggcctgtttacaccaccacttgttatacttgaagatgtacagagaaacctttaggtcatacttaaaatatgtaaggaggcagtttaggctaaacttgatttaactaacgtcttaactccagggctttaatggtgaaaactattgctttgcatgatccgttttccaggtgtcttttcaaatatacagaatctttaaattcctttcgtttccatcagtctctgtgttttacttaattaactaattatattgtatcactctcatagtccgttttgagtttcctgggctgtttgaaatatgctatggtaggcctttaaggactatcattctgtgcctgcacgtaatcacagctggatgggaagctagaggtgaatcaggtggtactggaggcatgttcataaagatgcctgagtaagccaatccagcctgtctgaggaatacaaaggatatgtgtaagaggactgtatattctctatctgaactgcatcagttatcaaattgagataaggagaggggctacacttttagaaggttcttctgacactatataaataggatttagacattagagcagaatattcaataatgttagtgtttttaaaacgttttacaaatgagagataaggattcttttttaaattgaaccaagaagaacactaaacctacttaattattcactgagcaccctgttgtcacagaaatgtggagtcattttatcccatttctaaatgtcctaattttgataggatattggcaagaaaaatgcaaatacacactttggagtgaaacactcatctatgtgattagttacctcagttggtaaaagtctggtgttaataaggtcaaggctatcactttgaattctcctttttcttgtcacaactatctcaattttagatgtttgacattggttataaatggaattggttgggaatgatggatggttcagtacaaacttatttgtacaactgatcattcattcagcacatatgtattgggtgcctacctgtgcaaggcactatgctaggaactgggaatactgaactgaccaaaataaacacatttctcttttctcatgaagggagatagatgagtaaatagctctttctcaacactccaggaaggaactacatcaattgaaatatctaaaagaacagctcctacttgtaatcaatagtgtctttgtcttgagtaaagggcagcagacatacctgtttttaatcacagacatgaatctctgcaaaggaaaattacaaaactaaataagatcagctaatattttcatggtacataatagtcaggagcaatcttttgttacctaaacatcaagggtttactttcagtcctgcagcttgctgcacagaaagccaatcactgagacaatgagtattgccagggaagaaggctttaattgggtgttgcagctgaggaaatgggaaatcaatatcaaatccatctccctgatggactaaaatcaggggtttatatagcagggaacaaatgtaactaaatgcaagtaaacagaaattagggagaggtaaggaataggagttggctaacaggaagcaggtagttgcttagacaatcatgatggataaggggttgaatttctccttgtctggatgtagtgatatgttaagttttggttccttgatatcatttgggagtcctgatggttggtttcctgagaaaagaactcagataagacaaatgtgactttctcaagttttaagactaagggggcagtttctacatttattcaaaagaaaccataaacatcagttatataggacaactgggtcgatttaaattttacaaatctttttatgtaacagcacacatagaaagtgataatatggcacatcaaagtgagtggaagactggccttgagagcttcaggtgctctcagccctcctgactgatttggggctgaacaacacaaaatcaatgtgcccatatactggtagccctcacatagcactccagagtgctgtgacccactggtttggaagctctggtttaccttttcataaaatgtaatatatatattttttatctaaagatgactgagtaatttaatcttgattgtcctgggaatgcaagggatatgtgggagagagttgtatctcctctatctgaactctatctgttagcaaaaggaggtgagtctgcttattggtggttgttatcttctttttacagatgaggaaactgaaataactcacagagggtcacttatccaacatgtggccaattagattcaaacgctgaaattctgacatctagtgttctcataatctcactatgattgctccactacatgaatatgttatgcacttaatcactcacatcactgatataaacagaattctctatcaaaattgttactccagaaacaaatcctgtaatgctttctaaggactctttaatgactctgagtgttgaaagggactcaaatgaggaaactgaagcccaaagaggttaagtgacttgcttaagtctaatgaaacccatgtctttctttttttacattcattaaattttacaaaaagagaccactaaatagaatagaagtgtgtgtgtatatatatatatgtgtgtgtgtgtgtgtgtgtgtgtgtgtgtgtgtgtgtgtctgtatttaaaagctgattgttttgacaaatcgaacagtgaagaggtatattaatataaagttagtttcatcctctcttccattccatttcagccaccaaaataactaatgctaactgttaaatacttcctcactttcctctatgctaacattttcttcctctctctctccccaccttctctctttgtgtgtatatatgtgtatgtgtgcatacatatataaaacacattatttacttactttcatatatacacatatatgcaaatattttcccttctctaatttttttttataaaaaagagaacatgctatgcatatcatgcttcagctttccccatcacacacaaccgtatgagaaacatccttccacgtcttctacaggtctaattcattttgctgcataatagttgacaggacagaactaccttattttattcaatcagttcttctactaatggatatttatgcattttttttctatttttgtttttaataaccacagtgttggaacatccttgtaaacatacatgcttccttacatccatgacatacaagatggaaatgctctctgtcactattatagttttgtaggttctagctgatgcaataagaaaatgaaatgaaatatgctatataaatattggaaaagaagagacaaaataatcttaattttcagattatatgattgcatacctagaaaacccaaaggatgcaactacgacaacaacaaaaaatagaactaatgagaaacttcagtatggtagcttcctaaaaatgtacaaaaattcaacagcttttgtttttgcaaacaataaccagttagacatgtaaaggtgaaaaatgaagtgatcttgtttaaacaatgacactataaaacacattagaatacatttaacaaggatgcaaaggggcttatatgaaaataagattagcatttgcaaaccatcaatcggacaagggattaatcaccagaatatataaggatctcaaataattttgtaggaaaaaaacctaatctaatttgaaaaatgagcaaaatatttaaatagacatttctcaaaagaagacatacagatgggaaacagacatatgaaaaggtgctcaatatcattgatcatcagagaaatgcaaatcaaaactacaatgagatatcatttcactccagttacagtgacttatatccaaaatgcagacaataacaaacgctactgaggattcgaagaaaagggaacccttgtacactgttggtaggaatgtaaattactacaacccctatggagaacagtttggaggttcctcaaaaaactagaaattgagctaccatatgatctagcaatcccacagctgggtatatacccaaaagaaagtaaatcagtatatcaaagatatatctgaacttccatgtttattgcagcactatgcacaatagccacaatttggaagcaacctaagtgtccatcaacagatgaatggataaagaaaatgtggtacatatacacaatggaatactattcagccataaaaaaagagattctgtcatttgcaacaacatggatggaaccagaggtcattatgttaaatgaaataggccaggtactgaaagacaaacaccacatattctcacttatttgtgggatctaaaaatcaaaacaatggaactcctagacacagatagcagaaggattgttaccagaggctgggaagggtatggaggggttgcagagaggtggggatggttaatggatacaaaaaaatagttaggaaaaatgaataatacttagtatttgctagcacaacagtgagtctatagtcaaaaataatttaattttccattttaaaataaaaagtacagttggattgtttgtaacacaaaagatagatgcttgagggaatggaaaccccattttctatgatgtgattattacacattggatgtctgtatcaaaataactcatgtcatcataaatatataacctactatatacccatgaaaataaaataccattgaggtactattatgtaatagaaaagctaaaatcgaaaacacagatgacacccaatgctaacaaggatgtgtagcaacaggaagaattattcattgcaaatgggaatgcaaaacaatacagccacttttaaaaaacagtttggcagttcattacaaagttcaaagtaagcttaccataacatccaacaactgtgcttgtaggcagttaccaaaattagttgaaaagtttcatccacacaaaaacctacacacaaatgtttatagcatctttatttacagttgccaataattgtatgcaaccagcaagtccttcttcctttgtgaatggctaaacaaactgtggtacattcatataataaaatattattcagatatgagaaaaaatgatatatcaaatcataaaaagacatggagaaaccttaaatgtgaaaccataagtgaaataagccagtctgaaaagggtacgtactgtatgcttagaactatatgacattctggaaaaggtagtactatagagagaataaaaagatcagtggttgccaaggtgttgtggaggaaagatgaaggaaggaatcaatatatggatcacagaatatttttagggtgggaaacaatttttaggatggcaaacaattctgtatgatgctgtaatgatggatgtatgaaattattcatttgtcaaaaccaattggactgtacaaaacacagagtgcaccctcatgttaactgtggacctcctttaataacaatctataaatattcgttcatcaattagaccaaatttatcacattaatgcaaaatgttaataatatgtagaaaacttgatgtgagagtttggagggtatgtggaaaccctgtactttctgcacaattttttctataaacctaaaactaaaaataaagcctattaattaagaaaaaaaacaaaatttattataggacataaaatatgatccaaattaatgaagagacaacatgtttctgcatgggaagataccaaagaataaaagatacgcttttctgaaaatgtataagtaatgcaatttgatagaatataaattatttgaaactggacaacataattacacagttaatataaatgaatatgccagaattgccaagaaaatattggaaaaaagcattcatgagaggggacatattctatgagttgctatcatttactacaaaacaacatcaattgaaacagtaagctaaggaaaagataattgacctgtagaatagagaatccagaaacagataaaaatacttatgtatgagaatgtagaatataataaaggtaacatttcattttaatgtaggtggagggagaatgatggtttatttaaatatggtgtggacataattgaatatctacttagaaaaaaattagatctctgactcttgtaccctgtttaagaaaaattctaaatgaattgtaaagagttaatttcatctacaaaaatagtggtttaggaatgaccatttctaaatgctaccacttatttcaataagttaagtttttaaagaaaagagctttacattgatttatcttgttatacattctgactgtttttctaaaggtggaaaaaatgtcattagaaacctcataataccgcagcctgaatgatcaacacttgcttgctaaaaaaaaaaaaatggtttcccaaaatgcttggagattttgaatccctttaggaagtgtaataaaattaatctgtgccttctgtcataaccataaaattgtatgcaacccttgaatttttaatcttgtaacaagaattttcaaagacatatttatccagaaggaatgagttgcaaagctcatgaaggcttcagtttggtgtgccctgaaaccatagtcagcaatacaaaatttaagatccatttgtacttctttttgttcctagatatggcattagaagtggggaggtttttttttttttaactgtttgtaaattataaaataggtgggctaatacaataggaatgggtatttggcatgtataagaagcactgggctccatgtttgaggacttggattctgatcaccatactaccattaacatggataagtaattaaatatcactggacctcaatttccccacatataaaatatatgtaattaatagctgttatataccctagacatgttataaaagtttaatgattaaagtctttacttgagatttgctacaactatagaaatggaaaagttatgtggaagccagaaatatagttacctaagacatctcagattctaatttaaggctgaggtttttttaaaggtcaaattattatgtataatttacaaatagcaaaattcatcccttttacatgtacaatttgatttgatgtgttttgacaaatgtatacaccatagtcaagatatggaacagttctgtcactccaagttcttctgtgtccttttgtattcaatcctctcgtcccagccttagtctttggtaaaaattcctttgtttctattcctataattttccattttccagaatgtaatataaatggaataatatgatatgtagcttttttgtctgtcttcctttacttagtataatgcatttaagacccatctatgttatgacatatatcaataattcatttctttttatgctgagtagtattccactgtatagatgtaccactgtttaaccattcactaattgatgaccatttggattgttgccattttttgattaggaataaaactgttacaagcattgggttttgacgttatattttcttgctttatcaacatgatttgtttttgtcaactttgtaatcttttaacaggcatgcctttttaaaatttaacaagagattgctcttgatctttcccaaattgttctaagaatctaggcttagaaggtccttgagtatatctttaatggcatcccagggatacaaacagttcaaagcaaactaaagcttcttaagcaatgtctttcctacagtatatcttcaatgtatccagcagaatgatcttttagaaatacatatctgatcataggatgctacttcttagtgaactctaatgattctataaaatcatttagatgacagctcctttttactgagtgtttgcagggcctaacattgtgccaaatatgttcatgcattacatgactcaatcattagtgaagccttatgagataggctacacggtggcagagctgaatttgaaccctgacggtgtgcaaatatcttagaatggaatttaaggctctttacatttgaatccagccactctcaaaagagcaaaattatttggaacttttttgtctacttcaagtgttttcacatctgtgtgcttctacacatgttgttccttctgtcttctacaccctgcctgccttttatatgttgttcaaactcagctcagatgctcatagtagcccacctgcataccatccccttgcccagacccagtctgctccaatacatgaatgactcagcattgaaatttaaacatttcttctttttctttctctatttcttcttgttctagtattcccattatgcctattttacaccttttgtagttccacagttcttggatattctgttccactttttttccattcttctctctccttccttttcttgttgggaagtttctattgacattatattcaaactcattggttctttcctcagctatgtagtctattaataagcccatcagaggcattattttatttctgttgcagtgtgttgattcctagcatttccttgagattatttttaagagcttccatctctctgcttacattacccatctactcttacatgatgtctactttttccatcagaattattaacattttaatcatacttattttaagttcccaatctgggaaatataaaatttctgccatatctgagtctgtttttttttaacttttattttaggttcaggggtacatgtgaaggtttgttacataggtaaacacgtgtcacaggggtttgttttacagattatttcatcacctaggtattaagcccagtatccaatagttatcttttctgctcctctccttccaccttcaagtagaccccagtgtctgttgttttcttctttgtgttcatatgttcttatcagttagctaccacttataagtgagaacatgtggtatgtggttttcattccctgcattagtttgctaaggacaatagcctccagctccatccatgttcccataaaagacttgatgtcattcttttttatgtctgcatagtgttccatggtgatatgtaccacattttctttatccaatctgtcattgatgggcatttaggttgattccgtgtctttgctattgtgaatagtgctgcagtgaacatttgtatgtatgtgtctttatggtagaattaatgatttatattcctctgggtatatacccagtaatagtattgctgggtcaaatggtatttctgttttgctctttgaggaatcgccatactgctttccacaatggttgaactaatttacattcccaccaacagtgtataagtgttcctttttctccacaacctcaccagcatctgttattttttgactttttagtaatagctatccgactagtatgagatagtatttcattgtggctttgatttgcatttctctaatgatcagtgatgtcgagcatttttttcatatgtttattggccacatgtatgtcttcttttgaaaagtgtatgttcatgtcctttgcccactttttaatggggttgtttatttttctcttggagatttgtttaagttccttatagatgctggatattagacctttgtcatatgcataatttgcaaaatttttctcccattctgtagattgcctgtttatattgttgaaagtttcttttgctatgcagaagttcttaagtttaattagaccctacttgtcaatttttgcttttgttgtgattgcttttggtgtctttgtcatgaaagttttgcctgtgtctatgtcctgaatgctgttgcctaggttatcttccagagtttttatagtttggggttctacatttaattcattaaaccattttgagttaatttttgtatatgatgtaaggaaggggttcaccttcaatcttctgcatatgactagccagttgtcccagcatcatttattgaaaagggagtcttttccccattgcttgtttttggcagctttgtcgaagatcagatggttatagatgtgttgtcttatttctggctctctattcttttccattagtctatgtgcctgtttttgtgctagcaccctgctattttagttgctgtacccctgtagtatagtttcaagtcatttaacgtgatgcctacagttttgttctgtttgctcagaattgccttgtctatttgggctgggctcttttttggttccttatgaatttcaagtcctgtgaagaatatcattggtaatttgataggaatagcattgaatctataaattgctttgggtagtagggctataataatattgattcttcctatccataagcatgggatgtttttccatttttttgcatcttctctgatttatttgaggagtgttttgtaattcttattgtaaagatctttcacctctctggttagctatacacctaggtattttattatttttgtgacaattgttaatgggactgcttttacaatttggctctcagtttgcctgttgttggtgtatgtgaatgctggtgattttatacattgatttaacatttttctcatattttcaactttttgatgtctgccttaatttcataccattcaacccagcaatcccattactgggtatattccagaggaatataaaagtgtataaatcaaactttgctgaaactttgctgaagttgtttatcagctgaaggagcttttgggctgagacaatggggttttctagatatagaatcatgttgtctgcaaacagagatagtttgacttcttctcttcctatttggatgccctttatttctttatcttgcctgattgccctggccagaacttccaatactacattgaataggagtggtgacagagagcatccttgtcttgtgccagttttcaagggggatgcttccagctttttcccattcagtatgatgttggctgtgggtttgccgtagatggttcttattattttcagatatgttcttcaatacatggggtattgatagtttttaacatgaaggggtgttgaattttaccaaaagcctttgctttgtctattgagataatcatgtggtttttgtctttagttctgtttatgtgatgaatcacatttattgatttgcatatgttgaaccaaccttgcatctcagggatgaagcctacttgatcatggtatattaactttagatgtgctgctggattttgtttgcaagtattttgttgaggatttctgcattgaagtacatcaaggatatcagcctgaagtttgttgttgtgtctctgtcaggttttattattagaacaatgctggtttcatagaatgagttggggaggagtccctcctcctcaattttttggaatagtttctgtaggaatggtaccagctcttattggtatgtctggtagaatttcgctatgaatccatcaagtcctgggcctttgtttttctttttggtggataggctatttattattgacacaattttttttcttttttttttttgagacggagtctctctcagtcacccaggctggagagcaatggtgtgatctcagctcgcttcaacctccgcctcctggattcaagcaattctcctatctcagcctccagggtagctgggattacaggtgcctgccaccgcacccagctaattttttgtattttagtagagatggggcttcaccatgttgcccagactgttctcgaactcctgagctcaggcaatccacctgcctcagcctcccaaagtgctaggattacaggcgtgagcgaccgtgcctggcctattgattcaatttcaaagcttattattagtttgtccagggattcaatttcttcctggctcagtcatggaaggttgtatgtgtctaggaagttacccatcacttctaggttttctaatttgtgtacatataggtgtttctagtagtttctgatgggggtttttatttctgtggggtcagcagtaacatttccttcatccaattgtgtttatttggatcttctctcttcttctttattagtctagctagtgggctatctatcttattaatgttttcaaaaaacttttgaatggttttttgtgtctcaatttccttcagttcagctgtaatttttgttatttcttgtcttctgctagtgttggagttgatttgttcttgcttctcactttcagttttgatgttaggttgttaatttgaaatctttctaactatttgatgtaggcattgagtgctgtgaatctccccttaacactgctctagctgtgtcccagagattctggtatattgtatctttgttctcattattttcaaggaacttgttaatttctgcctttatttcataaattacccacgagtcattccagagcatgttgtttaatttccatgtaattgcatggttttaagtgatttttcatagtcttaacttctatttttattacactgatctgagagtgtgtttggtatgattttggttcttttacatttgttgaggattgttttatgtccaattatgtggttggctttagagtatgtgccatgtaccaatgagaagaatatatattctgttgttttcaggtggagaggtctgtaaaggtctatgagatccatttggtccaatgttaagttcgggtcttgaatatctttgttaattttctgcttcgatgatctgtctaatactcagtggggtgttgaagtctcccactattattgtgttggagtctatgtatctttgtaggtctctaagaacttgctttatgaatctgggttcccccgtggtgggcgcatatatatttaggatagttaggtcttgttaaattaaacccatcatcattatgtaatacccttttctatattttaatctttgttggtttgaaatctgctttgtctgaaattagaattgcaacccctgctttttttctgttttccatttgcttggtagattttccttcacctttattttgagcctatgaatatcattacatgtgagatgggtcttttgaagacagcatacaattgggtcttgcgtttttatccagcttgccactctgtgccttttaagtaaggcatttagctcttctacattcaagattagtattaatacgtttggatttgatcccgtcattgtgctgttggctggttattatgttggcttgtttatctggttgctttacagtgacactggtctgtgtgtttaagtgtgtttttgtattagctggcagtggtcttttctttctatatttattgttattttcaagatctcctgtaaggcagttctggtggtaatgaattccctaaacatttgcttatctgaaaaggatcttatttctccttcatttaggaagcttcatttggttgggtatgaaattcttggttgaagattttttttctttaagaatgttgaatataggcccccaatctcttctggcttgtagagtttcagctgggaggtctgctgttagcctgatggtgttccctttgtaggtgacctgccctttctctctagctgcctttaacattctttctttcactttgaccttggaaaatctgacaattatgtatcttggggatgatcttcttgtgtagaatcttgcaagagttttctgtatttcctgaatttgattcttggcctctttagcaaagttggggaagttttcatgaacgatatcctgaaatacgttttccaagttgtttgctttctcctctcttctttcagggatgccagtgattcatagatttggcctctttacataatcccatatttcttgcatgttttgttcattcctttttattctctttatttttgtctgactgtcttaattcagagaatcagtcttcaagttctgagattctttcctcagcttgctttattctgctattaatacttgtgattacattatgaaattcttgtattgtgttatttagctctctcatacctgttaggttcattcttataccagctattttgtccttcagctcctgtatcgttttattgtgattttttcccttggattgggttttttcatcctcctcaatctcaatgatctttgttcctatccatattctgaattctatttctgtcattcctgccagttcagcctggttaagaactcttatgggagaactcatgcatttgtttgtaggacatacaacactctgaccatttgagttactggagttcttgcgttggttctttctcatctctgcctgtggatgttcctttaactgcagtgtagattgagtacagtcaataggtgtttctggatgttttcactgggctgaggctttgtgcatggtctttatttgaagcttacttcctgtctctggtttcagagggggggtatgttaatgaagtatttttaatgttgaagatttagggtgtgatccagcaggtggcacataggcttattggtcagttggtacactcttgctcagttgtgtggctttcctatgtttcctcacatttggagccctgttccctctcaatgctctgaaggtgtggcttcctctctcctttgagtgctggctgtagattgcaacttggcactactgggcttctcatagtagctctggggtgatctcagtgttttatgttttttccccaacttggaagcagcagaggaagggaccttagtagtggttgtggccaaggatcatttgcttgtctcctgggagctccactcgagagaggtgcaggtcagcaatggcttagtgcaatcagcccaggatgaagggcctgtgctgtgggtccaagccaagacttccatgtctggtgacaagttgtaggggatgtgtgggacctgtgggagatggactggcctcctctccttgggtcaactgcagcttgctggtggtgtggttaaggtacttaggatatttcctccgtagtctgagggtagcaagggccgttccactacagaggtagtggcacagaggttttcagttgtccttggagactctgtccaggaagttgctaagttgcctggaggacctgcccggtaaggagatatgggaataggcacccacataacagtctggtcagtttttcttagggctgctgtagtatgctggaggcctgctttagtcagtagtcaccttgaattttctagtacctggaggtatcactagtggaggctacaaaacagcaaagatggcagcctgcctctccctccgggagcttcatccccgggagatatggacctgttgctagcccaaagtcacctgaaggaggtgggtggagaccctggttggaaggtcccactcagtgaggaggaatgggattggggacctgcttaaaaaagaagactggctacattttggtagagcagctctgctgtgctgggggtctgttctagcccctggttgccttgggcactccaaagccccaaagttggaacagctaagtttcccaaacagcaaggatgacggcccagccctccttctgagagcttcatcccagggaggttaaaaatctctgttagccagagaacaccaacaggggtggctggaggcccagtttgggaggtcccgcccagtgagtaggaaagggattggggactcactgaaagaagcagtctcgccacattttagtagagcagctgttttttgctggggaatcccttctgcccctggtcagctcagactctccaaagcctgaaggttgaaatggctaggtcacccaaacagcaacgatggtggcccacccctccctcttggatctccttcctgggaaagttacaaatctctgttggttggaaaataccagcaggggtggctgcaggcccagtctgggaggtcccgtccagtgaggaggagtaggatcggggatccacttaaagaagcagtctagccacgttttggtagagcagctgtgctgtgctgggagatcccttccaccactggtcagcttagactctccaaagcctgaaggctggaatggctaagtcacccaaacagcaaagattccccctgcccccggccctgggagctcctttttagggaggtgcaatgcccctaccggtggctagctggaattccaagtcttgttctgttaggtgctgtggacatggggcctgaaggctattgctgctcagccccctgggttcagcctctttcctaggggtatgtttggaggtctaaccttccactttgccagagctgcagctaccctttctggaaagcccaagtatataagactccagggtctcctcacatgcttgagtggctgctctgccaaggctccacatagctctgtctgttagactgaaggccctggtggagtgggttcatatggagatctgctgatctgagggttgcaaagatccgtgggagaaggtggtttcctgtggtcacacattcactcaccacttctctgcacaggggaggttctcctggctccatgttgcttccaggtgggccgtcatcctgtcttgcttttcttcattctccacaggtcaagttgttttcttgattagtcccaatgtgagtacctggatgtttcagttgaaggtattgtatttactcgccccttcttttcctctatgggccacacatgctagctgcttctagtcagccatcctggccacttcatatcttagtctatttctgatgcttgctctctcttcaggctgtttttttgtttgtttgtttgtttgtttgtttgttttgttttttgagttggtgtaccttgtaatttttcgttgaaacccagacatgatgtactgactgggtaaaaaggaactgagataaataggcctttagtgtgaggtttttagatttttctggctaagagtaaggctgtttttactgttttctataactgttggtgttagaggctacagttctttctggtgtccttgtttttcactcttctattgtctttgggtttccctagagacttcttaaataagatgtgagttgtgcagttctttaaactgtgatgccctattattagacaggagtcctaattgatgtgttggtaagatacagggtgagagtaagtgctatataatattatgactaggtctcagtgttttagtgaaccttgtctctgaactgtgaccacaagtgcttctcagcttctctcccacccactacttgagacaggaaggctagaagggctagagctggctttttttcttcttccacttcaaaggctaaaaggagctagagttggatagtttccttctccatgtcaaaagctagaaaagggtaaagagttcataccagttgctggctcgtgcagctgcttctgctcccagtgagctgtgattctctatattctcctgtctctccagtttttggggtagtagttttctttgtgacctcagttatctgatggatctgaaaatggttattgatgttcagtttgtttggcttttttcttgttgtgaggatagtattgatgacttctaagccctttacatgtcagactagaaaccagaagttaatctcagccttagaatgataactttaggttaaagtgttgtctctagactgctatagaaaattgagtcacattaactcctgatgatcattaatatatcataacacatgtataacctgaaagcaaagtactaaaagtaataaaaataatagactaatagttaatatttattgagtagttttagcatgtgatgccctatattacagggcatttacatatatcacctcagttaatctttataatcaccccaattggtaaatattatcaccacctgttttttttaaataggtgaagcaactgaagcttagattgatttagtagcatgctcaaaaacatactacttggaattctaatcaaagtgtttagtctagaacttatattcttaaccactgtgggctaccaatatcaacattaatactgtgaagatagaaagttggagaaacagagcttggaagggaagggctccttgtagttggttatcctaggcctttggagtagagataggctgaaaaggacaaggttcatacctaatttgcaatcgtactcctaattgtctcttccatctttaaactgcagacagttcagtttccctaaagatttttttttttcttttgagatggagtttcgctcttgttgcccaggctggagtgcaatggtgcaatcttggctcattgcaacctctgcctcctgggttcaagcgattctcctgcctcagcctcccgagtagctgggtttacaggcatgcaccaccacgcccaggtaattttgtatttttagtagagacggtgtttctccatgttgatcaggctggtctcgaactcctgacctcatgtgatccacccgcctcggcctcccaaagtgctaggattacaggcatgagtcactgcgcctggccccctaaagatttttaagcagatgtttagatgccctgtgggagaatacagtctccaggggaaaggagaaaagttgcctaaggggtggatgttgggtattcaaacaaaggtgtttgaggactagaggttacatggttagtttatggtcgcatagctgctttgtgcttaaacctcagaatcagaagaaatattgaaatcaatcttcctgatgttcttgccatgaagaatgaatcatgtgctctgaatggcactaaagtaaccacaaccaccaaatcaaatggatttaaaaaacacctgtaggtatgatgatgatatctcagaagtagactatgaatacagtggtaaatatttcaggttggaaactccaagatccaaatgtagctggcaacaggttactttagggttcttagtaaacagatatctcagttgtgcattctgggctttcaacccagcaactactggcacgggacatttgccacctaggaaggtggggagggagaggaaaaaagctgggctttaagtgttgacattatgttgactgggtaaggatgtcctgcaacaaactactctatgaggggatagcaaggccacaaaacggatctgattgttgaacttaagcaactctagcaagacgggctctcagcaaaattttcaagttgttcaggtttaatagtcccagggacaataaatagtagggggattacacagtgagttcagtattagggaactgctcaaatttgagcctttggtggtttgtcctggcctcagacaaccatcttgagacttgacctatgcacttcaaattctttgcctagtatgttgctataattaaacacagctggagcagtggggtatggtgatattctttggctgtgtctgtactcagatctcatcttgaattgtagttcccataatccccatgtgtcatgggagggaccaggtggagataattgaatcatggggatggtttcccccatcctgttctcatgatagtgagtgagttctcaggagatctgatggttttataaggggcttctccttttgctgggcactcattctctctcctgccaccctgtgaagaggtgccttcctccatgattgtaagtttcctgaagcatccccagccatgcagaactgtgagtcaattaagcctcttttctttattaattacccagtcttgggtatttcttcatagcagcatgagaacagactaatacatatggcaatactgtctgttcattaggaagttagtgagcaggagagaagtaatgacagcagtaagcctagcagccagcagcttactgggagaaagagtgccaataatggaaccaagagcctggaagacttctgagagtctatataggcatccagactgaggtagaatagccaacaaagtaactttgcaaaaggcgtattagtggaggcaggatgggaacctttagaaattgtctgtgttgtatgaccactccttatggtgctgcccaacaagaatgtaatgaataaacctgcaagcctctggattctggctgctcacatggtagtgaatattattcccataagcaaatttgctgaagatgacagaacttgggggagccccacattttaacctagagatgtcttaccctaaagccagtttgccttttcatctacactacattgtctctagagggatgttggtgacctgaagacaacattttcttatgccacagttaaaaaaaaataaagatcctctattggatacaaagaaccttttataaggctagatggcagcttggaaaacacatagggctatctcgatcattcccaaagaacatataaagattccaagctgttcttcatcaggagttattttataattcctatacactctttagtttttacttcctggggaaaaaaagcaaaacagtgagcagagaaaatgaaaattgttagaattaattgcatatggactttccctaaaatgacataagaaaatgacaccatttgtctttgaatgagtgtgtgggcttatttgcccacccccaccactgttgtgtgaaagcgcagcagctcagttttcattttcctttcctctcaaaatgcccagagggaccatatttttgtttaatgaccttcagaatgattctttagaaatctgaggctatcagagttggaaacaatgcgaaaataattgtggattattattgtatgacggcagtggcagctgggctgtttctttttctctgtgttcagactttcttcttcattttcccagaaaccttatatcccaaggtttaactcagaagcaaatctcagataggtgataaaccttgccagacatggtatgtaatataatttcagacaggcccttaactgttcttcaggaagaccctagggagtgaagcagccttatatctacatgctctcaatagtattacttttatttactctctgacaatgtgtgtgggtagttgtattgaacataaagcaagcatatctcttaaatattatacttgtgaattaaagcaccagtttgtgtgttttgttgtcaaaattcctgctaacatgaaagaaaaaaaatgttatgaaaaaaatgggtactcgctgtctcagatcacttacacacacacacacgtacacacacatacacatgaacacaaacacacaagcactcacagctggggattgagagtcagcacagattctaactttacatgaatgtttaagatatgcgtatggaggcaggggtgaggagtggtagatgcagatgttgtatacaccatagtggggaaagtaaaaagtgctctcaactattgttcacatcatctacctcaaaatcaatttatttattgccttaactgacagaatttacatgataaaatactttttttttttttgagacagagtctcattcttgtcacccagaatagagtgcagtggcgtgatctcggctcactgcaaactctgcctcctggattcaagagattcttctgcctcagcctctcaagtagctgggattacaggcacatgacaccacgcccagctaatttttgtatttttagtagagacagggttttaccatgttggccaggctggtctcaaactcctgacctcaagtgatccgcctgcctcagcctcccaaagtgctgggattacaggcgtgagccaccgtgcctggcaataaaatattttttgccttgaatattcagcactccctaacagctatcccctacgccttgactgatgtttgtacagcattcggctaccactttggtagaacatttgaggcgaatgatagccagaatggggcaatatctaataagtagtctgaaaaaaaattcctaaaagacaaagataattgcctgaatattcttacatacttggatattgttatatccttgtcactttctggaaaagtattaaacattcctttctagagaagtccaatcttggtagcaagattccctcacattcctatcaggagagtaagataattggcttcaaaacccaaaacttgttctgtggttatatatcactgaactcagaaagtaagtggatgatttctccaggctgttactataacaaagcgtgtcctcattttacctagctatgtttctagagaagtccttaattttttatattccttccctctctacccccacatggatttcttgattacaagaagggagattctggagtactagtattagtttttataataaggagtaattaatgaaacaattgtaaacttcattgccaatataaaatcctattatgaaagattaataatgcctaagactcccctggagtatactaagtggctaagtgaaccatgtcctcttaggactcttaggaaatatccttgtcaaatagaaggaaccaggacattataataatatttagtgactgttaaggttctgctatacctctcttgtaattggggagcctctatgctattctatttatttttttcagaatgcctctaaagacttcttgctcttggggtcaggcctttgaagtggtttgtagtgcagtagttgtgatattagaattggatacaataggacacatttgtgatttttcttggtcattgacttaactccttagttacatattttgaaaacgaaagagaataatacaaaaaagtaaaagtactaacttgctggtactgagatgtagtctgtgaaattctattttttgcttacttgcaaatattttatctgcaggaatgcaagccaaaaatgtggagaagcataataatacagaaaggaaatgctcttctgatccaagaagttcaagaagaagatggaggaaattacacatgtgaacttaaatatgaaggaaaacttgtaagacgaacaactgaattgaaagttacaggtaggaatcagttctacaaaattacggcaaatgagattttaagtataatttggtttgggaagcaagagttttgttcaaagagtcaactttctgtgaatttagaattgcctgcaaatcaaatagttgagaaacttgctattaataagttgtactgagtaaaagcaatatatggaatatgaaaaaagagtttagagaacaagggcctagttgctgtgtgtctgttctctgtctttatgaaaggttctgaactcttcaaggtatcattattactaaacatctcagaaaatatatagtggagccaatctagaatgttgacttaacccatttgtggaatctccttgtaggtgaaggctgattttagaatgagaatctgttagatttttggaatgaaatcttcttagactgcatccaaaatatcatttatacaaaattctccataagtgagtgatgttattgtgagcttctagtgattcttagagcaactccaaatgaagaacatgcatgtgtgttttaaatctgaagtacaaacaaaatgtaaactagtggaaggataaactcagaatattcttacttgttagagaattttaggaagtaattttcagagacataagacagaatctaataccaaaaagatatcccttacaatgaatgtgatggaacctgagaaactgtatgacaaaaaaatctacttactattgctcacaaacaaatcttgactaattttcctattattatatctgtcatgtgtattttaatctcatatatggaacctaaaaaaaagttgaatgtgttgcaaaagagagtagaaaaatggatacgggacagagagtggggaataaggagtgtaggtcaaaaggtgcatacaaagttgcagttatataggatgaataagtctagtgatttaatgtacagcatgtagttaataatgttgtatgctgaggccagcgcagtggttcatgcctgtaatcaatcccagcactttgggaggccaaggcaggtggatcacttgaggtcaggagtttgagaccagcctgaccaacatggggaaaccctgtctctactaaaaaaaaaaaaaaaattagccaggcgtggtggcatgtgccgataatcccagctactagggaggctgagacaggagagttgcttgacacaggaggcagagtttgcagtgagctgaaatcacgccacttcactccagcctaggcaacagagcaagactctgtctcaaaaatgaaaaataaatataatattgcatgttgaaaatttgctaagagataaattttaggtgctcttaccacaaaaataaacatatgaggagattgatatgctaatttgtttggactgtggtaatcagtttgctatgtatatgtataaacaaaaaacatcttgttgtataaccttaaatataaacaattaaaaaagtatgtgtgtgtgtgtttgtatgtatacacatacatatttctattgtggataatatccaagccatgataaacttcaaaattacctagacaattgcaatattgattgcattaattgacttatgattaatgtacttgggcattacttgtttaaccatctaatgccaacatcagccagttggttaatttataacatactctttctaatgttagcaatacattttttcttctattttatttttgtttaaaaaggttcaaaaaggtctggatgacctttttgagatagtgttaaaatcagtcaactaattaatacttgctgagttaagttgattgctacaacccatatatttaatttggtttttgatccttgagattcattgtttttgtctttttcaaaattctaaatgttagcacagggaacacaaaatatatatttttaataaactaatatataatatacatatatattacttcactctctgtactaataaatgatagttttacttcttagtttgattttgtagagtgccttctatgaaagtttaaaaattcttttgattagaattgcatgttcttttccctatgagctttcaaaataactaccatattgggccaattccaaatagcaaagatctgcttttgattagtttctgatttcttcaacatgaactagacttccctgcctcatttatggcagaaaattcaatcatgggcagttgtacattattaataagtgacctgaccatgcacaaagcgtcgcagcatcatcactttggccacagtcactaatccttatgagaggcttgcagagcacttccattttggatcatttgctgaatcttgtaacattatagtatttggcttgagtttcaagttgaaccagaataaagtaaatacgaaacctccttttcactcacatcaaatgggttctgttgacaacgcatttgcttctttcatttcattttagattctggaaaagagagctagagctacttattttgtatattttataagatgttagtttacttgttttaactacagatctaaaatttcacttgaatacctcgcagaggatctcaaaatttaatgtgcatcagaatcatgtaaagggacccagataggatgaagatgaagatctctaaatacagatcctcagatttctcccttagattctaatttagtacatcagtaagactaggaatttacctttttgtccaggtgattctgttttatgctttccaaggatcatgtttttgagagacactagagaagagaatggtgctaacaagtcaaagtcataggtttgattattttgtgagtatgttagttcacacatgcacacacacacactgatttttataggccccaatttgtttcctttaaatttctaggaactgccatgaaaatagagatcatggtaaccaaggaaaatgtgtcaaggtagtgtgtgggtaaaagcgacttcaactagggaaagcaatcatttattcacttaccacttaaataaatatttactgagtacatgttacatgccaggcaacaagctaggagctggaaaagataattcagaatttgtttatgattatccttgggtcagtggtcgtcattcatataagaaagtatcatatttgtgtatttattcacacagttcaaatgttatgcttgatgtagaaacaaaatggctacttggtatggaagttcaagagtttgctctgtgaaggtttattcttttttggaacattatataacttataccatgctttgtatgctcaataatatgaaaacaattaacaagcagattgtcttctcataattcaaaatataaggctaggattatttaaagagtaaccactcatacttgttttgggtttagcatgggataagaatttcaatatgacatgaatagaggtggttaattacaaaattatgtaaatagaggttctttaaatggtgtatttcccttatgcaaattttgaaagattgtcaaatttctaaagcttattttctgactattctttttaaatttatgattctgagaaatataacttcagtaaaacaagtgtttcttaaaggtacataggtgctatttgctttaagaaggtcaaatataaaaagatccagatattcaaaactgataaactagaaggttatcatttgctttaatgaaataatttctccatatatgtcatagtatttctttagatagttagctttctttctgcattaaaacaggatttgatttaaatgcaacttttctggaacacttttattatataaatcgtagcagacttttgttatattattgtggaaatttctttttattccttcaaaggctgcagatgcatagggaagggtttaacaacaaatagacgtgcacagtagcatgtttaggtcatttgctaatgatgcctacagcgacagttttatttcccacagcatattttaggtgactatatgctattttaaagtttttttctttattctcatgttgaatttgtgcggagggttaattgaagtgaaaaagtaagacaggagagttggttataagaaggtgagaactgtagtacaggtgataatggaaaaagaagaggagtaggagagagtgagcaacataatgggatagagtctctagggataagaagagaaagtctgccttaagaaggtcaaaggcagtatggccattttcacgatattgattcttcctacccatgagcatggaatgttcttccatttgtttgtatcctcttttatttcctcgagcagtggtttgtagttctccttgaagaggtccttcacatcccttgtaagttggattcctaggtattttattccctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggactgatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaagaaggtcaaaggcagacattacttatagggattcttcaaaatggacacaagaaggaagccagaactaattatctttatttggaaggcaattcaccattcacctggcaaatcattcagaaatacatgcttttatgcagctttttagacatgagcattagctacttagaagaaaccactaacctgtttcctggtgaatatgcaaacaacacctctcctcctgattattgtagacagctctagagtccctggttggagacttttcacacattaggggtaatctcttaacccattggcatttgaatatgatggcaagaaggatttattccttgaaaatacttcaaagatttgctgctagattactattcagcaatagtagcaaagcaatctggatataaagcttggggtaaaactaccaagtaggatttgggatcagtctttggtgaatatgttcaaacgcatggctttagcaaatgcttttaattccactttgcaaagtttaattgtagtgccttgttgcaggtgtcatttagattacatagcttgttagaaaaactttcctctggtgtggaaaatggcagctatttacacacagaggaagcaatttcacattcaggctggaaaacacactttttgtggtcctggctcttagtttatttatccttctactgttaatgctgagattttgcaggggagggtgagtttagaaaaaaacagtggaacatagcaatatggtggagagttggtgaaataaatagtagcggggattttgactgaataaagataatataacagatgtaatctctaagccagcaactccataataatcataaaaagggctcccagagagcttttatctattgagagctcactgtgcaacatacattgcgtttagagattttcattcattttctcatttagtcctcacaaccaacatatgagggtggtgttggggctcagaaaacaatacttcaaaatgaaggactcataagcaagtttgtctttgaccttttcctgccctcctgtctctcagtcccattctccccaccctccccggaggctagccatagaaactggaatccctcttccccaaagcaggtcatagaaaccagaacccctttcctgcaaagccagccataaaacctaaaaatattactctaactttctctccacttctctgtgtgaaaactggccacaaagaagttatttgacctaccttgtttaactataggtcataaggtccccattccagagagggtcctggaaggaatgtgtgctcagagaagcccagaagaatctagacagacaggccttgctggttttccccactcagctcattagcattagatcatagtctttttatcaaatcatatgcctacatggctgtccattctttgctgaacctaagcataaaaatgggcaattttccctgtatctttgggtcttcattctgaaggctcctgtgtatacagtgtatacatgttagataaatgtatatgcttttctccaattattctgcttttgtgagttgatttttcagcaaatcttcagagggccaaggggaattttctgcctgggcccctatggtggttactattattgtcccaatttatagagaaataaactaaaacttaggtgaaatgatgtacccaaagtcacatactcaggaaatggcagaacacagatataaacctaggtctttccaattctcagatgtagctttttaatcaccaccaggcaaaaaactgcatgatttcactcaccaaatgtgtattgcatacctagagaacataaaccaaaatattggacacgatgtctatcattccactataatatcctttttggacattcacaatttggtcttcaataattccctattagaatttagatatccataaaaaaagcacacttggcattttgaacttagtccttagctcttagcactttagttaagatcgttaggagtagggccaataattgaatctgcatgtggtatggtgccaggaaaaaagcaaggaaaagtgaggctccagaaaaattaagaatgcatgaaacatggtaaattgttactgaattttgtgttttgatgccatatggccctactagtatgataatttatattgagaatattccaatgatgttcattgcagttatgactatgatttcaagctagtggaagtgaagcaatggatgaatgtctagttaaacaatgttggctcagttggtaaagatcaatcaacacataaatcagtgcctactgtgtacagtaagaagttcaggatccaagtttgtaatgttgttctgaaagcagacaggtagggacagaagtgtgttctcctttggaacctgtgaaaagagagttattcactagaatagtgcttctcaaattgtattttgtggaaccctgattctaagaaatgttaagagagagatttccaagagagaaagaagaggaaaggagaggagaggaagaaaggagaggaagagagaagagtggggaagggagaagagagtttctgtagttatttgtgtatctgccaggtcaaagttaaacagtcatcttttttgcagggtatctcagggcaccttagtgcccataatatctaatgtgtactctaattttctaaaagggggttggagcccaggtgtggtggctcatgccagtaatcctagaactttgagaggctgaggtgggtggattgcttgaggtcaggagttcaagactagcctgaccaacatgatgaaaccccatctctactaaaaatacaaaaattagctggctgtggtggtgtgcacctgtagtcccagctacttgggaggcagaggcaagagaaaaacttgaactcgggaggtggaggttacagggaactgagatcaggccactgcactctagcctgggttacagagtgagactccatctcaaaaaaaaaaagcggtgggggaatgggatatatttttaggacatttcctaaacttgtatgaacacataatattcccagcccccaaagcatctgaggatgttaagtttccacagaacaaactttaggaaagctaagtgaataattgagtgagtatctggctctattggcctcctgctaatgcctataacatcaacagttgaaataaaatacttatttggcatttaggttatgattagtatcacttattttttccattgtttattttttcaaccatcctgtaagctccttaagggaatggatttgttgactaattaatatctacatctataagtgctgagtatatgataggtattcaaaaattatttgtagcttgctttggctgagtgcttatttgattggtaagtgttttgattgggtacaaataagacaactttgtgtttgtagagcatcttataatttcaaagcactttcacttctgggatctcattctgttacaagaactttatggaattgtcagcaaatgtagtattattattattaatcttggctgagagagtttaaaacaatgaccctaggatataagctggtgaattgcacagctaggactagaatccccatcttataagtcctagttacacttttcctactctgccccactgttactctgtttgctgtcccttaatcctgggtactaggccagaagaagagatgcaactcaaggaggattccaaagttggtgactccagagctcaggcctaagaatctctgaaataaccttttatttaaaatgttggtataccaatccattgttttgtcttttggaataactatttctgattctaaaaggaaaacgatttactactgatgtctgaaaccaaatcagcagaggtagccgctaacaatactcaaatgcggccaggcacggtggctcacgcctgtaatcccaccactttgggagaccgggatgggcggatcacctgaggttgggagtttgagaccagcctgaccaacatggagaaaccccatctctactaagaaaaatataaaattagccaggcgtggtggcgaatgcctgtggtcccagctacttgggaggctgaggcaggagaattgcttgaacctgggagttggaggttgtggtgagccgagattgtgccattgcactccagcctgggcaacaagagagtaactccaactcaaacaaaacaaaacaaaaataatactcaaatgcttccagcagccaggcaggtcatgtccacagtgtgaggtggaccaggtgtgtgaagcaacaactgaaggaaaaattggagagtactagctgtactgactcaaccctagctgattgctgccatgtgagattgagaatccaatattactaggccctctgatttataagagacacctgaagtctggatttttgtgtggaaatccgtaaattgtaaagcactctgtagaccaaataaaacagcctgtatgctaaattcaacatggggactgcatgtttgtggcttttgcctttgaagatttggttcagtaggacttttattaaacaagcgactgactgtgtgactgactcagactctgttccactatttccatctctagcagtgagtggaaaaaaatttaaagaaagaaaacctgaagtggcctggagagcagttaaaagacaaactgggaacagcattcagaagccatcctaatcacaccatccagtagactagtcgatccaacaagagtgaaaggggcacaatttatggatgtaatactatgggacgggtattgacaaatggatcaccttagaaaagtgagtgatttagatgatgaagcaagttggtgtccagtattacagataaaggaagagccctggggatgaagcacccgccttaaagctgccctgaagcggtgtgatgtgaagcactgaagggaacaaatcattggcatatgttctctctcctccatgttcactatgagcaggcagttaacatgatctgaatgtacgtgtcctgattatcacatgaacatgtacctcatttgtaccttttgtgtgacctaataaggaacaaccacagcagtcaatagttcttggatgcattaagggaacattcacatgactgactgtgcatttcataattgactgttcttttgcacagtgcagaaatctcatgaccagcttgcagcagtttctttgtctttcctcctaggctttattctccttttctggatgaccctggcctttcctagcctacccagcccaccctggatgacatctttgtctcttatctgcctcttttaaatgtttcaatgacctgttttctctgcagctcatctcctcagatccttgctttctcctggggttaatctaatgtctcaatgagctaaaaaattcatgactgataaagaccaaaaatgcttctcttctcagctaacatatttgcaatttaatagatatttcaattctgtaactcataggcataactaatggtgggaatttctggggactttgcagggcctgtggggggcatttcccagagtgtcacaatctaccctgcaggtggctgcttgttccttctagaaacaaggtcaacaatattcatgaccttggggaactagaagaaaaaaaatcctactgaggatcactgaaaaaaaaagggccttggatgtcagtccatagagtgacttttttccttcttctgcatttttattttgtctctcctttctttcccttatttccttcattctgcctcaacctatgacacagggctatctattaaccctattgatgacaaccatggagagattgccagtctttgtcccaggaaagtttttgtatcatgtttctatgccctacagggagatgaacaaatactattaactttcccataagaagaaagacagtcttatttttctgtagagtcaggggctgtgagagcattcattcctgtgggcttattttgcaagcaactgtgcaggagaccagtttggatagctggggttgaacaagttagagcacatgacagcagtatatggcaaacgtgtgcaatccaggccagttctactccaatggctctcgtccatcacctaaggtgaccattgactccttggctgccttctctgacaccaagttagtgctgggggaagggattcttaggaaggggttacactgtgactcctagctatgtagtttcctgagatccatgggagcagattttcctaggtccattatgtatattcttgggagtctcagttaccttgttctctcccagcctgaaagcagtggtttgagcaagctgagaatattctatcaaggcacccttccataggaatgaaaactaggagcttggtacagagggagaccagccatgaactagatccaatagagtagagcagatgctcagagaactatcatttattaggtcaaggattatactttataatcagtcaaagcttctcacaacctcaaaaggctggtgattatttcctatattttataagggaagaaatgaacagtcagagaagctaagttacttgttatgatcacacaccatagtaagtgatggagctaggatttgaatccacgtttatttcaaaacattactcttaaagcaccctgttacaaattacctgaatgggtcctgctcaatacatgtcactagttctattccttcctgcttgcctgcctgcttcatgctttttccactcctctttgctactacatgttttacatttccgtaatttcctcgtgaagccatcacagactaacctcatcttataatcgcctattttttctcctgaattccctcaataattttgcaaaagttttcaccacattgcctgatactaatttatagtaataatttatgagagatcttctttgtgtagatcttgtagcaccaattacattagggctcttcaagatctgctgctccctatacaaagctttgccttactatttagatacaacataaaattatggaactaggagctaggctctgtgtttcataaatatcatctcatttgatcagctcagaatcctgtaaggtatgtcattttagccctgctttatagatgtggaaattgaaatttggggaatttaagtaatttttttctcaatgttctacagcaactaaatgataatggtggaataaagcctcaggtggttgtttttccaaagcctgagcccctcccactagtaaatgcttataaaattatctgctgcacacattactatgatatggtttgactggaacaatttttttattattttttgtttgtttgttttgttttgtttgagatggagtgtcgctctgtcaccaggctggagtgcagtggtgcgatctcggctcactgcaacctccgcctcctgggttcaaaaaactctcctgcctcagcctcccgagtagctgggactacaggcgtgcaccaccatgcccagctaatttttgtatttttagtaaagatggggtttcaccatgttgaccaggatggtctcgatctcttgacctcctgatcctcccgccttggcctcccaaagtgctgggattacaggcgtgagccaccacgcctggcccatcttagttatttcttgtcttttgccatgctcatggataggaagaatcaatatcatgaaaatggccatactgcccgaagtaatttatagattcaaggctattcccatcaagctaccactgactttcttcaaggaattggaaaaaaactaatttaaacttcatgtggaaccaaaaaagagcctgcatagccaagacaatcctgggtgagaagaacaaagctggaggcatcatgctacctgacttcaaactctactacaaggctacagtaacaaaaacagcatggtactggtgccaaaacagatatatagaccaatggaacagaacggtggcctcagaaataacaccacacatctacaatcatctgatcattgacaaacctgatgcaaacaagcaatggggaaaagattccctatttaataaatggtgttgggaaaactgcctagccacatgcagaaaactgaaactggactccttccttacaccttatacaaaaatcaactcaagatggatcaaagacttaaatgtaagacctaggaccataaaagtcctagaagcaaacatgggcaataccattcaggacatagacatgggcaaagacttcatgtctaaaacaccaaaagcaattgcaacaaaagccaaaatagacaaatggaatctaattaaactaaagagcttctgcacagcaaaagaagctatcatcagagtgaacaggcaacctacggaatgggagaaaatttttgcaatctatccatctgacaaagggctaatatccagaatctacaaataacttaaacaaatttacaagaaaaaaaaaacgcatcaaaaagttggcaaaggatatgaacagacacttctcaaaagaagacacttatgcagccaacagacatatgaagaaatgttcatcgtcactggtcattagagaaatgcaaatcaaaaccacaatgagataccatctcacaccagttagaatggtgatcattaaaaagtcaggaaacaacagatgctggagaggatgcagagaaataggaatgcttttacactcttggtgggagtgtaaattagttcaaccattgtggaagacagtgtggtgattctgcaaggatctagaactagaaataccatttgacccagccatcccattactgggtatatacccaaaggattataaatcattctactataaaggcacatgcgcccatgtttattgcagcactcttcacaatagcaaatacttggaactaacccaaatgtccagcaatgatagactggataaagaaaatgtggcacatgtacaccatggaatactgtgcagccataaaaaaggatgagttcatgtcctttgcagggacatggatgaagctggaaaccatcattctcagcaaattatcacaagaatagaaaaccaaacaccgcatgttctcactcataagtgggagttgaacaatgagaacacatggacatagggaggggaacatcacacaccggggacttttggggagtaggggtctaggggagggatagcattaggagaaatacctaatgtaggtaacgggttgatgggtgtggcaaaccaccatgccaggtgtatacctatgtaacaaaactgcccgttctgcacatgtaccccagaacttaaagtataatcataaaaaaatacttagtatgatgattgagaaatagtaggtacttaatacatcatattaattgcagtcatgcatgcataatgatatttttgtcaatgatggactgtatataaaacggtggtcccataagattataatactgtatttttactgtaccttttctatgtttagttatatttagatacacaaatccttaccattgtgttacaattgtctgtagtattcagtacactaacatgctgtacaggtttgtagcctaggagcaataggctatatcatatagcctaagtgtgtaggaggctataccatctaggtttggtaaggacaatctatgatacttataccatgatgaaatcacctaatgacacatttctcaaaatgtattcccattgttaagcaattcatgactatattataattagtattattatcatcatcattattattacaggaaagttttcaaaggtgagttcatggccatttcatgacaagaaagcagtctgacaaatggtctaagacaaattgctgttgttaatagggtgcttcatttacagagcttgaatggaaaaaaaatagaaagttaactagggggctattaaaaagcaaagagccatataaataggtattaatatttcaggcagaaatattttattcaaggagatgcaatcatgtggaataatttgtcaattaaggtggtcagggcaagtattgttgtctgtataaatgagtttttgcagccagcaagaattttaagggatgtatgagccaagagcaaaagctgctaagacaaagctgaggtggaaatgagtccggaggacaagcatgttgaggaaactggacttttcctgtctagcatttccttatgtcattatgattaatccctggtggtttataaaggcagttaaatggcctcctttggcatcaaataggaaaataattcatcagttcaagtctgtaaatcatttcttggtactggaagtactttatatagttagaaatgtctccatgatttgtcactgggctccagtggggatcctgaagagcaactggcaaccaccagatgcagaggcctatgtgatgagtctcatgggcatgggtctgcagggaaagaagattggttcctttctggggtacattgccttgatcctctctgactggcctggaggaataaccacttctgtgtctgtcatatagtagtcacttagtatgtttgttgaatgaatgaatttacatattttgtgtgttttgagtcctttgcattggagctcatcttacagtgtctgataactctctctagctatattctgggaaaatgagatagaagggcagtaataatgatgttttgaagctactgggtcagtaccctagttatttgcttaatgttgatggtcaagacatcatagtctcaccataaactgtagcataatagttgaatgaaaaataattgtgctgtaattttttatgataaaaggcattttaaatcacagtttaattacccaatcccccttgctcttaaaatcaacattttttgattttgttatccttacattttgtgctagtaaaattatcttcatgatgctatttaatttacctcctggcgagcatatgaggtgaaaggtaaaaaggacattttgggacaagtgaaaaaatatctaatgaagtggaaaccgttattcaccctcactccacatgtaatacatttgatattcttttaacattcatcaaatactcattgttctgggtaaatagataaactaaaaaaggtatgatgtctgtcctgagtgagcttgaagtataatgagaggggggagaatagacagagattaagtgaataaacatatggatacatgtataattatatattgcaatatatcattataaggaaaataacaaagactaattgagattggggatggcctacttgaacaaaataaagttgaggctggaccctgatggttaagaaaaagccatctagatgaagagcgggtgaaaaatattttagagggaacagcatgtgtcagctataaaagaaagatgatggtggcttgggtcagaagggtagtaatagaggtagtaaaaagtagacagatttaagagatattatagagatagaatgactatacttcctcatgatgattcctgggtttttggttttactaatagggtagacagtagtgctatttcctgaaatgaggaagactgagggaggtcagattttgtgaggggttacaaaagttctgttttggccatgttttagaaatacttattatatactctagaggggatgtagagtagacagttaaatatatgaatctggcattcagggaaaagtttgaactagatatataaaatttggagctgtctgtatggtatataggatgagctgcaataaagtactaaattgtgtggggcaattgatgattactataggagatcaatgcaaactgcagctcctaggccctatgttacatattttctccagaattgtgaacagtataagaaagctacttgtcatgattttttgaaacctcatcaaattgttaaatattaagcatgataattgtacctatattttttctgctatatggggatgatatcttgtatttagctgacatttgaatccttcagagctagaagaatataactaatgccacactaaatacagtcactatttatgatatgtgctgggtgccatattaatcattttacacacattattgctaatctttaccacagtactgaatagtacaggccccaatttatagataaaggaactcaaacttgagaagttacacaacttgcccaaggcaacaaagcaagttttggggggtcttttccccattccatttccacacattaggaaaagtgactctacatttccttttggattcttccaatttccaaagtctcttacaacccaaggaacagaaagaaatattgagatatgcacatttgctgctagatttccttgctattgaataaaagcctgtctgtaagtgtctggtgcacatgcacagcctgctgttgggatacccatcacttgttaactgcctgcctggactagcaactgtcttcaaaccctctgtataccatactgaattcttagttggaggtctgccaccaacaggagggcaactccctgtgtgtggtacaatgaagggagaataaagcctggtacatagttggctctcaataaatgatagctaatattattataattttctttatcttatgcaatgacgacttctcaaagtccctatgaaatatgtattattatcttactggtgaggaaatcaagactcagcaaggttaagtaacttgcccgggtcacacagctaatgaggaactgagttgggatttgaaggccactctctgattctgaaacttaagattcatgcatttctcaagtttaatgactgagtgaagccaggggtgtcattggagaatatcaagagataacgttagatagagaaagtaggtctaattactggagggccttgaatgtcaggaagaataattcatatacttagcctatttgggtatatgtgccacaaaagagctatgatttttcctcactgataaagaagttcgagtttttggacatcaggtacctgtttccaagctgaatgccctaacagctgtgagtaacacctgctccttgcacctgtgcaaactcagagacttaccttctctggtgctgattcgcataacattctttctcctattttctcattttaactcaactcaatgaagatcttctgagtatcttttctctgccaaggcactatgctagttgctgcttcactggttgttgggagcatgcagttaaatgtaatcacaccaactggcctgtataggtttgtgaggtggaaaagtctaggaagaaagatacttgagaaatagccaatgtctttttttggagcccctgcaagagaaagcataagtttatcctgtcctattaaccaaataatctctaatgattggagatgtctttttaaattaattaattaatttctacttgctgggaattctagctacacagacttttgatttagccagtaatattttcaaactataagtagcttaaaatgtggattagaactagaagggactttgaatagcatacagtctgattcccctcattctgtagatgaggtagcagaagcctggagagattaatttatgtgcccccaaagacacagcttggcagtaactaagttgatactttctccaatacaatggtgctttctgccactttctaatactccacagtgtctttctgacttagtcctgagccttgcctaggaggcttttttatgccaaatttaatcaatgttccattttaattgaaatatttaagtcagattaatgtaaagccttcagagagttctgctaatctggtttataaaagtcactcaggcaaaactgtgaaagtatataggatttctgacattttccagaagccattagcttatgttcttcaataactcttagaatatatgtcaaaggaggacaattttccaactaaccttggcacactccatatgtattcctttttggttggttcataaatcagttttctaattcaaagatgttttaatcctcaaaacatgcactcttccttaatgattgtatgcattacaatattaccccacaaactagtttatgaatattaaagtttattagtagggagataccaggaagcagaactgagaaaataactccagcagtctcccttgcttgaaaggaaatacgatggaatgaaaagggcacaggctttaaagtcagaaagacatggtttcaaattcttttcttaccatttaccccctggatgaccttggggagattattgaacccctttgagcctctacttcctcatctgtttgtatatctttgcttacagagctgttgggagaatttgagatgacagagtagatgatagctatttccactttgctattgtcattatgactgttatttactgttcctactactagtactattagaactactgctactactaccaccattaatctgctttgcagcctcaaaaaaaaaaaaacgaagatgctttatactactactatcaccattaatctactttgtatcctgcaaaaaaaatgagaatcagctgaagagcagaaaaaacttaagacagagtaagacaacgatagaacaaaacagccttttttttttttaaaaaaacaacttctattaacacattgccagccagaaagttcaaacaacctactgaataaagatagtaccttagtcaagttatggaaaatatatttttacaaatgaaattgttaagataataaccctttcattaaaccactctgtatattccatcaggacaggaatcatatctattttgcccttttgtattcctatcactttagtaaggtcttgacatagagttggagatgaaagaatatttgttgaatgaacaaataaaatccctaaaggtaaaaataagtattattcagctgctattgtttcttcattagtgtattcattaacctattgaaaaatatctgtgctcctattatatgataagcgttgtgctaagccctgggaatgaagtggtaaagaaaatcacgcacagttcttgtctttaagagcttaaaatctagtggagaaaacagcccttaaaccatcacacaaataagtatgaagttttaattgtgaaattgctatggcggaaagaaatgcatggactaaaataacatgtgttaggggaatttgacctaatcagtgagatcaggaaaggcttcttggaggaagtaaatcttaagcagagatataaagagtaagtgagcattaactaggaaagacagggaaggagaggcttttgggacaaaagggtcagcatgtgcaagcgtgccctgtagagggatcatggtgaataccaggagctaaaataaggccaactacagctggctggagtgaagtgaggaagcaagaaactagaataagcttaggctagaggggtaggtaagggacagacagtgcagagcctttgccacattcaagattttctcttcatcttaacagtaagaggaagacataaaagtgattttaaggaagggtgtgggtgtgacatcatcaaatagtttcagtgtggagaatgaattgaagagaagcctgaatagttatgcttgcactagtccaggctagaggtgatagtaacttggactagggtggaagttgtgactatagagaaaagtagatgcattttagggctagttagaaggtaaaatcaacaagacttggtgatggcttagatgtggagtatcagataaatagatgagtgtctcttaagtgatgattaggtttcttgcttgtctaattggaaggattgtggtaccttttagtgacaggtccgggtatgacaaggttcattcaatcacaaatctttatatgtgctactatgtatcaggcaccatgttaggtgttagaaattcaggaatttctaaattatggttcttatctacaagaagcccacagtctagtagggaagggagtacagaaaatcaacaagtagttacagtgcaacaatgagctagcttgatagaggaatgccaagagtgctatggaagcccagaggaggagaatcacctagcaaatgggcagagttgcagaactgtggggaaagccaaaaaagtggagttgggttattttggacttggtatgcaataatttgtcagacctgttcactagacattaaattttgaaagagaaagagtccttttttttccttcctcatctcctgcttagtgtaataagcaacctggttgtatattccatggctgagagtggagacaattcctgatgtcactggctgatttcaaaatctttgcagaactattcatatgttcctcttcctttacaagatataataggcttcagaaaagtggtgtgtaaatcatattggggtaaattaaatcctactttaaatgaactgagtcatttgctatctacttttgaaaaaaaaaaacagcattctctaattttttcacatatatttccatttaattcttcaagtttctttaaggcaataagggatccagtttcagctttctgcatatggctagccagttttctttaaggcagtgcccatttttttattgttttatttatataacttctaaatatattttacacatactttattttaaatcaactttattgaggtataatttacattcaataaaaatgtacccattaatgagttttgatgtataatatgtaccctaaaaatatgtgtagccctaaaaagttgcagtaaatctccttcaccccagtcccaggcaaccacctatctgctttttgacattaaatttgtcttggtggggctcacatttaatggcctccagtgaatattgtcgtgagcacatattaggggaaagccactttcttttatttcaattagaattcttatatcccaaccttaatgctataaagaaaatactgatcttatcatgcttgttttagtatgctttttggggttgttttggtggtggtttcacagagagaattcttgaaaagataatctgtgggggctacaaaattatgggccttgatttacaggcagtcagtcatttcctcactaactacgttaccattatgtattgatactctcttttttttgttaaaactgtcaatttttttaactttcgtaagtcagtgatagtatataggaatgggctcaggatttgccatgtagaccagagttcagactttaaggaacaaccaggaggctggagtggttggggcagagagagtagtggagagaaaattaggagatgaggtcagaaagatggtgatggtgggggatcagatcatgtagggctatgcaggccattgtaaagagtttggctttcactcttagatggaaagccattgaagggttttgaacagaggcttggcatggccaggtttattttacaaggagaactctggatattggatagaacatagactgaagggggcaaggactggagcagggagagcaatcaggaggctattgctatagtccagagggaagatgattatggcttaaaccagggtttagcagtgaaaggaattaaaagttgtagagttccagttatattttgaagatagaaccaacaagttttctgatatattgaacatggggtactagaataagtaataagtcacaggcaaatccagattttttggcctgtataactagaagtgtagagttgttgattaatgagatggggaagatggaatcaggagtttggttttggacatttgagatgcctcttagacatctaagtagaaatgttggatgggcagttggatatgtgagttcaagggagaagtctaccatggagaaataaatatgggagcgaacagcatgtaagttgtaagcaaatctatgatatcactgaagaatgtagatagaataggttcaagctctgagctgtgggtacatgccagcattagaggctggggagataagagagaaacagtaaggaagattgaggaggagtattcaatcaggcaaaggggaaaactaataggaagtaagtaaagatagtgctctcaagaggatgggagtgaaggactgtgttgaagctgttgattggtcatgttatttagaaacgtggtagttgctaattgacaggatcttgatctgacaggatccaatctgggttcctttcattatactgcattccttgttcaggttcttgtccttaagagtatctcttcactcctttacatagaatttactaacagcctgttgtgtgccaggcattgtcctagacactaaaacccaaagataaataagatatggtctctgcctttaggggatccatggtctagtagagagatgagatgcattaacaatgataatacagcatgtatagtgctatagtagagacacatacaaaatattatgggaacccagaactcatcttgggtgtaggtaggaggtggtgggagaaggcttttcaaaggagatgactggacagggatttcagtaatgagtaaaggtccactaaacaaaagtgcaacttatccagaaatactcacagagctgaaacatctgaacattatcttgaaaggtggattgtaatttatcaagtggacaagttgaagaaggactagagagaaagtcaagggccagataataattcagggtcttctgtattggaggagttgatggtgacaaattgggaagggggaagagaaaagaaggagtgaagcaaataacttctttattttctgcttggatgattgtgttggtagttatgctaaagtctcctaggttatcaaagttacagtattgagtctttcagaaggagtacaggtctcttcctcaaatttgttttgagttgagtgtcctgacactagacaggtgattactaaataactaggtgcctcacttacacttgatggagatagattttcttttaagtgaaccaagttcatggaatttcacttttctaataggaacatttctcttttgctaaggcaaaaatgggtcaagtgctgagacacatggctctgaagggccatcaaatgagatccacagctgggcccttagcccctcataaaggccatttctgcctatttaaagcctcctctaggcttgatcaaaatcaaaaccatttcaaaatgtaataaattattacattttgtgctgaattgctacttctcaaaatctcttacatagaacaggatgtttgagaattgagtttgttggaagttttgtaaaacattttgtgctttgtaaaacagaaatgaaaatattacaggacagatatattagagatatatctttttaatgacaaaagtcttttgtactgtctttaaatacttgtttactgttaatcaactatttgagagaaagggaggggaagcaaaagtgaaatttcagtgtgaaatttgtgtttcacaatttgtctcagaaactaaattgtaatgttttttaagcaatcataatggatttgtggcatttatgaaatgatcacaaaagtcatcaggaatatgataaccaattctcaaagtttgttattttgttcagagttaagtttttttgttttgttaagaattattgatgaagtcacttagctttattaaggaagtgaaaagaaaatttatgtcagtctttatttgtttttgaatatgtaatacccacacccagtagaagatccaaacaataaaaatatgtacattgaaaaaatctcctttctgcctccaactccttacctagatataatcatttttttcagtttcatggatatccttccataaatattctgttggatgtaatagtgattctaaaagtgtagcccaaggactcctagggcctcaaagaccttttcatgggttctacaagttcaaagctattttcctaataatacagttgaccctcaaaaaacacaattttgaactgcacaggtccaggtacatatggatttttttcaaccaaacatgaatagaaaatacagtattagtggaatatgaaactcacttatatggagcaccaacttttctaataagctggttcctcagggctaactgtgggacttgaatatgtgtggattttggcatatgcagggcgagataggggacagtcctggaatgaattccctgcatatactgagggacaactgtactaatgaaattaataatgatattaatatatatgatgttttgatattgaggtatcataaaatgtatcaacatttagaacatccatataactcaatgaagtagtattttccagataaccaatgtatgttgttatgaaattatgcatgtataaaagatccattcaaagagcaatatgggtcagtggattttaatgtagcaaggtatacaaagttaattgatatgatttcacacttggtcttagccaaaaggccaagatgcaataattgatatgatttcagattccacacttcagctaatccttaagaaactgccacttgttgtgtttggtatagtatcgaagaagatcatccacacttttttgaaaaggctgttaaaatacttccttattttccgactacttatctttgtgggactagattttcttcatatatttcaaataaaatgatatatcacaacaggttgaatgtagaatcagatatgataatttagttgtcttctgataagccaggcattaaacagattttcaaaaatataaaaacaataacactcttctcatggcctttttgcttttgcaaaatatagtttctgtgataaatatgttatgtaataaaatcatataattataattcattattttaagtaaattattaaatattttaaatccctcagttttaatttttaatatagtaaatacataacctatataaacaaaagcttcttagtattctctttaatttttaagagtgaaagcagtcctggccgggtgcagtggctcacacctgtaatcccagcactttgggaggccaaggcaggcggatcacaaggtcaggagttcaagaccagcctggccaatatggtgaaactccatctctactaaaaatacaaaaattatccgggcattgtggcaggcgcctgtagtcccagctactcgggagactgaggcaggagaatcgcttgaacccaggaggcggaggttgcagttgcagtaagccaagatcatgccactgcactccagcctaggcgacagagcacgactctgtccaaaaaaaaaaaaaaaaaaagagtgaaagcagtcctgagaccaaaatgttggccaactgctgatatattttaaaaagtgtacatttggttattttctctatcattctatttgtgtttatgtgtctatatttatttttatacacataggcagtgttcgtgcaactgtcctgtgacttggtttttgggatttaatattgtttgagcatcatttcatatcagtaatgatagatatttcacttttatgtgactgcatagtatcccatggtatacacatacagaattcctgaaaggagaattgctggatcaaaggttatatgctttttaaatttgataagactgccaatttgtcctacaatttatgctcccaccagcagtgactgagaatacccgtttccccaaatctttgtcagcagttttccctcaaatcttttgctgcttcctgagcatatagggaaaaaattatatctcattataggtttatttggtttatcttattatgattggtgttaagcatgttttcatataattcaatatggttatgttttacttttttgtaaaccatatgttttcacttctttaaagagaaccctcgcaccttggtacagataatctttcaatttctaaatataattctgaaaaaaaaataatgtgaaccttcaactttgaatggaatgaccttgagctaagtccctcaagctctaaggaccctttaagctgtgacattaagtctcaaaacaataacagatacatttgagctatacaagaagttagcttagcatgtttacaacatagtaattgaattgtttgtaatatgatttaactaaaagcagaaagttgagcaaaagcaatttgcaaacaatagatgataatgtaataagaaacatttatttctatatgtaaatgatgtgctgtttcctttacctgtcctttgtgaaaaacaatgaggaacgttatttctgtatctgtcaccatttcccacagttcagtggacaaagttcctcaagatcttccagtttccatttactagagctctgctttttttggagctgaggcaaggggaaatttccttatacttttatcaaaaaccttgaggttaataatcggagtgatttcagaaataagcctgttctgtaagagaatgggagtgtattagagttactatcatgcttaatataatgggacttcccattcaacatagatgtgaagattttataaaaatagccacagccacagaattgacatttgtgttttgagtcccttgttgcaatttagtcagcagagaaaaatacaacaaatgaaattttaagggtagaggaagagtcacagcaacacataagatggtcagggaagagcactgcctttcatggtctgtttgctgtggaacctcccataactaatttctgaaaagtaagccaaatgaaaaagtaaatggtttaacctttgtctctggttgacctgtttagctgactgtgtttgatgactgggaaaattttatttatttgaatacaatagtggagaagagtgaattgattaatcagtaaatcaatcagattttactaagtgcgtactatgtactcaaccctatgttagatgttgtataagatgtaatacctttttccagggaaagaacatgcagtggtaagtagttgttgagcacatttcaggcactattctaggtcctttacacatgttattgcatgtaatgttcacagtaaccttgtgaagaaggtgtagagtcagtactgttattcacacttaaggtcaaacaccctatagttctgtgtgtgggtgttgacatgattcagagtgaagccaagtaattagcagcagatacctcatggggtagatgggctagagtaggtatttttcgattggtgaagaaaaagaaaaattggtcaagacaaaggcaacaatatgagctcattatagaggaagggataagcagtatatgtttgtagaattaatctaacaagaacaagtgtgttaaggagttttggaaaatgagattggataggaagggtgaagctaagttatgaaggaccttgaaagccaggacatataatttgggcattttggactaggcagtacggaaccatgaaaggtttctgagcagaaaaggagtaacatatggaaaatgtttgtaggcagattactctggaagtggtaaatttggtggcagggtgactagacctgagattattgaaatagtttgatgtgaggtaggtgagtatctttttaaataaaagcatttaaaagaaacaggctactaaaagcatactttctctaggctttgaattatttgctttgggtcgaattgattagctcttggtagatgattagacaggtgtaaagtgaatcctgtgacctagacatcccaatcacttagactaaatctacggcaatatttttcaagccatgagttacatgacccattagtaggttataaatcagtgttgaaatttgcaaatagtgttttttaagtgaaatagaaaattgaatagagtagaaactttcaatgtgcctatagagtgataagaaaaagtgtgtttgtgaaaaattatttcagtcatttgtgttacatctgtgcatacatgcacattggctcatgatataaaatatatttattactatggcttgtggtaaaaaaaataagtctctgatctagagtatagcactgaattacttaatcctttttcctgccatgtaaattgtcaaagcttgcatgattgatttgaacattaagataaaaaccccaccacctagttcaggatgtctttacctttttcctggcccatttctaaccacccaaagtgatctgtttaccttcagtctttccataccaattcatcttatacccagctgccagatcagtctttctaagagtatttctcacatcatgtcattacctttgtccagaaaatacactggtcctcaatccatttatttaatattaatttagcaaatctcagttaagcacctaagaaatgaagtccacaatctttgtttagtcacatatgaaaattccttttaattcttacctcaaactgtatttccaactatgttagcaccacagagaccccatagatcagcttaattgtactacttactcttcctagaatatatgcatttttcactctactatacctttgttcatgctaatccccacttattgcccttgtcatcctttaaggccatgacttttataatcatctcagctggacataattagttcctcctctggacccacataatactttttgtcattcatgtgagactcatcacattctgtcttgcattatattagttgggtttattcccttttctagattataaactcttgagagtaagggtcacttcttgtttatgcctgcaatgttaacagtgctttgcaaaaggtagatggtcactatgcagctgccaaatcagtgaaaatgctgaattcatgacacagttctgtctttttctttcatttaagcagaatgacattatatagttcagcaaacaattttcccaatatttttcttagtatgactgacagcattagacagaatggaacagagcaaagagcactgggctaggaatcagaagacgttgacactagtcttggctctgtcaccaaaaaattctgtcacctttaatatgccatttgatctctctggttattttagcataaggcactcctcctttaaaaatacgggactgaaatgattaacttaaggttttttctaactctaaaaacattcatcttagattatttactgtgccagttgcattcactcagcagatacttattgagtccttactggggatatagcaatgatcaaaactaactatatgctttcatggacctgacattaaggtagtggagacaaataataaataaatgaaatgtaatatataatgtaaaatagtggtaagtgctaaaataaaaataaaacagggaaaagggatggagattggcaaggaaggtctctctgaagaggtgacatttgggcagagatctgtatgaggtgaaagatttggggagaagagcataccaggcagagggagctgctatgcaaaagccctgaggtcagaatgtgctttgcactttgggggaacaaataaaagtcagtgtgcttgagtcatagacagcaagaggttgagtaataaaagatgaggccagaaaagtagtaaaggactagatcatatgaaaccttttcaacggagtaaagagaatgttattctaagcacagtgaaaagccactggaagattttaagcggggtgttttagtccgttttcacactgctataaagatactaccaaggactgggtaatttataatgaaaagaggtttaattgactcagagttctgcatggctggggggtgcctcaggaaactacagtcatggcagggaggcgaaggggaggcaggcacctttcttcacaaagcagcaagagagcaagtgagagtggggagaagcgccagacacttatcaaacaaccagatctcatgagaactccttcactatcacaagaacagggtgggggaaactgccccaatgacccaattaccttccacctggttcctccctccacacctggggattataattccagatgagatttgggtaattacaattccaaatgagatttgggtagggacacagagccaaaccatatcatagggtagtgatatgatctacctactttgcatttaaaaatgatcgctctggctgttgtgtagagaatagatggcaagagtggaggccaggagactaattaggaagctgctaaaatattccctttaagagattatcattttctctatgtgtgtgtgtttctaaatagatttttgtcttttctttttaaaattttttaaaattttatttttaattgacaaaacttgtatgtatttttggtataaacatgtttatatatatgtgtgtgtatctacacacacacacatacattgtggaatgataaaatcaagccaattaacatatccatcacctcatatccttatcattttttgttatgagaacatttaaaatctattattttagcaattttcaagtatataatacattattactaactataaccaccatgctgtacgatagatctctggaacttagttctcttatctaactgaaactttgtaccctttaacgagcaaggagatgttgaatgattagactaaaatggtgacagtgaagatggagtgaagtgaatagattgggaatataatgtggagggagaatggacaagatttgttaatgaattgaatatggcagaggtgtaggaaaagcgggaattagagatgactcttatgtttgtcacctaatcaactgagggagatggtgataccatatactaagacggggagaatgaggaggaataagcttgagggttgaggctggagatttaaacaagagttcagtttgtgatataagtttaaaatgtctatttcagttttaaatgaagaaataaaagatatatatgaatatggagtttggagagaagtcaggagtggatatgcaatcttgagggcttttactatttaaatgacacttaaagccatgctactagatgagataacctcagaaatcattcaacattttcagactgggtaggaaaagagtcaacaaaagagaatgagaaagagtcgccaattaggtgaaagaaataccaggagtatgggtgtcactgaagccaaaagaagatactgttttgagttgaaggaagtgatcaactctagcaaatgctgctgagtttgaataagtggaagactaggaatagatcattgcatttggcaacatgtaggtcattgggcaccttgacacaagttaattttgatgtggtagaaaaaataggctaacagaagcaggttgtaaagagatggggaaaatgaggaaaaggggacaatgaatctataatgagaaatttttctgtgatggagaaatcgaggagttagctaaatgaagatatggggaatcaaataagcttttttgttgttataatacatataagatctctaaaaatatgttagatctgtttttaagctctactgaggtttaattgacatagaaaaaattgcatgtatttaatgtagacattttgatgagtttggacatatgcatgcttctactgtgatactgttcctataaccataatagttttattgcctgatgcacacagcaagtcagtacactgaaacatcaggttgtagcagagaaagaggtttcatcatagggtcactgaatggggaaatggaaaggaacctcaaattaatctccccaaggagtttggagctaggatttttaagtgtctcggagtgggctgaagtgtggagatcattgattggtcaaagagtacagggtgaagccatgggacagcaagatgaggaagctgtattctcatgctaatcttgttcctctgtgggggtcttcaaactggttgctggaatttgaggtttgaaaaacatcttaagccatcctcaaacaaaagccttaaaattctaatgtcagagatcctgtctataggaacaatggggatacaaatcaatttttaatttcctatgaccctaatgccagaaatcctacctataggaacaatggggtgcaaatggtcagttatctaatgctacatgacttttagcaacaaggaaatgagcaagagggcagcctgataaatgcttaactctaactatatttctgtttggaacgcggcatgcaattcttgtcaaccctgtaggaatgatttcagttctgctttgtcttgttaatcctctatcctgagctgtgatcaataaggagggaattgggtgatgacttctctggctgtgtcttgctgacaaggggcacagatagggaccataatcaggatttgaggaataaaactgctttgcagtggcctgtaaatggtcttgagtgccaagtctagagttttgactctgcatggcaaaaatgtcagttcttgttactagtccttgttgtctgtgggaaatagaaaagaaatacaacaataattataataaaaagaatttgtaaggaggcctgtattagggcattctcacattactataaagaaatacctgggggaaaaatacgtgagactagataatgtataaaaaaagttttaatttgctcatgattctgcaggctatacaggaagcataatgggttttgcttttgggaaggcctcaggaagcttccaatcatgtcagaaggcaaagtggagcaggtgtcttatatgacaggagcaggagcaagagagagggaggaggtgctacatatttctaaatagccagatcttgcaaaaactcactcactatcatgagaccagcacgaagaggatggtgctaaaccattcatgagaaattcaccccaatgatccaattacctcctaccaggccccaactccaacactggggattatatttcagtatgattttgggcagggacacagatctgaaccataaaagggaccaaaaccagtttcccattcccataagaagccagctaaaggatcattaagagggtttgtgacatacatctcttgccaaaatgccatatttgggggtataggtttctgagccccgacatcccctgtctgaaacttccctagaagtttcacacattaaaagctgagttggtggaaaaatttagtaagtagctgagtggcaaaggatcctagtaaaccagtctcccattcctggaataggccagttccattaaacagctgtatctcatttcaggagatggcattgcaggcaaactatagtttgtgtatcacaaagtatgcttgcagttactcaggaaaacagtagtagcaatttaattgagtataagtcagagaaatggaataaaaatttggtaatataagtttggagacatgcttagaaaagaattcaggattcaaactaaactgtagacaaataagaaaaactcaaaataatggacacagtatactaataaaaggtgtactgtagtttcttttgaaacataatttttctctcttcagtgcctcatttctaccaaataaaaatcagtaggaccaacttattggcaaaataagtttgagtcttattatatttggtttgattatttgcatagagtgcagcaagagtaattattggtgatgtaggctttttaaattatttttaatttttattttttgtaggtacatggtaggtatatacatttctgcagtatatgagatattttgacacaggcatgcaattcataataaccacatcatgggaaattgggtatccatcccttcaagcatttatcctttgtgttacaaacaatccagttatactatttttgttattttaaaatgtaaaattattgactacagtacccctgttgtgctgtcaatactaggtctgttaaccatccccatcttccccccgccctcccactatctttccaagactctagtaaccatccttctattctctatctccatgagttcagttgttttgaagtttagatcccaacaataaatgagaacatgccacattcgtctttctgtgcctggcttatttcacttaacatgatgacctcccgttccatccatgttgttgcaattgactagatctcattctttttttatggctgaatagtactccattgtgtatatgtaccacatttttaaaaatccattaatctgttgatggacacttggttgcttccaaatcttggctatcatgaatagcattgcagtaaacatcagagtgcagatatattttccataaacagatttcctttattttgggtagtgggattgctggatcatatggtagctctagatttgtcctttcaaggaacctctaaactgttctccgtagtggttgtactaatttacatttccaccaacagtggatgagggttctgttttctccacatccttgccagcatttgttattgcttgtcttttgaatataagccattttatctggggtgagatgatatctccttgtagttttgatctgcatttctctgatgatcagtgatgttgagtacctcttcatatgcttctttgccatttgtatgtcttcttttgagaaatgtctgttgagatcttttgcccattttaaaatcagattattaggtttttttctatagagttatttgtgttccttatatatcctggttattaatcccttgtcagatggatggtttgcaaatatcttctccgattctgtgggctagcttttcagtttgttgattatttcctttgctgtgcagacacttcttaacttaatgtgaacccatttgtccaaggcctgcagtgagtcttgcctggctaacactgctgattactcagggcccaaagactctttagtcagcaagtgatgaatcctgccaggacttggttcttcccttcaaggaagctgattctttcatggtgcacagtgtgtttagcaatgtcatctgtgtgctagggcatggaatgggggcctcaggactctgcctggtaccctgttctactgtgactgagctgatattcaagttgtaagacaaagtcatcttaatgtcccctctcttctgaagcagagggaagcagtccctcccagagctgcaagctatgctgtctgggtttggcagaggggtgacacaagcactcccttgggcgctctcactagattgtctcactaccttaagtaccttaagtccactggctgtaagctcagcacagaaccaggacttgcccaggaattgcagtccttgtggcctaaactggttttaaagtttattttgtaccccagagcactttagcccatggtgacagggcttgttgagacttagcttctgaccgctgggttggatgatttgcccctggctagggcttgtctaaatgccccttccatgggtactgagttctgccctatattgctttctgccgtgacagggcatcactgaattccaatgcaaagtccacaatcactgcactctcctccccaaaccacttgattctctctccatttgacatggttgctgccagggcatggaggagggttggtgattcaggactgtctttcataccctctttagtgccttttcccttaatatgatcttaaaaccaggtactgtaattgcgcccgcaaattaaaacctttcagaggagacaatgatttttactgtccattcaactggattccgcacaaaaagagaggccaggaggccaactgggaaggaattcttacccttttactggctttttgggttcctgaattccttcaactgcagcttccagaagagcagagttttgaccaccctgatcgctaattactaaggaaaaccattttcattattttcatgggttcataggtgaaagccactcaattttataagacacaagggatccaattaacattccccatatcagcagagacaaaattacaagatacacataacagagacacaaacacccgttattctactcagtttccaagttttagccaggcaaaacagacaaaacaccaaaatggttactcccagtcaggcctgctgatattctgctagtgattccttccagcttgcccacacacaaatggggcaagacaaaaacaaacacaaggcctcacaagtcaaaattctgaaaccagatttcagaactgtgaccagaagggtcctggcgtacttccctctaacagtgtgcctttcgttctccttccaattggggaaaatccccttaaacagggcccttcctataggttagggaaggtcaacaggatctccgaagaggtcacaagacctctgaagaggccaacagatcagaagaatggaaaggagatgtcagttgcacttggaagtactcaccagattcagaagacatctttcagattcagaaaccatttctctgctgcaagcaaatgtatgcaatgccctgccagcaagtgaggctccagggacagcccctggtttaaagaagccaggcatccacttgggctttcctctgggccacagaaatgggtgagggagcaccaagccacagccacataaccatgaggggtgtccctttgtggggttgccactaaatagcagccagaatatgttcattgcccaatgcacacagcaagtcaatacactgagacaccagattgcagcagagaaagagctttaattgtagggtcactgaatgaggagatgggagggaacctccaatccatctctccaaggagtttggagctaggattttttaagtgtccttggagtaagccaaagtgtggagatcattgattagctgaagagtgaagagtgaagtcatgggacagggaaatgaggaaattgcattctcatgttagtcctattactctgtggggatcttcaaactgctggaatttgaggtctgaaaaacatcttaagtaatagttaaacaaaagtcttaaaactcttgtgtcagattctgtctataggaacaatggggatacaaatcagttcctaaacagtcttatgaccctaatgtcagaaatcctacctatagaaacaagggcaatacaaatgatcagtgtccagtgctacatgacttttagcagcaatgaagtgggccagaaggcagcctggtaaatgcttaattataactatatttctgtccagaacgtgacatgcaattcttgtcaaccttatggggagggtttcattaccacatcaaggtactaaatatatccattacctacaaaaatgtacttgttttgctcaatggatattgtgttagtctgttgttacactgctataaagaaatacttgagactgagtaatctataaagtaaagcagtttaattggctcacggttctgctggctgtacaggaagcatgatggcttctggggaggcctcaggaaactttcgatcatggcagaaggggaagcagatatgtcttacatggccagagcaggaggaaagggggagggaaggtgctacacacttttaaatgaccagatctcatgaaaactttatcaggagaacagcagtagaaagatggtgttaaaccattagaagccacccccatgttccaatcacctccttccaggcccacctctagcattgagtattacatcttaacatgagatttcagtggggactcaaatccaaaccatatcaggtataaagtctgggttatgtgagatgaataagttctagagatctgcagtacaacacagtactcatagttaacagtacagtattgtgcactttgaaatatgctaagaggatagatctcatcttaggtgttcttcacacacatacacacacacacgcacggatctatttttcaatatactttatgccttaagcattgtcaatgacactttcatctttaaaatatcttttttcatttttcttttccttttttctctctatgtcccttcattcctcttcctccccactcctttctctgtctccccatctctctcttccttccctcccccaactttctctctttcgctctacagtagaaaagccaaaattcccatttgaaaagtttttgctatttttttcgaatgcttagcattccctcctgaaggggaattcttcccaaatatttgtgaaggcaccaaatttatgagaaaacacaaactgtaaactactcttgctggataataaggttgagcctttactatgtctaatattccacactggagggtaaataatttaatttataaaatttagaaatattttataagagcttaggatacaaaattaaatggtggacctgtaagggacatctgctcggggcagagaactattctttttcccctttctccccgtcattattgtatttatcaagaacgatgggaaaataatttttcaaaatccagggttttttaaaattttaaatatttttccatttatgtctaaggaattggatgatattccttattattatgcaggttcaattcttatacttcattttataactacttcattttgtgttgaaaggtttaaagcatgatacaagaaacacctaaataccattcatgaagattcacaaattttattgcagaggttcacaattttaaaaaatattttgccctatttgcttttttatttacctattttagatagataggtatagatagacatctaatttgtaacatatatattaataacatatactacataatgtgtatttttttcagaaaaatcttaaagttggagatatcatgcccctttcatcatatagacttcagtgtgtatttcccaagaaaaggagagtattctcatacaaagactccagtatagtttacaaaatctaaagatttaacagtgatatgttactttcaactaatctgaagtctttttaaatttgtgtaattttcttaatcatgtcttttatagatagtttttatctcagtaaaggataaaatttagtatcacacatttcttaggtaccatgtctctttagttttctttaatctggaatggtttttgagactgtgttccttgatattgaaatttttggaaagtatagatcaactattttatagaatgtccttcaatttgattgcctcatgtttcctcctaattagattcaggtcatacatctttgagagtaacacaatttaaacgaagattgtgttctaaaaagtgcatcttattaagaggcatatataaagtgggtttgtctgaacgttggtgtggttagattgggtgtggtggctcacacctgtaatcctagtgctttaggaggctgaagtgggaggatcatttgaggctagacattgtagaccaggctggacaactctattagttcattttcacgctgctataaagaaatttttgacactggttaacttataaaggaaagtagtttaattaactcacagttccgcatggctgggaacgcctcaggaaacttacaataatgtcagaagcggaagcaggcacatcttacacggtggcaggcgtgcgtgcacatgcaagagagagagggtgagcgcgagtgtgagtgtaagtgtgcagaaaaaaaactacaatttataaaaccatcagatctcatgagaattcattcactatcacaagaacagcatgggagaaactgtccccataatccaatcacttccctccctcaacacgtgaggattacaattgtcaatgagatttgggtcgggacacagaatcaaactgcattggcaacatagtgagaccacatctctcccaaaaaaaaaatttttttttaaattagctaggcatggttacacatgcctatagtcccaactacttgggaagctgaggagggaggattgcttgagtccaggagttcaaggctgcaatgagccacaactgcaccactgtactccagcctggatgatccaggatgaccctctctctaaatatgtgtatatatattttatattatatatattatatataatatatatattttatattatatatattatatataatatatatattttatattatatatattatatataatatatattttctattatatatattatatataatatatattttctattatatatattatatataatatatattttctattatatatattatatataatatatattttctattatatatattatatacagtacacatatataatatatatgatattgtttgattacttgatgaaggtagtatccaccagtgtactgtaactcttttttattcagtgagttacaatcctttataatgcttttcttgatgtgcaaattatctcagaattggccaggacgaatgctgtcaaactggctcctgtgcccttttaacatgcctctattccttgagcacttctttactttatgatgcaacaagctgttcaaagctcattttatgctttctctgctctgaacatgaaatcagccatttcctcatggaacttttgttcatttcaataaggaatagtttagaaactaggatctgggcactagatgtctgcattccaacaagcttcatcatggtgactaggtcttctcagtgaacagggtgaaatttatctgttgatatattaaaaaccatgagtttatactcatacctccagtttcaatccaccaccactgaaaacattctagtctttcccctttccctttccatattcataacatttttcctaaaataggaaaacatggctcccattattctcaatacatttactcatttgtttaagactaaaatatgcagaaacctgttttagaattgctaatccattcctccatgataaggtagcccaatgagtagaattcaatatgtgtttacagtttatttttattgaggtaaaatgtacatgccttgaaattgttaaatcttaagtatacgactcaatgaattttgtcaaataaatatacctatgtaacccacacccctgttaaaatttagaacatttcaatcactccagaaagttctcttgtgtcatttccaagtcaatccttctctcctttccagaggcacacattattctgaatttttccccacggattgtttttgcctattctagaagttaataaaatggaataatatactatgtttttgtttgtgtgtctgtgagatccattcatgttattgcatgtgtcattctcctttattactaaagatccgtcgtcctgttgatgaacatttagattgtttctaattttggataattatgagtaaagctgctataaacactcttgcacaagtctttttatgaaaatatattttcctttctcttgaataaataccaagacattgaattgttgggacaaaaagtaggtgcatgtgtaacttaaactgtcaaatattttgccaaaggttcttgtattattttatatcccaccagcaatgtatgagagttccagtcactctatatcattcccacattgggtgttcttagtctttcccatccatctattttacattctagtgggggaaagagggtatctcattctgttttaatttaattaaattaattaattaattaattaatttttgagatggagttttgcccttgtcgcccaggctggagtgcagtggcacaatctctgctcactgcaacctccgcctctcgggttcaagtgattctcttgcctcagcctcccaagtagctaggatcataagtatgcaccaccacgcctggttaatttttttgtatttctagtagagatggggtttcaccatgttggccaggctggtctcaaactcctgacctcaagtaatctgcctgccttggcctcccaaagtgctaggattacaggcatgagccatcgtgcctggccacattatgtttttaatttatatttccctgataactagtaatattaaatgttttatgcttactggttattcatagatcttcttttgtgaatatcttttaaaattttctggttttggctgggcgtggtggctcacgtctgtaattccagcactttgggaggccaaggtgggcagattacctgaggtcaggagtttgagaccagcctggccaacatggtgaaaccccatctctactaaaaatacaaaaattagttgggcgtggtggcacacgcctgtaatcccagctactcgggaggctgaggcaggagaattgcttgagcctgggaggtggatgtttcagtgagctgagatcctgccactgcactccagcctggccaacagggcgagactctgtctcaaaaaaaaaaaaaatctgtttttaaaattttgggggtttgtatattattggattgcaagaaatctaaaaaatatacattctaggtaaaagtctatatctaggtcagaaatattatgcaaatattttctgttttcaagtatacatatgtgtatgtgtgcatatttatatataaaggccttttgcatctctattaatgagccatatgatttgtagttttctgctagtatctttaactagtttgagtatcatgattatgatggttttacaagacaagttaggaagtgatccctccaactcttttatctgaaacattgctattacttcttaagacatttgatgaaactcacagtgaaaccatctgggcctggatatacttttttatgagcaggtttttggagaggaattgaattttttttatagatttagggctagtcagagtttctatttcatattgttgcagtttcagtgactattttttaaatcatttattttatctaagttttcaaactggcacaaagttgtttataatattgccttaatattcttattatatctataggatttatagtgctatcctgtctttctttctggtattggtaatttgtgtttttacatctttcttttttgagataagtcttgctacagcattatcaattttaatgatcttttcggatagtcaactgctggactgaattgatttttcctagtgtttgcctacctgcaattttatttatgtatgctcttgtctttattacttccttttttctgcctactttgggtttaatttacttgtcttttaaaatcttcttaaggttagaaacttatataatctattttaaacattttttagcataaacatttgtattatacaattttttccaactcccttagccacatcccacaaatttttatgtgctgtattttcatcattatttagttgaaataattttccagttaccattacgatttattatttggtatatggtatatttagaaatgtgttaatttccatatgttagtgctttttaaacataatttattgttgttcatttctaacttaattccactgtgatcaaagaacatgcatactctgtaacagctcacattgtgtaatttattgggacatattttatgtcttatttttaatctaatcattctaccaatgcagaaaaaggaatgtaaaaatctctgacttctcacttttattatggcttagtgtatttctttgttctgtcagggtttgcttatgtattttgaagattttttattaggtgtagatacatttatagttgtttatgtctcctggatgaattgacccctttgccattacaaaatgtccttctttatctttgggaatactctttgttttatagtctgttctgttaatagagcaactccatctttctttcttagctttttccattcttttattctcaacctgtgttttgtatttaaaaatgtatctcttatagacaacatatagatgttccttgctttttatccaatttgacaattgtagccttttaattgaactatttattccctttacattcaatatatatatgatatgcttaagtttatgccttctatttgctgtgtattttcaatttgtcccatctggtttttttttctgctctgtttttcccttcatgctttcttctgggttaatcaaatattttttagtccttcattttaatctctttatggtcatttaagtactgtacattcattttaggggtgttattagggattataatatgtatatttattccaatctacttagagttagtttttctacttataaaatatggaaactttgctttgcaacagtttgttttcatttatcccccatcactctttgtggatgattatacatacatacacacacacacacacacacacacacacacatatatatatatatatacacacagacacacatatatataatttatatacattgtatttatacttatttgtatttatattttatttttatccatggtagtcccaaaacaatgttataatgtttaaactttaaaaaagtaagaccaggaggcagctccaagtgagtgtagaggcatcattaaaaaatgatgactaataaacttaggtgaaaaatgtgttccttgctaatttaataattcatgagttgctgtcagtgtatgcatatatgtacaagcacatttatatagagacagtatttgtgttcagattcatttgtgtgacattgtttacaagaaaattggcgaaaggagttaccaattcagacatctcttccacttgtggtgatggttaagttaggtaagtgacctcttttttgaacacatcatttaaatgactttctagtaaaatgactacctgaatcttagttattcccttaatacctgggcagagtgtgaaacaaaagcagtatttcaggttaggataagaaaatttgacccaacatggaaaggatggattatggaatggatggaaagaaaggattatgatactccctctaataaaacatgaaataaaaatccacaattagctgaagcagcaagatgcagcctattctcttttattggaagtgtacatcatctaattcagtatctagaggctttagagtcagttaaagatacctgtgaattatttgttgttacggcagtaatgtcaattcctcaaaatagttccattatggaaacaggcctttaattttcaatcccaagtgatacagtcagataacttatgtcctaccattgttcctgagacaacttgctcttttttctttttgttgggaaatctgtttagatacagaaatagttggtatgacatttttcctgaagttgtatagcaatatacatgaggaaagctcaggaattatatggaatctttgcattttttaaaaggatatttaggactttaagacttgtacatatactgtcatacttttatatacattgtaaatagttaagataaaagtcaactttgcataaccttatatagtttttttttgtggtgagaacacttaaaatctctgtaaggtaatgcacatgttaattagcttgggttaggaattctactatgtatatacattttgaaacatcatgttgtacatgatagatatatataactttatttgtcaatttaaaaaaatgaaacacttttaaaaaggcaactttggacatttgttctttctccatatgcccaagatatttttcatagatttaaaccacagttaattcccaattaaatgaacaagaggtataaaataatgggaaagtagaatgctgagagaccaccacatccaacaaactactcaactttgaaatttgtgttcattcaaatacactgacattgtcagaatttatgctgtgggcattccaaaagttcagcatacagtgatacaattccccattccgacccagtacacagtactcctgggaatggaatagctcattctttctctttttttgctatctcccaaaaccagcctatagtgatgtgcctgaactcaaatgggaagatttcaaagatcttgcttagaatttgtaaaagttagggttattactgatgtgaaattttaacagataaagtaattgaacagagtacagtaggtattctctgtcaataattgtgaaacctagtgatcagaaatgattttaggtcacagaatgacttcaacagaaacagggacaaacatcaggactcgatcctttccatcttttagccacatttcttctcctagtagaaagcagagaaaaattagagttgtaaggtctattgatgcatcttggtaagaacatttgcagttaaaccattgagctcctaaagagatgcatctcactgttacactttgtgcccccctccatttgtttattcttccatgtcatgcacagggcaactagaggtacctaccagtaatattacattttggttaactattctttacacacaaaaaagatctttcacaatagtctcaataacctccttttgcagtgatttttttacagattttgtttaggacatgtgaatgtagatgatttactgtacagtttaataacataactgctttgttactcaccaaagtttaggtaaataaatttatggcatgagggagtgcgggaatggaggggtggggaaacacagagctcaccatacactcacatttttaatgccatacttcttatcaaagagaggttactttagaaaaccctatggcagtggacttttgttcttatggcatcagcaaggattatgtagcaattcatttgcagatgtagattttagcccaagtaaattataatcaaaatctatctgacacattgtgcttcctttatctaaattgccctgttaatgagttttctgaatacactaaatcataatcttttatgaatcatttcagtttaaaagccttcagaatctcaattagattatcttagatgaagagaaaagtaaatgttacaatgaatgtctctaactgtggcaaagtggaatgttatctcttaaaccactgtctcctttagtggcttcttccaagaccaggacctacaatttgttcccatttgcttgaaaaaaaaaaatcactaatattggtggtatttggtagtgaacttaccctctagtcgatcttgctgttttcaaggatgatgctcagcatgacatactctgggcttttaaaagagcctttctttgtatgtatcaacacggtagtttctgtagctgcggacaatcaagcagaccaaacaggctaagccagactgtgtcggatcacaccacaaattagaggcagatgcacttttttcaatctggcgttctcctttgacttactatatcattctccattttttccttctattatgttataccacacctaatttcccaaaaggctgagtcattttatgaaaatacataaaatatgtggaaatgggtgaaaaggaaactaagggtgagtaagctaagatggagccaggataaggtcagtaagccaatgcaaatcatgctgctatatgattcagctgcaggtacagaagagcctctttaaacatagcctgtagcaactggggtcaggatggagtgagatgggagggcatgaaagtatctaatgtttacaacatttcagtggccatcttattctagttctctagggaagaatatcagtccctctggaaaagggagggaaaggatgagaagctgaaagactgcaatcattttttaaattgtcaaatgagtccatttgttggaacagaaataatttagtagaaaataggcaatcaagttgaagttttcttctcctcactatttaatcttgatatattgagaggctcttaacatattaaaaatggacaatgaccaaaatgagaattggaatttcagccaaaagtatatgtgctttcatccacttgtggaaatacaagttctaaatgataattaatgttagtcccccatccagagtgatatccttattctgtgtagctttggccgtacaaaccagcctggtccatcaacagggaacaacttgacctctgatgaggaacacttttaccctgacagaaagtggtaatgttttcttagcttctgtagtctgacttaatgtcaggcaaaggcaactttgaagagacagtccttcaaataatactattggcacataatatttattacctttttttaaaaaaaaatgagatgaaagtcacataatttagaattaatcattttaaagtgtatgattcagtggcctttagtacattcacaatattgtgcaactataacccgtatctaattccaaaacattttcatcatcacaaaagaaaaccccatacctgttttattagtcagggttccctagagggacagaactaatggatgtatatatatatatatatatatatggttttattaagtattaacttacaagatcacaaggtcccacagtaggctgtctgcaagcttgaggagcaaggagagccagcccgagtctcaaaattgaagaatttggagtctgatgtttgagggcaggaagcatccagcatgagagaaagatgtaggctgggaggctatgccagtctctccttttcactaatttgtgattgaaggatgcaaagttaagcagttactctccatctccctctctccctagcccctggcaaccattaatttgttttctgttgtgcattccttgttgactatatgctttttgatgaggctggtgaaaaacagatggaactaacactgggcaaattagtctgctgtaataagaagggtattaaaaaataaatataggccaggcgcagtggctcacacctgtaatcccagcacttttggaggccaaggacggcggatcacctgaggtcaggagttcaagaccagcctggccaacatggtgaaaccccatctctactaaaaatacaaaaattagccaggtgtgatggtgcatgcctgtaatctcagctgctcaggagactgaggcaagagaatcacttgaacctggaaggcagaggttgcagtgagctgagatcaagtcactgaactccagcctgggtgacagagcaagactccgtctcaaaaaataaaaataaataaattgataaataaatatagctggtgatgggccattataaaaaaatctgcttgctaatcaatgaaaaaaggcatgaaatgagtgatggccaagactgtgtactcgttagttatctagatttaaccagaaaaatgaagcaacaatatatgaacaatttagttaaaataaagacattgcaaaaacagttattgatgaaaccaggcagagaaagagcagggtcaggaaatttgagtacatgtgtaggctttccatcttaaggagaaaaaaaattggataccatctggtacaagcactactctcccatgtaacatgaaaacttgatgaaaacaaaatcaaataaaccttgaatgaagaatcttactcataagaaagttcaacttcatccatgtgcaaatgtttgggcatgttgggaggcagagattaataggagtgacaatgggtataaactgaaggagctgttaaatccaattttgccttcactgtgtaatgacacaattcaccttctaccattcagtgcctcctgaaaccagatgcacttgaaatactgatggggagcgggggaacattgtttaaacattcagttttaacccatgactcaaggttgaaggtctccagtaattttttttttttgaggtaaaaagcccaatatctgtaaagccaaacttgagatagctaaattaggaatcactaaaggccctaatccagggttcagtagtaatcactttggtgaccttaggctagtaatttacccattctaatcctattttctcatctcactctgcctagctcataataatttttttaaagtagaactaggctgtatgtttaaaaacactttgaaatagaactcagcaactttttagtttgaatatttacaaatatctgtttattggacctgtaaaaataagggaaaaaccctttctgtgtgacacaaatatttattaagggcttaatcactagcattgaattcctctataaagtatagtcactaatacttcacactggtttttgatgaggtttgcaaatatgaaacagtgttgacagtgatgatccatttgcatggggttttcgctttttctcctctcagcttcttagtttatcttaaagccctcagaagcttcttgtatttcttcaacctaaaccacaatattttatctgtatgtcttgagattttggaggaaccaaggcattttcgaggaattataagtcatttcttgttgttgaaattcacacttgggagaagagtgtccttataaaagattattctggagagctaaacataatccagatcatgaaggatcgttcatgatagatatgaaccaggttaagaagctccttttttagacccttatttaaggtcagaaatcctgtttggtggccagtcagtcttcaacagccttctttactgaacaaagactcaaagactctctgaagtggcatttttcttttttcccccctgagaacaaaaagcattaatataacttaggtggaaaaagtgaaatatgagaacaggacagagctacttctgtgaggtagctaccattatttccacttcacaaatgaggaaactgaggcttagtacagttaaataatttgcctatattcacacaggtagcattagagttgggattcaaagttcatacattttaccactaagaagtaattattttctttctttcttcttcttttttttttttttaaagacgaagtctcgctctgtcgcccaggctggagtgcagtggcgcgatctcggctcactgcaagctccgcctcccgggttcacgccattctcctgcctcagcctcccgagtagctgggactacaggcgcccgccaccacgcctggctaattttttctattttttagtagagacggggtttcaccacgttagccaggatggtctggatctgctgacctcgtgatccgcccacctcggcctcccaaagtggtgggattacaggcgtgagccaccgcgccaggcagaagtaagtattttctaaattactgtgtgctgagaacacttaggcactcctctaggagttttatgttagagaactatgcaagatcgtgtagaagcaagggccaagttatatggtacatccaataggtgctatagaaataaataaaaggaagacattactgggatttgttcagtcagagaaaaaaaatttttttggaggagttggaacctgagctagctctcagagaaaaatataagaagtagatcaattaaagttggaggcaggagcatgggttattccaaacagagacaagaataaggtgaaggcacagagagagaaatgaacagagtgtgtattgaaaggactctgacttggtacaatactagagtcatggtggggagtagtgaagtgaagcctggtgtggcagggtaagctatgtagaaggccttgaatgccaaccacagggctttctctctgccttagaactgtttattgaataagcaaatttctgcctgtctcaggtactctcactattgttatccatcaagcagaacatgagttgcatttgctttccaaagtgctgttatattttatgtttatgaggagaaatgtgacaatacaggtccaggtgtccaaagggaattatagctatcgccttcaatgcaatacaaaactccatggctgctgggattttcatgcccactggcagcccagagatacattatttatttcaaattataccttttcccctaatgggcctgtgtttctttcaatgttctgctagttctagcagcttcagctgttgctgtcatacttaataaggactttgtggagcttagatattgtgcggctgcactatctttcccacagcccagtaaaggagctttgagatgagctttttctttctgtgttggctatgtttagatttcaacctgaaaaatattccaggttgacccacagcttattctgctatcagtgagagggtaggaatcagtaagattagcttcctctaatgccacagcaaggtcacccacgaagcccgtagcttgtcgaattgcatgaagtgatccaagctagttcaaaactcccaatgtattaaatgtcggtgcccacttttgcaaattcaggcatccaaattgtgcctggtatgaagcattaggcagtgggtctaggaaattgagctcaagggcaggaacatcataactttggaattattggcgttgacatggctattttcactcattgtgataggaatatgttcctgaaagaagcaagatgattctaaaaagtaccgtgcaattataaaatagtgggaaattaaagaagggtgcttttgtgcttgctttcttgccactgattttgcattccctattttacttcatggtagtctatatgtcactcaaatcaaatataattggtgctgtttagtatttggtaattttactgctgcttgtacaacatacgcaaatattctaaaatgtgttaatgatgtcagtacatcacaaataaaatgcacgtgaaatggaaataacgctgtgcacactcatacacccacaagtgcatgggagtctgatcttgatagattcagaagaacccttagctggcagttttaataggcgatcatagaaaagaatgccagcaaaaatgacagagctcatatttctactgacaaaataccaaaatgacttacgagttattttctcaaaaatggaagggggcagaactgaagagtcagtgtgtgtgtgtatatgtgtgtgtgtgtgtgtatgtgtgtacagacttatataaggtcagtggtagattggcgagatagactaatatgtgagtaaagttatggagtttaataacataatcatggttaactaacaggatctgaaactgtaaaaaatatagggaagcatcagtatttgatgaggaagattgggggtactgggctgggcagctacgatagaactgggaacagaactcttacattgaactgacatttagcccttgactttatgaatgtgtgttgaggttgcaactacaaagtaactacatttcttaagtgtcagaatagtgaattctaaccacttggcaaccacgtttcagagggaggattgtagttacttcactaactgggtctaggggcaataaggagaagaaatggctgcctactaggcaactgcacacattcagtaaggtggggggaggaggaagactattggtaacactcacagaaaagtggggcctgcctgcccagagacagagaattacagttgagaaaggcctgtctgcctggaagtgtgtgtgagtatattgtgtgagtatatgtgtacgtgtatatgtgcaggtatgtgtatgtgtgtttgtgtgtgtgaggatatgtgagtgtgggtatgtgtacatgtgaatgtgtgtatgtgtatgcatatgtgtgagcatgttgtataagtgtgtatgtgtttatgtgtgagtgtatatatttgagtgtcttatgcatgtgtgtatgtgtgaatgtgtagatgtatgagtgtataagcctgtgagtgaagtttacactgatgcagaagagggctggagcccatggagagaggtgatcagtttgaaccaggcctgatttgaaccctgccccatgcctggtgagcccatgctctgcaccagtgtttcatccctagctttgcacataaacaccatctctctctggaaaatctttccagtctctgactgggtaatgtaatgtagccccatccctcaaggaccagctcaggtgcagcctcctccatgaagccttccatgatttcatttcccctatctccaacagatgtgacctctcctgtggctatgggtttggggtggggcatctgtgctggggtgtagaggagtgttggaacactgagatgggagcaaactgacaggaagaatcagaggtatacatttagaatttgtagtttgtattaataacaagcacccttggtgatcctcattatcaggtaagtttgggaaacactggcccagtcttatcccctcattttttagaagagacaactgaagctcagagaggggaaatttactggcctaggatcacacaatcctttagtgacagaaccaagaccagcatgcagatatcccactatctttccagtccagttatgtttccctttgtattatattaccgtaacaagactggctacataatttgcatggcccagtgtaaaattaaaatgcaaggctctttgttcaaaaattattagaaatgtcaagacagcaaaagcagagcattaaaccaagcacagggcccttttacatgcagagccctgtgcatctgcacagatcatacacctgtgaagctgacgctgtcccacaaagagtgtttactatatcttgcatgtggtaggtcgttctataaatacttgtcggatgaatttatggattgaattaacacctcccatttgccaggaatctatgaaagtgagacactagataaatatgttttgatggaagtgtaggaaagaagagaagaaaaataggtctggaacatgatacatagggttactgacatttgtgtttggattttttatgtgagtttttgcacacaaattgagattgctacaaaggctatccagtataagcaattgctgagtaaccaacacagggtctctgactggtaataacaatggattttaaacacttagcaaccatgactggggaggaggctttgcagccctagcaggccaaggggctgggaggaaaagaaaaataaaattggctgcctactggacaactgtgcatatttaacaagaaatagtttggggtgcaaataaatcatctgagttgattaaatccagtctgtttagggaattggtatgtagcttgctcccttggtgaaggtttgacctaaggaataatcaaagcttttctgaaatgtctgtaatcactatttggaatccttatgttgccataagacttctaaaagccacatctgctatacaatattgtctggtgatccatataaactctttaggccacaggtttttaatttgtttgtattagttttctattgctgtgtaattcattgccacaaacttaatggctattaagccatttatttattttcccagtttctttaggtcagaagtgcaggtacagtgtagctggtttctctgatcagggtgtcacatagttgaaatcaagttgttgtttgggttgtgttcccatctggagcttgggatccttttccaaactcatttagattcttggcagaattgagtcctttgtggttatgaggtatccatttacttgctgtcacctggaggtcattctcaactcctagaggatgctctcatgtcccagttacatgtctctctccatcagcagctcctaacataatcatttgctttcctccaagtcaacagaatagcatctctgccacttagaatctttctgacttctccagttttttaaggtttcgcctcattgggtcaggctaaacttgggtagtctctttttttggtaacttaaagtcaactgattaggaaccttaatttcatctgcaaaattctttcacctttgcagtatagcataacttaattacaggagtgagaacctatcagattcacagaagggattatacaaggtatgtatgtacaacagtggtcaagattattggaggccatcttaaaattctgcctaccataatattaatgaatgaactttagggacatattcaaaactctaacattttatgcaaaaatttttgtgactgttcattttttccgggagccagttggcagcattcatcaagagaggtctgtgacccaaatcctattaagaaccactgatggaccagataatacacactggcaagaagtgatctagaaccaaatacttatttctgaaagaatttaaccagtgtcttttcaaggaactaaagaaatctcatgtggtgtttattgagatgaggtggctcaagttttattcaaaatatatcttttagtgtgtgattttcttttaaatcaatgaataattggtatttccaaacagattttgttatcaaagtgttcgtttctttttaaatttaccattgttactttatttttcacatttgtgtaactgtgcctccaccgtccttccccatctggctgcctataacatttccaccaatggcaaggagcggttaagtcagataaaatttggatattagttggggacagacaatcatcagtgctgtgcgcattatattccatacaggaatataattaaattttggaccttctggctaggttgtaagcaacttgagagacaggaatcagatcttgtgttatattctatatagcactatattgggtcaaaaataagctctcagccaggcgcggtggctcatgcctataatcccagcactttgggaggccaaggggtagatcacctgaagtcaggaggttgagaccagcctggtgtcaaccaggtgaaactctgtctctactaaaaatacaaaaattagctgggcgtggtggtgggtacctgtaatcccagctactcaggaggctgaggcaggagaatcacttgcgctcaggaggtggaggttgcagcgagctgagattgcaccactgcactccagtctgggcaacagagtgagactctgtcacacacacacacacacacacacagacacacacacacacacacagccctcaataaatattgggtgaattcactttgattcagaaaataatttttagagggtattgtgtgtaggaactgtaacaaaaaataggacaaaattctgtgcctcaagtttacaatctaaggattatcagataatcacaacccaaagattgtaacgtgatacaaagttaggagaatgccaaatgagaggtatgagcagtgtggtcagatcagattacatgtagcatctaatgggagtgtgggtggggctgggcaaggtaatgagtcagagaagagcacagcagaggagttgaaatttgcagtgtgtgaatagaaatggagtacagagggaggaaggctttaggatgtcagaagtggtaaggaagcaagaaagccatacttcaggtaaatagatgtactgcacattctccatgtgtggtccagccttcccctgctttttctgattggattcccttaacctattgactcaaatgcaaatatctgtcatggcccagtttaaatgtcagcatccccatgaaacctttttgttcactcagaccaaaaagaatctctcgttcctctgaaatcctgtagcatgctatctacatgtctcacaagtcactttctgttgtttagcatagttatatatatatatgcatgttttttcttctctatcaccactgatttaaaaattcccttactttatattgtaatttctgtttaaaaagcaatttcacatacattgttctagtgttctcttggttgcagatgaaaagaccaaggctcacaaagccccaagctttactgctagtaagtaacaaagaaagggcctgagtctaggttttcagaattcacacctaatacatcttttttattttgttttcaccagattattgtttgtgtgtataggtacgtaaaatgtctgtgaaggtgacagaaataaaatctgctgatatttaaaatgttactagtcttggccacttcacttcagatgtccagtgaaaatgctgtttagcttatctgatagatcaacctgtgtaaataatctttctcataagtaaattatgggaaaatgtgagtctgagtttcatatccctatatttcttctaacatggatgtttgatgcacgtttttaacagctttattgctatatgattcaaataccataacatttgtttcaagtgtacagttcagtgggtttttgtaaattttgtaaatttacaaagttatggaactgttattaccacagcccaattttagcatatttccttcatcccaaaaagatccctcatatccatttgcagtaactcacattttttcagccccaggctaccactaatctcttttctgtctctatacattagccttttctggaaattttatataaaaggaatcatacaatatgagttcttttgtgcctggcttcttttactttgtacagtgttttcaaggttcatctatgctgtagcatgtatcggtattgcatttttattgcaaagtatagatatactatattttattttcccattcaccaattgatggacatttgcattatttacactttagggctcttataaataatattgctgtgaacattcgtgtataagttcttgaataaacatgttttcattttatctctcttggttttatatatatatatatatatatatatatatatatatacacatatgtatatatgtatgtggaaatgctaggtaatatgacagctctatgttcaactttttgaggaactgtcagactgtttccaaagtgactgcaccattttacatttgcactaacaatgtatgagggttcctgtttctccatatcatcaccagcatttgtcattatgtctttttaattataaccattctagtaattgtggagaggtatctcattgtgcttttgatttgcatttccctgatgactaaatgatgttgggcatcttttcatatgcttattggccatttgaatgtcttctctgaagaaatgactgttcaggtcctttgaccattttttaaaatcaggttatttgtctttttattatttgagttatgactttttatatatttaaggtgaatgttttttaccgaatgtatgatttggaaatattttctcccagtctgtgattcatgttaattttccttattttatgttttattttattagttttttagatacaggatctcactctgttgcccaggctggagtacagtggtgcagtcatagctcactgcagcctccaactcttgggctcaaacaattctcccacctcagcctgcagatagctgggactacaggtgtgcaccaccacatctggctaatttttaaaatttttttttgatagagacagagtctcactatgttgtccaggctagtctggaacttctggcctcaagcaatcctcctgcctctgactcccaaaatggtgagattataggcatgagccatggtacttggcctgtcttctttttttttaatggtaactttcgaagcacaacaatttttgaaaattttttacgaagtccaattgacctaatttttatcttgttgcttgcgtgttgttgtcttacctacaaaatctttgtctaacccaatattacaaagatttgctccaatgttttctactaagagttttacacttttagctcttacatgtaggtctttggtccattttgagtaaagacttgtgtatggtatcaggtagaagttagaattaatctttttgcattgttctagcaccatctaaaaactattttttatcccattgaaatgcctttgtacctatgtaaaaaatattaataataaatgtagggttttttttattccattgatctatacgtctatccttatgccaatacaagactgtcttaattactgtaactttatagtactttttgaacttggcaagtgtaagttctttgttctttaccaagattgttctggctgttcttgaacatttgccttctcatacagattttaggagtagcttgtcaatttttgccaaaaaaagcctactaagattttgataggcgaatgtctgtgtgagaaaaaatggaaaaggatctagaaaagactgtgagagtcatcataacataaagccaatctgacaccaagtgagagagatgaaagggaagttgggtagaattgtcctagacttccatcagtctaaagaaggtttaacaggagagtttggctgataatctttaagccaaagtcaaccaacaaattgttttctgtttcccaagaatggacctgcctttgtgtccctgccatgctcagtcattggctgggggaagcctgtgggacacacgggctcaataccagtgtggtgatggattttagtgcacagaagctagagcctttcgtcagttacattccttgtagttggaggtctgtgagttggattctcatagttgctacaatacatgaccaagaaacattcttctttctccaggagaacttcagaagaaggatctgatcattctggcccagaatcaattttccttgaagttcagtcttataatgtctgtaatactatgcaatatagattctcctacattcagactgtcactgtgttcatgtgcttggctgaatcatggttgtttctagaggaagtagccaagatgatgtgacttgacctcaacaatactgattatttaaattctagcagtaagttctgctatggaactatccatgtatattttgtataagattccttctagatatctgtgtgcatcctcctttcataccatgggagtttactgagtgggaagtccataggggctggtaggaaggcttcatttcagatatggactttgtacccattgagatgaatgtcatagaaagggttagtttaaagaagtagatgagaaacattaccttggaaacagcatgtaggtagagtagggggctactgaaaagatgtattccctatataggcacttcagtggcattttaccttttttatgtaagtagtaattatacatttaaatcagcaaaccttgggagagcatactttctcagcaatgttttcattttttcatatctctaaaaattaatcttctgttgggagtgacttaccaatgatccccacgctatcatgtgatttcagcattctttccattatgatgtcttttcagcctccagcagaggtaagagataagttgtgaagtagaaagttcttaaatcaggaaaatgaaaaaaggaaatcaatgttacaactatgaaagaagcaagagtactttccagggcaaagaatttggtgtaatctagatagtatatctgatccctttgtcaaattcttttctgaacctaggaggaagttgtaacagtcctcacattgccttgtaccctccaagaaagtcattaacatttcaaaaatattatcagttttttttgaaagccatgggagaaccttaccattttaaagtaaaattatgctttgctttgtatgatttcaactgctctgattccattttagttaagggtagcttaattctcatggctctaacccatcccagtatatttgcctgaagctctattaagtagattgtattaagtaaaattttaccaacttgaaattaagaagaggttttaacctgttaaggttttgccatgagaatggatgtagtcatagtagtcataccttctatgccttcttggtttctatctgcttgcttcattttggctttggcattgcgtttacctgcagcaaaaccctacagaattcacctgaggggttagacactaattatgatagatttacagtcatgtgctgcataacaacattttggacaaggatggactacgtgtatgatggtggtcccataagattataatacgatatttttactggacttcttctatgtttagatacacaaatatttaccactgtgtttcattttcccacagtattcaacatagtaacatgctgtataggtttgtagcctaggagtagtaataggctatgccatgtagtctaattatgtagtaggctatgcagtctaggtttgtgtaagtacactatatgttgtttacacaatgacagaatttcctgacacatttcttagaatgtatcctcattgttaagcaatgcatggctgtgctgactggtgtttatcacaactctatatctggcaggtcactgctgccatagcaaaggctatttatttttctttgttgatttaatatagtttcagtcattagaaaatatttttctgtggattctgattcaaagttcattaatcaacagaactgatacattgttgagatgacccaggacctggaagtgtagggatgtgcccatttgttacatgaagtgttgacttgtaattagaatgtactcatgatgcatagtgttaaatacaaatgagtagaacatgagaattgggagaaatcttagagattatctggtccaaccccctacattttactatggaggaaactttgtgtggcccaagtcacataacaaataaatagaggcagaactcttttgggcctgaatttgtatctctagattcctattccagtgattattctatttcctgttctgtttcttaagtgtcttagtctaaagtgaatttatcatatattgggtagcttacatggaaattaaaagtaaacattgagctaagcaactgtttaatttcatattgaaaactaagaacaattggctatgaacaggtgggataaaaactttcaaatgcattgtgaagaattaaggtctatttttatgaggatgacagtgatcattgattcaagacatctaatgcagaactatctgggcttgcactgtactgcatatacggcttttaagcacttgaaatgtgcctagtccaaactgagatagatgttgtaagtgtaaactagacactgtatttcaaagagttagtaccaaaaaagaatgtaaaatatttcactaatactgtaaatattatacataatgaaattatgttatttggatatattgggttaattatatacatattattaaattagttttaccaatttatttttactttttaatgtgactactagaaaatttaaaattacaggtgtggctcacattgtatttctattgaatagcacctgtccagagtgttgctaccaaatgtatggtccatgaaccagcagcattggcatctcctgagtgcttgaaattaatgcagaattttatgactcaagctaaactgactgaatctgaatctgcattttaacaagattcccagggtaatttacatggacattaaagtttgatatatactgagcaagcatgtgcacaccttgttcagatacttcctagttctccacacagaacttgttggatcccttctgattgatatgtgacatttagagccaggtcaacccacgacattctggctttaagctttggtagatttttaaactgcttttatgtgcagtggttttctgatctcaaaaagctctaccctcctcgtataccaacatgtttttactaataaatcagacagcagtgatgaaggtgggaactccagtaggccaaatatgaaagttacaaatgctgttaataccccaatctcccttctgctcagatatctctcctggttctacatcagtacagccaactgtctgttttatatttacctctgttattctactagaatctcaatgcaaagtgtccagaacaaaattcaccatgttacctaaaaaatatgattatttttatatttcatgtcctgatgggtatcagtaccatctacctatacatccaagtgtgacctggaagttataattaataatccttctttcacgtcttcacacaaacctgaaatccaattagccccttaagtagtcaactctgcctcacatctctctctggaatatattcttactttccacttatactgctctaattctgagttttcattaaatctttcctgaattattatagtagcctcctatctagtcttctataccctgtactatctcccctttctaaacattcttccacattgcaaccagaaatacctttctcaaatacaaatctgatcacgcctaaaatcctttggtggcttctgagtagctcagtctccttgttaaatggggctaataatagcacctatgtcaaaggctttttgtaataattaaataaattaatgtatataaagtgtttagaatagtgcctggtacaatgtaagtgatatgtaggtattagcttatattatgtttattattcaaggctctttacagcatgtgacctcaacctattttgttagtgaaaccaatgtcctatcaatttcttacaacacacagaacattttatggcttatgcatggtctgtcacactgtttgtgctgcctagaatactctttatttttgtgccagaaaaaaaccccacttcacatttttccccaagttggttcctggccttcatggctcctttttgatggcaaaaatttacctatattccatgcttgcttattaaaatacattcctaaactatgattatctaatgctggaagcttacatattccatttggtaaatggatgatgctgcccaaatggaatgtatggcaacatttcagatttcgttaccatgaacatttaaaccaaagtaaccaaagctttcccagatggtgaaatgaacagctaatttttgtaaacagaacagcaggtggtctcctaatttatctaaactcaaaggaaaaaaaacttgtttgtgaccttcagacagatactgactactggggaaaaatgatttttgtcagcttgtttatataaagttttaaatcactggtgcttggtgttttcctcctgttttaattgaaataattaattccaattagaataacaggcataactgtctttataaaatatttccattctagaagagatatagttcaacagcatttcttcaaataaaatactaccaaaatgtcattggacaaagtaggaatttatagaaatctgatagtgaattctactaggatatcacctcctaacttaaggtttccttaagtgtgcattctgaaaagctgcatcagcttcccttgctggaacctatcacacttccaaatttcttgccgctgtctcttcaagaagtgacaatggcaagatagacaggcagaagaaccagcacaagtgacaacaagtaggcaggaaggatcaatgcgtattcacagaatcaccagaacaatccaaatgaataatagcagaaggttcctgttggggaccagaagcaaatgcaggtatcgcagacatataaaacagaatctcagggaataggtccaaaaaaaattttttaacaagtaccctgccaccccaaataatacagatgctcataaatatttcaaaaccactgggctaagtcttcaatttggttcacctgcatttgttgctggtccccaacagggaccttctgctataattcatttggattgctatggtgattctgtgaacatgcattgctccttcctgtctacttgtcacttgtgcttggttcttttgcctatcttgctgttgtctcttcttttcatctttcattattttatttgcttctcaaatgttctgtactcaatgatacttttctgaaggatgccaactttcaccactgttactcaacatagtactggaagtcctagctagagcaatcagacaagagaaacatataaagggcatccaaactggaaaggaagaagtaaaactctccctgtttgcagatgatataatcttatatttggaaaaacctaaagacaccaccaaaaactattagaactaataaacaaattcagttaagttgagggatacaaaatcaacacacaaaaatcagtagcatttctaatgtcaacagtttacaaactggaaaataaattttaaaaagtagtagtccaatttacaatagccattaataaaatcaaatacctaggaattaaccaaataagtagaagttctccgtaatgaaaactgcaaaacgctgatgaaagaaattgaagaggacaccaaaaattggacaaatattccatgttcatggattagaagaatcaatattgttagaatgtccatactactcaaagcaatctacagattcaatgtaatcctatcaaaataccaatgatattcttcacagaaatagaaaaaaagtaccctaaaatttatatggaaccacaaaagacccagaatatccaaagctatcttaagcaaaaacaacaaaactggaggattcacactacctgacttcaaattatactacagcgctatagtaaccaaaatggcatggtactggcataagaacagatacataggccaatggaacagaataaagaacccagaaacaattccacacgcctacagtgaacttattttcaacaaaactgtcaagaacatagactggggaaagaccatcttttcaataaatggtgctgggaaaactggatatccatatgcagaagaatgaaacaagacccctatctcttgccatacataaaatcaaatcaaaatagattaagaggttaaatctaagacctcaaaattgtaaactactacaagaaaacgttgggaaaactctccaggacatcagcctgggcaaagattttctgagtaataccccacaagcacaggcaaccaatgcaaaaatggacaaatggaatcatatcaagttaaaaagtttctgcatggcaaaggaaacaaccaacaaagtgaagagacaacccacagaatgggaggaaatatttgcaaacaagccatttgacaaggggttaataaccagaatatataacaagttcaaacaactctaaaggaaaaaatctactcatctgattaaaaaatgggcaaaaatattggaatagacatttctcaaaaaaagacatacaaatgggaaacagacatgaaaaggtgctcaacatcattgatcaacagaggaatgcaactcaaaactataatgagatatcctctcaccccagttaaaatggcaaatggctttcatccaaaagacaggcaatagcaaatgctggaaagaatatagagcaaagggaaccctcgtccactgttggtaggaatgtaaattagtacaaccactatggagtccaatttggaagctcctataaaaaactaaaaattgagctaccatatgatccagcaatcccactgctggtatatatccaaaagaaaggaaatcagtatatcaaagagatatctacactccagtgtttgttgcagcactgttcacaatacctaagaattagaaacagtatctatcaacagatgaatggataaagaaaatttagtacatatacaaaatggagtacaattcagccataaacaagaatgaaatcctattatttgcagccacatagatggaacaggaggacactcagtaaaataagccaggcacaaaaagacagcattgcatgttctcacttatctgtgggatctaaaaatcaaaacagttgaattcatggacatagagagtagaaggatggttaccagaggcttggaatggtagtggggtgtggaggcagggatggttaatgggtacaaaaatatagttataaggaatgaataaggcctagtatttgataacacaacagggagactatagtcaataataatttaattgtacattttaagataactaagagtataattggattgtaacacaaaagataaacgcttgaaaggatggatatcccatgctccatgatgtgattattatgcattgtatacctgtgtcaaaatatctcatgtatcccatgaatatatacacctactatgtacccacaaacattaaaaataaaaatttaaaaaatgctctcctggaccctgtttttgggagaaatctctctctcttactaaactgtgttttcacacatattgaattgggagctttgtatgcaaattatcatcttagtcttctctcttctaggatgaatctcggtgttttactcactactgaaatcctgtacgtacttgtgtgcacaacatataccatccttcacacataaaaaacatgcaacaaaacttgaaaactagttatttggaagaaataaatatatattttatatagaggtttttttttaaaggaaagtattggcatatttcagcaaggtaacttgatgtgctaagatgaattcttgagacaaagatatgacttggtacagcttggtagagtaaagcctaaaggtacaatcttctaaacctgtgactgctcaggcttcccttctgctcagacccttttttctctacctcccatattccaaggacttctatgtggctgccctcattttggttaccttatattgatgtctttgccatgaatttggcccttgatgcccttgtcctttatcttggcttttaactcttacccagattaggtacaccatagctgttcagtgggtagggccagataccttcccttaacacatatacattcgtatgtaagagggtactttctgccaactgatgattaagttaactcagtgctaactggtgccataatatagcatagagctgtgtcacatagacccagtcctcagtgggtctctctgatgcaaaggaaaaagtgagtcctcggttcagatgacttttttcttctcctagcagccacaatattgctttagctcctagctcttggcctactcatttcaaacttagaaaaaaagctatggtattgaactgggacatagttcaggcccaggacagagattttaaattaatgtctggggtatccaagcatgtgaaggcatagacacatacatatgaaacccatttatactggatacaaaaacttagctgaaaatctttccagtcgaccacctcaaatagttggatccatttttaataaaagtaaggctgatttggtgcaactacctttcagttaggatcagaaggggtagatggtggtgaaagggctgaaaatagaggattccacctagaaagcacaaactaagctttaatattgtctttcttgagtaaattttacattgtgaattctggtctcactacccaacaaaaaccatgggtgagagaaattaatgtccttagctttcctctggagacatctttttgttctaacacagagaaatgtttgccaataaaaattcatacccaaatgagtacagttattggttaagatgaaatgtttctcatttgaaactttcatggttgttataaagaaaatttctgcatcccttcataaacgttgagactgactgaaactgactgagttaagttatagtatcaatgaatagccacacattttctactttaaaaatataagtgatcagagagccattcggctcaaaagaagatgattgtcatccagtcaggaggtttgttgaaccttatagaatacataagataaagttataaaatgatagcatcacttacacactgaagagttataattgagatgcccagttgctgatggtagctaagatgtttgtgtttttctgaaaaggactcaatgtggcctaatgttcttgccttctatgctatgaatccttcaaagcatcactcatgcattcaataaaactttattgtatgcctactatgtgccaagcactttgataggctctcaagtttgtgctattccttaaaactttttcctgctttgtgtcttaagacattgcatttccctcgttctgctccttagtcatagatgtagcctttgctttctcttatttacctctaaaatgtaggtgtttcccaggactttgtccatgttttcttctcttattctgtactccccctgggtagcatctctcagcacaatctctacatttatgtctcctaatttctacctctggcttctctcctgaattcaaaatacaaacttccagatgctctgctggcaaagtcatcatggctattctgttgataccttcttcatgatccaagtgatacataataccttctgcctaatcgccaactccaccttcaaacctgctccttcttccttatatcatttattggtaaatgtcactactgtattacctgtcctccatgttagaaacctaggcatctctgatgccttttttccttcctatcacatatattgagtctgctttcatagcctactaattctgcctttcctgtgagctctcttttttccatttccacctccaataccttattttagaccagtaattacaaactgacagcctgcaggccatatgtgtttctttcaacagcagtgtttatttttaaaaatgtaacatcctctaaaatgaacatatactctcgagttcaccatgtttctgctgtatcttcaatggtgctaagccagtaccttttatataatagatagttaggcagtatcttgaattgagtgacttgtcctcggaaagcttataacctggctggaaaacatgaaatatgtatatgtaaaatgatttagtaacaacccaaggcagactataagaagaatgtaaaagaaaagtggagcagacaattagtttttcatgtgatgagagaagggagagatcattttgggagtaaccagagaataattcacagaggaaaaggcatttgatcagagctttaaagagtggatagagattatgaaatattaaataaagttgctttattttgatgtttacatcctaagtaaggactttgttgcaaatactgtggattaatgagggagaatgggtacttatttccctcaaactccaaaccatgggacaaatgaaggggggagggcccgtgatgattgaaaagagtaaatataaaactgataggctgggtgcagtggctcacgcctgtaatcccagcactttgggaggctgaggcgggcggatcacaaggtcaggagatagagaccatcctggctaacatggtgaaaccctgtctctactaaaaatacaaaaaattagccaggtgtggtggcgggcgcctgtagtcccagctactcgggaggctaaggcaggagaatggtgtgaacccaggaggcagagcttgcagtgagccgagatcgcgccactgcactccagactgggagagagagtgagactccatctcacacacacacacacacacacacacaaacttgataaatggaggtgttactctaaagggtaagaagtacatttccaaaagtatcaatagcttcagatatatttagaactttcaacaaactcatttgataaatttatgaatggcaagacatgggttttaagagaaaccacaaagtttgggaaaagatgcttggaaagtaatcatgccttcctattatttgcttctttgttatctatttaaagattaaatatagggctgggctgtccatgctacaggcaggcccagaagccctgttttgatgttttcattacctacattctctcctacagtacagtgatatatattagaggactttgccttagttgatgttactgtcaggattgtaactagaattactcatatactctttgctgatgaagaggtaagcctgtaaacagcttagcaggaaagaccatgccttactttttttattagacacagcacctagaataatgcaacaaacatagaggctgttcctaaattccttttgatttcctctggctgaatctaaaggcaatatttgtttcttggagcctgaatcttcatctagcctcagacacaggttatacctacttcctgcctatccctcttccactattctctcctcctcagagcctgttgtactctgttatttttgaaagtccttgcaattccattatcatagcattgcatataggctagttctatggtgaggccaaggggagttaaattgcaattaccctactccagctgggcctagcaatactgcatttgaaaagagtcaggcttttgaaggatgacctttttcatcctttttttcttctccttcagcatcttttgctgccaccacctcctcctacaactgaccatctgaagcagtttaaatatctgctcatttaaaacagcagcacaggctgggtgcgatagctcatgactataatctcagcacttttggaggctgaggtggatggatcacctgaggtcaggagttcgagaccagcctggccaacgtggtgaaaccctgtgtcttctaaaaatacaaaaaaaattagcaagatgtggtggtgtgcgcctgtaatcccagctactcgggaggctgaggcaagagaatcacttgaacccaggaggcagaggttgcagtgagccaatatggcaccactgcacatcagcctgggtgacagagcaagactccatctcaaacaaacaaacaaataaataaataaatacaaacaaaacagcagtacagcaaactgacatgtggccccaaactgggatgttgtgctagtatctagcccatcactgtcaaacccaggagtctagtgttgtttttgatggtttctcttggatgctgtactttgttatatgccatgtaggttcctttttggaaagtctaggatttccccaaaacatatagggaatcgtgtatgaagtctccaaattaatagctcatctcagattttagttgttggaattctctcagcagatatattttcagaatctcatagttaataatatatggagcatttggaaagaaactaaagacagggagatgatggagaagttgggaagatatatgaaacatatgggtaggaggataaggggagatacattttaaactaaaacattaaaatgaaggatcaattttaaaaaatcaaaacccctgatttttctaatcacaatctaatgttatccttaggaggcccttatgcttataccaggctaagcacagagcagatatatcatctcagaaactacctgtctgctcaaaagcgtaaaggaaacttagtgagggaggcttctaattagaattaagagaaactgaggcagatgatgatcagatgtaatcagggtagacaatatacatagaacgaaagccaggttacttaattatattttaaactagattatgcaacatataatcagtggcatactaaggctggagccacggaagcagtccactccgggcacaggaaataaaggagtgcattgtctgtagagatataaaagcagtaataaatgtgattaataatcagtttgacttggtgtgcacattattatcactttggagtgcccaggcttaatccttggatttacctttcttttctgtctatatttactctttaagtaacttctatatgctgatgactctcaaattaaaatatctgtatctatccaactagtaactccacatctacatagtggaagtctaataaacacctcaaatgtaacatttccaaaattgaattcctagtatctccataaaacctgcagtcttccccatctcagttgatggggtcttcatccttctgattgctcacaccaaaattcttggagtcatccttgactcattcttcttttctcccacagcacaaccaatctatcaggaaatcatcttggctctaactttgaaatatttccagaatctgaggactcctcaccactctctctgttatcatcctggtctgagccatcatcatcatcatgacttgcctgatttactgcaaaaatctccaggctggtctccctgctaaactgagaataaaagcttaggctcctttagtggcccacaaggccatatatatctggtacttggataccactgtgacttcgtctcctgttcctctctccttcactcccttcacttcagccacattggccaccttgatgttccttaaacacacctgagcatcctggggaagtttcttctgcctgtgatgctcttccaccctgataactgcatgctttgtactccctcgtctctaggtctttgatccaatatcaccttcccagtgaggtttatcctgccctgcctgtttaatatgcaacttgtccccactccactcccacctccccatactctcaatccaccttactctgatctaggcttttctttgatgcatatcatttgttactttctaatttttcatgaaatttgcttattaattttgcttactgtttattgtctgtcttccctcactggaatgtaagtgtatatttttgctcacacattcccagtgtctcaatagttcctgcttggcatatagtatgtattcaataaattattgttgaatgaatacatgaattgtatttaactatatatatctattaattatggaagtaatttaactgactgaaattagagaaaccaggcatggggcacatctacacatcacaaccaggcacttcaacacagacttttttgttccctgaagcatttgtggatgtttgtgtattgtttcctttagattacaacctaatccttgacagaaattgtaagtgcttgttcatacatacttgcaattgcttactttctgccagtctaaatcaagaatatattataagaatttccctggtttgatgaatgtcacttactgcaattccttcttacacatttgcacatttactttttattgtttgtattttcttttcttttcttttttttttactgaagattgtttagaaagttctatataatatagaacttttaaaaataagcatgattgtttacctaccctctcatccatctagatatttccagtgagaaaaaaaggaaggcaaaaaagagaaatcacctggaaggttaccagaattaactcttaactggcatttaaaacctttaatctctaactgccctgtaaacaagatagtactttcatacttaactttctgtataaatcaagcaccttttttatacaaccttatgagaactgctagccatgtgacaaatattaagaattgatggccaggtgcagtggctcatgcctgtaatcccagcactttgggaggccgaggcaggcggatcacgaggtcaggagatcgagactatcctggctaacacggtgaaaccctgtctctactagaaatacaaaaaattagccgagcatgggggcgggagcctgtaatcccagctactccggaggctgacccaggagaatggcatgaacctgggaggcggagtttgctgtgagcggaaagatctcaccactgcactccagcctgggtgacaaagtgagactctgtgtcaaaaaagaaaatgtggcacatatacaccatggaatactatgcagccataaaaaatgatgagttcatgtcctttgcagggacatggatgaagctggaaaccatcattctcggtaaactatcgcaaggacaaaaaaccaaacaccacatgttctaactcataggtgggaattgaacaacgagatcacatggacacaggagggggaacatcacacactggggactgttgtggggtggggggaggggggaggcatagcattaggagatatacctaatgctaaatgatgagttaatgggtacagcacagcaacgtggcacatgtatacatatgtaacaaacctgcacgttgtgcacatgtaccctaaaacttaaagtataataataataaaagaaaagaaaaaattattatctgtatcttacaggcagggaacataatttagtaatttcatagaaaggtctatactgaactattacaaatgtttttaagtacctgatttttccccatcattaactgtggttttctcttcaaatttctttttcaactttcaacaagaacatcctgctgaagcttgtggccacatctagtacaattgtcctcaaaggcttgtgctgagaagaatggaagatcgctagatagcttcctagggcagtgtaggattgaagggaagagagaacctcagagcaaactcagttaattctgatttaatcattaatgaaccagacaacaggctatatttacgaaactgttaatcaaaacagacaggatgtaaatttctgggacaaaatgttgaaaatatcaattctgtagcaaggttaaacctgtttattatttatttaatctcaagacacagcagaccatttattgattaatgagaaataagaagcatgttgcaattaaatttaacttgtaagtcaggaggccctggcaatttggtctgatactatatgactttgggggatgaattttgaaaattcctactccaggataaggaagacctcatttatttctttccaaggtctcatatatcatgttttatcttaaaaggaaaacagggaaggacagcaattggctgcattctgaaatccaggcaatagatctaacatagctattctattaaaaaaaaaatgaggaatcctcgaacatagaaaacattctacacaaggttggtcaggtagctatgttgaagaggcaaagtccttggaaggcccatttgtcctcagaaaatcattagacacagctagtgaaattctgactctccatcaagcaaggcaaggctaactttgtatgtaggtaatatgttctttgcagtatttctttattttatgtcttttaaatgaaaaacaattaggaaagctacattgtaaatatttgtaaaaatagaatgagttttaaaagatttaccccactgctaccattcctataaaacttttattaatattttgatgtatttcatttcagtctttttttctatccataaaagttacatagttgtaatcatactgtccttacaattttgtatggtgctttttaaaacttaatattatatcataagcttttccaaactgttgtgaaattctcttaatcatgattttaatgtctgtaaaatgatccattgaatataccatgatggacatttaaattatttccaacttgaaccatagtaaataactatttggtggcatgtacccccatagttatttctccataactggatttttttctttaatgcagagacccacaaataaaatcattgggtcaaagaacatagctcttttagcgaattatattacagtttgattttgtttttacaaaaagtatagtgtgtgcctggaaagatacataggtacttaaaatttaacagtgattatttctgctgctgggtctacaaataaatactaacgaatagttgcttttctttcttttttacttttcgttattgtcaaagttttctttttttttttttctttctttttttcatgagatggagtctcactcactctgtttcccaggctggagagcagtggtgtgatcttggctcactgtaatctccatctcccaggttcaagtgattcccctgcctcagccccctgaatagctgggattacaagtgcatgccaccacacctggctaatttttctattttcagtagagacggggttttgccatgttggccaggctggtcttgaacccctggcctcaagtgatctacccacctcagcctcccaaagtgctgggattacacatgtgagccaccgctcctggcctttattgtcaaaaatttctacagtgaatatgtattcctttttaagttgagaaattataataggacaaagacagagtaaagtgtaatgacttaaactcgggctttagaggcagactcctgggtttgaatttctgcttagctagttactagctctgtgatcttaggcaagtaacctctttgggactcagctttcctgtctgtaaattaggataatgatggtacataagctgttgacctcatgtctgtgttgaggattaataaattaatccacatgaagtgctgaaaacaatgtctggtatataataaacaccccataaatgttcaatatcattgttatttgggactggacagcaattcaaaattcctatccctcatacagatcatgccaccctctctgaaattctaatgttggcaattcaatccagtatagttcattcataggacaagtatacttgactttacttaagaattgaagtgattagaagagggagcatctgaaactcagatccttctgccgtcttatatgtatacgttattctctgtgctctccagaatagtctaattgaagaaaaaaatgaggatatgctgagagccctggttatatgccataaatagctctggtttgaatgagagggaaatacaaggcagacttttaaagacagtaccttacaattttatctgtgacaggcactgaacttaaatattatgccatgaagtatgactatgaacatttatagaagtagatatgtcttggtacaaatctctgtcattcaaagatggctttcccctcgaagcaaaattgattgttttgcttcattgaacattgcaaaattggatatcttgtttactcttccatataccaaagatttataaggtacaatctattagtaaatataaaaatgagaaccgagtttcatttttaaaatacttttagacgactaatctacctagagacctacatttaattctggagaataatctataaattcttgaatagatatgtcaatgccctttatcataatcaccctagtttaaaaatcatttatcagatgcctactcaattatctacgtcgtatctttttatttcccagtataaacaaatacgcatactagggaagctcactgtgtgggatcaccagagaaattagttcatgcagtgaataattattattttttccatcggatagttaagctcaggattttcatctgtgtaacttataatgtatttctactatataacatagatgaggtcgtgttaatatgaagccctcctgcccttctgagacccaggacagtgtttggcagccttctgatgctttaatactttgaagaaaagaagtaaatattcatctaattatctggaaagttttttttttcatttcagagactcaatagcctatgtaaaatggacaccaaatcattatttcccaattaaacttttcttgctctgagcatgatagtggcatttttttaggccatccaccaaacaaagtgttgttcctcgttcctccagatgttaccatcttcttttcatgcccagggatatacaacggaatgtgtcctcaggaggtagttagaaattttgtttgcctacacttctaagtctcaaattaaaagacatcaactactggtgtatgccagtcattgcataagcacaggaatagacttaagctatttgtctaaatttccattccagggagcaacaagaaaatcataccaacagtataataaaaaggcatttgaagctcagggcatatctattgtctcctttatggcaggcttgagagaggaagatattatttggacgaggagtttacctaatatctgcgacatcactcaagcctactctaagcttttcttaaactgtcctttacttatgtagtgctgtaaagtaaaaataattaaaaaaaaacaagcattgtcttaagtggataccactgagcgtaaagcctacaaggtgtttgaatgggctgtctctcacttaagcctaataaactctgattgtattaggaaatgtagtttaataactcctgtaaaccgggagtcaacaattctgtgtcccagaaaaataaaatgaaataaaagagttggaaattattgagagctttgaacacacaatgtagtggatgaacacaggcatttcacttttgatttctatgagcagtaatttttttgttataaaaacaagaaaaaagaaaactactgtcatactcagatactcacttccctgtactagtataactcatgaggaaacaaaagctctccctatgagtaagctccagaatctatcagaaaataaatcaccttaattttcattgttattggaaagccttctgccaaatggggaagtagatgttgtactgactgaagcttcattttgtgacaacagcaacatagggtctgacttggaaggccttgaagaaggctgtaaggcctttgtaatacaggtttgcggggacaggactaacatcagtagacaagctagctgagatagagctggctttgactgatcggggctattatatttccaagatgcagcctagcctctgagtatcagaagcagcttaagtattaagggggtggtggtgctactgtagtttaaaagcagatttttaaaaaaagactttattgtgtaataatttagcattgagaaaaatagtaaatgtagctatttttttctccaggtagaactgttgaaagggacaattttaaacagccttcttcacttttagcagatataacacatagattgtccttggtgagaaaaaaggcttgatgtcaagtccagaagaaatgtgaatgtggaattgagtttgaaataaactgattcccaatgctcccattcataaaactgcatacagacctgtgtgttgagtgatgtacaatctttttgaaaattcactgatttatatcagtcattttattcctcaaactcttcttcatagcaccttccccatgcacccatacctccaggtacctggaaagggtttgtctttgtgtccatttcttgcttctgactcttgaaccaactgtataccctaagccaattgcacacatactatagagtataatggtctctggagtcaggcagaattgggcgtgatgcctgattggatcacttacagttatgtgatcctgaacaatgtaattaactttctgaacctagttttccacatatgtaaagtggagctaataatagcacctacccttgaggattattttttgcctggaggattaagcaaggtaatgtaataaagagctttgcacagtgcctagtaaacactcaaaaatagtggattctgctttcattttttgttggagtattgtaatttattcctcctcccgctcttccctctcttcctccatcatcatcatcatcatcatcatcatcatcatcatcatcatcagccaacatcacctatagaggctacctgggctacctggttacggttggtcatagactcatacctctaggccacagtttctcaaatagcagcactcttgacattttgagccggatagttcttggttggagtgggaagaggttagcctgtgccttgtaggatacttactgtaggatgctcatttaacagcatccctaccttctacatactggatgccagtagcacacatactccacacctttgtcgtcaagctatgcaaccaaaaatgtctccagacaatgtaaaatgtcctctggggagcaaaattgctcccagtcgaggaccactactctaggtattctttggcttaaaaatatccatgaaaagtatctaccattcatgtatctattactcttcattagtttgactcatttcatccagtaatcttggtctttatcttaaattctcctttagattttcagagttctctggtttttatcttgatttttgaaactaaatcttatttctctattttccttactacaaaccagcaattctttgatagccggttctgggccttaatatatctctgaactaacaacttactgttttttgctttgagctaccagcacttatctgcacacccctagtgctaggtcactggtatctagctagagcctttcctttaaatgtttttataaaaggcagttgaaatgaggactctagagccagatatcctgggttggaatcctggctcttccaattaatagcttagtgactttaacctctccattttcctccatttaagaaatgaatacattaacagtcactatttcatagagctgttgtgggacttggtggtttaaataaataaaaatttacttagaacactgtctggcatatggtaaataccatgtaagtgtaaactattattattactattctcataaagactcccatgtgtctttactagcataacataaactaaactgcaagccccatcttagtatgttatgaaacgccaggggttcagtgtagctcccattgctcacttcacagagagccaatcactgagacaatgtgtattgccagggaggaaaggctttattcaggtgctgcagcaaaggagacaggaaataaatctcaaatccgtgtctccaacaaactaaaagtgggggtttatatagcagggaaggagtgcagctatgtgcaagagaacaagaattaggagaaaggaagcaatcacgatgggtgaggggtctagtgtcttattgtttgaatgtggtgatctggtaagtttcagttccttgatagtatcagggaggcctgaagattggtttcctgaggaaggaactcagataagacaaatgtgagattcaagatttaagactgtgagggtcaatttctgtgtttattcaaaaagactataaacatcagttcttttggacaattggaccagtttcaagtgctctggaagactaccaatgttttcacctcatggtacatattgaaaattttaaatatgtattcagcaaattggagttaatcgtggtggctctgaccacttgaggactgaggtgatcaatatcttagccatgtgtaactgacttgtgacatgcagttgtccacagcactgtggtttgaaaactttgcaccaggctcatcaaaattaaaggggaaaggttttaaattgtaatccagttagaaattgtgatttcctttttggatgtgtaagatcccagcatcttctaggtccacaggccttgtaaggtctatagctgccctttagttttcttccttgaacaagctaaaataaaacaaaggcaatttctggggaatatcatgaggttttaaacatgtgtacatgtttctctctaatagttcagaatctagtaattcccacaagtataatggtatgagaatttaacccaacaatgttagagaacagcagctcttcattcaaatttcacatgatgacccactcattctattttgtaattttcttttgaaaggtttggggcagaaatagctcagatattttaaaaagagctattttctctgtttttctgtttgagtcctgtggctttcattttatggcatgagaggactgtttttcatttgtaacctctccaagtactgattttaagcaactcattaacatatgcttcctcttcataatccatcacattcaaacatttgattggtctcttcagcacaatatgaataataaactatcttcctcccagagacattcaaaattgtggtttagatatgatgaaccagaaaaaaatgttgttttttagtccactttttgaaaagtctcttagatgaaaggatactacaaatgaactttctaaggtaaatcagggctttggctaaaaaaagccaaacatttcagtcaaggtctgacttacaaagcatgctgtcagccctaccagaatatgtggcactggacacaatatacttcaatttttaatttctattgtcaatgccttcgtttatgcctttattagtttatgcctcaactttggtgatagctacatattggactgctttttctcttccaggacctcccatatgagttcttgaaacgtagctttgatagtatcatttcactccaccaaaaccttcaatggctccctaatgattgatgaataaattcctgggaatcatagaaatgctagaatgtcagtgttggaatgaatcctgaagtataattcaccagttgccaaactatggtctctggaccactgccagaagtttgcactagtcctcagtggaaagagaaaaataaggacaatgaagtcagtgttccataaaatgaaatttacttattttaaaaattatttaaaagtatcttgaggttgggcatggtggctcacgcccgtaatcccagcactttgggaggtcgaggcgggtggatcgtctgaggttggaagttcaagagcagcctgaccaacatagagaaaacccgtctccactaaaattacaaaattagccgggcatggtggtacacgcctataatcccagctaactggggaggctgaggcaggagaatcgcttgaacccaggaggcagaggttgcagtgatccaagatcatgccctcgcactccagcctgggcaacaagagcaaaactcttgtctcatgactaaaacaccaaaagcaatggcaacaaaagccaaaattgacaaatgggatctaattaaactaaagaacttctgcagaggaaaagaaactatcctcagagtgaacaggcaaactacagaatgggagaacatgttttgcaatctatccatctgacaaagggctaatatccagaatctacaaagaacttaaacaaatttaaatgaaaaaaaacaaccccatcaaaaagttgccgaaggatatgaacaggcacttctcaaaagaagacatttatgcagccaacaaacatatgaaaaaagctcatcatcactggtcattagagaaatgcaaatcaaaaccaaaatgagataccatcccacgccagttagaatggtcatcattaaaaagtcaggaaacaacacatgctagagaggatgtggagaaacaggaacacttttacactgttggtgggagtgtaaattacttcgaacattgtggaagacagtgtggcaattcctcaaggacctagaaccagaaatccagaaatacgatttgacccagcaatctcattactgggtatatatccaaaggaatataaatcattctactataaagacacatgcacacatatatttattgtgacactattcacaatagcaaagactcggaaccaacccaaatgcccatagtgatagactggataaagaaaatgtggcacatatacaccatgcaatgctatgcagctgtataaaaggatgagttcatgtcctttgcagggacatggatgaagctggaaaccatcattctcagcaaactaacacaagaacagaaaaccaaacaccacatgttctcactcttaagtgggagttgaaaaatgagaacacatggacacagggaggggaacatcacacactggggcctgtcagtgggtggggggctaggggagggatagcattaagagaaatatgtaatgtagatgacgggttgatgggtgcagcaaaccaccatggcgcatgtatacctatgtaacaaacctgcacattctgcacttgtaccccagaacttaaagtataataataataaaaaaaatcttgaactttgttttgaaatatcttttattttatatagtgacagcattaatagataataatttatttgtttattgtttttaatgtccatacttggcaaaatgaagttggcaaccatttgttgcttcacgtcccccatcccccactttttatttttattttttattttttctgagacagggtctggctctgttgtccaggctggactgcagtggcatgaactcagctcactgcaaccttcttcctcagcctcccaagtcacttggactacaggctcatgccaccacatccagctaatttaaaaaacaatttttttttctagagacagggttttgccatgttgcccaagctggtctcaaaatcctgacctcaagagatctgcctgcctcagccttacaaagtactgggattacaggcgtgagccatggcacctagctgccaccccgaactttttaaattttacaaatccatgaaatccaaaatctgaaagctactcatttcataaatgagaaaatttaaaaaagaaagattaaatgacttacctaaggccatacttatactgggaatgctgtattacaaatgttaatattagcttcaagtctttaccataaatttcaaagtcctctgtacttaaatcccagtatgcatttgcgtctctattatcagcatatcttaaaagaaaacctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgaggtggtatctcattgtggttttgatttgcatttctctgatggccagtggtgatgagcattttttcatgtgtcttttggctgcataaatgtcttcttttgagaagtgtctgttcatatccttcgcccacttgttgatggggttgtttgtttctttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgtttttgtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttttcaagcaccatttattaaatagggaatcctttccccatttcttgtttttgtcaggtttgtcaaagatcagatagttgtagatacgcggcattatttctgagggctctgttctgttccattggtctatatatctgtttaggtaccagtaccatgctgttttggttactgtaggcttgtagtatagtttgaagtcaggtagtgtgatgcctccagctttgttcttttggcttagaattgacttggcaacgcgggctcttttttggttccatatgaactttaaagtagtttttttccaattctgtgaagaaagtcattggaagcttgatggggatagcattgaatctataaattaccttgggcagtatggccattttcacgatattgcttcttcctatccatgagcatggaatgttcttccatttgtttgtatcctcttttatttcattgagcagtggtttgtggatctccttgaagaggtccttcacatcccttgtaagctggattcctaggtattttattctctttgaagcaattgtgaatgggagttcactcatgatttggctctgtgtttgtctgttattggtgtataagaatgcttgtgatttttgcacattgattttgtatcctaagactttactgaagttgcctatcagcttaaggagattttgggctgaggcgatggggttttctagatacacaatcatgtcatctgcaaacagggacaatttgacttcctcttttcctaattgaatactctttatttccttctcctgcctgattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaggtatgtcccatcaatacctaaaaataccatttgacccagccatcccattactgggtatatacccaaaggattataaatcatgctgctataaagacacatgcacacgtatgtttattgcagcagtattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcccaaggacaaaaaaccaaacactgcatgttctcactcataggtgggaattgaacagtgagaacacatggacacaggaaggggaacatcacacaccagtgcctgttgtggggtggggggagggggaaggatagcattaggagatatagctaatgttaaatgacgagttgatgggtgcagcacaccaacacggcacatgtgtacatatgtaacaaacctgcacattgtgcacatgtaccctaaaacttaaagtataatacaaaaaaagaaaacctatattctaaacagtcatgatcattttccattccttaaatgtgccttgcagttgttctttaccctacctattctcctaaaatcccacccagctcaagtgctgactctattaccatacctcaatgtcagaagggatcctttgcttttctgtgcttccatatgtggatgctacttatcagcatattatgtcttgttcaacctgtcatcgtctgtggactattccccctcctatgctctccatttcagtaaatgacattaccctctacccaattgctcaagctggaggccttgaagtcattcctttctgttccctataccaatattgagttaatcacaaagccctgtcatctttagctccccaatttatcctgtatatgtccactttaattcttccactgaactgctacacagatcaccctgtgtctccttgttccaccatgcaatccattttttacctaccggccgcttttagatctggtactgctccttgtaaaatcctttggtggttttccatagccctcagattaaagcctagaatgtcaacatgttaatacaagatatgtggtacccatgcccacttctccagcctcatctcttcctactttttaatttgcgtcctttgctttagctgtactggatttcagttccttgaatgcatctgtctcactattgcatgcttttgcttgccgattttaattgcctctcacttctctggatcttcacacatgctatggagtgaagcctacactgcctgcaatactcttccttctaggaaacataccttaaggctctaagtttcagtttgggtgcgccgtagcagagtacctttcctttaccatagcactcaccacattatattgcaatttcttgtttaactgatttcctttctaactagactatatgaaccatgaggccatggatcatctttatgttgctcaccattgcattcaaactgtcagctctggcacatagtaggtactcaataaatgtaatctgtatgaatcaaaatatcatactacatttcctcttatactgttgagactttcatatttgtggtatttccttgattctattacaaattcctataagtggaaggcagtcttttataattactaccattttatagcaccacacacataggctgctggtaaatatttgataaatagatgaataatctatttttttcttacagggtcgcgggtaagaattagagtgcatatttgtaataaacatagaatgcagcacaacaaaataggctatacaatctaagaagtttggactaatactagtattgattgtttatagcctaaaaggtgccccccaccaccgtaaaatacctgctttaaattgggaaatactctatggtttcatcaaggttaaatacgattttacaaatagggattctgatacatttcaagggtaataaaaaatgtaaaaatcttaaaatgacttgtgatgccttgactgctgtggggtgtgtgtgtatgtgtgtgtgtatgtgtgtgtgtgtgtgtgtgtggtttgtttcttgggggctgaactcagctggagtttccatgaagttatgggtagggtgatagatttacattgaaatatttcactttatccaaaagttagttcagtttttcttaatgggagattttttcaattgagaatatatttttgcacttcatgtttattgattctctttccaacatccagaacatacagcaatatcatcagtcatagatagttcatattgcacataatgggctctaatatcagtctgtttgtatatatcataatacctgaattgttcaacaaaatatctcataaggcaggaagcttcttttctgttttctgtttttgatagactcaacctaaatggataatgttctttgtaaaaggtgagcaaaacatcagcactggtgatatttattttacaggatgtgccacaagcctggctcactcctcttacttagaagggcattacctgctgagaccatttggatttgttgagtccagtgcaaactgaaacagtgacctatgtgaatgacagccaggtaaatgtcagaggacaatgccaaaaagacatattaagttcaggagttgaaattgtggtaagcattagtgcccatcctcaaagaagtcttctctgactttcctgtgcaaggcagtttcctcgctccccaatttatgatgctatatcaaactcaacaaaccttggtaatggattgaatgatgtgggtgaaggaacagaaggaagaatcaagaatgtcttggccctaggattattatctggctcacggtaagctctaaataaatatctgttgaaagaaaaaatagctgggaataatacacattttgtcaccctcagccacactatgcagactataaaattgatgcttgtttacatcattaggtggccatatttacattaaaaccacagttttaagagccaaaaaatcctgggttcaaatcctgacttcaccatttgagctatgagacattaggagagttacttaactgagtctttctttctcttcttataaaaaggaaatcatctcataccaccctcacaagatgatggtgaagattagatgagataatacatttatcgtacttagaagaatacctggcagaaagtattcgtagagggtagttatcattgttgtcagaatgtaatgtacttaagtgtcttgaaaatagtaaatattcaataattgttatctaaaagtattataattatcactaccataatagttttatagtaaattattttcagtagaatgcttatggtgacaaaaattacactttttcatattattgcacacaaatttttagtcttaatttcagtaattgttatttcttaaaatatttggtatagacatgggatatctttttatttaaatcaataaagggaatggttgttgctcttataatttatgcaaattgttcataaatgaataaattaaagcatttatttgtactaactctggtagtttgctaaaaaaaaaatcaggacaggctaaaagaagatatggatataacggctgcattgtttttgctttttttgataaaccatatttcaaattcattcacagacattttcgctttcatgaatccaagatatcttctctagtttctaaaagtatatatacacatatacacacacaaggtatacatatactcacacattcacaatattaaaatgtttgggctaggtgtggtggctcatacctgtaattccagtaatttgggaggccaaggcatgaggagctagaggaggctgagttgataggattgcttgagcccaagagtttgaggctgcagtgagctatgattgcaccactgcactccagcacctggatgacagagcaatatcctatttctaaaaaaaaaaaaaaaaaaaaaaaaaaaaagtttgctgcctgctgctgcctaggaccacaatggagaatggagaatagttgaagaaagtgcagtacagaagtttaggcaagtggtaattgttgttggtatccatagattgagccaatgcaaatttgcaggctttagaaagatacctctgctgttctccagatttattttctaatttcaccttatatgttttttttcctacacgtttttcttttactgtctcataaattttatgtcagtatgctatgactggatatttaggaggaaacaaaattgcattgttaaaaagttcagtctttttttttttttttcttgaaaatgagctgctaactgggcacagtggctcacgcctgtaatcccagcactctggaaggccgaggcaggcaggtcacttgagctcaggagttcaagaccagcatggtgaacatagtaaaaccttatctctacaaaaaatacaaaaattagcttggcattttcccacatgcctgtagtcacagctactcaagacgatgaggtggaaggactgcttgagctgggtggtcgaggctgcagtgagctgtgttcacaccactgcactccagcctgggcaatagagtgagaccctgtctcaaaaaaaaaaaacacaacaacaaacaaaaaaaaaaaaagaaaaagaaaatgggttgctttttaatgctatggttagtggttagcaaaccaatagcatcaatccagaatcttcatcgaataactatggtgtgtcgcattctaagggagtaaatggagtaagtatgagactttggctctgtaaggaagtaagaaaagtgaaagacaaaattgagcagaagtagaagctgaccgataatgtagttgctacggcctcagcagatcttacagggagatctggagttaggatgggtctctggatgattatcccaaattgaaacaagggggctaggcttttgaattccttcatcaggcagtctttggccatacgccactccctgctaaggtgttacctttgggcatacagctccttatagccaaggacaattcccattgttgtggctctagctgcaaggattggtaacttgatattctcaacagttgtgggataggtgcattggcccctaaagaacctacccttgaccaagcaccagagcatttactataaggcattgcaacttgaactgccctttaaaggctggatagaatttaagtagatgtagaggagaattgacatatatgcattcctgggtggggaatggtatgggaaaggacaggctgtactggagacagcaaataaatcagattttaattcagcttatatttattgaattactactttgtaaaggtactatgttgtgctgggaattttcataatgtggtacctcatttaattgttataaccctttgatttaaatattatttccattttatatatgaggaaaatgtatctcagcatggttatgaattgcccaaagtcacccatgaaaacagtattagagctggcactcaaatccaagtttcctagctctaaagactctgctttttctgctacaccatgttcatatgtctaaaaatggaaaattacacttacaaatggtggcagtagattatggagagtctataggatacattctggttcttggtcccatactttattgttttggtctctagttgtctcagaaattaactgtaatttaataataataataatacatttagtaatagtagttttaattaccattggttatcgttcaccaatactatgttaaatttactcactctttctctgtggattattgcattgagtctttactgtaaatctgaaaaaggtagtattgtttttattttatgtatgaggtaactgaaacttagaaattgtccacgatcacatagcaagaatgtgacagagctgacattagaacccaggtctctctgactcctaaagtccatgattttaagcactacattttaagcctacctctttgtatgttttatagtcctttatacatcaccgagcacatggttttgtgctattactatacttaactattacttatcaccttagcaacttgggataagtaattttgtctgtctgcttcagtgtctaaaatttttactcaagtgaagcaatacctacccatggctaatgggaatactatatgagaccagagagtgaagcagtgaactcaaaaaaatgggcttatacctgatttctttcaggctctaggcctatgtcaattggattgattttattcattgtttcatgcctactcttcatccatcctttattacaacaaatatttattgagtcttactgtgtgcctgtcactgttctagatggtgaaaaaaaggcaaagtcctgtcctcatagagtgtacgttctagagagtgagacagttgattcactactaaatatataaataaataataactcaagatagtaataggtgctctggaaaaaaattaaagcctggaagagaatgggaagtggcatagggtggggaagggggctgataatttagatagggtggtcaggagaggctttttgataagatgatataaaagtagagacctgtgggaagaaaagtaagccatacagatattttgaggaatagtgttataggcagagaaagtgaataacaagtgtgaaagcccaggggtaggagcttgactggcatgtttgagagccaccaagatccaattaatgatatgttattataatattttgccaaatgactcaccagtgatataaaagatttaaaagccgtttccaaagtatttccctgtagagcagatttggaatgtgatgaaagagggaacaggaccaatgggaaaatattaaagtgtttgaagccaactcatcaggatgaaataaatgagatgggctatttaatgattatctatagcagttccatataaggtttttataaagaagcagtggaatagccttctaaagactaagctcttccctttctcttaggaggtaggtacgaattagaaaattaatcaagagagaatgtggcctctgatgacatgagagttgtttgaaggtggcaggaggcaggagggtggttgcattcagtcaatagttgagcaatttacaaaaataaatagaattgagcaaattcagaacagatttaatctccattttattttcaagctaaacaaaagatgctgatataagggggaaattactccaaaaatccagctttactgacatattttgagtcatttgcatgaataaaatggtcctagagacaagtgcgaacttgactttaaagtgaataggcctggaagtgttttctgacggagaattagtttggtgcattcattcaatatttattgatataatatttatattcatgttattccaaaaaagagttgaagcagattgcaaagctatgtatataatccacaatacaaaaactaagagatgaaatcaggaggaaataataagaataggagaaataagataaggtcaagtttgggtaaaataaatgtctaaactgtatgtcgtagttagagacaggccacacacatttagctctgagatttctagaaacaactgaaagagtcctggaaactgagataatagacttgtattgtgttaagccactaaactctctttcaaaccattccttagttctcaagggaagacatgaggatgggataaacctccaggggaattggggtactaactttcataaagatttttacttcttgaagaggacttaatttcaagtctatgtagaagcagaataaatgggttatgtgattgtttaaggttgctgaaagatctttccttatatgtagaaacctgtattggcttttgagctacttgaatgtagcaaactaaatattctggaataggatctgtcatcctctacatgggacgctcttttgtatgatacccatccactcttttgcactttgaacatttcaggcctttactgagtatgtaattactgactgctaaacaattatgtcatttgctgaattcctttatcaccagacacataatcatcagttcaaaaacaattaggcaagattctcattgatcttcagaatgtccttaaagcttttcaacttataattaacacatatacttgtcttctttcctttagcacacgtgaaacagaatagtgttcctgctgtaggattttcatcatttgccaatcttcactgtaatccttgaaaatgtgaaggtggatggatgcattttactttacaattcagtgtgataaaacccacagctgctgttcaaagttctatttaatttagaagggaaaggactacttttatcgtgcaggagattgattgaattatataattctctcaaataaggtagataataaaattttaagatatattttacaatttcactattatatactacctagaaggctagctatttttattccttcacagcctgagggggtaggaagttttataaactccacgcccgccccccaaagactacaggttctatcctcaacaataaaggaccctacagtgttatcagtgagagaaattattctgactaagcaggtctgttatttcactaaaatatcgcttatgccttctaatctcaacattccagaaaatgtatttaaaaaacaggcaggctatcagtaaaaaagaaaaccaaaaataaatctaaatattttgttcagttaatgatcagtgtgatttatttatttttattgtatatatttgtagggaataatgtgatattttgatctatgtgtatattgtagaaagagtctatcaagttaacatatccattttatgtttttgtggtgagaatgttaacaatctattgttttagtaactttagaatatacattattattaactgtggttatcatgcagtgcaatagatcaataaaacttatctttccagtctaacagaaactttgtaccctttgagcaacatctccctttgtcttatcccttttcctcccctctcctttaccctctggtaaccacctttctattctctgtttctatgagattagcttttttagatttcacatatgagtgagggcatgcagtatttgtctttttgtgtctggcttatttcacttagaataataccctccagattaatctatgttgtcacaaatgacagaatatcctcattttttaaggctgtatagtattgcattatgtatatgtgtgtataaatgttatatacatgtgtttatatatatgtgtgtatatatatataatatatatatatatatataatatatatatatatatatatattcttcattcattcattgatgaacacttaggttgcttccatatcattgctattataaataatgcagcaatgaacaagggaatgcagatatcgctttgacatactgattacaattttttttggaggtatgcccagaagtgagattgttgtatcatatggtaattctagtttagttttttgaggaacctctatgctactttccaaaatggctgtaataatttacattcccaccaacagtataaaagggttcttttttctccatatctttgccaacacttgttagcattcatctttttgataatagccattctaacagttgtgaagtgatacctcattatgaatttaatttttatttctctgataattagaaattttgagcatattttttatatatctcttggccattcatatctcttcttttaagaaatatatatttagatcctttgcccaattttttaaacctggtgatttgtttccttgctattgagttatttgggttccttatatgtttttgatattagccccttatcagatgtattgtttgcaaatattttctcccaatccatgggttatcacttcactctgtttcttttgctgtgcaaattctttttagtttgatgcaatctaatatatttttgctcttgttgcctatgcttttgtagttctattcaagaaatcattggagcttttccctgtgttttcttatagcggctttacagttacaggtcttacgtttaagtcttttatccattttgatttgatttttgtttatgatggaagataggggtccaatttcgttcttctacctgtggctattcagttttcccaacacaatttattgaagagactattcttccccgttgtatgttcttggcacctatatcaaaaattaattcactataaatacttgattttatttctgtgctttctgtccttttccattggtcaatgtatctctttttatgccagtacaatgctgttttgattacaatagctttatagtatattttgaaatcaggcagcatgatgcctccagattttttctttatgctagagattgctttggctctttggggtttttttctggttccatatgaattttaggattgttttttctatttttgtgaaaaaatgatgttagaaatttgatagggattacactgaatctttagatcactttgggtattacaggtgttttaataatattccttcaatctgtacagggtatatttttccatttatttgtgtctccctcaattttttaatcaatgttttacaattttcagtgtgcagatacttcacctccttggataaatttactcctaattacttttttgatgttcttgtaaatgacgttttaaaaaaaatcagatagctcattgttaatgtacagaaatgctacttattttgtatgttgatttggttatgtgcaactttactgaatttctttattgattctaatagttttttgtggaatctttagggtttttctacgtataacatcatgtcatcagcaaacagagacagtttcactttttccttacctatatggatgcattttatttctttttcttgcctaattgctttagctaggacttccagtactatgtagaatataaaaggcaagagtgtacatccttgtcttgttcctgctcatcaaagaaaagattttaacctttcttgttgagtatgatgttagctataggcttgacatatatggcctttattgtgttgaggtacattccttctataccaatttttctgagggtttttattatgaacagatgttgagtgttattgcaggctttttctgcatctattgagatgatcatgtggtttttgtccttcattttgttaatataatatatcacatttattgatttacatatgttgatgtatccttgcattcttaggatagatcctgcttgatcatggtgagtggtctttttaatgtgctgttcagttcaatttgctactacattgttcaggctttttgcttctatgttcattaggaatattggcctgtagttttgttttcttgtgtccttgtctggctttgaaatcagggtgatggtgttcttataaaataactttgggagtattccctcctcttaaatttttttgggggagagtttgagaaagattggtattagttatctaaatatttggtagaattcagcagcaaaaccaacagactcttggcttttctttaatgggagattttttattagtgattcaatatccgtactcagtaatgatctttttagatattctgtttcttcttgatatggtcttagcagggtacatgattctaggaaatcatccagtctttttaggttatctaatttgttgatgtatagtttgtcatagtagtttattatcttcctttttattttgtggtatcaattgtaatgtctcctcttttatttaggattttgtttgtattttctcttttttaattcttttttgagacagtattgctctgtcacccaggctggagtgcagtggcatgatcttgactcattgcagtctctgcctcctgggttcaagcgattctcgtgcttcagcctcttgagtagctgggactacaggtgcacaccaccagacctggctaatttctttctttttttttttttgaaacagagtttcactcttgttgcccaggctggagtgcaatggcacagtctcgcctcactgcaacctccacctcctgggttcaagcaatccgcctgcctcagcttcctaagtaactgggattacaggcgcctgccatcacgcctggctaatttttgtatttttagtgagatggggttttataatattgtccaggctggtctcgaactcctaacctcaagtgatctgcccacctcagcctcctaaagtacagggattacgggcatgagtcagtgtgcccggcctgtgtcttctcttttttctttgttagtctagctaaagttatgtcagttttgtttatcttttcaaaaacacaacttttagtattgttggtctctttttctagtttcttattttttttccttctctgatctttattattttcttctttctgctaagtttgggcttagtgtatgattttttctaatttcataggttgtttatttaaaatttttatttttttaagtcaggtttttgtcactttgaacttccctcttaaaactgcttttgctgcattccataaagcttgctgtgttgttttcattttctttatctcaagatattttttatttttatttttatttcttcttcaacccattggttgttcagaagtatgttgtctaatttccacatatgtgtgcattttctaagattcatccttttattgatttctagttttatgccattgtagtcggaaaagatactcaatatgatttcagtcttcttaaatttgttaaaatttgttttatggcctaacagattatctgtcctggaatgcttcgtgtgtacttgagaggaatgtgtattttgttcctgttgggtgaactagtctgtaaatatctattaggtgtttttgtctaaagtctagttcaaatccaatgttttcttattgattatctgtctagatgatctgtccaaaattgaaactggggtgcttaagtcttctgctattattgaattataatttatctctccatttagttctatatttgcttgattagttgccctgatgttggacatatatatacttgcaattgttatgacttcttgatgaatttacccctttattattatttaatgaccttctttatctctttttacagattttgacttaacatccacattatctaatataaatatagttaccctgctcccctttgctttttatttctatggaatatcttttcagtaccttcactttgagtctatatgtgtctttagagataaagtgagtgtcttgtaggcagcatgtagttagttcttgttttttatatccattcagtcacatagtgtcttttgattggagaatttaattcatttaaacttaagtccttacctatcaataattacctattactatttacttacctattggcatttgttaattgttttcttgttaatttgcagatcctttgttctttttttcctctcttgatatcttcctttgtggtttaatgattttctttaatggtttaccttgaatcatttctttttgcattttgtgtatctactaagaatttttcattatggctaacatggggcttatataaataatcttaaaacatgttatactaataacagaatattttaagctggtgacaacttaactttgaacacttgcacacactctacgttttatgccttcccacactttgtttttcatgacacattttgtatcttttatagtttatatcccttaacaaatgattgtatctatggttgtttataatagttttatcttttaactttcatagtagatataattgattttcacaccatcatttcagtataagaatgttcttagtttgactatgtatttacttttaccagtcagttttattttttcatatattttcatgttgctacttagcaacattttccattggcttgaaggaattcttttagtatttcttatgaggtggtctagtggtgataaattatcttagcttttgattgtctgagaaagtttttttttaatctccccttcatttttgaaggacaagattgcagggtgctatggtttgagtttgtctcctctgaaacttgtgttgaaatttgatccctaatgtgttggtgttgagaaataaggcccagtgggaggtttttgggtcgtggggacacatccctcttaaataaattaatgtccttctctggcaggaatttctcactctcataggagtagattagttcctaagagagaaggttatttaaaaaaatctggcttccttggtttctctctcttgcatcctgtcttgccatatgatctctttgcatgtgtctattttatttctgctttctgccataagtggaagcagcctgaggcccttaccaaattcaacaacccaattctggacttcctaagcaccaaaattgtgaaccaaataaacttactttcttcataaattacccagtctcaggttatagcaacactaaatagattaagacactgggtatagtattgttagttggcatattttttctttcagctttatgaatatatcattctattccctctggcctgcaggggttctgttgaaaaaatctgctggtaatcttagagaagtttctctgtatataacaattcactttttctttgcagctttcaatattctacctttgtctttaacctttgacagtttaattattaagtgttttggtgtgagtttctttgaattcatcctattatagatgactgttaagcttactgaatctgaatttctattttcttcctcacacttgggaagttttctgccatgatttctttgaatatatttttctgttcctttctctcctccttcgggtacactgaaaatgtgtatcatattctgtatgatggtgtcccataaatcccttgggctgtctttaatcttttttattcttttccctttttgcttctcagattggatatttaccagtgacctgtcttcctgtcttcttctgcttgatcaagtctgatgttgaacctcttgttggattgtttcatttagttaatatattcttttgctcaattattcatgtttgatactttttaatattttctgtcactttgttaaagttctcaatttgatcatgcattgctctccttaattcagtgagcatctttatgatgatccttttgattttcctgtcaggtaaatcacatatctccatttcattaaggtctacttttggagatatatcttgttcattaatttgaaaaacatctctctatttcttcattttacttgactctctgatactttctgtgaattagataaaaattctcctctctcagtcttattagactggtctcatggaggagatatttctcaccaatcagcccacccagagattcttagtgcctctaaattccttgtgcttgtccaacctgctgttattcttcttattggattcccccaaattagacagtgtcaagtcatgttattgccttgagtaaggtgagattgaagccagtcctttgagatacagctggagaggttggggtgttagatgtgtgttccagcttttcctttccttgcagagaagctgggggctagattttatctcacatttattctgccgtaaccaaagtggagggtctgagacatatgactgtattcttgatcagactgctcattttgaacctggggagatagctgctgaatgtttgtaattttaaaagtcatctttttgttttctgtagtttaggagactcaggactgcacagacccaacaacttctagagctatttgatttaggagtgagttgctggtaagggctataaaagttgagatgctctatctgtgccaaatctacttccatggagagtctgaaaacctggatttattgctggagcaagccagggaagaatgtgtggggcatgaccactctcctgttagagcaagcagaatattcatttcaaaagtggtaaactgaccatatacaggtccatatatctattctgttttaaaattttcactagttgccatcatttaagcagctaagactaacataaaaatctgtttagcttcactttaattcccttataccaataacatctagaactgagtagcaaccatgccttttcaaaagggaatatattttccaggttatgcaagtcactactcttccctattttcttacaccttggcccattcatttaattatattgccagcctgacttctatagcagataagttggggaactcttgttattttgcaagagataaatatttattttatcttattttttagacttttaggttcaggggtgcacatgcaaatttgttacataggcaaattgcatatcatgggggtttggtgtacagattattttgtcacccaggttatgagcatagtacccaatacgtactttttctatcctaaccctcctcccaccctccaccatcaaataggccctggtgtctattgttccctttttttgtgtccatgtgtacaaatttttagctccatcttgtaagtgagaacatgtggtatttggttttcttttcttgtattaatttacttaggataatggcctccagccccatccatgttcctgcaaatgacatgatataattcttttttcatgggtgcgtagtattctatggtgtatatgtaacacattttctttacctagtctaccattgataggtacttaggttgattccatgtctttgctcttgtgaacagtgctgcaatgaacatatacatgcatgtgtctttatggcagaatgatttatatttctttaggtatatacccaataatgggattgctgggtcaaatggtagttctcttttaagttatttgagaaatcaccaaactgctttccacatggctgaacatggctttccacgtgggatttacattcccaccagcagagtataagtgttccctcttcactgcagccttgcaagcacctgttgttttttgactttttaataatagtcattctgactggtgtgagatgttatcttattgtggttttgatgtacatttatctaatgactagtgatattgatcatcttttatgtttgttggctgcatgtatgtcttcttttgaaaaatgtctgttcatgtcttttgcccactttttaatgggcttgttttttgttaatttattcaagttctttatagattctggacattagacctttgtcagatgcacagtttgcaaatacttcctcccattatgtaggttgtctctttattgtattgacaatttcttttgctgtgaagaagttctttagtttagttaagtcccatttgtcaaattttatcttcattgcaattgcttttgatgtcttcatcatgaaatctttgcaagggctgatgtccagaatggtatttcctaggttttcttctatagtttttatagttttatgatgttacatttaaatctttaatccatctcgagttgatttttatatatcgtaaaaggaatgggtccagtttcaatccactgcataaggctagccagttatccctattttgaaaaaattagaagacaaaagtaaggaacaaaaaattaccatctatagacctaccactcagagtcagccaaacttcatatttggtatatatttttcagttcattctttcagatagatcagtaggtaggtatgtaaacagccagccaaccagatatgtttagaatatttttatgctaatgatgatagatcaatattatttattatttttcttatttcaatgaagacagattgttcagagaatgaggttttaagttacttttatagtaaactgagagatgaacacaaacaccatttgttttaatgctttgcatggaaagatccttcaaatatgccattataatttttggtgcaataaaccagtgatgaagattcaagtagactagtctagactaggatatttaaaatccttatggtccttgatatctgagatgatatcccgttcagggaatggaagtagttgaggaaggtataatagattggtactgaattcaggatgacccctaaatcttgaagcttcacataaattcatttctcttcatgcctcctgagctggaattctctccatagcatcattttcacaggtttttaagttcatacttgaatgcctctaacaacagaagacttattacctcttaagctacaacctgtcctttttaaccaactattaaaaaggtcttttaggttaggcacagtggctcacgactgtaatcccagcactttgggaggccgaggtgggcagatcacttgagtccaggagtttgggaccagcctggccaacgtggtgaaaccccatctctactaaaaatataaaaattagccaggcatggtggtgcatgcctgtaatcccagctactttagagaccgaggcaggagaattgcttgaacccaggaggcggaggttgcagtgagccaagattgcaccactgcactccagcctaggcgacagagtgagaccctatctcaaaaaaaaaaaaaaagtcttttaatcagcttaaatgtgggttcctaaaactttttaatgtttaagttcaggggtacatgtgcagttttgttaataggtaaacttgtgtcatggggtttgttgtacggattatttcttcacccaggtattaagcctaatatccattggtcatttttcctgatcctttccatgctcccaacctccaccctccggtaggccccagcatctgttgttcccctccacatgtccatgtattctcattatttagctcccacttataagtgagaacatgtggtatttggttttcagttcctgcattagtttgctaaggataatggcctccagctccatccatgttcctgtaaagcatgatttcattcttttttatggctgcatagtattccatgatatatatgtaccataatatggctgcatagtattccatgatatatatgtaccacatttgctttatcccttctaccattgatgggcatttaggtttattccatttctgtgctattgcaaatagtgctgcaattaacatatgtttgcatgtgtctttatgatagaacaatttatattcctttgggtatatacccagtaatgggattgctgcgatgaatggtagttctgtttttaggtctttgagtaagtgtcacactgttttccacaacagctaaactaatttacattcccaccaatggtgtataagcattcctttttcttcataatcttgccagcatctgttattttttgactttttaatagtagacattctaactggtatgagatgaaatcacattgtggttttgacctgcatttctctaatgatcagtgatactgagcttttttttcatacagttgttggctgcatgtatgtctttggagaagtgtctgtccatgtcctttgcccactttttaatggggttgcttgtttttttcttgcagatttgtttaagttccttatagatgctggatattagccttttctttgatacacagtttgcaaaaattttctcccattccttaggttgtctgtttactctgttgatagtttctttcactgtgaagaagctctttagtttaattagatctcatttgtcaattttttcttttggtgcaattacttttggcatctttgtcatgaaatctttgctcgtttctgtgtccagaatggtattgcctaagttgtcttccatggttttcatagttttaggttttctatttaagtctttaacccatcttgagttgatttttgtatatagtataaggaaggggtccagttttaatattctgcatatggcttgccggttatcccagcaccatttgtcaacaataaatgagtagggagtcctttccccattgcttgcttttgtcagctttgttaaagaacagatggctggtctgggcgcagtggctcactcctataatcccagcacattgggaggctgaggtgggcagatcacttgaggccaggagttcaagaccagcctggccatcctggtgaaaccccgtctctactaaaaatagaaaaattagccaggcatagtagcacacacctgtaatcccagctacttgggaggctgaggtatgagaattgcttgaacccaggaggcagaggttgcagttaaccaagatcacaccactgcactttagactgggcaacaagagcaagactgtcaaaaaaaaaaaaaaaaaaaaagaaagaaagagcagatggctgtaggtgtgtggcctctattctgtttcactggtctatgtgtctcgttttgtactagtaccatgctgttttggttactgtagtcctgtagtatagtttgaagtcaagtagtgtgatgtctccagctttgttctttttgtttaggatttccttggctattcgggcccttttttggtttcgtatgagttttaaaatagtttttttattctaattctgtgaagaatatcattggtagtttgatagaaatagcattgactctgtagattgctttgggcaggatggccattttaatgatattgattcttcctatccgtgaacatggaatgttttccattttttttgtgtcatccctgatttgtttgagtagtattttgcagttctcattatagagatcttacacctccctggatagctgtatccctaggtattttattcttttgaggcaattgtcaatgagattgtattcctgatttggcttttggcttggttgttgttggagtataagaattctaggccaggcacggtggcttatgcctgtaatgccagcactttgggaggccaaggcgggtggatcacgaggtcaggagatcgagaccatcctggctaacacggtgaaaccctgtctctactaaaaatacaaaaaattagccgggcgcggtggtgggcacctgtagtcccagctacttgggaggctgaggcaggagaatggcgtgaacccggtagacggagcttgcagcgagcctagatggcgccactgcactccagcctgggtgacagcgagactccatctcaaaaaaaaaaaaaaaaaaaaagaattctagtgattttttaccctgagacttcactgaagttatcagcctaaggagcttttgggctaagtgtataaggttttctagatataaaatcataccacctgcaaacagggagagttcaacttcctctcttcctatttggatgctctttatttctttctcttgcctaattgctctgccctataaaagtactccatcttgacagagtcagagtccctaggccagtcagacttttgccaggtatcctaaagaacaacaatctgagctgggcatggtggctcatacctgtaatcccagcactttgggaggctgaggcagctggatcacgaggtcaggagatcaagaccagcctggccaacatggtgaaaccccgtctctactaaaaacacaaaaaattagctggacgtggtggcacgtgcctgtagtcccagctgctcaggaggctgaggcaggagaatcacttgaatctgggaggcggaggttgcagtgagccgagattgcgccactgcactccagcatgggcgacagagcgagacctgtctcaaaaacaaacaaacaaacaatcaacaacaacaaaaaaaccctgtacctgctatatttttcaggctgtttcagaaaaaggcaaaagtaataattcattacttgaaactagacttgactttctgggaattggttaacttgtttgaagaaaatatattaaacatttattgcctcattgcttgctttcaagatatttttctatgccttcatttatgagaagctggctcagtttgttgaaatccatcaatgatttgaactataacattcataatgttctttataacccagaacttgattacataatggtatttattgttctctagttttttcatgtgcacaagtcttgtcctgccaactgtttcgtaagtttttcaaaaccaaagctcatgtcttctacttatttcatggttttcctttcctcacaatatctagtacagtaagcacttaataattatttcttaacaaaacaagatctgcatgtgggctgtgtagcttggctcaattcttacattccagtttgtgccattaaccccaactagctttctaggaagacttgtcacatggggcctgggcaacgaagattagatgattaagaaaagccaggcttcattgctgcacagaaaaactgaaggtcctatgctactgctcagatgtgagtatctcagttcatacagatgatatacttattgaggctagttggtcccagtaaatttagagttctgcatgtatccttaacatgctctttgtgaaccattgacaaggcattcacaaattaggccaagtgctcccccaagtcatggtttacatgtttgctttgagagatttacttttccttctggcaagtattcttccctcttcctcctgtaagaaatatgaaacttgtctctggtcatgaaggttttatattaacctattttttaatacttactggggaaaatccctttttctgctgctgctgctttgattggctgaaaaatggcagctaccttactctggagcttctaagtctgcttctcagcatttctcaaatatctgagactttgttgttcttcatagtaaaagataaacccttagactctttttttatttttcagaaattatcactattctaaaagagccactgagttcctagtctggatattttaaataaatatgtatttctgttattcttttccaagtcatgtcagcataataggagtaggtgtatgcaaggaaaactagttattgattaaagaggattttgaagtggtctaattgtcctttttaatgatatcaacctataggaaattcctaaagtgaaatttgaagtaattttgtcttattgaacaatctgtatgttgattgtcaatcagtggacaaaattaccaaatcagctatgccattcatcatttgacacattaatttattacttttttcagttaaacagctttataaattcaaaaacaaatgcatatatacagtgaataaaatgtttgagcagcataaacattgcaggtaacaaaagtaattccatcttctgccccacactgtcagtcctgctttgagaggcaaccactcttaacagattttttgtataaactttccccaaatttctatagttacacaagcttagaggatgtgtctgtgttgtctatacattttttcttttacacaaatgggggcaaacttgatattaagttctacattttgtgttttctcctcttcgtaatgtgttttagagatttcatattagcatagattgatctaatcatttcttcaaattgctgcctgtaatttcattacatgggtattccataatttatttttgtcagacccttccccaaattgatgaatatttaggggtatgtgtgcatgtgtgtgtgtctgtgtgtgtgtgtgtgtgtgtgtgtatgtgtgtgtgtgagagagagagagagatgaatactgagataatcttaagtatttaattgctctatacctaaatttgccaaacagactggatttcctgtttgttaatctgatctttttcttggtatttgaaagtcatgctagttagaaaaaaaatcagtaattttaattctgtacatatttatgaaggtttatgctgcatccagcactttgctagatactattggatataagaaagttataagacaaagtttctgcccatacatatttttctctgtagtttagaagaccaggtttactcatgtaaaataattagtgaatcatatgagatagagtaccatgaaaaagaaactccaatgtgaacttacttaggtactcattataaataggcaggctcccatcatagcagtaaactgtgtgtgtaggccagttgaagaataccacacttggaaaatagactgctttggggagatatttgaggtttaacctaaactcaaacttgaagaccatttgaagactatgaaaacgctttcctcccagataaatgactataaaaagtaagcaaatctggaattaaaatcttacaaattgaaataatatttctctataacaaggccattttgccatcaaaaaatggaataacagtctctccaaagtgtgcatatatgagcttatctacactgtatagatacagtagcataactactctaattagttttcaaaaggacattctccttgtttcatggaaactattggatgataacaaatagtctgtacttcagagaagcaaaggagaaaaaaatagcagaataggctgatgtcagttaattgttaatatatgaggtttgaggtagaaggtagattcttgaagtttgaaatattttacatgaaaactgagagggtaaaagtttgagagacatagatcaccattttcactttatgaagaatgctgtcttttatttacgcctttcagcttatatttctaagctagcaatttaaggacttatgaaagatggaagaggtatagattagaatccaatattttggtgggtcataggcttgtatgattcttccttgtgctaatacaatcatttaagcagaatgatatggtgataaaagctaataaaatacatttagggaaaagcatgctgtgttggatattcagaatttgaggaaatgtgttgtgataacagaatgagtgagcagctttcatagagtacatgcagttaagatgaaagcagggattgagaaaaaaatgttttttctgaaacagattttgtacctaaactgaaaaacatttagtgacgtacacttttccttccaaataaatatttcagtcagccatttaccttctattctctgtaacatgttcactaactaggagcatgttctctcacatttaataaagtaaaaaatgcatcagcttttcaatgttttccccaactttctattctatttaacaaatatttcttgaatagctactatgtgcggagcatcacaatagacattgtatgggatgcaaagtcaagagtgaggccactggtcttagaatcaggaaacttgccttctaatcctatttttgccagttacttgtatgacctagagattcacttctcattttagagccaaagtcctggatttaatgatgtctgaggtctttttcagctatattgtaatccaacctaatgagtaaaaccatttgtttcccctaaaactttacagtattctatggggggtcgaaactattacagaaataactatgaaagaaagcagaatgttatcggtaatttcaagagagagttacaaagtgatgtaggccattaatagcttcatggagggagtgaccttgagggattaggttttgataggcagaaataggggtcataagaacaactctgttcctattgtgggctttctccatcctggatattactcagaatttgtcagtggcaaaacaaaagtagtagaaagttagcctttgaaggatttttatcagtctgtttccgaactagccaatgagtgtagattggagctgtaagcaatgaagtaaaagtaaaagagatgaacatgaaacatagggaggggtcatagaaatggaatttcttcacaaatgctaatagcaactatcccttacatttgtataatggttaaaaatccaggatatgagggtatgacagagctgttaagagcatggccgaatatgctcctaacatggactaaaccagacctgggtttctatccctgctctgacatttaccagtggtagaaccttgtacagtcacttagcctgttgcacctcagtttcatcatttgtaaagtggagataacaactactccatgagatggctgtaagattaaaataagattgtgtatttaaagcagttatcaaaaggactgacacatagaacttactcaaaaagggtagctaggaggtagtatgtcaggtattgttctttcctttcaacagaaagtcaaaactggggctctgagattctgaatcatttattagaatccagtattctttctattacaagagtgactcctaacctgagttttctgcccacaccctatccctggggggcatctgtgaaggtaataatgagaatctatgagttattttcaatatttgaaagaagcctaacagagagcattaatttactcgtgataaattacacaacctgactaatatgtcaagtttctttgcttttgcctgaaattatatcaactcattttggtaatactggctatctcatgctgatgggaaactgattggcagctatatatgcctttgatgaatagaaatgaggaaaacgaattttatatcataaatgcagttgatctgggagatattcttttcagcttgggagaacatagagaaaaataaaatgctcctttgttgctgaaactattgagaagcactgtattttacaccatgctttctgattcaagggaaaagggggtttaaggggcttagaaagataggcagttgtggtcagagagaatttcagactttgagagcttatgggtaaattgttttcatataacatacctgattgaaaggaggatatgacgtgtttttcttctgtgagaaagagatgaggcaactgaggcctaaagagggataatgaatcagccaagttaaaaaagcagcttgtaacagaaccaatatttcaacccagtcttgtgactctgttccatagctctctctactctgaatcaaagaaatatagtcatcttgtcttgattttgccacaatgtccaaaaaaacattttctcaggtctgattttaatattgactttttctagtgaaagagagaaaacactgttagaagatgaatgaaaatgaagttagggacttacagacagctgacatacaaaggtctcctttgtattgattggcttctttattgatttgacaatatagatcaatatctcttcctctgaggctgtagtgttatagtgtgaattctctgggttccatttcactctgcagaattgatacaaatacaacaggtgcagaggtaatagggggatgaattatcatattagctattatttactatgtgcccactatggccaggaatgttattcaggcatctatatttattgagtgcttgctgtgggcgaaatgctagtctaggaagtgacagagtaatgaacaagacagagaaaagtccctacccccatagagctcatattttatcattctaagtatttttgtatggattaccttacaacaaccctgtaagtttggtactgttagtactctcaatttacaaatgagaaagtggagacagagttagtaagttacttgcacagggtcacacagctaggaatattaaatttggaagttgatgtaagatctgtctgactcctaaatgtacatttttctattattcttttcaagttttattccccactgtgctacttcatcagacagcttctttctgccattcttctcaacactctcttcctctcgtatctatctttccttttggttataatgctgaaaacatgcagttattaaaccaaagacagagaggcaaaatacattcatgtggataaagtaaaatgtacgtaggcttgctcacacactaaacagagagggcactatgcagaagctgtttgctttggggagattagataggagatgttatacgataatagacaaaatttattgactgcttattatgtgttagccagtatactttttcatatttaatttgtatgtgtatataatagctgtacatatttatggggtataagtgatattttgatacaagtgtgtaatgatcaaatcagaggaattgggatatacatcatctcaaatacttatcatttctttgtattgggaacattccaaatccattcttctgattattttgaaatatacaacaatatattgttaactatagttaccgcatatctacaaccatctgatctttgacaaacctgacaaaaacaagaaatggggaaaggattccctatttaataaatggtgctgggaaaactggctagccacatgtagaaagctgaaactggatcccttccttacaccttatacaaaaattaattcaagatggattaaagacttaaatgttagacctaaaaccataaaaaccctagaagaaaacttaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaagaaacaaacaaccccatcaacaagtgggcgaaggatatgaacagacacttctcaaaagaagacatttatgcagccaaaagacacgtgaaaaaatgctcatcatcactggccatcagagaaatgcaaatcaaaaccacaatgagataccacttcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccaacaatgatagactggattaagaaaatgtgcacataaacaccatggaatactatgcagccataaaaaatgatgagttcatgtcctttgtagggacatggatgaagctggaaaccatcattctcagcaaactatcgtaagaacaaaaaaccaaacaccgcatgttctcactcataggtgggaattgaacaatgagaacacatgggcacagaaaggggaacatcacacactggggcctgttgtggggtggggggaggggggagggatagcatttgaagatacacctaatgttaaatgaagagttcctgggtgcagcacacgaacatggcacatgtatacatatgtaacaaacctgcacgttgtgcacatgtacccttaaacttaaagtataataaaaaaaaagaaaatcacatgaacgcaaaaataaaaaaaaaaactatagttactctatttttgtaccaaacactagatcttattcctactatctaactatatttttgtacccattaaccaacccctctttattctcccctcccactacccttctgagcctctggtaaccatcattctattctctatctacatgaaatcatgttttaacctccatatatgagtgagaacgtacaatatttgtctttcttttcctggcttatttcacttcacataatgtcttccagttctattcattttgttacaaatgacagaatctcattcattttatagttgaataatattccattttgaatatataccacattatctactcatcttctattcatctgttgatagacacttaggttgattccatagcttggctattgagaaaagtgctgcaataaacatgggaatatacaggtatttctttgatatgctgatgtcctttcttttgaatatctgcccagtaatgagattgctagatcatatggtagctctatttttagtttttgcaggaactgccgtactgttttccataatggctgaactaatttacattcctaccaacagtatagaagcgttgccctttctccacattctcaccagcatctattattgtcttttttataaagcccattttaactgcagtgagatcatatctcattgtggttttaatttgcatttatctaatgattggtgatgtggaaaatttttttcatatacccactggccatttatatgtcttcttttgaaatatgtctattaggatttttttgcccatttatagattggattatttgtgttttttgctattgagttgctcgagtcctttatatagtctgattattaattcctattcagttgaatagtttacattttttttccattttgtaggttgtctctttacattgtcaattgtttcttttgctgtgcagaagcttcttagtgtaatataatctcattcatccattttttgctttggttgcctgtgtttttgaggtcttactcaggaattcctttcccagaccaatgtcctgaagcatttccccaaagttttcttctagcagttgtatagtttcaggtcccacatttgtctttaatttgtttttgatttggtttttgtatttggctagagatagggacctagttttattattttgcatatggatatccagttttgccagcaccattttttgagtagacgatcctttccccaatgtctatttttggtgcctttgtttgaaataagttgcctgtagctgtgtcaatttatttctggtttccctattctgttattttagtctatgtgtctatttttatgccagtagcatgctgttttggttactatagttttgtagtataatttgaagtcaaggactatgatacctctagctttgctcattttactcaggactgctttgactattctgggtcttttgtggttccatataaattttaggatttttttttctatttctgtgaagaatatcattggtaatttgatagagattatattgaatctgtagactgctttgggtagtatggacactttaacacattcattcctctaatccatgaacatggggtagctgtccattttttgtgtgtgctttttaaattttttatcaatttttcatagctttcattgtaaagatctttcacttctttggttaaatttattcttaggtaattattttgtagctattgtaaataggattgcttccttggtttatttttcagattgtttactgttggcatacagaaatgctactgaatttgtatgttgattttgtttcccacaactttactgaatttgtttatcagttctaatagattttttggtagagtctttagggattttttttaatataaggtcatataatttaaaaacaagaataatttgacttcttcctttcaaatgtgaatgtcctttatttctttctattttctaattggtctggcttggacttctatagctatgttgaataaaagtggtaaaagtctgcatccttatcgtattccaaatcttaaagggaaggcactcagttttcccccatttagtatgatttagttagctgtgggtttgttgtatatggcctgtatcatgtagtcagtatactctttacgcattcaattcttagaacaaccttataagataggcactgttattattattgtcttcattatttatatgggagaaactagggtacagagtggttaattaacttgccaagaatcctctgtttataaggggcagaactgagattaaagttcaggcagacagtatccagagtttgttgtcataatcaccaggacagtacttacaacatagtacatcataccataagtaattgattatttttaaaaatccaggtatgagaaaataaatgtataaactatagtagtaacaatgagaacagaaaaaaggctatgaatgcaataggcattttagagaaaggggcaacaacatttactaaatctcagatttgaatgacaaggaaagtgattatagcagtgacattaaaaaaaatctaaagagatcaaagtcttgggaggggaaatagtttggtttctgacattctgatattaagttgatggtaagatgtccaagtagaggaactattaagtaagtgaaatatgggactgaactcaaatttgaagacaaatcccttcagactctttgtccagagtctgcaggccatagagaggtatgaagagagaggatagaacgtagaaggagcaaaggctttcaccacgtagacatttcctcctttctttttccagtaatattattattgaaatacaattcaaccttagttttaactttttccaggctaggatgtttctttgcttcctcatacttttctccaccaacatcaaaatataataggatgcagtccattcagaaaagaaaccagttaacaaattatgccttcaaaggaagaaaatttcctgtgatccccgattgtggtctaaattatgtttattatacgttttataaaattctgaacaggtattgaactattttaaatttcttggatttattgcttttatacaaaaacaaacttacaaatgaaatataaataaaaccacaaaactaataaatctaaaattaattttaattatatttgtcttactgaaaaaaatcactgtttggaatgtgactatgtactactgaaaagtgcaggtttgtttgagttgtacatggctggatttctgtgtgctacgaggtgcttttaagtctccaccacttagattgcagtgtgctatgatgtatttttgttctcatgtgacatgaaggcatcatttatatacatttatatgtatacatttatatacagtactactttgtgacaatataatcataaacgaatatgtaaaagctggcacttaaataatgcaatagtatcatcatgaggtgatcacctagaatacccaaaatctattttcttaatttattttaattcaaacataaagtttgaaacatatacacacaaaaatattatagaaaagtcctaccctcccgaaactctagtttgaaaaatattaatctgaaggcaggagataaatatactgtcttgttgtggctttataaatttgtacattttcctagcatgactaaatttaatcctgcctatgtgttcatataatgaatgtgggatttaggagacatgagatctcaaactggctctgccattattctattatagaatctcaaggaaagtgttttacctccctggacctcatttttctcgtgtataaaatggaaattggagaggaagaaacaggatgaaccacatgatctctaattaggactccttgtgattttcaagtcaaccatacatttgaatttcagaatggatgatacacatttcactatatatgtatatgcacttatgtgcacttactgatataatgtttacttaacaccatggatattagttcatttgccaaggaagagtgttactcaaaattcatgataaagaatttttttttttttgctgctcttttggacctgtaataagatattgttaacctacatgtacttcataaaaactttccctatgtgcattttctttttttttttttttgagacggagtcttactctgttgcctaggctggagtgcagtggtgcaatctcgactcactgcaacctccacctccctggttcaagtgattctcctgcctcagcctcctgagtagctgggattacaggtgcacaccaccacgcccggctaatttttgtatttttagtagagacggggtttcaccatgttggtcaggctggtctcgaactcttgacctggtgatccacccgcctcggcctcccaaagtgctgggattacaggcatgagccaccgcgcctggcctccctatgtgcattttctaaaaaatgtatctaacttaatgattatgagtagacagttctgttgaattttatttatgcaatcacatgaccatttctttactatgaaacatataaaattgtactgtaagtgaaacaagtagttccattgtgtaattgtttcatcattacatataatttaataaatacttcttttcaaattagggaataacagacttggcatttatatactttaaacacttaagactccttcagcttctaaagaatttaggttaatttacaaaacagaaagtgattggcttacattatgctttgcgtctgtagaaaatgggtaattgggccgggcgcagtggctcacacctgtaatcccagcactttgggagaccgaggcgggtggatcacctgaggtcaggagttcgagaccagcgtgaccaacatggagaaacaccgtctctactaaaaatacaaaattagctgggcatggtggcacatgcctgtgatcccaactactagggaggctgaggcaggagaattgcttgaacccagaaggcagaggttgcagtgagcagagatctcgccattgcactccagcctgggcaacaagagcgaaactccatctcaaaaaaaaaaaaaaaaaaaaaaaaaaaaaaaaaaaaaaaaggataattgaataaaataaaccgttctatgaaagtgtgaattagtaactctgactatgtcggcagccacaattttgcctccctaagcaaagcatatagagtatacatgatcacattaagaaatacagcaagatgttttgggtcaaaccaaatattttaccaaagcagatttttttttttttttttttttttttttttactaatgatgattcaacactaataccatgaacaagacaaaatgaattgttgtgagcacaaattttctgcaaacattattttaaaacttggcatatttatgcctattagtgaatacatctttataatttacagcttaacctcttcaggtttataagaacaagccagtttgaccattggaaaagaaaaaggagagacagagcaataaccacagtctgtgaagaggcctactcagtaacggtctagtttatgcttaaaaatactggaaggcttgcatccctcaatctctcagtcaattactttagttctttgaaatcaccccattaattaggacaaatcctgcgttttcttatgtctagatttatcaggggttttttgcatctctctcttatccacagtttagttttatataatacaacctgatagcatcttgttatcattttgccttgatttgctttgtgtcttattacataaaaggggtactaatctttgggaattcactccttattagagtcaattgagatttgtaacttgagatgcaagcttatatttttattataaataattgcctacaaaggaattcctagcatgatatgttatcagcataaattactatgttttaattgtaatgtattttttaaatatgcccacaggaaaggtttttctcctacttagttttgtagaagattattttgtgtcttcccacttcattcctagtatggattccaaatatatcacttgcttgatggtagtataattttataattatattgttattggcaattcagaaaatgatttctatagtttctttgacataaagtggataaccagaatgagttgattttcatttatctttgaagccaattataattttagtaccaaccaacagttggcacttaatttgcctggtctacagataaccaagaaaagatattgccattcattggtctcctcactctcttctataaccagaagctaggctgtaaattgccattttctgtaaaagttggcccatttgactccctctcttaattaccgaacgctactggttgtgatggttttaacttgattatgtacagttgttaggcaaatgccagttaggagttgtgaatgttttagaaacatttcctcagaataattgtgctcagtttttaaggataggaactggaggctagtcagatatacatttgataaacaaccaattactcatctcatgttgttctttactgggggtatttctggttttctagggtggaataaatacagaggatggttcactttgctctgtctggatgagaagctttgatctccaggatagttcttttttaaatgagatgaatgaattttcacctttaagtagggtgcttatataatttattattcaaatgagaaaacttttgagaacaaaagaggttattgctaactgttatgctgggagaactggcatgaattggggatttatgccaggcaaactgtattacatggtctgtcactttgggacaacatggagatttgcctccccaccacttctcccaaccctgtccctctccatccactcacaccccagcctaagaaaatgttctgtgagacatatatagctcaggggatctttgaacatactgatgtgtgttcctctgcagggattacttaaaaaataaaaatccccctactcatctatcttcaaatcagtcaaaacaaggtttttcattatgtttccatgtctccctcctctgctgttgtatccctttaacagtcagactctcagacaaaagataagataccatgctctttctaaaatgtaaatctaatcatatcactctactctgtaacacacttcagtgggtttccattactatggactttgtgatccagcccctgcctcaaatcccaccattctctacctccctcctattgccaatcgagaatctctttctgttcacaaagtagcattccaaagacatagaaatattcatattgttatatcctagctagtaagaaatgtacctacacatgaaaattgccccatcatctagcacggtgcctgacgtataattggcatttaataaatgttgaataaaggaatgaatgaagagttaaatgccctgagagaaattttatttaaggcaatctatttaaaatatgaatgagtatatagcagcaattatcctcttgatctgcttagttaagagttaactatattgttgggctcttttttttttaggcaaagcatagagatattgctttataacataacattccccccactgtcttaaggacctttaatatgcttaagggaagttaatgtattaataatagccatttcctagggcctaattagccatatttcaatctttgtaattccgtatgagaaaaatatcctcacagagttcaagtatctgcggcatacgttttggcctcttatatatctagggtgaaaagctaacctggtaaatatgcattccagatggctttcatcagataaatctagtgaataagaggcccactgataaaaatggaagttataaaaattaataagaaaatggatgttggaataaagacctgggataaccatcacagatctcacaatgatgctttacattatagcatgcaaaacacttttacagacattttcttcatttaattcttggaattgtggggagagactctgtaaagtaggtaaggcaaggtagttgtttttatccatgtttcgcatatgatgaaactagcttatgatattttgttcgtttatttcagccagtgtaactaggcttcacttatttatgagacttcagaatgaataataatcatgttatagggtgcctgaagaaattaatgatatctaaggaatcgcagtccttagcataactttggtttatttaaaatgtgctgatctgtaaaaccaaaccactagggtttgaagaagactggctgtatctaaagattagcaagataaagatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatgccatttgacccagcaatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagggggaagggatagctttaggagatatacctaatgctaaatgacgagttaatgggtgcagcacaccagcatagcacatgtatacatatgtaactaacctgcatgttgtgcacatgtaccctaaaacttaaagtataataataataaaataaaaaaataaaaaataaaaaaaaaagattagccaggtcctgttggcaacttattctgaatacttaataggctcaattggaagctagtgaagttttaatcagttgtccatttaggacccctcatcagcaccagttcatagggcctgtctgaaatattcttaggtagcagaggttgtacagaaagatctttgtgttactcttccctcctaagcacaaaacaccaaaatgaataaatgaataaatcaataaattatacactctaatcttgacctcagtgcataaaagttaagtcgagctctagaccaggtataatcacctggcacttcaacagtatttgaattactgaattgtcaccaaaatatatatcaagtattttttcacgtttaagacattgtacaacatgccatagagctcaggagaagatgaggaactttgacagtgacatttttttaaggtgcaagtggcatatttgtgagttatgagccttattctctgtagtcctaataatacatttatccctcatagaaaaagggtttcataaatcagccatggcaatgtgcaatattctcaaattcaggtatggagatatatgtataaatttagtattctcactggttgtgctgaagtgttgttgaatgtgtgagtgtgtatgtgtgttttctccagattctgactttgatacaaacattcaaaatctttaatagacccccttttcagggttagcaaatcttagtaaatgtctgttggctctactctttaagtctatgattcttttttgcatccattttaaaattgggataactgctagaaaataattagaactaatgtactagcgtaatcaaccaatgagttctttctgcctgctgcacagacaaaatcaattcactaggactgcagcaatgcagtaaagaaagtttaattgacacaaggctggccacacgggagaagaagttcttgctcaaatcagtccccctgaaggctcagaggttaaggtttttcaaggataatttggtgggcagggagctagggaatgggtgctgctgattggttgggaatgcaatcataggagtgtggaaaatggtcctcatgcactgagtcgtcttctgggtgggaggccacaaaaacagttgagtcctgagtcatgattctacctctgggtgggatcagtcatttgccagaatgcaaaagtctgaaaaatatttcagaagacccatgataggttctacaaaagtgatattatctacaggagtaattggggaagttacaaatcttgtgaccttcagaacaatggcttgttgttgtttaaccacacctatatcttagcagaattcaggtccctcttataagcctaacctgtggccttttgttagttttacaaaggtggtttagttttgggaagggctgttatcatccttgctttaaggttaatctataaactaaattactttcaaagttagcttcatctacacccaggaataaccaaaagcagcttggacattagaagcaagattgagtaaactatgtcatatttctcttactgtcataattttgtaaagatggtttccctagttaagagaaattttctaagattctggtgatcccatgaagacctcaaatcaataaatacttttgagtgtaaaaaaatacatattactatgctaggcactttgacatatctcttctcatttaatgtacatgactacactccgagggcattatcagcctccctatttcataagtgaggaaactgaggcacagataattaaaatgacctatcttaatcaaaggtctttaacaagtcattgaataattttcttctttcctagaaagtaagtataaccagattcacagttgatcattttagcaattgagatgatgtttgtgaaatggctttggatactctgaactgtcatgagaagtttgtttgttgtctagttttaccagtagtgctggattgcctaatgggcaggctaatcatgcatttatggcattagcaatgcagcatatctataagtcttggtgaatctttttaaagcatgaaagtagccattagaaaaagatctttttggatttgctaaaacttattttatattttagagttgtgtttactttgaattacctgtttgggcatatgatcttttcagaactgaaggcctctaaatgtcttaatctggctccttattgcattttgaatgtttgagaactcatttattcattcaatcatttaccatttctaaaatctacaaagaactgacttttcctttcttctcatattcttagagaatcagtcacccttctttgagagtcaactggcattatattagtttaggccctcattatctcttacttgggccattgtagcagcctagtaactactctcccatgttcagtctttctcttcttctaacctatttaattgctacttataaatttaccttaccaaaactctccttctttcatcaggaacctgtaaaggatctctattgtttaccatatcaagaccaacccctctgcagtattttcaagatcttcaaatactgactcctatccacctatttagtctctttttcactgtgtccctagtcttctgttctgcttaacctgattttctcattgttttctacagaagctatgctcattcctacatccaagattttgctcttggtattgctctgacatgtgatgttttttctccttttctccatgtatccaaattttcaccaaccaccaacattcagctcaagttctgaatcctctgtgaagtcctctctgctacttcaggtgatgctcaactctccttcctctggttaccctattataattgtggcatatattttagtaactaattgccttctaattattttatatgtgttggttttacctctgtaaccaaactgtaactccccagaaagtatagcagaatactacctagtaaatactaaataaataaatatttttattggtttattagccaagtagtatagagactctatgaattttaaattacctaatgtgactaaatggaattaggaatagtgattagaatgctttgtgtctttttaaaattcataaatatatatataggctttattcaaacactcagagtttgaaaccggaaaccacttctcaaaccagtctgccccctctgaggctgaaagggttctcacatatatcctcatggagccatcataaagaaaaagagatattcttaattttttttaattaaaaaaaaagaaaagaagagatattcttaaactcattttagagatgagtagaggctgagaagagtataatgaggaagagatgatttatttcgtaagaaagaaaggtgagaaacaaagacattccagatgtatagagccctggaaaagagacatcatatatcttcagtacattcagtgttgtataaatagtacaatatggctggaacctcaagttgattcaaggcaagtgaatgtagggaaataaaagatgtggtttgaaaaaaatctcagtgtgtccgaaattgagctcatcacatttgtcatccccttcccaaatatttttatcttccttctcagtgattgttccaccacccacccagttttttaagtcaaaaattcagatgtcatccttgactttctcttttttcttctcttctctatacagccaaatgctaggttctgctaagtatgcatctaaattaacctgggaaattgttagaaatgcaaattctaaagttcaacaccagctactaaatcagaagccctggggttgatgcccagctctctgttttatcaagtcctccaggggatttttttgcatgagaaagtttgaaagccattgctgctggcaatgaggagtcattgagaggcttgaagcaggaaaatgacctagtagaatatgcattttagaaaggtcattctggtatttgtatggaagatagatggtaagggagcaaaattaaaggtaacagaactagttagtagaatacaaaaaataagataataaaagacatagaggaaaagataaatttgtgaggtattaaagagctaaaattgatcaatttatgttaccattcggatgcacagggtaaagaagagggagtgataggtgtctggtcttgcacactaagtaaatataatgatcagggtttggggaacaatcatcaatgccccttccctccttcctttttttaataaagttgagatgactttacggtaatcaggtataaatatttttttaaacagttgtctccttgagtctggaccttgggagagaggtcaggcttatcgataaggattttggagtcaacagtatactagctggtaatagctactgtctgaatggattaaataacgtaaaagacaaatcttttcctctatgtcttttatgttatttaatccattcagacagtagctattaccagctagtatactgttgactccaaaatccttatctacaggcctgacctctctcccaaggaaggaagcatttcagggtgagaagagaaccaaggatgaagtccttgataagaccaatacttaagggaggtctccagggaatcctgagtaatggttaaagagtaagggagagaaccagaaaattgatatcatgctggtagaggaggatagaatttcaatgagactaatagtgttgaatgccgtagataggtcaagtaagatagctaattagttatattagttagtacataagttccaaacccctgggtcatgtaccagtatcagaaccaggccacacaacaggaggtgagtgacaggtgagtgagcgaagcttcatctgtatttacagctgctccccatcactcatgttactgcctgaactctgcctcctgtcagatcagcagcagcattagattttcgtagcagcacaaaccctattgtgaactgtacatgtgagggatctaggttgcatgctccttatgagaatctaatgcctgatgatctgtcactgtctcccatcacccccagatgggaccatctacttgcaggaaaataagctcagggattccactgattctacattatgatgggttgtgtaattatttcattacatattataatgtaataataatagaaataaactacctaataaatgtaatacacttgagtcattctgaaacctgccacctccccagtccatagaaaaactggcttccatgaaaccagttccttgtgccaaaaaggttggggtcattgagttaggggatcactgtctttagcaattacaacttcaaggaagttttgagaacagaaggtggcagtacattaaggagtaaattggaataaataaatggaatttttagctattactagtttatgaaaggaaggaaagaaagagggagtgacagctagattgagacaaaacatcaatggaattttcttttattgaccaagataattgtgtatgtttacaatctgaaagaaaaagtgaattgggaagaaaaatttgaagatacatagagaaacagagaacttgatggaataagatctcaaagaataagtgaggggataagatccacagcagagtaggaggtatttgctttaaatattgtatttttattgtctcttaatgcattggcctctcccaagtaaattgagaacccctcaaatgaatagacacagtctttttcagtccctagtttagggctcaaaaaattttttgctgaatgaattaagatcatttcttgatttactttgatgcttcttctctcccccacttactctttttttttccccaattttccatccttagctctcttctcttgtcactgtattcagttgctccaggagatctcaaaaatgcctaaagtttctttttctgagacaggagaggttgagatgtgactagaccttttatactcagagtaatgctgaatcattaattataccgtcccttcctgtttgccttcccatggagccacactaagtagaattggattggatttgagggttgttttccaacatgctgcagacacttgatatacaaccttttatttttttatttttatttttggcaggccccttcttaaccctacaacctcagaaactttccatttttgtacctgctcagttcttccagtagaaagtaacccttgatgcatagcttcttggactgggaaggtcattagagttttttgatgatgattccaaatgcaacagagtagcttgcctgtttcaatagattttcctttgttttgactttgttgacctatcatttgctgaatgatataagcagcttcacaataaaagagggtatattatacacaggttgaagcagggtaagtatttttgtcctgagagaaaaatccgatctaaagatatatttgatttttttgtgtgtgtgtgtatgtaattaggaatgaccatttgaagtagaagcagagatgtctgagagcccaattttcaaagtaataatttgctatatttatttcaaagtaaggctctatggctaattttaggaaaggccttggaaatgaaccaacatgctttaggaagattcagatgtttagttttaaacctttccatacatgctttaaaacattctaatagttatctgtgaaagaaatgcattttaaatataagaaaaaaatgctatttccttttcagtgcctttctacagcaactgaaagttaaattagaatgccagctgttataaggagcatgttaatcttcctctagggcaagactgttcttctgatcttctcctgttttctctacagtgcccaacacagtgcagagaaaccagcggaaacttagtccatacttgttgacttgacagtttacagaaacattttgtcctctacaacctccttcagactatccctgtcgaccctatatttagaaaatgggttcttgtctaagtctggagacaaggttatatctgtggaacagatgctcattatagttcacatgcatattgaacaaaaattcagaaaagcaatgaggtgaattttataatcttcagaaatccccttgaaagggccacaagaataggaagctggtgcatatcatcctcataatttgtctgctctctaattggcaccaccaatgttttgggttccaattcattgacccatttttttattcctctgctttttcaaaaaagtatataaactttaaaagacactctgttactatttactaatgccacttgactggttactttttgtacttgtccttataagcagtgtataggtcaaaatcaatgtaaacattacctatacctctcaagcagtctctccccttaccatccctatccttcttagaggtcgcttccttaatactccaaacatatgcttctctctatcatagaactgatcaccctatattgtaattgcctattatgtttgtctgtgtcccccatattgaaccacaggcagaaactatcttccatttttgtatctcctgtacctgacacaaagtctggcatataataaaatattcaatatatatttgttggatgaatgaatgtatgatgctccaatataggcaaatttgccagtctacttttaaggccttcattaatctgatgctattttaatttttcaacttcatttatttatgagcacctattatgttccaagcactgtagatataatggtaaaaaaatagaaattatccctacttctataaaactaatagttcagtggaggaggcagacatattatcacacaaataagtataaaattacacctgtggtgtcttgaatgagaggtacacagtgctgtaaaggctaataatggggcagggtgggaagttttcctaatttaggaggaagtgatacttaatctgggatctgaaagacaattagcattagttaagtagaaatcaaaagaaaatattctgggaagtgagaacagtctcctgtgcagtagaatcccaggcagcagaagggagagatgaagctggagaagtaagcaggtgctaaatcgtgtattaccttacaaaccatgttaatgagcttttgtctttattctaaaagcaacagaaaacatatcctacaacattcttggtctttctgttctttttcaaaaccacaaatcttagtctttgtacttctaatcatactatcctctacttgtattatagtcaccacccttttccactgattcaaatcttgttttttgttcaggtatagttcaagtcttatgtccttcaagatgactcctttattagttcagtctagacagaataacctttcatattgtatagcacaaatttatactgtttatatacttattgtgcgggctcttatatcatcctaccttatacttttatgatgatttcatacatggcttttcactcaagagactgtgtaatatttgttttctgaatccctcttaaatatccatagcccagtacttgattcacactggattcccaagatatactgagccatgaaacttgatataaaccaaatcttagaatatattaagggaaatactttgatcctaatgctgttggtgatgacacaagtgcatgcatttgaaaaataaaaaatgcagttatattacctggttttattggctacatcatagcaactacttcactaagttaacttgtcttttcactgcacttatcaatctgcattttactcattcaataaaaatatactgaatgtagattttgaagcagctaccgtgtaagtaaggactgggaattaaaaactgaatacaatatggtcttgactattatcttactctgttttgtgctgctataacagaatatctgagactgggcaatttataatgaacagaaatgtattggctcacaattctggaggctggaaatctgatactgaggtaccaccaggtttggtaattctgattccaacatggtgccttcagcactgtgtcctccagaggggaggaacaattaatattcacatggcagaaggcagaagatcaaagagataagaagaggacaaactcattcctttataatggcgttaatctcactcatgagggtgaaaccttcatagcctaatcacatcttgaaggtcccacactttcatattgttaaaattgtaattacattccagtatgagttttggaggggctgaacattcaaaatatagcaatcatcacagagctaaaaatatggtgtccaaagctattaaaaatcacatttctattgccaaaaggttatatgagattggttgacactcaggatccttaagcagagtacaaatgatatatttcattttcacaggaaatgtagcctcaccataagtttatggatacaaagtctggatattgtggaatgtgctcagcattaaagtaatacaacaaaaataatttcctctgtgagtattatagtctttgatattgaacctttaggcactgtacaggtaatgctctgtgaaaagcagagttttatagggataacaattcatctatacttttcagtaaggctaggtaaaatttcttccaactgggaggcagtccagagctaggactcccttaggttggtgattttctttatgaagccattaagaagttatgaaggtatctagagatagagatcatcaatcagtgattgattattagcttttttaaaagaaagactttggccaagtatatgaaattctgattatttactctaattcttatgaaatcttagggtaactgttaatataaagtaattgacattaaaacattaatataaattcttaataatttagttaactctttgagttaaccaaaacctgactaaaatctttgtcctattagaggagacacagaaaactacttattctattaattagcatacattttaaagtatcctgaaggtaactagcaaagtttaggtgcttgaaaaaaattgtcactttcctaatctgccatttgaagaaaaatgctcctaaaattaaactattactatgttttgttcatgggacatgttacatcaggggatgtttcctaaaggtttcatagaggagtagtcaatacaactttcaaaaatgaaaataaaatttaaaaataacctaatattaattttgactccttttttaaaatcttcagttatttcatctgaagtaatacagagttgcaaggcattatcactcaatcataaggatctttcaaaaattataccaccctgctatgaaagactcaatttcaaaatattaatgattacaagccagagcttctgtaaacatacatctcaactttgaatactggcaacactttcagcaagataaggatgacaagaaaatgtactttcctagcctgttttcaaagcacatacacatttttaaaaggtcaaggggagggactttgtaagaatgtattattatagctttttactgaactgatttgttttaggtatctttttgttcatatcttttatgtctccatcatagtaattgtattcttatatgatgaaaataggatgaaacaaaaccactgagaatacacacactgtctttgttcctgaaggacaaacggtgacccaagtcatgggctgctttggctttgattaaaattaaaatcttgtacagattccagttctgaacatatgtctcatactctatgtgctcacattagggtgcgttaaaaatattttatgctaacagattacagtaggtaacagtatgcctttgtttcctacaaaagaatgagtcagtaaattgttctacttaatggataaaagactagctcaagatgcaaatatatcccaatagctctaaatcccactgtaattcttcctaatttaaggcatttattaactcataacagaggctcaagctattcatatttctagcttattttatttatctttctcttattacctgttctactctaagctttgcaaatcttgaaaatcctaaaaatgtcaaaggagagacttcaccaattaaagtgtgctgcaacatagtggagagaatggaaccattgtgtggttcatattgaactgcatgatttatatgagttttctttccttcccatgatttgttgtagcaaccaacttcacatagtcatgtaaaaattagagggttctaagttcttccaattggctctgtatttcaaagtacctgttgaactaggcaaacagaatagcatcattttttttaataatcagtgatttggtgaaacaggtggaagatacatttttgtttccaaatgctttctaagaatgactataaatgcacagtttattaaagagattcaacaatgccatttccctggtgcttctctaccaagtaaatgacattttgaaatattattttttttctaaagtataaaagacccacccagccattatataaaatgagggaacacttcttgttgtgttaacatcttgaatctagtctcagggaagctgttttatgagatttactggtgcaatttggttgcagatgctcatgatttatagaaaagctcatggaaacagacagaatctgtataaagaaccaaaataaaaacaaaaacattaggtaactcacatgaggtggatgtcacattaatcatgtttttgtcattttggtttaatgttcatgtcttggggagtatttgagagtgatgctatgtgaccttcagatccctgtagagtggttcaggttcaaactcctggaaggctcacatgtgataaggtttgggctactacctttctcagcctgtgaaatttgagactttccccacattttcccctaaccaatttatccaaacctccacacctccaaacggccattaaattttgaactcctactgctcttattctctttcttccctcttttgttaacgtaataatttatcaaccagtttttctttaggaaacaaaaatgtattgctgcctactctgatgtttgcacagtgttttagaaggcaaacttcttatagatggtatacagcctggtgcttctcccttccaaagtgccttatacagtgctagttataaagttgatgttcatcattggcttattaattgattgatccttgtgtcctgtccctcaactagtcttagacattgtgtttagaagataaatagagcagggaatttttcatctggcctcattgttcctccaaccacagagatgtgagcccacctagtgacaaagtactagaaaagagagcaaactgtcagcttcatccttgtctgtcagagcatgagactggtttagatgactttgcctagttgatgttaagcacattctcatttcccatgttaagccttacagatcaactagactagagtagtgctgtgatatgttctcacctcttttcccagcccctaggttacctcatcacaccaccatggattagactgttagtatttgttgcttttattacagatgatttctaatatgtaattcattttcattaaaggatgatgctttattcttccttgaaattttctgttctccctcccctttttttcctattctgttcagggacaggagggatgaggcacatttattcccaaaaaggagagcagatgtagtggttggtagggatggcaggttctcctgaacttacaattccatattttgcatatttatattcaaatggttcaacaaatatataggaaaggatcctgcaggaccctacagtttccagaactgatgatttgtcatctgaaaaggtatttttcttcatagcttgagaagaagttaaagcaaggctcttagtatacattcaatctaaaattcaacaaaagattcttctcatttacagaatgaaataaatgcatattatttcgccatactttcacaagattttatttgctactacatagacacctaggttatatgctaccctaaccaataaatattctatgaccaagtttatgtatttcctatacaggcagattttttgtatgttttgaaacattctaagacagtagtgtttattctcacatatggttatatacatatatatagagagagagacttgtttttgataagtgatgtatggttcatgtaagtgtctttacaatgtattatatttaaggtttgattttgtagacatgtttagtttgatttttggagtttcaaagcttatgaaaatcattttggttcagaataataaaataagttagataatgaaatttatatgcattttcatatgtctgtacagaacttgatataaatactcaaacattcttcctttatatacctttaggtttaactttgatttgatttggtaacataagattaacagtgatataaattttggttcctctagagaaagaaatacttgagaccactaaaattaaaaatcttgcattaacatcctataattgtatgaaaatttaataagcttcagaaaatataatatatttggagccttttataacatagtgtagcatttgcttggaacatggaatgaaaattaagagtgaatcccaggttttagccaagggcaggaaggtggcaaagggaggcgaatccgagtgggtggagggaggggaagggcgagaggagaaaaaggtgggaggaggaccaggtgggagggtggcggctccctcaggacccagcgggggcagcgcgatgaggcgggtgaccctgttcctgaaaggcagccctaagaacggaaagagtaagagacttaaatgaatatgactgattgtcacacaaaagtgtgtcctacttcaacactcagcattcaagaaatatttatcaaagacctgctgtaagccaggtggttgctgtatatggaactttatctgatttgctttctgtggccagcagtaaactcggcataaaagccaccagtgtgtataatgggaaaggtggactgattgatgatattgctttgatcagggatgatgatgttttgtttgtttgtgaaggagaatcatttattgatcctcagacagattctaagcctcctgagggattgttaggattccacacagactggctgacattaaatgttggagggcggtactttacaactacacgcattactcctaccaggttgtagcatgcatctttttgagagagcagctgggatcgagtatactcttgacttaaatgtgtttgtttataaagacaaatggagaaatcaatttgtttccctgaattctaaggagcactttagtgaataaagaacctgacagtatgctggcccacatgtttaaggacaaaagtgtctggggaaataagcaatatcatagaggcgctttcttaattgaccgaagtcctgagtactttgaacccattttgaactccttgcgtcatggacagctcattgtaaatgatggcattaatttattgggtgtgttagaagaagcaagattttttggtattgtctcattgatctaacacctggaagtggcaataaagaattctcaaccaccggaggatcattcaccaatatcccgaaaggaatttgtccgattttttgctagcaactccaaccaagtcagaactgcgatgccaggatttgaacttcagtggtgctgatctttctcgtttggaccttcgatacattaacttcaaaatggccaatttaagccgctgtaatcttgcacaggcaaatctttgctgtgcaaatcttgaatgagctgatctctggatcagtacttaactgtgcaaatctccagggagtcaagatgctctgttctaatgcagaaggagcatccctgaaactgtgtaattttgaggatccttctggtcttaaagccaatttagaaggtgctaatctgaaaggtgtggatatggaaggaagtcagatgacaggaattaacctgagagtggctaccttaaaagatgcaaagttgaagaactgtaacctcagaggagcaactctggcaggaactgatttagagaattgtgatctatctgggtgcgatcttcaagaagccaacctgagagggtccaacgtgaagggagctgtgtttgaagagatgctgacaccactacacatgtcacaaagtgtcagatgagaattttagaggctggaggaagatgtacaagatgaaaatgttttccttatcacttttctttctccactcactcagttgtctagaagaaataacactgtaaggaaattaaaaaaaaaaaaacacatttagaggattatgcttgttctgagcggtgcataagggaaaaaactgactttttttccatattctgatttttaacagaaaagcactcatttaatagatgtagggaaactagatattgctgccttttgaacggggtaggggggtttacctggttttatgaccaggaatagtatctattatatttgcttttaaataggaatgatgtggaaataccatcttggtttgagatgcatttgaggattttaatttatggaaagtacaacatatgcaattatatttattgaatacctagatgcagtatggatatttaaattgttaaaactttatgaaaacttggaaaaggttgttcaggtttataaatagctttagtgacgcctcccctctttaaatacctgtcataccatatgaatatggtgagattagactccctaagactcttttcaggttcatttttataatgtttactttttaggttaggacaaaacagtagctaaattaaagtaatatccagttcttactgattgagacagagtggaaagaaagacatcgttgtacttcactgtcattccaaaggtacagtggaactccggatggaggaataacttacctatcactacaacacttataaatgagaatttctcagaatttcattctaggcaagttccactcaacaccagaccaagcaattctatctatttacactattagcttagttttctcatacaatcatcacaagcataggaagatacttcaaaaccaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggagaatgaggaattttaaacacacattttattatagccaccaaaaaacagatgtaaagtaaaaataaaggcatttggctggtccaagatgtaataccaatcagtcagcacctgtgattcttttacttatattttttgtgtttttttaaacaaattttagcccaattttcttgagtcattatctctctgcagcagcagaggaagggcctgtacctccctaccaatgacctggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttgttatttttaccaagacagagaagtattgtattgagagataatctattttcataatcaatatatgcctaaattatatttaaatcatttcactctgtactatattttcaggaattatagaatgtgttattcattcacttaaaggtacctctgtagaaataacctaaaactgcagaaggatctgaaagatctaaacatggtgtgcttagaaactgcagattttagatctaatgtatacagcattaataaatgatataaagtgttgaaaaaaaaaaaagagtgaaacccaggttttagatatacctctaccagttacttgctatatgattttgggaaaactatttttttgtctctgagctttaatgccattatctgtaaaatgcagtgttacaatagatcattgtaagttatagccaatatcaaaatttttcttatggctgataggaggtttatttcccaaatctctctctttagaaatgcttaggtatgtctacaagcatatagcttaatatttcaaacaaaacattgatgtttacctttattaaattttttcacagctttaatttttgagtacctatgcctccaaaccagtcaaatcaatttttccaaacctatgcctccaaaccagtcaaaataacttctatatattgaagtttttgaaagcacatgtaaaattcaggataaattaccattgccatgaaaaatgctataggttaggtgttctttaaaaaaattatatacatctaacaattatttattggagacactactatgttctaggcattgtcttagaagcaggtgatacaaaagtgacagatagcatctctgctctcacaaagattatactcttttgggagagagaaagtgaagaagaaaacaaaacatacaaaaattatcagctagtggtaagtgccacccagatgaacaacatatgtgatgtggtagaaattgaggagatggaatggaccaggtagtaagggaaagcagagatctgaatgccatgaaggagccaaccacatgaagatgagtggggaaaaaattccaggctcatattatgtgaaggcccaaagcaaaaatgaactcagcatgtttaagaaattgaaagattagtgagactgaagcttagtgggagaagtagagaatggtaggaaatgaggtcagaaaggtaggcagggaccaaattggctttgatttatagatagatagatagatagatagatagatagatagatagacagacagacagacagacagatagatagagtgtggggggggggttggaaaacatattttaaacaaacagtatagatttggggtatgcttaagatttagagtcaacagcacctgttagtgagatgaatatgaacagtaaaggaaagagaaattggaaaaacacctagaggtttggtttgagcacctggataaatggaggtgccattaattaagatagcggaagacttgagggaaaatcaagtgtagggtgcaaagaagtaaacatcaacaactctatttagtcttattaagtttgatatattaattagccatccatataaagatgttaggtagatagttacatagagaagcctgagtttctgggtagaagtcaaggcagtagatccatatatgggagtcatcagtatctatatgttatataaagtcatgaagcagaggaggagaagttagcaaatagaagtattggttggtgaggtaggaaaaaaataaagagagactataggaggaggcaacaccaagagaaagagagcatttaaagtgggagggattagtaaactatgccaaatgttactgagaagataatgaggatgagagctgagaaatggctatcagactgcgcaaagtggagactattgagtggtggtaaaggaagcctaattaatgttgattgagaagaggatatagagtgaggaaatgaaatttcttcacactatttcccctcctgggataggcttggtacttataggccaggagagaattggaagagatactcaaagtacttaaagaaaaaataaatcagccaagaatactatatccagcaaagtaagttatccttcagaaatgaagtaggaataaaaaccccctgagagaaggaaagactgagaaaattaaccaccacaatactggctttgcaagaaatgcttaagggattcatacatctggaagtgaaaggatgacatctaccaatgtgaaaacatgtgaaagtataaaacccatcagtatagataattccaaaatcacactcagaataccccagtgctgtaatgttgctatgtaagtatttcagtcctctagtatgaaagtttaaagttaaaagtgtcaaaagcatcaacagctataattagtggctaaggtagaaacaaagataaagttataaattaaggcaataaaatacaaattatgtgggaggagagaaaaatctagagcatttttatgcaaccaaagttaagttgttatcagcttaaaatagtctattgtaattctaagattcattatgttagttccatgataaccacaaacaaagaaatcacagcagatgcagaaataataaagagaaagaaaacaaaacttaacaccacagaaaaccaccaaaccataaaggtaaacaacaagagaggaagaaaggagcaaatgatctataaaacaaccagaaaacaataaactggcagaagtaagttcgtacctatcaataataaccttgaatgtaaatagattaaattccttagtgaaagatatagagtagatgaatgcattaaagaaaaccacaaaacccaactatgtgctgcctacaaaaggctcacctcactattaaagacaaacatagactgaaagtgaaagaatggaaaacaatattccatgcaaatggaaaccaaaagtaagccggaatagccatactcatatcagataaaatagactgtaagtcaaaaacagtaaaaagagaccaaaagattattgtataatgataaagggatcaattcaacaagatgatataacaattgtaaatatatatgcacccagcaccagagcacccaaatacgtaaagaaaatattattagatctaaagggaaagatagactgcaaaacaataatagtaggggacttcaacaccccactttcaacaatagaaagaaagtcaacaaagaaacgttgaacttaaactatatcgtagaccaaatgtatctaacaaacatttacagaacattccaataaacaactgcagaatacacattcttctcaatttcacatggaacatcctccaggatagatcatgtgttaggccacaaaacaaatattgacaaatttaggaagaaaaagagcacatcaagtatctcttcttatcaaaatgctataaaactagaaatcaataaaaagaaaaactttggcaatcttacaaatacatgggaattaaacaacatagtcctaagtaaccagtgagtcaatgaagaaattaaaaagaaaacttaaaaattcattgggacaaatgacaatggaaaacacatcatacaaaaacctgtgggacacaacaaaagcagttctaagagggaagttcatagtaataaatgcctacatcaaaaaagaagaagtatctgactccaatatttattgtagcactatttacaatagccaagatatagaatcaacccacatgtccaacgcagatgagtgataagaaaaatgtagtatatatatatatatatatatatatatatatatacaatggaatactattcagccataaaaaagaatgaaatcctgtcatttacagcaacttggttggacctgggggacactatgttaagtgaagccagccagactcagaaagacacataccataccatctcactcatatgtggtatctaaaaaaagaaagttgatatcatagaagagtagagtagaacaacggtaataagggaaacagagactgaggcagaggtgggagaaagaaggaaggatgtggcgaagttggtcaatgcatgctaagatacaattagaaggaagaagttctggtgacaatgcttatcagtaaggtatagtgtattacaaaagagctaggagagagcttttgaatgttctcactgcaaagaattataaacacatgatgtgatgaatatgctaagactatgatttgattattatacaacatttatgcatctaaacattgatttgtactccataagtatgtacaactacaatatgtcaataaaaaataaaaattattctgatgaagaaaaatatatttggagtttagcaatttcttctaattgactttgatttttgttaaattcaaggaaaattactgaaagtaatgcatttattcaaaatataatatggaatgttaccctattttttaaaattatttttctttccaattttctatctatatctctacatagatggctggaatgatgtttaataaatgttaataatgaatgtttcagtgtggtaagattctgtattacagtatatgtaatttattttctgtgcttttctatattttatgaatttctgtcataagaacgtattgtttttataaaatatcaaattgattattttaaaacattgtgctaatgtcgataacatgggtttttttccccatgtggtaaacagaataatgtccccctcaaaaatattcacattataatcactggaacatatcagtatgttatgttatatggaaatgggaggagtaaggctattaattagctgaccttgagatagggtgattatcctatactatccaggtgggcccagtgtaatcagaaaggtccttataagaagaagaaggcagaaatgacagaatcagagagatgacagcaggagagggagtcagtccagctctactggctttgaagatggagccatgggaccatgagccatggaatgtgggtagcttctagaagctggaaaaggcaaaggaatggattttttcctagagtctccagaaggaatgcaaccttacttacaatttcatttttagctcatcaggactcatgctggaattctaatctatagaactgtaggaatacattcttgttattttaaatcattacgtttgtggtaatttgttaagtagtcataggaaacaaatacactcacttccacttaactattatctaatttattctctactcagcagccacaacaaacgttataggcctgcattgtccagtataatagccattagccacatgtgctaaatgagcacataaaatgtggctggtctgaaatgagatgtgctgtatatgtaaaatacacactggattttgaagacttagtatgataaatgtaaaatagctcattaataatttttaatattgacttcatgccaaagtgataatatttgggctatgtttggttaaataaaatacaatactaaaatttattttccctgtttcatgttacttttaaaatatttgtctacaggaaagcttaaagctacttatatggcttacattgtatttctattacacagtgctgatatagaaggcaaataagacactatcattttcttttttttttgagacagagtctcgctgtgtcacctaggctggagtgcagtggcgcgatctcggctcactgcaaccgccacctcccggattgaagcgattcttctgcctcagcctcccgagtagccgggactataggtgcccaccaccatgcccagctaatgtttgtatttttagtagagacggggtttcaccatataggcccggctggtctcacactcctgaccttgtgatctgcctgcctcagcctcccaaagtgctgggattacaggcatgagccactgcgccaggccaacactatcattttcttattaaaggccttcaatgtcttcccactatacatgcaatattcttcaaactccttaacttgaatttataagatcttgcatcatctggcttctggtacctgtttagcctcatcttttgcctcttatactccattctagtgggccaagcttgtttctgcacaggggctttccatgtgaggttcagtagacccaggaaactcttcatttcactattcatttgattgaaaagctctcatccttccctctcagctcaagtgtcactcaggtataccttctctggaatcccaatgtaggtacattttgctgcctcattcatagcatgctgttatttttgttaatggcacttttcacaacatgtaatgataaagtttttgtttatttctaaaattctctttgaaaatgataagctcagtgtatgctttatgtattaggcaaagcacagatgctcagtaaatattaaattaatgtagaataatcaaataagataatgtttatgtgaacacattataagctataatttactgtacagatgtaataatagtaatagtcatagaaagagaaggaggaagataagggggaggaagaaggtaagaaattaaagtctttgctttgcatcaatttttaatagatttttttccagtctcttatgtctttaaacatttgggaataagtaacacaataagtagctatattccattgctttaaaataaaagatctattttcaaagacatatcccaatttcttcttaaaggaagttttctaaattgtttgctggtgactcgggttcccttctctaaggcataatatgtatatccacagtagtgaacacaatgggaatggagtgtggtggagtaggtgttggagaaagcaaagcaaaaccagcattaggatggttatatataataggaatggttatcatataataggaagtcagactgtgcaaatatttgttactgctatacctactctcttaaatatgggagtagcattatttgtgttctaggtgaagctgtccagagctatatgtctatttgagattgttagtttttgcaacaggaacatgaaatttgtgtccctaattgtaatgctcaacagtcttgctataaataagtataattgcactgtactttctttatatttttttctaattagaaatttatttttccctgtcaaagtcagagcttaagcacggcctttcttaaatgatcttaaagtaaattttcctacttatgtgccttttctacaatcatttctgacttaaagttaaccttataattagcattttaatagcccaaaagccttccttgtacttagtagcacattacgatctgcattgaaataggaatgttataaaagaacaaaataaaaaaattacttatgttagaaaagttgtttttctaggttttgtttttgtgttttccttatggcatatcctctctatatattagacaaagattaaaacatctctttttgaagttactgaatttattattggggaaagttatcaaaaccaatcctctacctttaataaaaatgccttaatgtgatattttaaaaataatacccaggaaatgatgctttcaaaattaagattgatctactcatttccaatttggagaaccaaaggcaaactaaaaccttttggcttatatttgttagttatagatagatatggatatggatgtaggtatagatatagataaaatcagacttgagacagcattgaaaaattgaagtgtgccattattataagataccatttaataagccacaataaaaaaaatcttattacgtgattcctgtatatgtgacactgtttgccttagatacatctctatcttttgctgctatttccccatccactcatacacacatacttattttatcaatgtctcaacacctgaagtactcccacttctgcctctgtgccttgtctaatcatcgcatctccaatcagattgcctgagttcaaatgttcttttcacgacattatttgctgtgtagccttggtaagttacctaacgtctctgtccttcagtatttgtatctgtaaagcaggaaaaatgatggtacttcttcatagaattgttatgaaaatgaaaagtaatgcatgtaaagtattttggcataatcttggcaataaatgtaaactattatttttactcctttaaattatacgattaatactactgctactattttctctactgccagccctctatatactctatatttattaaatcagttcttaaataatccttctctccgtagccttcctgtattaaagaggaaagataagagctcttttctcaccccacctttgcttctgtttcgcttgcttctcattgtcttaagaaagagacttgcggggttaacagcagcatctctggctgatgtaatccaaacctcaaaagcaacatattaaaaataaagcagaacatcaaagctggttctttaataagtcctctgtttccttcgggtcccacacctaggcgacagtattttttcatactttgttcttgtcccctattccatgtcttgcagatctagctcagttttgtaaattgcaaccttttctcctttcttctgtagttagttcatttcatttgaaataaagcatttaatgatcatctagccctgtgctagggagtcaggatatgagggagagttcttaaagaaacaaaatcgtgagatactgcctcttctttcaccaaacaggaaattagatttgtataagatttatatgaagtaggccgggcgcagtggctcccgcctgtaatcccagcattttgggaggccaaggcaggtggattacctgaagtcaggagttcaagacagcctggccgacatggtgaaaccccatctctactaaaaatacaaaaattagctgggtgtggtggcgtgtgcctgtaatcccagctacttgggaggctgaggcaggagaatcacttcaactagggaggcagaggttgcagcgagccaagatcacactgttgcacttcagcctgggcaacagaacgagccttcgtctcaaaaaataaattatgtgatttatatgaaattattagaaaatcctgaaagaaagagtattcatttggtcagcattcatcacatgtactaaaattatttgtttttacatttttctccattaccatagtatgagttcccttggggaaaagtcagtgcctcagtaatactgtttatctgctcaagttcctgtcttgtaggaggcattgaagatattttttgaatgagtaaatggcaggatgaaaagatgagacctagatcttatcctcaagaagcttctagtctgttagaaaggatcacttgtgtacataagtagtagtaatccttattctagcctacatttatagactcttctctcctctacttcccaatgtacccagtccatagagaatatgacacgtatgcttacacctctctttcataatttcttctgctgagaataccctttcctctttttccacttatgaacttgtattcatttatcaaggtacaactcttaatagtatcttatcagtaaagtcttctctgagtcttttccccatgtagaacaaatccctctctcctctgcccacttacagcatttttcatatacctcgcttagctcttagtacattaaatcataattacttatcattttttcagctttaatgtgaactccaaaaagagtgagaccttatctaattgatctttgtaattctagggcctacaaccgtgtctggcttatagttagtgctcaacacatagttgactgaaaaaaaaaatgaatgaatggatcaatgactcaatgaataattgtgacaaataccctaaaagaagtgggaaaaaaactgatatatgattgttattttgtatagtagggtcccaagagccaaattcaaattccccctttttggttaaagctctccctgcctcagtctcactccttttttttcagttcctataccttctgtctgttcttgactttgccataaccgttgcctgttatgacagattccgtgagcatccagcacagatgtatgtataaaaacaagtaagattaaccataggtgagattttgtcacttgaaacataataatatcatgtataactaattgttgcatgttctaattaattgcatattttgattaattctttggcagggaataatcctggactaattttcacagaattagaaggcagtaaaatatactcaccactgcaattatactaaacatagttgaatggagaagattggtttgaatctacactaatcccaagatgtacatgggaatttgttctttaaaaaaatacccagcatacttgtcatttatcatattgttataaaactcaagaagagaaaagaccccaattacttttgctttccagttgtttggagatctgataaaaggaggtattttgaaaatggctcaacaacaactgacaaaagtccctaatggatcatatgctttgtcatcctcagtagcatcactggtttactctgcaaacattagcagtttccttaatctccacagtcattggcttgagagtgaaaacactgcatcacctagttagaaccacaaaaactagattggttttatatttaagtgctttgaaaatttagaataacacctggtaacttataacaattgtccagggaacatctataacgtgcaattgctcagggagtgtttcggtaaaatttatcctgaaacaagttggccagcagccacatcttgaaaacatctatgttataaagaaaaatttcatcatactggtacatttttccatagagtttggcatgtattatcaatccactattactttagaagtataatcttaataatattttttgaaaccacaaggtttacatttatattttcctgattttctaggaaaattagatggacctgtgatagaagtagcattcggtataataagtatattttacagtcaccacatacacagttactttgaatatctgtcttcattctatatctaccaaggattccacgtctcactatttccagaaggctttttcaaagcacgaattctactgaattgagaatggggatgttgtttgttgttttccagaaatagacttgcatgctactatattttgagcaaatgatcacaaacacatccgcatgagaaggcaacagatgtaaagaaaaaacttctatatttattacaaaccaagggagcaatgcaagtatcacagcaaatttgtaccaacaattatatatattcttttgctgacagcttggtctgcaaagctgctagagtgcagaatcagcaagtctaacccagaggcaactccaatctgatggataatatttgattcagtaaatgaagtcaagtaggagtttaaaaaccagttacatcttctttcatcagacattgcttcatcttgtcagtctttttttgtagactgtaaattgaataatacaaaatgttatctgcaaaaaatttttcagcttgttataaagtgagaccatttgtgaaaggatgaaatagttacaaatgcgtatttgttactgataaatgatggcatgtatgatccagtgttttgaactttcctccacattaaaaaaaaatgttggagataagaaaactaacccaggtttttttttttcttctgagtacaacagataaaaggaaaagttagcctgggagggatttttgaagttctttggttcactgattttctaacctgctttcacattataaagcacctaaagtactttttgaaaatatagtgttaggctccactctgaaattttgattcaggaaatctgaaactacctactaagtactgtcaccacaacaagtctatgcacttattcagaactactgatctaattcaactccttactcaatgcggaatcctctttacaaaaaccttaaaatgtggctgttcactgactcaaggcagcatagtccattgttggacaattctagttcagagaaagtttttatgtattaaccccaaatcctagaaacttctccccaatattgtgtgtccagcaacttcacatgacccttccatggtcacacatgtgcttggttcatcagggactccttattttgcttagccaattctgtctcagggcctaaggagtgtgcgtatcaaaaaacaaaattgcattaaaagttacatttatattgatgaaacaaaatatccacaggtttatgtccctcaattagtagctatgctggattgagctgttcactcagaaatggcttctaataacttaaatgttggctgagtatttaagattaagatttgccacttaaatgacagcaacacttcattcagtattgggaagtgtgagaaatttgactgacaagccccactagcctatttacaggtatcagggttacagttgaatttaaccttacactcaggcttctccagaccaaaagagccccatcttctgaacttcctcaaaaagcgaaagacagatctgagaaacctgtgccaagacaatcacatcactgggaataagaatagtactgtgaaccccagaaatctaagacaggtctcagttaatttagaaagtttattttgccaaggttgagaatgcacacctgtgacacagccttagcgtgtcctgatgacatgtgcccatggtggtcagagcacagtttggttttatacattttagagacatgtgagacatcaatcaacatatgcaagatgaacattggttcggttcagaaaggtgggggacaactagaagcaaagacaggacaactcaaagtggggagtgggcttccaggtcaaaggtagataagggacaaaagatttcattcttttgagtttctgattttcctctccaaatgaggcaatcagatatgcatttgtctcagtgagcagaggggtaactgaatcaaacaggacgcagatttgccctaagcagttcccagtttgacttttccctttagcttagtgattttggggccccaatatttattttcctgtcacacattcccccttctcattttaaaaatcttttggagaaagcattttagaagaaaataagtctatgatctcaggtttcgtctgatagatcatggctagaatggtttattcctagatgggtaggtcctgagttattaggaaagttcatttttagcaaattgtgaagtctcatgtttatgaagagaaaatagggggaagaggggagaaaaacaacaacaaaccaaaggatgagtctttactcatcctggaaaatcaatataaggcacattactctgaagtccatacatcagtaggcagctatgaaaatggtttatgtaggtaaataggttgctgttattttcttctgaagtttaagttgtctagcttcagttcacagggctttacaaaagcacagcttagttttcagtgactccaagttagaaaaatgtggggaaagagaaggagaaataactgaaaacattattttgaagacttacagccaagaaaaattagaattcattccaaactatagaaaataataaaaattgaaaaacattaggcaagactagaatctaacaacacgtttactacagttttttaaacatattttttctctctccagttttccatttttactaaagacaaattatggtaggactgatttgttttattatacttggcctgattatttgtatacagtgcagcaagaataacattttttacagaagcttttaaattggctttgatggaattttgtttcataggagtctcagataagacttttaaagctgagcccagccttggatttataccatcaaatgcctatgatttgggtgaattcctcttctcttgaggttccaagataaacctgggggctcctggtcctgtcagaaagtgacattctttacttaccccgggttaggacccctgtacagggaatgtgtagacaaggtataaagtcagttttcccaaggggcttttattggctccacaattcaagtttgattccttaaaggaaagcacaccattccagtcaaagccttagtaaaataaccagtttctccaattgcgtcctgttatagaggaaaacagattgttatttcacttgtgcaaataacaaatattaagaatactcataaatagcttccaaatactggagaattcaggtagagagaaacaaatatattctaaattttgttcatagaagtataataaattgttaaaagctgccaatagctcaaaagaaaagtttccttgactctggaaaaacagaacaaaggatcagcaacgttttaagcaaaaagtcaaaaagattacttccgtcttctactagttcagtccatgtagttaattcctgttctgcttgatattcatgaacatttcagttctccatgagttctaaaagttttacttctgttctgatgttacaatcttcaaagttatcagaaacttgtattcaagagcacctgtgggagttttatagctgattataaaaccaccttctaaagaggaccaaaacaagacaacaattgtctgcagatgacaaaaagttttagggcagccagagtcaaggacacaattgacaaggaaatttgttgcctttgttgcacacaaaaaattatgttaataatttaacataacaattataattattactgataatgtccactaagtcatatcagaattataggagtttcccattattttggaacacatagcaataacatatgtatacaaacacggtgcaaagaaaactaaaagccatttcatatttgacagtgttttctgtataattttcataccgaataaaccaaattgtcatttttggacttcaggaaacctaatatcttaaaggattaattaggtcagaaaaagacataatttataatttgattttggtaagtttgtcaaatatccaaaagttagaacacatgatatcacaggtcattgtaaaataagtcattcatttggccaaagtgataactcaaggatttcaaacaaaaagtgagaaccttcactctttgagagatttctttttcctttctcttttgcagctgtgaggaattttggccatattagagagactttgttacccataatttggaattctcactcagatttgacccagtcaggtagagttggtcaaatctgatgggagaaagaatggaacaaacaacaacaacaacaaaaacccaacaatatgatcactgagcactctaatggtaaggagaaattaagacaagttagttgttaaactttagccaaggcaaaaccccaattcagctacttacctagggatggttctcaggctgaagatggctttctaccattctagaagcaggagaaaaaatcctcaaactcatcttccctactgggagcgaactcaaactccataaaggagttacctaccttccatcatcatggaaacaggaaatcttgccttccttgttggaaacaagtaaaaaaaaaaaaaagggtgttgacagcaaaataaactttagatcttgaccaaatttggggagatcagggattatctggagggggtgctcctagacctaagcaaattttcctattggtttgagccataaagttagttcatacttgtaccaagcaccagtaggagatttgtcaaaaggaaggggcatctttattcagaatcccttcatggttaccaaaatgtgaaccccaaaaatctgaaacaggcctcagttaatttagaaagtttattttgccaaggttgaggatgcacacccgtgacacagcttcaggaggtcctgatgacatgtgcctaaggtggtcagaacacagtttggttttatacattttagagagacatgagacataaatcaacatatgtaagatgaaaattggttcggtctggaaaggcaggacaactcaaagtggagaatggtcttccaggtcataggtagataagagagaaatggtggcattcttttgagtttctgattagcctctccaaaggaggcaatcagatatccatttatctcggtgagcagaggggtgactttgaatagaatgggaggcagatttgccctaagtagttcccagcttgacttttctctttagcttagtgattttggggccccaagatttattttcctttcgcagtactcaaatggagcaggaagtggaatgatacagaggacgtacattgaatctggggatgggggtactgtggagaagctagttaaacagtaaacagtcccagctactctggaggctgaggcaggagaatcgcctgaacccgggaggaggaggttgcagtgagtggagatcattccattgcactccagcctgggtgacaagagtgaaactatgtctcaaaaaaataaatgaataaaataaaaaataaaaattaaaaaaaaacagtgaacaaagggattaagtgtgtactgataatccttttctttccaccttgtcttccttcttggtggtaagcttagctcttgcttagctcagttcacacctctgccatgccttgtaattctgtgggacatcacccgggggagtcctattttggttgccagctgggcttggaagtacaggctctttactctgggtctccatccaactgagccaccagagcagggtcagacttgaaagaaatccagggcagctactgtcctgacagataacccagcatctttcattccagagaacagtcaaattagaggagagagatttaaatcttaccttgctgagaagaggctgtcacaacccagaccgctcactgagaacagcattctgactaaaccttggaagggtatggacatagtaaaggagattacttgggtttgaggtcaacaactctctgcactgaatgcaatgagggtgccaaatgtcatcttctaaattaaggacctggccaacttaatgcaaagacaggcaggggaagaaaaagaaaaatacggaggaggaaacaaagacgatgagagtaaagtcaggaaaagggaaattgagtatacaggaaaaaggaaaggaatttgattaaggtgaatgggaacatctccttccccacccccacctcaggaattgttaggactgcagctgctcttttaactttttttttttcctgaagtcaatttttatgcataggactcaggaagtttaaaattaaatgacacttgccagttttttgactcagtgtaacttccctctcatgttatcctttttttttcctttgctgattcgtgtaagcaaacccattatctgaacaaaggggagctgacagagtgtcctgaccttatcttttccaactcctaattattttcacaaggtactgaaatgaagttttggatttattttttaagttggggaactagaaaataaaggagtgaaattgtgctatctctgatgacaccaacaattttccagatttaatttagtttattttaaaaaaatgctacaaaaaaccccatcctaacaccaacaaaaagaacatcaacaaaccagcctgactaagcccagacccctgtcaggaaatgaaattgattaaaggtgccccctcttcctgttactgtctgtaacacttgtctatttctgccaaaacatgtatcaaaatctgtaattttcttgtttattttttctgtttttttttttttttatgttttgcctgtctccctcccagtagaatgtcagatccattagggcagggattgattaattaattgttttgctccctaccatatatatttctgaactaggaaagtacccagacatagcaggcactcaataaacattgattgattgattgaatgaatgaatgaatggtgaggctcactgaacagacagaacaagcctttaggagagatccaaaccactagtctgtaaagtactatgtcatctgacccctgcctaccacagcaacttcataatttactctccctctgacctttgaactcctctcacacactatattctacctacctcagggtgtgatacatgagatttcatttacctgggattttgggatgctcttactggcttggcaacttctcatctttctgatctcattataaaggcacctacatgaaaacttcttggccatcccaagtagccaagtagcctctccttagcccctattctactccttgttattctctctcattttacattgttcctttccttcaagggattattttttgtaatttataattctatatttatttacttctttattgcctgccccctcccattgttatattcataacgactgggattatgttttttttttcttaactctgtatccccaacatctaatacaatcattggtacagagtagataattaaatatttgctgattaaatgagtaagtaaatgaataaatgaattgctaatgttccttctcccacacctcattgtgcagacatgccatcctgaggtctggtgtttttatacttttggcatggccatgtaccctcagaccccaccagagaaaaccttgggctaggaaagcctggatagtcccaattacacttcaatgatttgaaattaaggttatatgaataatttattttgaaaggaagaaatataaagaagggaaacatttttgttttcatttcttatgctcaaagtggtttgggttcaaagttggatttttgttgtaaatacaccacacttgcagcaatacaatataccatgttatttttgtcacaaacagcagatttcctaatgggagctagagagtcctttgggaacttggccaaccaggcctagtaagccattttgatcatgtcatcttggattaattgctatttgggctccatgctttctttgcctggattaggggacagggcttgtgcaagctcctgatcaggcctcctgctgccagcacaatactgtctcccactctcctcaaattctttatcttcacctgttctggaactctctaacaccctatgacttcagcagctgttgtctctgcccctgaatcagacatgtgttcaatagaggggtttatataactaggccctgagaaggatttttccaaatggaactaccccatatattttatttactttaggatatattgcttctgtctctgtatccttcctagtaaatatcatgtctcttaactttctggagtcatgtttataaatgcagcagatttgtgtactatgtacagaccttgctgatttgcagctcctagcaccaatccttgtgtttagtagacattcagtaattattgtttaatcaaattggatcaaatctgaaagcgtattgatgccattagaggaagaagaatccaaaaagactgtcttcctaggaaggaaacttcttcatctctttgacattttgagaactccttgtgtgagggcaacatgtgtagatgagatttagattatggtttaagactaactactaactgctggcctctatcagtaacaggaagggacagttagcaaaatggtgattgagtttctgattcagtttctattgaaaggatctaaaataatatgtatacaattcattgtaactagatgttggaggtttgaaatattccgaaaaggattctaatttaaaatattgaaaaatatgctttgaatatatacaaattcaaaacactatatgggaaaaatgaaaataaaatagaaattgtgaataaaatatattaatgttacaaaagaaagtaaaattgaatcatatagtaacatctagctttattttcagaaagtattatcaaatgaagaaaacactaatatctaaaacaaaaaactacaaaatatttgatgcaccaaataaattgaactatcaagtatttccaaaggcctaagatttcttacatatagacagtactaatataaaatttgtgtgagttgtaaaaactgcccagttccagactccaagggatacaaacaaatatagtagctttctttttctctgttgaaactaaattttactaactcctggacttattctcatttccaggtcaagattttgttaactcagactttatacttcgtccaaatgacatttgcattgacaatctcagaaaccatttttgtcagagttcccgacaacatccaactctgtctgagattccccctaaatctctaggggtcatctgagcccaccttcaccctgcatctcctgctccttttattcacttctgcgaaaagagggagttgtgttcaccttctttttgcatttagcaaatgaaaacaatcaatggtatttacaatttccaacatacataattaagagacaaggcagaaaagatttaaagcagactttcaagatttagtcaatactaaacctgtggtacatttgtatagtttgctgatctggatgctttgaggatataatgtccctcctatagaactaatcattcatgctgcttagccctcatttattttctgactcctaagagcaccatgctttacgtaaaatgagtgcacaaaggtcaggtggcttgagaatttgtatttagttcagagacttgaaaatttggtaggctatgcttgtatttttttcccctaaatctgaaaaacctgtgattttcctttccccagaggcagtctgctggattagatggagacacgttctgccccaaagacagaaactaaataatatccggaaatatcttgatctgaagcaaaagccatgccaaacgttactgaagaaagctttgaaatataaaaataagattagaataagaatcccagtgtcctacactaaatattttaacaaagaaatcgttcaccacttagcactttgtgtaatactgtacagattctaaataaaaatgggattacataattagtacattgatcaaaaattgtgaaaattagcttcaagttcttaataagtcatagctgaacctcagcatgggcaaactgctgaatgttcaagggatgaaaaatagaatttctgttatgtagctctaggagcatcatgaaaatattcaatcaatctggcagattaaagatactgcaggcatcctttattgtcagagatttgattcataatctatacttatcaaatttggtgacattaaacagtggttttcaaaatttaatatgcttcagaatcaactgtcatgcttgattaaatgcagattctttggctaatacaaaaaacagtctcattcaatggattggtgttgacccaagaatctgcactttaacaaacaaggcaggtaattataaaactagttgaccacagactatgtttggcaaacaatgctctagtaacccaggggtcagcggacattttctgtaaagggtcagatagtaaaatattttctgctttgtgaaccaaatgatctgtcacagctactcaactctgcccttgtagcatgaaaacaacaatagacaatatgtaaacgaatgggagtgactgtattccaatcacattttatatgcaaaaagaagccttagcttgagtttaacccgtgggctatagatagcatacttttcagaaccttggtataaagaattaactcttgttacacacctaataccttcaatctcaggtttttctttttgtatctggtttatagtagagaggagcatctgttggtcaactgtgattttagagtctggctccatttgctattgtaaataccaaataaaatagagaacaaaattttttgagctgtctacacaaaataaagggaaattctcatgacctattttccagaaaatcttcttggattaaccaagccctgtctgtagttaaccaacacattctcctgctcatgttttctctacaattcgcattaatgattcttaaccccagtatgacaataatatggggcaggaagattgagcaagctcttttgatagaacaaggacaaaacatacctggcatttgtgctgccatttcaattcacaacacccatagtagacattgccaatcaccggtagtactctttccttctgagtgcctatatggccacaaagtatttctcaagaattccaggtactcattaccatcagactagagttgtcatgtgagataaaaattatgtgtcatcccttaataagctagccttactatatagaatttttattatctggggttattctatttggaggcacatagtattatttctactatatcttaatccatataattatgagccttgcttaatagagttacataatacacattttaattggttgtcattttctgttagaatattagtatcaaatttgaggactgtgactagtttatcatgttataccctgagatcattcgagaaacacttgttgccaggtttgtatatcatcttttctcattaaaatttctatattcatcatgtctatattcatcatgactatgatagtatactgaaaacttctgctaatagttacctaactaaagggcatttgaaaccatataaactgacattattggcaatctgtaaattgaattgacctatagtttcttttctggaaagatatcattgcaactatagcatatctttgaagtagcattttagatctatttgggttaatatttactgttaaagaattgtttggctgcataattaaaatgttcacttactaagcacaatgtagtttctagcattaaatggactctcttgcacagcatgctaccgactctgcaaactcatgaagtcatatgctagctatttcagtaaaacttatttagtaaaacttgaagaaaaattagcatttaatgaagcaaagcaattttcaaagcatttacaattccatcctggcacataaagttcatgtgtaatatgactttatctaaatatttactgaggtggtagcaagtgttttactgttggcaggattggttatgaaggatttgacctgaaactcaaattgaataggatgaaaagttaagtacagagagcgaatacggtctaactaggtggcttgccacaaagtttctagcataggcaagctggcatgtgatctgagaggccatctccattagacacccagcttttcacctagcaaatttgatagaaactcaaacaccaaaatgaagcagatggatagtggcaaccttctgtatctagtactggtgtttcagcaccataacctcccttataggtattctccaggcttttcctatagacttctgttatgccttggggaacatgatctgacctctgatatttccaaatctccataacaggatctgagtttgtttatttttaaccaagcttcttcccttaaaacattaaaaatctcttctagctgctcaacaaaactttcgacggctttaggcaaagagagagcatttgttagaggttctaggaagacccaactccagaaataatatgttccccatccttatagttctgatgtctgtctttgagacacataagaaactgtttactctagatattctctatacttgacatttatcaagaagatatgggaaataaagaggggttataagtgaatctatgagaatgaagcacatgcaactcgtgcaaatttcagagagagaagagagacagtggaacagaaatgttggtgcaaagggggccttgcaaaagaaagtggggttgagaaatctgtaatggacgctttgaatactgcaggaaatgagatccaggtgggttttggacatgttctggccaaaattgtgaccaggtttatcaactattgacaagcttagtttaccaaaccaagaaccttcttgttctaagatttcagtacacaggactaagcttccagaaaatttgggtagtagattcagtgtcttcaatttgcctttttttttttttttttttttttcacttttctcactctggaattttcccaccacaacaatcacatcttgtgcttaatatcctccctaggcattcagccactctctttggaatatcaaaacatctggaaaatgttgggtgagctcatttgctctaaggtgttaatgatgggtgaaaagcttaatatgttgcctttcccatgtgagtgtgtcttgggtccaaaaaatgactaatgagagctattctgaacattcttcagtatgggagaggtataggtgatatagaaggttttcttactgtcactgaaatcacagtcctgtaggccactgatcactcataaagtcttccctgtggttggctgtggaaatacagataggaaaaatgtggctggttctctcagtgtttgatctagaactatcattaagccccccctttttttgcttttgtttggttcaatttgcttttagttttttgaaatcaggctctgataagaatgctagaaaattctgaaagactcatctcaagactttctagacaaacaatgtatattttattttttgtacaaggttatttggggagtgggataagggagaattcagagagttcagggcaaaccctaggatacagataccaatttcagagtgccagccaggccttagaaaatctacttaccatacccagggaacccattgctaatttgaatgaccaatttgttgtttttaacccaaagttttctctcatcaagtcattgtctctatttaaacaattatttgccagtctgtataataattgatttttttgtcttggtggcagatgggaaactaacacttgtaatgttatagaccatgtctgagcatgaatctttagatcaacttgaattttaatatacaaggttatttttgtctttaataaatgacttgctcattggtatagaagatacacttttattatccttttattactttccatgtagttcaaagtttaatatgctagtctagctatgattggttaagaaattgacacacatggctattattgagcacaatatagtgactatcaatatgtgttttttcccggagtgggaaaaaaccccacatttctcacatttgtacactttgagagttggaaatcatcaaatatttagctagttccattgatcttagcttattaaaacttcttgtcaaatggtaggaattcttagtttattttactgaagcaaaataaacctaaatgaattaaatggttctgttagttgcggcatctataaaattaggaaattgggtgagatgaatataaggtgccatagctatgtcctctaatattccttcaagcaaacatctatgaatccatgtttagatttggctccataacaataatgccttatatgtgatagcactctctaatttacttatgtgagcttaattgacttgcaactaccctattcctttacatatttactaagttcctactaattgtccacagtgtcattaggctttgaaaatataaagctgaggtagacagtcccgtgattattgtccccattttagaaagaggggatcacagactcaaagatgtttagtgaccagagattacagttgtggagctgggacagaattccaagcaatttgacttaacctgttcatactcaccttctacctcttgtgtgcaagtagatggaccagacagaaatgcaaaagttaatgatatggatatgtcaccaaaagcatgatccataaaagaaaaaaaatgataaattacacttcatcaaatttaaaactttgctctgtgaaagacactggtctttcatgaaataaagaaagacaagtcacagactaggaggaaatatgtgcaaattgcagatctaacaaactcgaatttataatatttaaagaactcttagactcaataataagaaaaccaacaacacaatgaaaaatagattgaacagatagttgaccaaagaagatatacagatgctaaataagcgcatgaaaagatgttaaatatttctagtcattagagaaaagcaagttaagaccacaatgtgctaccattaacattcattaaaatagttaacattaaaaaatactgacaataccaagtgctgacaaggatgtgaagcaactagagccctcatacattcctggtagaaatgcaagatgatacagtgctctggaaaatggtttggcaggttcttataaagttaaacgtgtacttgtcatattgaccagcaatctcagaatgaaaactcacatttgcgtaaaaatatatacatgactgtttacggcagcagtattcataattgccaaaaactgggaacagactaaatgctgttcaacatgtgaatgaatttaaaaaattgtggtgcatccacacaatgaagtgccacttgacaatgaaaaggaagaaatctttgtccactttgtgatgggattgtttttttcttgtaaatttgtttaagttccttccaaattctggatattagacctttgtcagatgggtagattgcaaaaattttctcacattctgtaggttgcctgttcgctgtgatgatagtttcctttgctctgcagaagctctttagtttaattagatcccatttgtcaatttagcttttgttgcaattgcttttggtgattttatcataaaatctttgcccatgcctatgtcctgaatggtattgcctaggttttcttctagggtttttatggttttgggtttcacatttaagcctttaatccatcttgagttaatttttgtatgaggtgtaaggaaggggtccagtttcagttttctgcatatgactagccaattttcccagcaccatttattaaacgggtaatagttttcccattgcttatttttgtcaggtttgttgaagttcagatggttgtagatgtgtggtcttatttctgaggtctctattctgttccattgatctatatgtctgttttggttccaataccatgctgttttggttactgtagccttgtagtatagtttgaagttaggtagcatgatgctccagctttgttcttttggcttaggattgtcttggctatgtggacacttttatggttccatatgaaatttaaagtagttttttctaattctgtgcagaatgtcaatggtagtttggtgggaacaacaaacatatgaaaaaaagctcaacatcactgattgttagagaaatgcaaatcaaaaccacaatgagataccatctcatgccagtcagaatggtgattattaaaaagtcaagaaacaacagatgctggcaaggctgtggagaaataggaatgcttttacagtattggtgggaaagtaaattagttcagccattgtggcagatggtgtggtgattcctcaaggatctagaaccagcaatcccatttgacccagcaatcccattactgggtctatacacaaagggatataaatcattctattataaaaatacatgcacacatatgtttactgcagcattattcacaatagcaaagacctagaaccaacccaaatgtccatcaatgatagactggataaagaaaatgtggtacatatacaccagggaatactgtgcagccacaaaaaggaatgagatcatgtcctttgcagttacgtggatgaagctggaagccatcatcctcagcaaactaagacaggaacagaaaaccaaacactgcatgttctcactcataagtggcaattgaacaattagaatacgtggacacagggaggggaacaacacataccggggcctgtcagagtgggggcaagggcagagagagcatcaggacaaatagctaatgcatgcggggcttaatacctgggtaatgggttgataggtgcagcaaaccaccgtggcacatgtatacctatgtaacaaacctacacgtctgcacatgtatcccagaacttaaaataaaaataaataaataagaaaaggaacaaaccactgatacatgcaacagtatggatgaatctcaaatgcacaatgctgaatgaaaaaagccagacccaaaaagttacatactttattttttccactaagatgacattctggaaacagcaaaactatatggagagagaagagatcagtgattaccaaggggttaagggagagagactgacttcagaggccagcatgagggcaatcatgctggggtgttataactgtcctatatcctgtttgtggtgatcattgcagtcatctatgcatatgttaaaactcgtagaaatatatatccaaaaattgtaataaaataattattacacattaatcctgacagttaaaattggttctagccaaaatttaaaaataagtgaggtttgaatttagcaataaatgcttcctttacttttttgttattagagacacttttctatgtattgtctttcctcagttctttctctcagttttcaggatatgatttaataaccaattcacagaaaagtttaaatgactgataatagctacatgtgtttcctctagtagggccatattcatttgagcaggttaccaaaatcttaaattaaaataacgcatttccaacagtaggtgggatgccaagcaacagccaaaggataaaggagttggtagggataaagagtcagaacagcctccattacattactgaaatgaagatatatttgctttgaaattttaattttggaggttgtataagaatatcacttagtctatatggtactatagacaaatatatagaaatgtagataacactcccaaatactgatgaatgtgctcagaccaggaagggaaatcttacatggaacaataaaaataagtgtcttgaaatcttaacttcttaataaatcatttagttgattgatttttacatcaaaattctgaaactaaactcattgtaaaaatataaacgtatatatatatatatatatatataccatatttattgtcactttctgagagctgagcaactatagttgcatataaatcactttaaaacttatgtaatagtgagaattcatttgtaaattatagtatttttaaagcaaaatgtcacccagtactttatttttacctacatttacatgtcaggtttccttaaagtgaggtatacctgcacaagaatggggaagttttgagcactatagaatttgcttacttcttttttattcttattaatatcaaatacaggtaaaccagactttacaagcaatgctacaaacagtgtagaaagtgtctctacatctatcatataaattcatgtttattagatctcagtgagagtaataaagagtttcaaaataaattggagctgcagttcttttcaaagtgaccccggtaacaatgtgtctgaattggaatactttatctatattgatttttattttcatgtcaagtttgaaaaatatgtcaggtgtactttgaggatacataaagcatatattcctaattgtatttatttttttgctactgtctatgtcaggtgtactagaaacatagggattattaaaattaactaaaacatggcattattacccatttagaaacaggtgctaggaactctcaatcttgggttctatgtacccagtttcaatcttactggtcaattctgtttaaaagcaatccaaaccagaattttctctgaggagaacaacagtaaaatataaagtgttaccatgggttaaaaaaaatagttgagtggatgaatatttagtcacagccattaacctttaattttaatggttttgattgaggaagaagtttttgtttttagcatgacacttaagtaaatgaatggtttgatcaaaatttactgttataggctaaaagtatgagattaataatagaatatcagagatgccagtcaagccactgaagaaatggattcaacctaataaagagcataactcatcaaacttaaccatgacaagcctaaatattcccatttcatcaaaataaaatggctataattaagtgttttaaaattaatgttatcagctcttcattcatccagtcattctaggccctgcttcccaactctgaacaacttccacctctgcctgttccctctaactagggaaatgtatcagactgagtgaagatttgagcaatggcacagaggttgatgacgtgagaaataatgacctggttaagtaccagataatgggtatgtgccaaagattaaggggagcctttggctagaaacaaggggatgtttgaattagcctaacatataagatcccgaagcacccagctccagataaaaagaatcagggatattaaatcaggagggaaatagtagaaggaggtaaaagaccaaacttgataacccaaagtattataaaactctgttttggggttacattagaagatgacttagggatgtggtatatgaatacatcagggagtagtggcgtgttggacaaaaagaaccacggaaatatagaatctctttttgtgcccataatttagactaagctgacatcattgtggctttcgcttctgttagatgggctcgtctgtgatgaggcccaacagatttggctttacttaaaattgagttcttcaagacttcagagtggcaagattacagggtatttatgtggcatccctcctctcccattagtcttcacaacctcaaggagaagacaagtaactgagcataaggaattgatgcagtcctcaggttcatgtagaggtccctctttcctgttgattagtaacctgcttgtatgtttgacattgcttggctgtgtgtgcccacccaaatctcatgtggaattggaatcctcagctgtcagggagggacctggtggaaggttattcgatcatgggggcggtttcccccacgctgttttagtggtagtgagggagttctcacaatattgatggcttaaaagtggcagtttccctggcactccctctctctcctgctgccaggtaagacatgccttgcttccccttcaccttctgccatgattgtaagtttcctgaggcctttgcagccatgtggaactgtgagtcagttaaaccattttgtttataaattacccattgccatgtagtatctttatagcagtgtgaaaatggactaatatagtgttcctaccctgttgccatttgtgagcttgaactttatctcttctgactgtgatcttggcttggctgttggctcagctcttgtgtatttatgatttacttcctttttgctgcatgtgctttacttcagatcctgattgatcctgtatgtttgagcctaaaagtacaactacaagtccaaattgccccttgggcaaatgtttggcattttttttagactctactatgattcttgttaatcctactatattggctcaatcagaagtgcccaagaccgttccctttacaatataacttttgctgtacaaaaaaaaaaaaaaaaaaaaaatggggtaaggaaaaggatggaagaaaaaatgatactaaggagacattaagttaggagaacctccttaacattttgtctattctacaggaaccatcttctcttataaaatattttttggtacaggccagagaaaaacacattgcactgcatgggatggataatttctctggcccagagcgatgttttgtatgtgtatgtctggaaaggagccaggctcaataaggacagaaaatatcaatgagaatgggataggaagttgaatttgaagattatttcgggtaatgaaaaacatctgatgaccttggccgactactaaattaaatctgagttaaaagatagtttggggctttaggaacaagagtccgcaggtatatttctctgttgataactatttgtgatggaagaaatgaggtgaggaatgcctaggtgaatgtctttcacagctaaattgaaacatacagactcagacagaaatggtcatggaggtttacttttaaaaataaattcatataccagctcagaaaacatcccacaaaatgacagtatgtgaagggttatcctcttggaaaaggaattcaattttgaattatccatactacagaccttgggagtctttagtcacttcatccaatgaaaaatggagatgtttgacttagtgacagatgatctgctcaacaatgttttctttcttctattgctgcttcaattgtatatttagtgaattagttgtgattgatgatagcattttaagcacttgatatttttttctggtgaaaagatggcataatttaactatattaatagttttaggtttaagtgaagcacaatatatttttataatccttcaatagtgaagtcacaatttatacaagtggattcattctgtctttagaccacggaactctgacaaaaggatgtcatttaaagtaatgttgctcatccttcagagatgcaaaactgaaggctacattgctctgatatgaaataactttggagttttgaatgcctggcaaaatttgtatatgccactaacagtaacttaagtggtttgtacagctggagccaaatatgctctgcagagaaaaatatcaccaactgctgtaattttcacataagtaataggactaaagaaacagttttgttcagaaacaacaccttctctaaaatctgggcatgaaatgttcaatcggtgatatggattgtctgtgtctccaccaaaatttcaccttgaattataataattcccacatgtcaagggtggggccaggtggagataattgaatcatggggggtggtttcccccatactgttcttgtggtagtgaataagtctcagcagatctgatggttttataaatgggagttcccctgcacaagctctcttgtctaccaccatgtaagatgtgtctggcttcccctttgccttctgccatgattgtgaggcctccccagccatgtggaactgtgagtccattaaacctctttttctttagaaattactcagtctagggtatttctttattagcggcatgagaacagactaatacaatcagtgtcaatgtttattattaataacataattatggacaacgtaaagtgctagtaattacaacagattagagagctgctattttacctcaggtggtattatttggagtctggtatatatcagatttagggtgattaccttaaaaccttagaagaaatgatattaactaaatgttattttctacttagtctgttacttcctgcagaataatagtttatgctcttacttagtaaatgtcacagtaggggagaaaatataagagcatgcccatatacccacacagtctcctttggtgtaactaccacatcacagtatcttagtgctacctgaatgccaatagctaagttttgtaaatggagatgaaagagaactagggaaattaattgatgtgattatctttcagtagtgctgtataatgacgtatttacctaagcttgtaggcctttaagtggactctcaacatttctaatattgaatgaacccagacctctcttaaaacatgccagttcatacatattatgcttataagattcaaacgttctctcatactgatagccttcaactgagatatatttagattatcaatgtcaaattaagacatgacaagttcccaaagacatataaacatgaccctgacaaatgaatgtgctggaagctggatcttatgtagaagtaatagcttccattctgttccagatctggggtgtatgtgtatgtgtgaagttgactgtataaatgtaaaaatttatccaaatctttggtatgagtttctgtgggacctttggatggtacctcatcataccatgtctgaatggtatgtcaggaacataccgttctgacataggtttgaagactagtcttaatactaaagcatttccccacgaataattttatttatagtattcataagtaataactacaaaaaggctcattattatgaattgggttcttctttattttttattttattttattttattttttttggagtctcactctgttgcccaggctggagtgcagtggtgcgatctcggctcactgcaagctctgcctcctgggttcacgccattctcccgcctcagcctcccaagtagctgggactacaggtgcccaccaccatgcccagctaatttcgtttttgtatttttagtagagacggggtttcactgtgttagctaggatggtcttggctagtcttgatctcctgaactcgtgatccacccgcctcagcctcccaaagtgctgggattacaggtgtgagccaccgtgcccggccatgaattgggttcttattacctaccaggggtataaaaatgtgcagtcttctgatcctagctctaggcaaacaaattcataaggtgcaaacattgtgtaatcccttcaatactgctctctgtcactattcacaaatgttagctccctattatccccaaactttgtggcacgtttttaaaatcagtccctagcctgtaaaggccccaaatgataccaacctcccatctcttgcatgcttatattttatacttctgacagaggacatgtaaagctctgcctacatttctattatttacacccgaatctttgtagcatttcataccccaagccccttaataatgtgcagtagaagctctgtgcccaaactgtattggcatatgccacatgctggatcccttctactttgagtgaggacaaagagtcttcatacaggctgggcatggtggctcacacctgtaacctcagcactttgggaggctgaggccggcagatcacttgaggacgggagttcaagaccagcctgaccaacatggtgaaaccccatctctactaaaaatacaaaaagtagcccagcgtggtggtgggcacctgtaatcccagctactcaggaggctgaggcaggagaactgcttgaatccaggaggcagaggttgcagtgaggtgaaattgcaccactgcactccagcctgggcaacagagcaagactccatctcaaatcaattaatcaataaaataaaaacagtcttcatacaaagggtagattataacctatggtactttattggtagtgtcttcattggattgataatttaagtttcaattgatttctttttaaaatgttttaatttttaattattgtgggtacatagtagctgtatatacttatgggtacatgagatatttaggtatagacaagcaatttgttataatcacatcatggaaaattggatatccacccctccagcatttactatttgtgttacaaacaatccagttatactttttttagttattttaagatgtacaattaaattattattgactatagtttctgtgttgtgctatcaaatactaggtcttattcatcctttctatttcttttatacccattaattttccccacctctcccacaatcccccactacctttcctagcctctcgtaaccatactttattctctatcaccacgaatttaaatgttttgatttttagatcccacaaatgagtggaacatatggtgtttgtgtttctctatctggtttatttgacttaacataatgatctcaaattccatccatgtttttgcgaatgacagtgtctcaatcattttatggctgaatagtactccattgtgtataagtacatttatccattcatctgctgatggacacttaggttgtttccaaatcttggcaattgtaaacagtgctgcacaagcataggagtgtagatgtctccttcatatactgatttcctttttggggggtatgtacacagcagtgggatcgctggatcatatggtaattctatttttagttttttgaggaaactccaaactgttctccatatttgttgtactaatttacatttccaccaacagtgaacaagggttcccttttctccacgtccttgccagcatttggtattgcctgtcttttggatgaaagccattttaactggggtgagagtatatcttattgtagttttgatttgcatatctctgatgatcagtgatattaagcaacttttcgtatgcctgtttgccatttgtatgtcttcttttgagaaatgtctattcaaatctttggccaacttttaatcagattcttagatttttttcctatagagctgttgaacaccttatatattctggttatgaatcccttgtcagatgggtaatttgcaaatattttctcccatcctgtggattgtcttttcaccttgttgattttttcctttgctgtgcagaagctttttaacttgatgtgatgacatttgttcatttttgcgttggttcctgtgcttgtggggtgttactcaggaaacttttgcccagaccaatgtcctggagactttccccaatgttttcttatagttgcttcatagtctgaggttttagacataaatctttaattcattttgatttgatttttgtatatggtgagaggcatcatgtttcattcttctgcatattttttaataatgccaaaagtataattcattattaatatataataattacaaatatctgtaggtaaaataatattgttttatttatatgtatttattttttaattttaagttacaggatacaagtgcagaatgtgtaggtttgttacataggtatacctgtgccatggtggtttgctgcacctatcaacccatcatctaggttttaagcccagcatgcattagctattggtcctaatgctctcccaccctgttgaggatttttgcatcaatatttatcatatatattggcctgcaggtttttttattctcatgtgtctttgtctggttttggtgtcacagtaaaactaaccttatagaatgagtttgaaagtattcccttatcctctattatttggaatagtttcagaaagattggtattagttcttcaaatgtttggtagaatacagcagtgaagccatcagttcccaggcttttcttttctgggagactttctattatggctttgaccttgttacttattcttggtctgttcaggttttggatttcttcatggttcaatcttgatagtttgtatgtgtcgaggaatttatcagattattctagattttccaattaattggcataacttactcatagtagccactaatgattatttgaatttctgcagtatcagttataatgtctttttttatctgttatttatttgggtcttctctcttttcttcttagttgggccaaagacttgtcgactttatctttacaaaaaaacaaatttttgtttccttgatcgtttttatttccttgatcgtttttattattttcttcatttcagattcatttatttctgctctggtctttattatttcttttcctctactaatattgagtttggtttgctctcacttttgtagttcttttagatgtatcattgggctatgtatttgaagtttttctttttttgatgtagggacttacaaatttttctcataatactgcttttgctatatcccataggttttgtatgttgtgttttcattatcatgtgttttaagagcatttccaattttcttcttaatttcttcattgaccctctgcttattcaggagaatattctttaatttccatggattttacagtttccaagattcttcttgtttattgacttctagttttattgcaattgtagtcagagaagatgcttgatattattccagtttttttgaatgttttaagacttattttgtggcccagcagcatatggtcttctttggtttatccatgtgctgaggaaaataatgtgtatttttcaggtgttagatgaattattctacaaatttctattagatcagtttggtctctagtgcagattaagtctgatgtttctttgttgattttctgtctggaagctatgtccagtgctgaaagtgaagtgtgtaattcccctgctattattatattaggatttatctctctcattagctgtaatactatttgctttatatatctgggtgctccaatgtcaagtgcttatatatttaaaattgttatatccttttgcagaattgccccctttatcattgtataatgaccttctctgcctcttcttacactttttgtgttaaaatctattttgtctgatattggtgtagctattcctactcttttctggtttccattgccgtgggatatctttttccatccctttattttcagcctacatgtatctttctaggcaaagtgtgtttttgtaggtaacagatcatagagtcttatttttccatctattcagctactctacatcttttgattggagagtttaatccacctacatacaatgttattattgacacataaggacttattcctcccattttggtattggtttctggttgttttgtgtcctcctcttccttttttccttccttcatgtcttccttttagcaaaggtgattttctctgctggtataatttaatttcttgatttttgttttttgtgtatctgttgtatgtttttaaatttgagattacgatgaggcctgcaaacactatcttataacccattattttaaactgatgacaacttaacactgattgcataaacaaagaaaccagcatgcaggaaaattaataagaaatccacactttaactttgtctctccattgtttctctttatgtcttattgttctatatatttgaaagttgttgtagttattatttttgattcgttcatcatttagtctttctacttaagtgaagagtagttcacacaccaccaattaccatgttatactattctgtgtttttctgtgcatttactatcaccagtgagttttgtaccttcaggtaatttcttcttgctcatcaatgtccttttccctcagattgaggaactccctttaacatttattatagggtagggctggtgttgatgaaatcctttaccttttatttgtctgcgaaggtcttcatttctccgtcatgcttcatacatgcttagaatagtatatctggttaaaattatatatatatatatatatatatatatatatatatataaatatattatacatataaatatataaatatatataaatatattatacatataaatatataaatatatataaatatattatacatataaatatataaatatatataaatatgttaaaaatataaatatataaatatattaaaatatgttaaaaatataaatatatataaatatattaaaaatataaatatataaatatataattttaaccagatatactattctacggtaaaaggttttttttcttcagcactttaaatatgtcatttcaaatgtctcctggcttgtgtggtttccactgaaaagtctgctgccatatatattgaagatccattatatgttatttgcttcttttctcttattgtttttaggatccttttatcctttacttttgggagtttaattattaaattcctgaggtagacatctttgggttaagtgtgctgggtgttctataaccttcttgtacttgaatgctgatattttcctctaggttttggaggttctctgatattatccctttgaataaactttctctccatatctctttgtctacctcctctttaaggccaataacttttttttttttttgatacgttgttttgctcttgttgcccagctagagtgcgatggtgcaatcttgccttactgcaatctccgcctcccgggttcaggtgatccccctgcctcagcctcctcagtagctgacattacaggtgcccaccaccatgcccggctaatttttgtatttttagtagagacggggtttcaccatgttggccaggctggtctcaaactgctgaccttaggtgatccaccctccttggcctcccaatgtgctgggattacaggtgtgagccttcatgcccggcctaaggtcaataactcttatatttgccctttccaggcttttttctctagatcctgtaggtgtgcttctttgtttttttcttttgtctcatcggattgtgtattttcaaatagcctgtcttcaagctcaccagttctttcttctgcttgatcagtcctgctattaaaagattctgatgcattcttcagcatgccaattttattttcatctctagaaattctgcttcattttaaaaaattatttcaatttctttgttaaatttatctgatagaattctgaattccttatctgtgttatatttaatttctttgagtttcctctaaacagctattttgagttctctgtctgaaaggtcacatatttctgtttcttcaggattggtccctggtgtcttatttagtttatttggtgaggtcatgttttcctggatggtgttaatgcttgtaaatgtttgtaagtgtctgggcaatgaagattaagtatttattgtaatcttcacagtctgggctttttttgtgtctgtcttgggaaggctttctaggtattcaaagggtcctgggccccaagctcaatggcactgtggtttgtgcagacttacagaggtactgctttggtggtcttggataagatccagatgtatggctgggtgcggtggctcacgcctgtaatctcagccctttgggaggctgaggtgggcagatcacgatgtcaggagatcgagaccatcctggctaacacggtgaaaccccgcctctactaaaaatacaaaaaattagccgggcatggtggcgggctcctgtagtcccagctactcgggaggctgaggcaggagaatggcgtgaacccgggaggcggagcttgcagtgagccgagatcgcgccactgcactccagcctgggcaacagagagagactccgtctcaaaaaaaaaaaaaattagctgggcgtggtggtgtgcacctgtagtcccagctactcaggaggctgaggcaggagaatcgcttgaaccagagagtcagaggttgcagtgagccaagattgcgccactgcactccagcttggtgacagagtgagattccgtcaaaaaaaaaacaaaaaacaaaaaacagaagtattctctggattactgggcagagactcgttccttttccttactttatcccaaacaaatggtgtctttctctctgtgctgagctccctagaattgagagtgtggtgctgcaagcacccctatggccatcaccactgggattgcaatgggtcagatctgaagccagcagagcactgggcctcatccaaggcccttccctttagtgcagtgagttccccaaggacctaggcatgtccagagatgctatttgggagccagagatttggagtcaaaaaccttagcagttcacctgatgttctattctactgtttcatccattgggatgggcgattcccctctggctatgggtagtccaaatgctccctccattcacagtcactggctaagcccaacatggctttattcttcatggtgacagggcagcgctgagttcaatgtaaagtccccaagtcactgcactcgccctctgggagatgggggagtggtggcataggcaaatcgagattaccttttctgccctcctcaatacctcttttggtgatattaagttaccaccaggtactgtgattgtccacctgatttttggttcttgtgacagtgcttctctgtgtgcagatagtagttaaaatttcatgtttcagcattggggaggaatggtgtaggcttctattctgtcatcttgctctgccatccttgattgtttctaattcagtctaacagccaatcaacaactatttaaatccattaaaccagtaataaatttagactttgcttgtctgaggctagcctcagcctctcagttgtcctcattgagcatgtaataaatagttccagtgaagaactctgggaggaaggagtacaactatttgtattgaagtcttcagtatgtatttctggggatttttcaagagttgatgtttgcaagaaaatcaactttgagtaatatagaataataatctctttcattttagtaaatctctacagagaacattgacacatactggtggatttgatttctacaacaactttgcgaggaaagtagatgttactatttctattttccaaatgaagaaacttaatgaactttgtcaacagagatgtaaataacgaagaccacaactcagtcttaggtccgagtgtgtgtgtgtgtgtgtgtgtgtgtgtgtgtgtggtttactgctctgttagaattatgattgttagtgttgatatgagggttttttcccccagtgagatggattaattaatggcattgctaatttatatctccttatagtttcacagtatactctcatgtccagaatgttctctcccttttctcctaggcttatctcctccatgaaaaactctgatattttctatggatatcttctctctcagaacttctagagcacttctagtttattctctaaaatacagcacttatttctcttatattttgtttatagtgaactgttagaatgaaatagaaactgctctcattgtacgagtggctttaaacatcgctatctcttgacctctccttttattcccatggacttttctaatggcctgcttagacttatccctcctccaagaaagtgtcagatttatatttcttttagttttcttgtctgccagttggagataataattactatttcaaaggactgtgaggattgaatgataattacttcagaagtgcctggcattgtttctggtacacaataaatggtagcttttgtgtataagacagatattaaagtgttaaagagaatgagaaaaaggaaagatagagttgtaagtatctcttagccttcttagtaattccccttggctttaggcatgcctcaagtttcaccatttcttccatgaacatctgtgctttgattacataaacattcttgtttcccagattagtctatccataataacatctgtgaaaagatgaggtatgtgtgcaagcataatatctataaagagaagttaaaatcacttctgcatacatattgtttgcaggtatccatgtcattaagtactaattaatgctgccttttgcatgtgtgctgaatggaagatacaaagaaatttggtgaattacccattaaccacattcaacagagagagaggtagagttttttccctacttataattatgaacttatagacactatctcccgattgccctttgaaaagtcctccaatatataattactaatataaatatagtcacgtggcctaaaaaaccctctataacacttttaaatgcttcctacatttccaattgtacctctttctataggagatactaaaaaactgcttcatccctggcaaaatctccagtgttgagtcctctcttttattgtaaatattaccattgaaaaagttttgcatcatctagtgatgatctaaacttatgtgcacattaaaatgaagggtggaaaaacctgttcatatacaaaagaagaaacccctgcaattttgaccaattttagaaccaaataaaactatgtattatttttgagaccgtttatcttttttaacttctttttttctagtgatgaggtaaaaacagaatacagttatcagaaataataactgcagattcaagaaagtttcagaggtgatcctatctgttttcctgcccaaactagtgaataaaattgcacaactaataatttaggaacactgcctatggaagccatagtgaagtcatagtaaaaacatgaattttcagcaattgacatttcatataacaaatcatattttgaccttttgtatgccagtcataaaaagatacttgtgggaatgacctggtattgttgatgtatctgaaatattttttgtacttttattgggctctatctttgttgctgctgggagagtgagaactctctttttcacttacatccaatagataaaaggggggggacattgattgtcttaaagattcttattattatgaataataatcttaagctctcaaagaaccagaattctcaattaaagatttttctatattcaactctacctgtcatgtgtagcttgcatgtaccagttgcccatcccacaaaagaatgaaaaatgagaatcctgacagatttggtgttggattttagactttaatgcctttagccctgcaatgggcattttactggcattttgaagatatttctttttaatctgcaaaataaagatttgaagtgacttgacaatgatagtaagatgattagtggtgcacattcactataaaaatacaatttgaccattgtagaaagtctttaaatggtattgatacttgcctttcaggagtaacactgagatattcaatgtaccctacctccactgggaagtgaaactggaaaataatttaagtgtgtgtttagaatctctccaccccactccccgtatctatttttggtgaacgtccatcaatcaaaggtcttataccttcacattgacacaacagcacacacagaatcttccacatctttgacacagggtaaactcttggtaaatattggctaatggtaaggataaaggtttctttggcctaattttagtcatattctcccatgtgcaaggctacatttgtccagagttctacatttaggattccaaaataagttaaactttgtatacttcatgtcaaatcagtcatctgagattcatttattttttctgaccattgacacagtatataatgcaaaccacttgttcagtcccatttaattatgaagtcaaatcacatggtatacccaaaattttcatcccagtgattttgtatttccaaaaaatcaaatctgatagactttttttgcaatgcaatgtattgcttaaccattgactggtaaacattcaatccagccaggagtaaagatacaggcttatgcaaattaataataagtgccttttcatcttacattctcccaattcccttcctctagggcaaggaaaatagtcatatcctggatattttctttcatgctgctgtttaccttcatggtgtgtatatatgatactcctccagtaattgctctgaagtgggcaaaattagcatggaaagaaacaaatgctaaatacagtataagttgtttaggattagatattgtaaaaatataaactatacatccaggagagatgtcatcaggatgcctgactagaggtgctcaacactcatcttcttcacaaaggaggaccagaacaatgaataaataagtgcgattcaagtagagtgtctatggaagaacactggaattcagcaaggaagggacaaaattttctgaagcacagaaacttgggatgtcagcatacgaagcaaagcacccaactgggatcagctcagaaccaagagagactccccattaggataaaaaagtaagcaggagatctccagcagccccccgttactaatgcagatgcctgaaaccctatctacaagagaaccccacagtccttgcaggccctgatcccagtaaagggagttgtctagagttaatgcagctgtattgctccagagacagaactaatgctgtgtttcccactccttgggacataacttgcaacaatatggtgtcattttgagaacaaagtcatgctggagtacatcctgccttgaggccgaagagcccctgtatctccatatcccttggtcccacctgtcattccaccatgccaacacaaaaggctataatgtcacaaccccagatagacccaagagtacagttatgacaccaacacttgagcctacacagtaccctacacctcaaaaaacaggcagtccagcacagagtataggcttctccccaaaccaaaggagccaacatgtttgttctccagggcatgagaaccacctactcaatgccctctaccgctggtgaccttgtacccttaaccaacagagctggttatcttatctaacttatatagcttatataaacagatctaaccagagctgctgtacactgtgcatgcaaccagaggccaggggctgacccacccagtacaagctgcccctggcaatgctgtctgtctctgtaactagtagagctgccacaactggtgccctacccccaagtacttcagaactggcctacacagcaacccctatccccagcaacccctatccccagcaaagccatgctacagtcttaaaaactgcccacagcccagactactgaagcactagcggataccactgacattaattacagatgaataaatcacaacaaagactccactagtgggactcacccagaattaaagccaaagcaccctgccctactcatactttaagatacatatataggaaaaagtacaataattatcctgtaacagacctcaaagcaaagtaaatatataaactgcctgaaaaggaatttaaaataataatcctaaggaaatatcagtgagacacaagagaatacaggtatattgatacaattcaactaatttaggaaaataatttatggtctgaatgagattgcatagtttgcaaaaattgtctcccattctgtaggttgtctgttcactctgttggtaatttccttctttgtgcagaagctctctaatttaattaaacctgtttgttgatttttgctttcattgcagttgcttttggcattctcatcatgaaatctttgcctattcctgtgtctaagatggtattgcctaggttgtcttccagggtttttatagttttaggttttacatttaagtcttcaatccaccttgtgtctatatttgtatatggtgaaaggtaggggtccagtttcagtcttctgcatatggatagcccattatcccagcatcatttgttgaacagggaatcttttccccattgcttgtttttgtcaggtttgtcaaagatccgatagttgtaggtgtgtggccttatttctgcgttctctgttctgttccattggtctatgtgtctgttcttgtacccgtaccatcctgttttggttgctgtagctctgtagtatagtttgaagtcagttaacatgatgcctccagctttgttctttttgcttaggattgccttgactattcagtctcttttttgcttccatatgaattttaaaatactttcatctagttctgtgaagaatgtcattggtaatttaatagaaatagcactgaatctgtaaattgctttgggcagtgtgatcattttaatgatattgattcttcctatctatgagcatggaatgtttcccatttgtttgtgtcatctctgatttctttgagcagtgttttgtagctatcattatagaaatattttacttctctggttagctgtattcctaggtattgtattctttttgtggcaattgtgaatgggattgcattcctgatttggttctcagcctgtttgttgttggtgtatagaaatgttagtgatttttgtacattgattttgtatcctgagaatttgatgaagtggtttttcaggtcaagaagcctttgggctaaggctatgagattttctacatataagaccatgtcatctgcaaacacggatagtttgacttcctgtcttcctgtttggtgctctttatttctttctcttaccagattgccctggctaggctttccaacatcatgttgaatagtagtggtgacagagggcatccttgtctagtgccggttttcaaggggaatgcctccagcttttgcccattcagtatgatgttggctgtgggtttgtcatagatggctcttattattttgaggtatgttcccttaatacctagtttattgatagtttttaacatgaagaggtgtcgaatttcatcaaaagccttttctgcatctattgaggtaatcatgtggtttttctctttagtcctgtttatgctgctcttttctttctactttcttgaagtaagaccttggattattgatttcagattttctcttgattctaatataagcatttagtgctataattttccatcctagtatttctttagctacatcccatctattgatatgttgtatgtttatttatattctgttctttgtatttttaattctttttctttctagtttgattctactatgactagataacagaatatgtaagatttcaattatttttaattttagacatttgtactatggtgaaagatatggtctgtctcattttaaagtatcctttacatactttaaaattgtgtattctaaggttggtggagtattctgtagatttcacttaaaaagattgattgataatattttcagttttcctgtataattgctggttatttatctaaagttatacacacacacacacacacacacacacacacacacacacacacacacagagctgctgaaagaggctagagcagtttcaatctacttaaaagaactggaaccacagcctgcctagacccaccctgttgcacatggaagaaatgtcatgaatatcacatttatatttaaggtaatcattaattgtattatttgttgctatttatatggtggtaaatatacataacataatattcatcattttaactatttataaatgcacaattcagtggcactaagtgtattcacaatgttgtgtatccatcactgctatctataccacaaatttttaaccatctccaacatgaactctgcacccattagataataacttgtaattttccattccccctcagcctcttgtatcctctagtctactttttgtctgtgtacatttgcctattctgggtacctcatataagtgtaatcatacaatatttgtctttatgtgtctggcttacttcacttagcatgatattttcaagctccatcatgttatagcatatataaaaatttaattgctttttatagctgaaaaatattctattgtgtatatgcatgtatatatatgtatgttttatatatatatgtatgttttatatatatgttatatatatgtatatatataaaacattttggctttacattcatctgttaatggattcttgaattgttccatcttttggctattgtaaataatgctgctatagacattggtgcagaaatatctccttgagtttctttccagttcttttggacatatgcttaggagtggaattactgggtcatatggtaattctatgtttaactttttgagaaaccaccaaatggttttccacagtggctgcacagtttacattcccaccaacaatgcacaaaattttcagtttcttcacatccttgccaatatttaatttctgggctttttctttaaattataaccaatctaatgggtatgaagtagtatctcattgtgggtttgatttgcatttccctaatgactaatgatgttgaacatcttttcatgtgcttattggccatttttatatcttctttggataaatgtctatcgaatttctttgcccatctcttgaattgggttgtattttaatgtttttgttcatctgtaggagtatttttaaatatatctggatattaccattaccaggtttgcaaatattttctcccattctctaattgtctttttgatttcttgatagtgtttattgatgcacggaagttcttaatttgtagtttttcttttattgcctattctttcagtgctatatcagagaaattgtagcaaatccaataccactacaatggcatattattcagtaataaaagaagaatgaagcaaattcatagataaaccttaaaatattatgctaatgtattatgttcacagagttatgcaaccatcaccagaatcaattttggaatactttcattacctcaaaaagaaatccatacccattagtaaatcttctaaggtctcttctgggccaagtatacagttttgctcatgtgtttgaccttctaaatgtttaaagcttttcaaagccctctatggccatctcattacccagtttttcctttttacgtttttcagtcagcctcttatcaattcccattgatggtgtcacccgaggcatctgtgaagtcaaacaattgacactgatcgtttttgactaattctctgtgaataaaactgttcacctggtcatagaaatcatgccctgagaatgtagcttttcaataagctttcagacaggtcgaatagagacaattttctgtgtatgaggcttctggattgctctaaatccattctgcttcctccaatggctgctaggctataggattttataccacagtagtgaggctattggctgttaaggataccagggagctggggattagggccaattaaaacaccacgaagctcattgttcttactgaaattcagccacttttcttgaataaacattccttgtatcgttgcaagcctttagtttgtttccagagttctgaaaaagttgactttggcagatttttgccaatgttctcgttgcttttatggaagagttgatttttgaagtccttactccaacattccagaagtgccctcttggatgaatgatcttaaacactttagttcaacatagaataaatgtgtgtttgtgtgcatgtgtgtgtgtgtgtctctgtgtgcatgtgcgtccatctgcctgtttatctgtctgcctatctgtgtctgtgtattaatatttctctcatatgtacacattttttattgtgttcatctactttgactgtaaaccttctgtctgtgtgttggttcttgaatatttatttcaaagaaatgttatttttacaacattgttcttgttctcctttaaaggtcagctacctttttccttatattttcatccatacatctgtgtttggcttttattaagtagcagcagtgcaatattcctggttttatctttctggcttaagcatgtgagcaagacacaaaggataataatacaacatactttaagagacaaaacaggttgctataataatagaagatctatttaaatatatttagcatctctttatgtagaaactaaaacaaatccaatattaatagcattaagcatttggggcatgtgtgtgagaatatgttttctgttcaaaaataaatttttattatccaagtcctttaaatttattttttccaatttgctttgctaccctagctgggatcattatccaaaccaagcatcaaaattcacaattatatgaaaaataaatatatactaactacatttccacggggaaaaaattagttggcaaaattggtactagcctaaatatgactataccaacttaccaatataatccggtacttcaattattttggctatgctaaatcaggatgccacaattcctcctggaatattaaataatcctttgccagcagattgtccaacagccagtcatacttgctcagcacctatcttgacaaaattgtgaagcaggcaaagttatgtcttcagcacctgcccatcccctaatttagttccttttgtttcttctttcataataaatggacaagcaggcgactcacctctttacaaggctctccatgtgaccacaaaaatgttttaagaatagactaccttatttaatgaaggagacaaaaactgtaagaggaagtacatccccaatttgaaaaatcttatcgtatgtcttattgtaaaacagtgcctcctgatgctttcatgtctccttccttctttccttctcactcttcttctctctctacatctctctctcctttattcttccttctccccattcttttctttctttctctaccctgttcttcccccctctcatccttctttccttccaggcacatgtgaaccacttctttttacattgggtctctcaaatatggagtattaatcacataagcacgtaaataatggcatgctgttcatctgggaatttttccaagtaatggtggttagcaagctgtgtaatgagcttcttgtaaccctttctcttccctcactctgaaattaaaggtcagggatctctcactagaatattacaatgctaaacataccaaaagtatctgaaaatgtttagttaccaataggcaagaaaagttttctagtcctttcattttcatttaaaaaatatctcttgggaaacctatttcagatcacgaagttttacacaaatgtatagctaaaacagtcacctatcgatccaaatacctattaacagataaacaacagacaatgattcactcattcacccaggataaagccatgtctgtgtacacacaaggacaatgtagttaaaatgggtgactttagtttgttgctagagatatgattgaaggaacacagacacttgagtcagacagacatgagcttaagtctattctctcttatgtatttgctagttttttatgtagaaaatgtgaatttcctatgttacgttgaggtgattgaggagaagaagattaaatgaaatgataaatgcaaagtatcaaacactgcctggcacatagtaagcactcagtgattactgctgactgctgctgacattcaaggagtttccagtgtctcaagtcctgtagatgcccaaatgagtcactccacactttgcagattctttctgtagtatcagttgcccttagtgccttctaggaagagaagaacattagtccccttcagctcaactgtgtatatagataggataagggacttgggcaagaggaagctagtgctagtgactttctcccatgaacacttttcctttaagtctttttatcatcaccaaaatctatttggtttagagtttctgtcttactaaatgttaccctagtggcttgaaagggttagtgccatttccaaattgagtatattctgccctaaaaaaaatctgaacacaaatccctacacatatgcatacattaatttcagcctgcttttcttccccgcccaaaggctcaggctgtctgaagagtaagcttctagcttctcttaggcaatctgtattttaaaaaatcactgatccttccatcagaattacttcctttcatttcagagaacaatcctatcctgtcaaaaatacactgcaatagaaataaagaggaataatagcagagtataatttaatagaaagaaaggagggtgaggtaaactataggcaagaggtatgcaaatgcttaatgtgacacacagaagaaagaagccatacgtaggtatatgtgtgttgtgtgtgtagagtagtgtgtgtaaatgtgtataggagcatgtttgtatgtgtgtgggggcatataatttgtaaattggtatagtgcataggaatgaagcactatgtatcttgttaaagatactgcttttttggttcttgaataaggaggatgctggaaaacatccaccattatctgtactcttggtttgcacaatccttcctccctgctatcccctgccaccatgcaaaactttcatactgcgtcattaattcttccagcctggggatagtccccaaattctctcattactgggctgcttagtgccatcaaaatttggattattaaggagctgcatgaggccttgtttccttataatgaaagcacaatgaccatctagatagagattaatatctcacttggggttatgtaatattttctttattccattctagttgcagtccctcttcctaatttttcaaaatgccactgaagcccatttcatgaaattgcaaagtaatctgatggtgatgaatcacttttagaaggaaaaaaatttgccgaagctatggatttgcattccccatgtcattttagttaaaatgaggaatgcttggaatttatatataaacagcattgtgttttggccttatttattacaaaagacacttgagagagctgcttgtttcaattatactttgccattgtgtgaagagagaaaaaaagtgtcttcttttacttacatatttgctatcagtttaggacttttaaggaatagtttgttaaaatggctattgaaaaatttggggtcctaatgtttgttctcagagacaaatctatgaatttattttctacctgataattcatcaaatctgggcctctgtgaaaggcaacccagttgtttttaacatcaatgctctccctcactatcttcccatctttcttttctaatataattcttctgccccaaatcaaaattagaggttaaattcttcttccccagcacacatggtcttttgcccaactcacttcacactactcatctttggttcaaatcccaacaacagtcttctaatctccatctgcagtccttacccccattttctcttccctctaataggtgctagaaagacaagttcagttttctgtctgatatcatgaaacccctaccatgaaatcactgaataatctacttacctgaatgattaattctgtgaagtttgattctttaatataacaacagataagaatcttattaatttgatattttcgggatcacagaaagtttcactagtttttttctttagaaacattgtttgccttctatggaatgggtgagtccatggatttttcaccattgctgaatcaagccatgaagttttccctttattaataagtatttattgagcccttagtatgccatttatccaatgaataataaggagtgggagagtggattgagacaaaggatgcaaacagtgtggaccctgctcataaagacaaggataagctcttgccttcgtttgaaggaattgtattattgatttgataatcttcccaggacctagagaggtgctaatagttagagttcagggttctaattctggtttgctagtaatcaagtatttgatttaggcaaagtctctttataactctttaggttcctgtttatgtgaaaacaggggattgggctagatacacttctctctctctgtctgtctctctgtctctctctctctcccacacacacacacacacacacacacacacacatgcacgcatacacttgtgcccacgtggaagacatataaagcaagtagtcagcagtgagaataatgagtcaaagaaagctccttctaggaggtaagatttaaattttatttcatcacttatgtgtacagagtaatggttctgctgagtaatgttatcttaccttaagtttcagtttaaactaaacatatgatgaaattactttcaacacgatcttagtatctgtcctcccactttggttttgcatacagaaagtaattttggatgtttgatattctagtacttggcatatcctactcattatagattaagtatttctggcttctgccagatgccatttataaccttttgccaaaacttgtttacatactcaaaatttgactatccactccttgaaggcagagacttcaaaatcttctatttatttatagtgcctagcacaatgccaggcacataatattctctcataatcttctgacaaagatgtctttgggaaattatattgagagatgacaccaatgtttgggcattcctatttgaattttgtaaacattataaattggaccaacagaatatgatatggcaataaaatcacatcagcttcaatttatcaagttcttactatgtgccaggcattttacatatgttatctcatttaattcttataacaacactataagataaatgctattattctcacttacttagggggaaactgaggcacagagtggttaaatagtttccataaggtcatatagctaataagcacaataagtcttcacttaatgtcatcaataggttcttggaaactgtgactttaagtgaaacaacatagaatgaaaccaattttaccataggctaatcctaaacaagaatttcaacagcatatttctggtcacaaaaacatcatcaaacttctaaatgaatacaaaaacacttctaatattaaacgttgaaataaatgcgagctatacatacatttaagaaacattagtaaaaacaagtaaaataattattaaccccaaaatccaaaattcctttctgtatataaaaccaaagtgggaggacagatactaagatcgtgttgaaaatgatttaatcacaaatgttagtttaaactgaaacttaaggtaaggtaaaatttctcaacatgacacttattccagagtcatgggtaactggagcctatcctggcagctcagggcacaaagcagggaccagccctggacaagacatgattgcatcatatggcacactcacacactcatacactaactcagactaagacaatttagacaccccagttaacctaatgtgcacatctttgggatatgggggaaaatcagagtacccagagaaaacccacacagacatggggagaatgtgtaaactccacatagacagtggtcctgaccggaaattgattatttttcctcatcaacatcataaaacaattttgaacaaaacaacattatttgaagaccttctgtaatgaagcttggaattgaaaacctgtctagctagaaaccctttaaccactattgtattgactacttggcattaaagcaaaatcattttctgtgaactaatccatagtctaattccacagtcttcagttcccctctcatctagaaagaagacaacatagcatttgcttccttttccatcttcgaccttgaaagatatctatgtttttcctctttgaaattgactctaagaaaagtcttctttcctgagaaagtgaagtgaacttagtatcaagaatctctttgaatggagaagacgcattctcattttgtactatcaagtcatagaaatgtgtaattttagattttgagagccagatcctttaataatagattattagaaactattgttgatttattttcctctgttattatttaaagacagacttgcttttaccttaaaggcattgaaataaatgtactaggatgttaatattcttctcaaatttcaactttgtatagaaacagaccctggatttgttggcagctaatcaattcattctggttaggactgcttcacttacccctgaattttaacctgaatctgaatactcaggaagcaaatttaaggactaagaaaataataattttcccacttggtagattggtagcccaccaaagaaggggctgttaacattttagagtgggaaaattaacctgacttttctgtgcaaggggctttctctctttgttcaaggacaataggcctttatgcaaatacttctctgtctcactccagtttaaaagttcttctggctgcttgttagctgtcagtaagtattgttctctagttttcctatcttttaagggcataagatcccttgagcaggcttggcgggcatacattatccctgacattattgttgcacgtatatcttctaaaccatcccaattggcatattccaagaattctcaagggatagaggtgacaccagtgaaagcaagaactgatggtccaagttgcccagtcaagtggtgattttgtttcttgaatgagaaatcagaactctgtaagtccccttccatggtatggtttataggaagctaacatttgtggaattagaccccttggtgatacgacctttcagaatacctaatctcaaataatttcaaccttttttttttttggctgcttttcattgttaagacatattcagtcaaaatatttttggaaaacatatgtttttagcataaatgaatattatattgactcaaattggttggaaatcacaagttaaaactgctctgtcttctgtagctaataattcttggcactgggattatgtttcaggatggcagaacagtctgcatgagtgctctgattggttatagaatattaattggctgctgaggtagtgtttagagctccaatttaaggttgacaagaatgatagctttcatttgtatgcaaaaacttcaactgtcccttcaagaaagatgatcacatcctacttcatctgtcactctttctttactttttaatagaggaaaaagaaaggagaatgaaagaacctttatcaaacatgattttcaagattgccttgatgcaaatgaagtgtctcaatgatcttgttgcttcactaaagcatacttatttactctttgttggtaccttagtccattttctgttgctataaccgaatatctgagactgggtaattaaaaaagaaaagacatttatttcttacatttctggaggctggtaagcccaaggtctagaggccacatctggcgcgggcctttttgttgatgaggaaacaaggtggtgcagggcatcccatgactagggagctcacaaaagacagccaaacccattttttttaacagacccactatcacgataactaattcactgtcttaagccattaatccataaatggattaatttattcatgatagcagagccctcataacccaatcttctcccaaaggtctcacctctcaacactactgtattggggactgagttcctaacacatgaacttttgtgggacacattcaataccatagcaatcagattaagaagtacatgaactggaataaggtgaagctttcattcactgaaaaatatcaactacagggtattgtctctgagattttcaaactttaacagtgatttgtttggcattctgtgagacatttcttattagccaaagataaataacaatctgatttgaggtactagcaaaatgaagtactgacttccatcatctccatcatgccactcaattgcttatacaaagttgctcagggaagacctggttctatgtgaaagcagagaccaactgtcagcttaaggaaatatatataatggaccctgaaagaataccatattccaacataattcactgtgattttggattagattctactacatataacagaaaaccctgcttatagttgttcaaacatacacgtattgattctctcaagcaaaaagaaacagaaattaggcagtccagggttggtatagtgacttcaagaagtcatcagggatctacacttttactttcttactgctcctctattgtttgcatctgatttccatcccaaatttacgagatggcctatggagctctagacataaagtctgtactctatggaacggattaaagacatgtggtaagtgtcaccttggaaacaggaaccaggaggaaatagaacatagggcagggggcattgtaatagggaaaataacatggaaagaaaaatatagagcaagtcctcaaactcgccttatcatcagaactagctgtgggagggcttattaaaaacacagatttctactctccattccagatccactggattatattgtctagtagcggtacctagaaatgagaatttcaactagccttctaggtaattctggtaataaggcaatgtattatctagagtgatgatagcagctgtagtaagcaaaccgaaagatgtagaatggttgagatatgacagaaatttattttttctcatacaaaacgctagcacgtgttcctaatttaaggatctgggttccttcattcttaaagtttcatcatctttagcatatatcttccaaggtcaccattatcacctgtatcaagctggtggaagagaaaatggtatgaaacatcttgtgtggaagatttttatgggtcaagcctgaaaggggtgcatatcatttccacttacattgcactgactaaaactcagacttatgatcacacctaactgcaagggaggctggcaaatgtgtagtataggtatgtgctcagaaagaaaggagacaagttttactgaaaagccagcagtttctgtatagtaaagtttgggaacagggctggcctcagggcatgtgacctatgcagctacacaggttcctgaacttagaagggcctcaagtttggttgaatgccctgatgttactctcttaaatttcttaataatttttgaacaaggggccatgtttttcattttgcactggaccctacaaactggaccctatttaactggtacagcttaggaaagaatgacccagagtgtgaggcagagccagaggaatatggcacagttcaggactttgggcagccagcaggtactgtacttcagaagtgttcattaatgaaccaatgttcttggccaccagagagccttctctcagagtgctatcctgttctgcattttttatctgtgacttagatgacatataaatgatatttatcacattttcagatgagaggaagttgggagggacagttaatactttggagcacatatttcttttcaaaaatatctcagtagtttggaatgatgggttgaaactaaccagattacatttaataggaaaaaaatgtaaagcttttcattcaggtccaaaactccaactgcaaaagcacagtcttagaattttatttggctgagagcacaagcagtgggactagattgccaaaaattctaatttagtcttagtctgcatcacagaaaggtagggtccagaacaatagaagtattggtttaattgcactttagatgacatcagaaattatgtgttcagtttattgtaccatatctaagaaacccattgatagattagattgtgtccaaaaaagattgtctaggatggaaaagggttttggaaaacatgtcacctgaaagacagtgggcaattgaggaaactaagtgtttagcctgaaaggggaagagcttttagaagggaagggggtgaaagagatcaagaaatctgtctgcaaatgttttaagcattggtatatagaaggtgtattgggtttattctgtgttgttccagagaccagaaataggaccaagaggtataacatacaaagaaacaaactacagctgaacataaagaagaaattttaataaagttattccaaaattgaaatgattgatgtcaagaggcagtgagcctattgcagaaaagttatcaagcaaagactgaatactgggaactgtggagggaactcatgtattaggtaggaagactagagtctttgtaattatgactgtctaagactaagtactattgaaatgatgcaaattgatcaggatcttgttagtcttatattttaaaaggactatgaagccagactgcctaaattcaaacttcagctttgtttcttattacctatgtaatcttgggtaggtcacctaatttcttaatgcctcagttttttcctataaaatggagataataatagtatataccccatacataaagttattgaaagcattaaatgaattaatactggtgaagtccttatagtaagcattttgtaaatgttatatattattattttccagaaatatagttggtgataattcttctatctcttcttcaatgaatgtagcctttagtacaattagattaatttacactagacataaaatagaatgctatggtgacaaaatcctttaaaacaccaaaacaaacaaacaaaaaactgaagtggtcctgtagatattcttcacaggcaccctgagaatggcataagatagctatatctctgggatgcaatgttggaagttgtgactttaggaggacatttccagctttccagcttatatatttagagattttataaaaacctcatagggctttttatatttcttaggtcacttgatcctcatattaactataaaactacacagggcagttaccatatccattttgaagttgaggaacctaagcaatagaaaagttagaaaaggtaacagaattgttcaaggttacactataaatttttagtggagccaggatcagaacccatgtatcttaagttctagctcagagctcagagataaaccaaatgggtagtaagttgcttttagactatctagtctgtggaagaaatttcataaggctgatgaagtggcttctattattttgccagtaacttgcctgtttgctttgcagcaaaattgacatcagcctgaaaacccagccacccagcttaatttcctttttggctttgcataggttagggggagtcaataaaatcagtgacttatgctgagtgtattatccacacagacactatggaaatatacttgccagctcaatccattttttatgcattattatagatgattttgaagcttgtggagaatatgtggtcctcttaccaaggcagaagctggctatgtgagttttagatctgtatctatttgtacaagtactgtgatagcacgtggtattgcagaatcgaatttttgaagtgagtgagtcttgctttggtgatcctgatgctctgtatctctatctaccctactctcacttcttcccttcggtacctggcccttgtcctttcaaccttcctctcattggtgtacctattaggttggtgcgaaagttattgtgaaattacttttgcaccaacctaaatatttacagccattcatttactgtggggtaattaattgggttccatccctaggagaatatacagctcgatgttctctttaattggcaaatcaatgtttgctaccatttattgagaactaaactatgtaccaggcctctgcctagcactttagaagcatgatcttatttgatcctcataataatcctaaaaaatgggtactattattatccacagttatgcatcaaggaaatggagtcccagaggagcttaggaatcatgaccaaggtcacaaagtaagtgctagagccagaactaagactcaggtgttaacacagaacctatgctttcaactacaacatcttagagttctgtgatctagatagtgggtggcagatgtttttgaaagttgagaaaggcttttcctataaaataataaacataagcaaccatttgctctgaattagactgagatcagcctgatgctaatgaacatcacagacatttccaaggtctagatacacataagacaggtggggatgaggagcttctgctgtcccaggaactgaattcttttctcacgtactatgcagtgccttttttttttttctcccaagctctctgagattaaatggatatatgctagtgagcactggctgtcaggctgatgctaaagcactaatgggtcattagcccatagacaaagatcctaaagggttgggttttggtcagacaagtaactagccttcatgttaaaagcatagcagtagacactgagtcacctaacacagcaagatctatttgcagggttttccctgatttgtaacctcaggtaataacccccacaagagtttcctgaaaagccttttgttctctcacaaatgacctgaccactttttgactaaagatactctcagagaaagtgcatatttgctgtagaaacatccagtggcactagatcaatttgtcataagctcagagcagttttcacacctgggtttccatctgtacttgaatgttctgcagaggaagtgtcagtccagactagggaataatgggatgaggttggggaagtgaggggtgggatggaggggtggtggtggtacagacccttaggtgaattagactatacttggaagctgcttcatttaaaccagtacagaaaacactatggtggaatttgattcccctgtcaaagaattagcttgccttatggtatttcaaagacgtattatttagagggtcaggatatcctttgaacatcgaacccaatttcttgacaaagttatatcaggagatgaatgataatcacagctgactaaatgcttattctatcagagaaaatggggccatcaaagctccacagttaactggcaagtttactcaaaaagttgattcaaaaaggcaagtcaccctttttcatgagatttggatcctactttgaaaaattcccaagatttcctatctcagtttctggagacaacaattcttgctttcctagtctccgagttggacttaatgagataatcatgggaaagagaaagtgctttgtaaattcagttaatttttttcctttctcaattcttctgtatccagtaatcacatcttgaaatcacctagcttatattttttccttggaactatgagcagtcataattggctccatttgaaaatcaatttcaacatcatagatcatcagcttatatttgattaattaaattagttctcatcggtgttacgaagacagggaacaagcttggaaacctcccagagagctgccatcatgtgggaaattaatcaagatttctaagagccaggtcctgacttcagtgatggaaatggaaagtaaaactactttattttcagagactgctctagtatgatttagttcatttgaaatattattacatattcatccttgaatgattctgggggaagatctcagctttaaagccaaacagacatagatttgaatgatagctctgccatctttgctagcaaggtaaccttggtcaagtgacctaacccctttggcctttaatttcctcaaccacaacaacaaaaaatggaaatagtggtactcatctcataggaatgttgtgaggattaaatgagactgggagactacagaataggagtcaggaaattaggatttacattttggttctggctcttagtagccagaggttagtccttaggagagtaaattaacctgtctgaacctcagtttcctcatctgcaaagtggaaataacaccctgcactttatagatttttgatgaccatgcatttggcttgttgtcatgtaaacaaataggttactcacaatcatggaaagttctctggtaatgtaaagctgacatggaggaggataaagtgataatgccttgtgatttacactttattttctacctcagatcccaaactaagtaagtctttatgttagaatggttctcttctttctgagctctaaatatcacatcacaaataatgtttaccaaacaaatattctgtgaattagaaaattatccctgtcatgaaacttttgattttttgaaaaatgcttatttaatatccggttgtcatcctcattacggactgttagcacatccaaacaactgaacttaagtgatattttgcttttccttattcttttgtattgcaaaacatcatgttaacaagttatgaatgcctaattagtttgaaaaccataagtaaataaaccattagactgaaaacagaagtatcaatacctgcccaatctagtcaaataattgcctttatgaactttggtttgaaatgcaaagattatgttcaaaaactgatttggctgaaatgagaccagtaaaaaagttattttcataaaaatacaatacagacaatatgttattccatatgacagccgcaatgtcatattctgcttctttaaattttatctatattttatttgattacttcttgtggcatggtagtaggcagaataatgccctccaccccaaagatgtccataatctaatctgttaggaatatggtaggttctatagcaaagtcaaattaaggttgtaagtagaattatggttgctaatcccctgacctcaaaatagggaaatcatcatggattatccaggtaagctcaatgaaatcacaggtttccttaaaaatagaagaggtaggtagaaaagaaagaataatataatgtcacaaggattcaacctgcccttgctggctttgaagatgaaaaatggccaagcaccaatgaatgcagacagactctagaaggtagaaaaggaaaaggaattgattttctcccagggcctccagaaaggtatgcagccctgctgacaccttaattttaatccagtgagacccacattagacttctcacttcccaaacaataagataatagtaaatatgttgttttaaactactaagtgtgtgatagcttaccagcagcaataaaagttaaaacagtcaattaccactttttgtcagttactacagccattttatacctccgtttcttctactagattaagccttttgatctgactctgtgtattcttcaaatttatactttactgcccccaacgaagatatacacactagttggtagagtacctttctgtaatagaactacaaacatttgttaactgattataagaatgaattacaccaagtaatccaaaatcgaattttcatcccattctttgacctgtggaattttgtggatacagctaaaggaggtattcagtcaattaatccccaaagctcatcagtttagtgaagtgtttaggtttctttctttctttcctttttatttatttatttattttttttggtgatgcttatatggagatattttggatgtattttgaacacacacacaaaaaaacagtcttaaaaaaaaacacggaagaaatatgacagtatagagtagtggctatgaccttggactcaagggtgagatagactttggttgaatcttggacccaaaatgtatttaccagcaatgtgactttggacaaataatttaaactcattgagcctcagttttcttatctgtcaaatgttgataatagtaggacctactttatacattgtcatgaggatttaatgagagaataaatgtaaaagggcttggcatgaaatccctgcttaatcaatgttagccatggtgcagtagcaagaatattgaacttttaattcaagaaacttgggtttgggtcttctgttttattattaatttgcagtatgatattgagtacattcctccttttctgcctttcagtttcttcatctgtcaaaatagccagatgaattagatctctaagggtttgtctagctctaaaattatccatccttgggtatcatattatatttttagacatcactatctaggccaaatttctagatcctgacagatcagtcatcacagagccaaatgatgatctttaagcaaggtaaaaattcacccatctcccatgtttaacctttcatacttattttaatactaactatatcccaagttctgtgtgaaacctggaagtatactatcttgtgaaatttctttgataataactatatgtggaatttgtttgacatcaacaatataagggtccagggagtactattttagagagagaaagaaaaatcttacttgaggggaaaaaggcaacagtgaagaaaaagcaggaactgtgaagaaaaaaaaaaaaacaaaactaccatcataaccactgtttaagtttccatttcccccaaggttgttttcttttcaaatttgaagaagttgctttatgtctgggcagatttgtgctgaataaacattgttctctccagagaagggccttgtgtcaaatggcattgagaagaaattgccctgccttatacttaagctttcccaaagctcatgcactgctcaaaactcaaatattagtggaaataaatgtgggatctagagaaaagggcaactcagggcaacttcacagcagccctgaccattcactaccctcagggcacatccactgaattgcaaggcaggacacaggctctgagccagttgctagggaggccctaagctttgcaggggcaatggtcaggtaagttgcccagcactttcccagcagtttaacctctatttggtaaaggatcacttatttattaaagacaataactgactttaagttctatgctaataaaaggcaaatacttcaatggctttaaataatggaagggatatttttagtgaaactggaatgtgttttaaaagcaatgtaatcctctgaatataaactttcatgtgtttgactctcagcagttctcaataattttatcttccaaatatacatgtgaggaacatgaaccattgtcatcagtaacagtgacttaatgaagcgaattatttttaaagggttgtagtaggtagggagatgagggagatacatgtaaaagtatctgaagttggagccatcagtgatttgaaaacaaattttcaaataattctggggatcactggttctgttttttgtggtgagcctatcacaaatgttctattatagctgggacacctagagaatatatcttctctctagattgagttaataaacagtccatgctgatctgtttcctcctgttacaaataagacagacaatattataattttggtagagaaaatgattataaaatattaattgctacagtggttagttgatggaagtaataacaagctgaaataaaaacaaagcttgattattaatgaacattgattttttaatttaacatatgcctgggctcttttcctaagatgttattatgaactagaagattcactcatagtaatgctggttagaatcttgaggaaaacagctttacttgtcttcatcggcttctgcagaaggccaccctgtttgttggctaacatcaatgtgaagatagtaagtcaagaaaggggccctggtgcccaatgtgtgcctacaatggactaaagtctttcattccacatttagagacaatccttcaaaagcagctagccttatgagagaaggtacaagtgtcttaagttcacattaaggtttaaatggcagatgcttttttgcagcaggttttgatcagagtcacaactttgtgtgcctaaaagcaggatggagaagaaatttctctaaaatagagatcacaaaattaggaatattagggcaaaggagatatattgtaaccaaggctggtcctgcttgaatttacaggtttggaacattaaggatgatattgaataatcatgatttttctatactttttcctggataatcatctaaattacgggactctcagcctggtaattctagaaataaaatatttttatcgtatggagctttagattaagtggccagtaaattgtgtacatcataatacaggattaggaagactatgtagttaattgagaaagagagattccttgcctcaagcaattatcagctaatcacaataaaaaaatgacaagtattccaaagaataatagctcttatgatgtgttcagagctcagcaatttctgcattcattctgtgttcaatttatgaaatcttcaaactagtcaactacctaggctaagcttggcaaatctccattcatgattacaggaaatttttaaggtattaacaggatctctggctctccgtaaatctgatttgctaagtaaggacctccattttgtcttctcacatgaaagctattcccaagtctttcttcccaaaatcctcaattccctcagaacaataggcagtctgtaatacttgtacatctgcgcactttcggacaaagagccataaggctgctattgctctcttttggaattagctcatgagcttaggtgatttggaagaggaaagagcccatggaatggttgctacccattgacaaaatccagtgactatttcagaacttgagaagtatttggcataaaatattattgttttaattaataaaattgtgttttattaatggatgtgtgtgatcaatgtcacttctttgcacaacttcagggcatcccattaatattatatgctcccaggaatgccattcacatggaaactgatgtaagtgtgcccctggagttgggcaatgagatggtattgcctgttacctttggccatctagtatttatttctttttctaacacaacctaagttttctttaggacagtggttattaagcaggtacaatgttattgccctcattacattttgccaatatcttgagacatttctagtttcacaactgggggaaggtcctactggcatctttgggtagaggccagggaagctgctaaacatccaacaatgcatgggacagtcacctacaacaaagaatttgctgttagtgaatgttatctcgctgaggttgaaaaaaactgcttttaggagattcttctcttcttcatgatttgcatataatctttcctaggcctggagctcaaaacttgttcattcagcctgtcattctgggattttgaatcttgatcaaagtgaaacaaggacaaaacatttaaccaagatacaacacaataaaagaaaacatattaaaaaaaaacaacaaaaccagttcaattcaatgagggggtcaagatgaaattattgtatagtctcttttgcttgcatacctagacctcgcctggtttcttttctgttattaaacctagttccccaaacttcctggccatccttgagatatacttctgataaattcccttttggctttaattagcaaaagtttgattctgttccttgcaatctaagaatgctatgggaagcacagttttttagagaaagaataccaccgggaagttaatttggagattgtgtttatttgttccccaatgtcacatactatcttctttgctgaattatatgagacatgatctttatcctccaggagcttaaaaatatagttaggaagacaagacatacccatgtaatgtgaggtttaatttgtattcaaagtagtacatgtcatgaaccaaatgggtggttcaaaggagtagtcaatgctttaggatttaagagaggagaaagattagcttggactgttattaaggaaggctttctggaggattcaagacttaaacaagtttttggaggatagctaggacttgggatgaaaaaaagaaagggggaggtcttagagtattgtgggcctggtgaaatcagacagaactcaattcaggtcccttctttagattcaagaagaagctgcttgactttgggcaagttatttgtaaaatgtaatataaaaagtcttgaaacagcctagaacagtagatattaagtaaatcataactatggtagctgtttttgtttgttaccaaacttagaggaagagtttaagccaagatgcatagttggaaattaatgcgatgtgaatgaggaaagtaagttgtctatagcatcaataaaatagaagataggtgggtaaaaaggcaggaaaggctgggcaccgtggctcacacctgtaatcccagcactttggaaggccgaggcgggtggattacctgaggtcgggagttcgagaccagcctgaccaacatggagaaaccctgtctctactaaaaatacaaaattagccgggcgtggtggtgcatgcctgtaatcccagctactccagaggctgaggcaggagaatcgcttcaacccaggaggcggagattaaggtgagctgagattctgccattgcactccagcctgggcaacaagagtgaaactacatctcaaaaaataaataaaataataaaataaaataaaataaaataaaatataaaataaataaaataaaataatgacaggaaagttattaaggctagactatgactgcctttatgttcccaggtgacaagttcagagtttatcctcctgtaaatgtaggaaacattggtaggttttgaatggttaaatgttatgacgaaaatagtgatgttagaatgtgattttagtgctgctatgctgaatggatttgggaggatccatttcattgaccataacatacaaattccaaaatagcttcattcacagaaattaatgagtttctgtccttctactccctcccacttggtctttctggccaatctaattaaacaggtaagtcaacaacaaaagaggacaatgaaagttgtcataacagtaggtaacacttgggcaatgtagtcaaattcatttattcaattaaacaaatgagtctacttattttttaaactaagttcatggaaattgaccaatcatttcagtcaaaccagttgatctggttgtacatatagataaaatcattgcctatcatggaaaagaacaagttattttgagcattcttctcaggaaagttagtgtcaaacatataaaacctagttttaggaagaagaaggcagtaatagtagtagcttcactaacacgttaagactagtgtcatggtatacacagtagagcaattatatttaaggataattaaatataagcagctactgaggaaagtgcattggtgaaattgtacattgaaacgttagtaacaaaatgtatcctttgctcccattctttcaatcaaagcatgaagcttaagcagcaaattcaaagattagctcagaccccaattagtcccccttgaggtccaggataaaattcctaataaaattgtaaatctctgccctgttgtttaggggacttggtattgacagttctttctttcctttcacaattagtaactgagtttcagatgagatttaaaaataaaaatgaacaagaaatgagcttgcctccctgtggcagcatgcactctagctaatctgcaaatgctataattatgcaaggtgctgatagatttgtctctgggctggtggtcaggatccaattgaactgctgcagttgctgctttatcatcacaaatgttctgcacttcttagcaattctcaggcctaaacatgatattggaatttaaagaggcaccatagccttatatcccattgagatgtgctgggttaagtgccagttcatctctttccattcacaggtttagggggaaaaggtgtatatgtgtggggtgtcctacagggatcatgtttcaactggctgtttgccacaaagccattcccattggactaggaaccctagtgtaattatcgtagagtcaaagaggctaaaaccactgactcagtactgagctctttacctgtctactgcctacaacttatatcctgttttcctattcatcttgcaagtgggggcttttggtcccaaggggacaccaaataagacaatataagcttcatttaacttcatatctaaattggccacatttgtaactgtcttctttaccttacaaggtcatcatgaagataatatgagctaatgtatctgaaagcactttgaaacttatgaaccacctataaatgtaagatgcttaaaattatcattaatattagtgaatgtcacttcagcaattgatatttaacaataataaaattagggtaaatacatccatagtccatggcggaagataagggaaggggaaaacaatgaccccaaactcatcctgctgaaagcagagcaagattgtcatttccatacatgaaatacattccttacaattgcttcccacctatcacattccagttaatttatttggaagaaggaaatattttaaaataagattgcccaagaatagtttccagcaaactaaatgtctataatttggatgtgtaaggtaaattgacaataattctataaagaaatcaaaatgggttttttattaataaaatgaaaaatggctggatttaattttatttatgttttgaatacatagcatatggggatggttcaaaatataaaggcatatagtgaagattaaatcttccttctgcctgcccatgacaccctttccttacccaccacagttactcagccatccactccctctcttcagaggacaccactgttaccagttgcacatgtatccatctagaaatatttcatacatatacaaacatttatatatgcatatgtatgttttatactcaaaatagcatgctgcgcatactatttgggaccttgtttttttcattaaacagtatgtcttggaaatattttcatatctaatctacagatttacctaattattttaaacagcagtatcataatatgtcattatatgaaatcaccacaattgtaacaaggctcctactattagaaattgaggttgtttccaatattttactattacaaataatagcaaactacaacaaaattgaacatctgatataactggattttaaattcaaacatattcattttttttaaagtagatccctcatgtttccaataatatttaaaaatcagattattaagagtaactgtagtatttatgaaatgaagactagacattatattagtaggtctaaattatgccaaagtcaattaaaacaaaaatgttgttcaattccataaggacaatacatattgtatgtcatcttgaatgatgtgttggaaaaatgaaggcaattaattcactgaaatttttccacttcaggcagctcaggtattaggaagagaaagctaatgtgccataaagctctttcctaagtatatttctggtgcatttgtttattatcaacaactattttgggaatctctccaaatttgtatagttccctaaccttacctgtcctgtaatcaacttttatttctctctttcgcttctaaatattcttcaaatagtatgagatcttctctcatgttggcagggaattcctaagctagtcaattaatggtggcttaatcattatagcacaatcctatgctattcctcctgtgaattataaagaagtataaaacatttctttttagtaggtaagagttcagttggatacttgaagcaagacataaatacagaatcagttaaagggaattcaggatataaacaatagtttgatataagtaagggttgttttatgacaacaatacacatgacattatgtatctgcatactgagtcctctcatttctttcttccaggtgcctctcagatttgtcctctcattaaaaaaaaaaaaaaattccccaaactccaacctggtgtgactgctcaccaccacccatccccacacactgcagcattgtttcctcaacctcttagtttttgttcttctctcagcccattccacatatcaagccaatcatcattagacatcacttcctttgagtcattttttgtttcaagatctacaatgacactccagcctagaacatcatgtccaaattcctctgcctgttactcagagtcctccagaattcagccccatccaatctatctagtttcatttttaattcatggtgctcacaaaaccccttctcatcaggctcattttcctcaaagcatattatgcttgtgaagttctacttttgtgccttggtttatgttgttaatctttcctgataatcttttgaaaatctttttgagaatcttctgagaatcttttcttctttactctctgcctttccaaatcttctccactctctgcctttccaaattttctccatcccttaagtttcgtatggagatccattctcttcataaaactttccccaaaccttccagcgaatattaacctctcctttctccatttctttaccacctatatatagccttatagctcaaatgctacattctatgttccattctctattatggtgtgctagtcctgtgttcatagtcctgtgttataaattgagggcaaagataaagactttactttctttccctttagtagctagcacaagacttggagtacaaaagatgcttaattggtatttttgatcaattatcccaatgaagatatcattgctttattatattgttttggaggttgcagtggagagtgggggataattcagaggtttagaagattcatgtcactaaaaatgtccgttagggtaatatttcattgagaataccactacaaagcatatatgaggatttactatttctcaattatacttttaaaatatatatttctttatacttacaaatttataaaaaccacccaaaatagtccatttgtttcatcttgttggaaaatgtagttgtcaaaatggcctatttacagtgaatcaatggtgctctaaatgtgctgggaaatggatattgtatggatagagtaacaacccaagtaggaagtaggaacactgtctaataaatgtttacacaccatcaagtctacaaacattaaatatcatacatgatagaatctttctcatcctgtaatttatctcaatttttccattactttctttcattttctcttctagctttactcacagacaagcctcccaagccattgttccccatggagaatcagccaagtgttatagatgtccagctgggtaagtcccctccttggaataacacttcctaaacttgccctctgttaacagatggggaaaattgcatgaaccaggaaaggtttattgccactgttattacatgcaaatcaatttgtgttctgctcatttataaccctggagttcagtgcgatagcagtttaaggaaatgagtttgtattgcatcaaaaaatggtaatactaattagttacactgggtattaagtgtgctgtatgacagagctttttaattctgtgattgatagattcatgagtgtcttgcattggtgattggtacagaaaacttttcatacatgtcagccaaaatttttatttggacagcattaactcctggagaccaagcacttcttaaaataaaatacaggcttcggtttcgcctttaaaatgatttgataatattattttcaatatcacaatccagggtcatttaaaacttgtttttaggttgggatcctgaatatttatgaatcatatgatgttgggaaaagtggcaagttgacttatgagtgctattgtctttttacacactcaaataagaacacaaggtgttacacctctttttagagctcctactgctaatccttgtaattttaagtactgtaagctaaaaactcagaggcctgctaggatctctttcaaattgtggcctttaatttaaatcatgccctttaacatttgcgagatttcatctgtcttggatttcattctagtattctaaatttcttcaattctaaatagaagaaccacaagagaactgagtaaatatgcttgaaatgtattgggcttacactgaatatatgatttgttgatatttgtgaccattgtggtctatatccattatacagccagggaagacaaattgatcccaattttcactcatttagaaaggtttttctttttgtttaatttttaattattgtgggtacctagtaggtgtgtatatttatagagtacatgaaatattttgatacaggtatacaatgtacaataatcacatcagggtaaatggggtgtccatcacctgaaacatttattctttctttgtgttacaagcagtccggttataatattttagttattttaagatgtacaataaattactgttgactgtagtcaccctgttgtgctattaaatactagatcttactgattctaactatatttgcatgcccattaaccattcctacttccaccacacccaaaacccttcctagcctctggtagctatcattctactctctatctccatgagttcaattgttttaattttttagttccccaaaataagtgagaacgtgtgaaattcgtctttctgtgcatggttcatttcacttaatgtaatggcctccagtttcatccatgttgttgcaaatcactggacctcgttcttttttatgactgaatagtattccattgtgtatatgtaccacattttctttatccatctgtctgttgatggacacttaggttgcttccaaatcttggctattgtgaatagtgctgtaataaacatgggagtacagatatctttttgatataatgatttcctttcttttgggtatatgcctagctgtgggattgctggatcatatggtagctctatttttagtttactgaggaacctccaaaccattctccacagtggttgtactaatttacattcccactaacagtggacatttgggttccctttgctccatatcctctccagcatttgttattgcctctcttttggatgaaagccattttaactagggtgagatgatacctccttgtagtttttggaagttttgactcaacttttgatctttataattcagttgggattgttgaaagcttatttatatcttgaaaataagagacagaaaattatattcctaatgttcacttttccaaaatgaaatatagcaaatagtagtttttaaataagcctagcaatgtgagtaccaaagttaagcattttaaacaaaacaaaaagaaattaataaacatgttatcaagagtggactgtgcaaatggtaaatatttggaaataatgaagtattagactgtggctcttcttatgtcccctatattgttttgcagtcattatattttgttagagccaaatctagatatgctgatacccttactgactgtatgatacattttacttacatttctctaccttgaactgggataaaaatattccaagggaactttgtggttccaggggttacatggagccatatgacggtctcgtatcattagtttacatggaaattcaagtggataaattgatttcatttggtatgaaaacaatttatccacatatatatctatatatctatatctatctatctatctatctatctatctatctatatgtagaaagcaacatttgcatgataaaatgtacatgataagcccaggccctgtggctcatgcttgtaatcccagcactttgggaggccgaggagggcagatcacaaggtcaggagatcgagaccatcctgattaacacggtgaaaccccgtctctactaaaaatacaaaaaagcagccaggcatggtggtaggcacctgtattcccagctactcgggaggctgaggcaggagaatggtgtgaaccctggaggtggagcttgcagtgagctgagatcatgccactgcactccagcctgggtgacagagcaagactccatctcaaaaaaaaaaaaaaaaaaaaatagtacttgataagatacacaaataaaatgtgagtaaattttatgtttgtggtccctggaggaataccttctgtactctcctctgctattaggcacacaacagcaaagtttgaaaagtattgatccaaagcaaggagaaggaccattgtagaagatacattccattcagattcactgggtgtaacacctgtatgtactgttcaggacatctacaagatgtgcactttgtataaacctgtattctaacatagatatatatgccaaaataccctaccaagtactaccatcctataagattactaaaataatttacttccaatttacattagatgtaaggctgaacttttcgggttttagtttgtaacacaattggaaacaactttattgacagaaagatggagacctgcttatttttcatcccagaaaggctgttactctgagatgttaaacaaccatataattcagagaaagaaaagcaaaatcagtcaaaccagatctttggtgtttcaaggagcacatgactgattaattttaagtgattttaactctttcacggatttatttagtaccatttattcacaattggaaatccttttgtaagttgctctcatacctcaatagtcagatgacattatgagcactataaatgtcaaagagctcctccgtgtgagtgggagttctgcagtcagaatcatgaggcattagaaaacaccatgtgtaaaaaagagatagagaaagataactgggactactggatatctctgtctatgtctggaaaacttgaagaattcagtaaggtaatgaaaactggaaattgttttccttcagtttctgaagtttatcaaacacattcaattctggacatcctcaagctagaactaaaattagagctgccaagaaatacgaaaatccaatccatatggctaaacacattatcaactttgggtttcccaaatcacattacttaaaattttagacaacatcatggtagattaaaggtggccatagatttttggctactcctaatatctaaacttgatttttcattcttctcccgttgaatctgggttggccgtcgggacacacttgaccaatagggtgtggcaaaagtgatgttctgaaattttagaggctgaatcaaaagaaacttgcaacttctgtcccagtgttttggtccactctgaaaccaccatgctgtttgaagtttaagccacatagagaggcactagaggatgagacacaatatggtgggagagagaggtcaactagcaccaagacaccaatataagtgaagaagatatcttggaagtggatcctccagccctagcttccctggcttatgccatgtagatcacagacaaaccactgagctgaactcttctcaaatttatgaccccaaaattcatgagcaaagtaaagtgattgtcatttgccattaagttaggggtagtttgttaagtaattagtagataacctgaacaaacattaatcagtttatctagagcattattaattttatttttcccatggacaagaatttcatgcagcaattttatgcaaaatgagacacgttttaggaaatacttgagtatcagcttcaaggtagttttaggaaacatggtctggaataagtgtttatgtgttcatttgagggttacactctgttctcagttctgaatatttctaaaaggaattcattaaatgaaaaatttcagtagaaataaatacttttcatgcatggagttggcatcagtacagatattttgttatgtctctagagaaaaataaacatcttgactttttcctatagtggaagccattagtcatctgcaaagttctagaaatttagatacgtttttgctgatttagtgatgacagtttggttgttgctaaattgtgttcacattgtaatactgaaagaagatgaatctttaccaaataaccatatattttgagatgataaacacattcttaacaaaataatctgaaaactattgctctcacaaaacaagtctatgcaactaacgttccctgtggtaatgtatgatatataaaagataaaacaatgtacaacacgtacgtgcaaaattccaatttggtcctgttatcctttattttttctctctctgaaggtaaatttagctttaaattcgagaaataaaccttgactataccagggccaattcttttctcagcagttgaaaaaaaaatattttcaataattttttctaagtaaaacaacactgtattacaatatataaacttattttacacctttaatacaaatttattaaaatattgtaaggacatgtgccccatttgaaatatattcatgctagatagaccctttttcataaactacttcttttcatgagacccaaatgcatgctttacaaactgtaacacactcctggaagctttgaaaaagtcatgaacaaatttgcatgaaagatttgagatctgctatctaattttaattaaaggtgagtttcaaaatgtgctctgttcttctgactgatgatgataattttcttttccttccttcctttctttctttctttctctttctttttctttctttctttctttttctttccttccttccttccttctttctttctctctctctctctctttctttctttctctttctttctttcttttctttctctctttctctctctctctctctctctctctctctctctctttctttttctttctttttttcttgagatgaagccttgctctgtcacacggggtagagtgcagtggcatgatctcgactcactgcaacctccgcctcccgggttcaagtgattctcctgtctcagcctcccaagcagctggaatcacagtcaggtgccaccacgcccagataatttttgtatttttagtagacattgggtttcgctgtgttggccaggctggtctcaaactcctgaactcaggtgatccaccagcctcggcctcccaaagtgctgggattacaggcatgagccatcgagcctggccgataattttcttcttggaagttttttaaaacttgaaataagctagacagcattatgcagaaaatacatataaacatttactttctctttctgtgtgaatcaaaaaggaggcctggggggcctaaggtagatcagaaaaacccagacaagtagaacatccaagctaattgggttacttttgatgtttcaaaaagccaatagttcatttctagacaaatctgatccagtataaaagattctttttcttttctattctcattcagaatttattttatttttacaggctattcaaattcatatttcatgagtgtgttatatgctattggctcaaactgtctctatatatgtaagaagtgttaatcttcatcagaaatcgatttccctagcatatcagtttctactgaaaattatatcagatcccttaagagaccagtgtaaaagactctacaagagaatatatcaaaatataacatttaattcaatactcaggactagaaggcaaacaaatacccagtttaatcccaaattaggaaataagctattcaactaaatttatgttttttataaaacattatttacctaaaaacatttattgagttcttactggatgccagcatattagctcctgaaaatacagaggtgaattaaatgaatttcttggccttaaggagttctcaatctagtggggaaacagatgtgcataagtagaattgcatcgcaatatgagaactgccaaaagagggaaaaaggaaaatgatttttcttgtggcaggacctcatgttctatatgcttaggctttcactaaaaacaatgacaaaactctgtagcttcaacccaattactagatttatctgaaaataattaagaattaccaagaatagaaccttttgaaatcataaattgtccaccatttgctttaatgtggcaaatactaaaaatggaaatttatgatacccttgaatcaattaagtttaacaaaattaatcaactccttctaaagttgaaataaaatgaacaatccaaagcaagtcaacaactgagctaaatgtcaaactagaattattgtattttttatttttttatttttatttttttttatactttaagaagaaaatgtggcacatatacaccatggaatactatgcagccataaaaaaggatgagttcatgtcctttgtagggacatggatgaagtagaattattgttaatgcaaatagtaatacatggttatttcattagctggagtcataacttggtatatgcattgtgtgtataatggtggaagcaagggattttttaaattttttatatcatattcttaccctcttagtttcaaataactccttaaaaacttttatgtaatcttgaataactgaacactatggagactttggagagtaagaaggagggtattatgaactaactcagttttcttggcacacgtaatgggagctagttcatggcagaatttcctcacccttgtagacattctagggttagtgagttgtttccaaaagacctatttattcaggataacacgcacaagcttagcgtgagctaccccaaactgaaaaccattctattgcccagatcatataccatgtgcattatttacagctttggaaaatctggaccaagccttttccttaagagttggctgcagtattgagtgagactgaaactggttcccttactttgtctaagtttctataacagctgtgcttgttttgagatttttaagaatgaaatgggaaaaaagttaacagtttactaaatagtgtctgttataatctaacaatgtgattacgaacatctcttaaatagcatgattgttaaccagtcctctatgcatacattggtgtttgggggcattgcttaggcttatgtcttattgagatactgatacaagtttgatggtgtttcatcatatttttaaaaagccaaaaccattatttcatatatttgaaaccaaaattatttgagaatttactaggtactaggcactaaaatgggtatttgcacatacagtgtcttattactcataagagctcaaagtagtagtagatattgttgaattattttgcagatgaggaaacgtaaccacagacaggtgaaatagcttacatgatgttacataattagtaagtgacaaagatgggatttcaacaagatctgtttcactccgaagttttttctttttattatagcacactgggtatggtaacattatctagaccccaaactctatcctaggaaaaaactatcattctaataaggacagctaaataatattaacaactatagtaattattatttaataacagctctactattacaaataataatgttattactctacttagtataatttaataacatttctagtactgctaagaatagcaattattattataatcttatttaataataattctactactaataataattattattatttgtagtgataatatcagtagtagtagtagtggcagtggtggtggtggtggagctgtcacttattgattgcttacagggtactaggcactatattaaatactttatatagcttattttatttaattttcccagcaactctttgtgataaacccaactacttgcctcattttaacagttttattattatattagtcatataccgtacaattggcaatttaaaacatccatttcaatgatttttggtctattcacgatgttgtgcaagcatcaccagaatttcataacattttcaacaccccagaaagaaactctgtacccattgacagtcactcctcagtccctcagcctcaccccatcctcagctttaggtagttattaatcaactatctgtaactatagatttgcctattctggatatttaatatgaataaaatatgtaacatgtggtcttttgtgataggcttcttacatttagcatagtgttatcaaggttcagtcattgttattgcatgtataagtacttcactccttttcattgctaaataataatcgaccacattttatttattcattagttagttgactgacattttgatcatttgtattctgtggctcttatgaacaatgctgctgtgagcattcatgtacaaatttatgtgtggacatatgtttccatttctcttgtgtatacctaggagtagaattgctgggtcattcggtcattctatgtctaaccttttgaggaactatcagactgctttccaaagagactgtaccattttacattcctatcagtaatgcagaggttccaatttctctacattcttgaaagcacttgttatttttttatttttaacataattattctaatgtgtatgtagtactattgtggttgaaattgtgttttttatttatatttccctaatggttaactatattgagcatcttttcatgtgcttgttggccatttgtatgtctttggaaaaatgtctatggccccttttttaaatgaggaaaatgggctcggagaatttatacaacttgtcccagctagtaagcagcttgaaagtagtgaagctaaagttgtcactcttaaaccttgccgtattcctactaatattagtagtattgtttacaaggtcctcttgtacttctgctctttcctaaaatagatttttggacagaaggtgagtgatcatgtatatggaagttaaaggggtgtctagtgtgaattgattcagtgagaaaatagaaattattaagagcattgctttaactttaaatctttgtaactcaagccacaactcctttttaaataccaaactaatttgtaagcagtacatatgcctgaaaactagctgtgaagcacaagacaatataagaaagttttctggagggatttacagtatacttaaatggccaaaaattgtatgtaacccagtatctgaacagagatcaagaaactaatttgtatcattcaacaataggaagtatagattaaagagactttaaaaataagttagagaactctccactgtttgaatttattaggaataagtgtcaactgagtgcactgttccccaaaagcatatgatgtctgtgttgatatcaataccatcagctttgcagcacttctcagcagcttcatcttctaacccatcttattcagtgggttatagatgctttttaaagatctggaaaagaaaaaaaaataacgctacaaattttgactatgtctaaaatgccacatgaactgggaaaaaatagaattatttatgatctcttttaattcaaatattttatataattttatgtaaataaaggcagattttatggatgaacttgtagaaaattgagtaagctattatcttgcttattcataattgaggtagaagggtattctcataattgaggtagaagggtagctttgtatcatttagacaattccattaattgtcctctatacttcatttaaataaatttggcttaaactttggaagatcttttgctcctttaataatagctctttccagaaattacttagatatatcagagtgggatataaattttggtccctttttggggggtcagggtctcgctctgtcacccaggctagagtgcagtggcatgattctggctcactgcagccgcaaactcctgggctcaagtgatcctcctgtctcagcttcctaagtagctgggactacagggacacatcactatgcctggtgaagtattttttaacatttttcattgagacagagtctacacagaataaggacaaggcaggagatctgggaaaaaatactcagagatctgtgaaactacagctagtagtttatgttcaaagtagtaacttggagtttggaagcttacaggttgcagaagccccggcaaggtggtaagcaaagaagtcacgtcagaaaaaaaactgatcttgggtttctagcaaggtggaaaagtcaaaggctgaaagccatcacaaatcaggcaacaaatggatactgaaagatcaaagacaatggtactaaacctgtaagagtttgctcgattcccacaagagaaaggtattgtcactgtgaacatagccactgaaaagtaaagtttgaaagaactgggtcttagagtgatgcaaaagagggcacacctggcaattaagatcagttaaagcaagtcctttggctgaaaaaaggaactccttcaaaaagagtataatataaaataaacttggcctgataccagttctaatgaaaagtctagtctttaccaatatctgaatttcaaaaaaactgaagtaatagtatattcatcaagtccacaaaaaagctttgattttgtttacaaatgcaatattaacctaggaatagagcctatgtatattgaaatgtggtgtacatttgtaagacacttattttccaagaacaagaggagctctgactcactgagggcctgtatcaatttcatttattttccttagttgtgaaggtgttgactgtatatctgttactatagtgatgattttacatttgttgtcaagttgtttgatgaaattgtaacttggtgagatgataatcatggtgtgtcttaaggctgattgttggcaaaagaacaaaaataatgtgaacatgtgatggagagggggcctacaacaaaggagagggaaaattgtgtcaaggtacaatttgaaaactgctgtaaaccaaaaataaaattctaggcgtctctccccgccacaaccatctgagtggactcctcctctcggccagggcgttccaaagttagcatgaaaaactggttcaggccatgacaggaagggaggactggacatgtttcattatactctactcccttttagaattcaggaaaagctgaccagcatttaacatcaacacagaccttaagtctgataagaaacatatacaatctattctctctgaagcttgcttcctggaggcttcatctgcatgataaaaccttgatctccatagccccttattgcgacccacacattctttgtgattgataataactttcaaccagttgccaatcagaacattttaaaatctacctataaactggaagtcccctgcttcgagttatcctgccattccagaacaaaccagtgtgtatcttacatgattgatatctcatgtcttcctaaaatgtataaaggttgtgccctgacccaccttgggcacatgttctcaggatttcctgagggctgtgtcacaggccattggtcacttacatttggctcagaataaatctcttcaaatgttttacagagtttgattctttgtgttgacactctcttagctcaattatgggaaaatgaaagttcttgagaaagaaagagaatcatgctaactttacataagataattaaggaaagtgaagggttaactttaacaatagtacctcatatttatgcagtatgtatttccaaggcattcaaagcatgttttcaggcatcatttaattaatttctttggtagttctgtaaagtatgatgagtataagatatcattcattaagcattgacacgtgtagtgattaaggttctttgtgacacccacaggcagtttaattgagcatgctagtgaggaatcagctagatcaatagtgaataaatgattgttagcctgatcattattagtcagatcagaatttctgtaactctactattatgtatgtacacatatgactgctattatatatatgtaaaatttatagcagggatgatgtgtgtactcacttctgtgtgtgtttccacttcctttctcagtcaagtggtttgcttattaacctaataatagccattctcatgagtgaccactttgtatataaagtagctcttaaactttacagattactactctgcttgcatttactttttggttctcaatgttgattcctgtgattttagtttttatattcttttgatgtacaaagaattcttaaatatatttattgggtatatatgacatttaaaaccatataatctatagtgatcagatgaaggcaattagccagtgaaatgtaaatcaaaatcacaataaagtatcatatcatctcagttaggatggctattattagcaggacaaaaaataacaaatgctggtgaggattagaagatactattatgaacaattataaaaactgaagaactttgtcaacaaattcgaaaacctagaggagagggataaattcctagatacatacaacctaccaacctatcattgaaccagaaagatgtagaaaacttgaacagacaaataatgagtaaggatattgaatcagtaataaaaccccccaacaaagaagatcccaggaccagatggcattactggataattctactaagaactaattgacaatactaataataaatgttaattaaattcattaacaataactaaagaagaattaattccaacttctcttaaactcttccagaaaattgacgaggagggaattctttcaaactcattcagcattaccttaatactaaggccagacaaagacactaaaagaaaagaaaactacaggctaataactctgatcaatgtaaatgccaaagtcttcaacaaaatactagcaaactgaattcgacaccacattaaaaggatcatacatcatgaccaagtgcgatttaaccccagaatgcaaggaagtttcaacatatgaaaatcaatcaatgtgatataccacattagcagaacaaaagataaaaatctttagaacacatgaatatctcaatagatacatacaaagcatgtgacaaaattcaacaacctttcatgataaaaacactcaacagaatgaaagccatatatgaaaatagtccacagctaacatcatatttgatgatgaaaaatcgaaagcttttcctgtaagttgaaggacaaggcaagtgtgcccactcttgtcacttctattcaacttagtaatggaagtcattgccagagcgatcaggcaagaaaaagaaaaaaaggcattcaaatcagaaataaagaagtgaaagtatcactgctcacaaatggcataatcttgtaggtagaaaaacctaccaattccaccaaaagttagaactaataaattcaacaaattgcagaatacaaaatcaatattcaaagatcatatgcatctttatagactaagaataaatgatccacaaataaaattgagaaaacaatgccatttataatagtacggaaaagaataaattacttaggaataaacttaactaaggaggtgaacgatctgtataataaaaaccacaaaacattgctgagataaagaaggcacaaataaatgaaaagacacctcacatttatggattagaagtcttagtattgttacaatgtccatgattacccaaagtgatcttcagattcaagacaatccctatcaaaattccagtgacatatttttttgcagtagataaatcaatcctaaaattcatatggaaacacaaaggtccccaaatagccaaaacaatttaaagaaagaacaacaaagctgaggcctcaaactttctgacttcaaaacatactacaaagctacagtaatcaaagcagtgtgatactagcataaggacagatatgtagaacaacggaacaaaattaaaaaaacaatagaaataaacccatgtatatttgatcaaattaccttcaacaaatgtaccaggactaaacaatgaggaaaggataatcccttaaaccaagggtccccgatccctggggccacagaacagtaccagtctgtggccttttgggaactgagctgcaaagcaggaggtgagtggcgggcaagcaagcattactgcctgaggtctgcctcttgtcagatcagtggcacattagattctcataggagcatgaaccctattacgaactgtgcatgtgagggatctaggctgcgtgctccttatgagaatctaactaatgtctgatgatctgaggtggaagagtttgatcctgaaacaatccccccgatactgtccctgttcatggaaaaattgtcttccacaaaactggttcctggttccaaaaatgttggggatacagatgatcttgggaaaactggatatcaatatgaaaaataatgaaatcaggccccttctcttataccatacacaaaaatcaacccaaaatgcattaaagaattaaacataaaacctgaaactatacaactcctaaaagaaaacacaggggaaaatcataacactggtcttggcagtgacctttttttaatgtgacaccaaaagtataggcaacagaagcaaaaaatagacaagtgggactacagaaaactgaaacgcttctatgcagcaaaggaaataatcagcagaatgaaaagacaacctacaaaatagaagaaaatatttgcaagccatatatttaacaaaagtctaatatctaaaatatctgagtaactcctacaactcaataacaaataacctgcaaaaataaactgattgactacagataaaaactttgcatagacatttctcaaagaagacatacaaatagtcaacaggtatgtgagaagatgatcaatatcactaatcatcaaggaaataaaagtaaaccataatgagctatcacctcatacctgttaagatggctattattataaaaagcaaaacaaaaggagagaaaataagcgctggtaaggatatggcaaaatcagaaagcttgtgcaccattggtgggaatgtaaaatggtgcagcctcaatgggaaacagtatggcaatccttaaaaaattaaaaataaaactaccatatcatccagcaatttcacttctgaatatttgccaagatgtggaaacaacctaaacatccatcagcagattaatggataaataaaacgtggtctatacataccatggaatatcattcacatttgaaaaagaaggacatcctgtcctatgcgacaacatgaatgaaccttgaagacattatgcttagtgaaataagccggtcacagaaagacctatactgcatgattctgtttacatgaggtttttaaagtagtgaaactcttagaagcagaatgtagaatggtagttgccaggcactggtagaagtagaaattggaagttgctgttcaatgggtatagagtttcagtcatgctagatgaaaaagctctagaggtctgctgtacaacaatggatatatagataataatactgtatacttacacatttgttaagagggtagacttcatgttatatgttagttactacaatgaaaaaaaaaaaccaaaaatacaaaacagttggtgagaagtgttctaacagagatctattaactcagaaacctaaggcttaaagtatattcttccctctaccttgtcttatataatgtgccaacaatgcttagagatcttcctgcttagactgttctatattattgctttagtaacttcaaattaggatcccatatttttgctggggcaagtattacaatcaattccaaattggtctctttgcctcctctttctcatctttaataaattctcatcactataaccagaaaaaaaatctatgttaaaatgtaaatcttatgcatctttcctgatttaatctcttacataactctcccttacttgcccaaaagagaaaatactaattccttacattgattactggttgccatctacttcttcagtctcatcattcttgctatgccaaattgttttatttttgttcacacaggaactcatatcccttctcactcacaacctcctggcaaacattttttatacaccaatgttgagtttatcatcacttcccaatgatacctttcctgatccctgagctgcaatcccaggaagaaaatatgtatcccttttatgtctctactataccttatgaattatcctgtcccagcatgtatagtttttaattatatcttcatttgttgatatgtatgtatctcttactagactgtaaaactgatagtatttgcttcaatatttcttttccagcaataagcactgtgcctgatgctcaggaaatgtctattttatgtatgtgtgcacagtcgtatgtatgaacaaatttacagatatgtgaaggaatgaaaaaacaagtgaataaatttctatgataactaaatttcagatggttggcaacttccttcactgcagccctcccattaatttcattatattttacaaatccaactttactttagaaaacaaccttgtgatttaatttagtgctatctagaaccataagatcttagccttgtacgatggctcatgcctgtaatcctagcactttgagaggctgaagtgggcagattgtgtgtggccaggtgtttacgaccagcctgagcaacatggtgaaacccccactctacaaaaaatacaaaaattagctgggcatggtagtgtgtgcctgtgatcccagctactcaggagactgagctgagaggatcacttgagtcctggaggtcaaggctgcagtgacccttactcgcatcactgcaatccagcctagatgacgaagtgagaccctctttcaaacaacaacaacaacaacaacaacgacaaacccatagagtcttaaaattgcaaggaaactccagccaatataataaataaccacaaaatcacagtggcttaacgtaagaaaagtttacttcttgctaatacaaaatctagttgggtattcatatgacttcctatgcagttcaagctttttctacctagtggctttgccattctgctggatcccccacacttatctagccaagagagagaatgtggagggttgcaatgttgtttttaggttccagaacagaaagtagcgcacattacttccaaccatatcttattcagagttcaccacatgaccaacctaattacaaggaaggttgcataatatagaggaacacatggatatgggtgagcactggctgtcccaatagcatttatctattcctacttgatgttgctcctctgggagcatctctaagaatattgtctaaaacaaaagcattctatgacaatggagaacacattatctccacaaggcagcctattcaattattgtataattcttgtaatcagaaagttccctttatgctgaactataatctcactcttgtggcaagacagagtaaacctatttttcttccatatagtccttcaaatatttgaataaactagcaggatcccccagcctcttatattctttaggataaatatttacaattcttgaaaatttcttataggaactatacactattatggctaccctcttctggatatacttaatgaagagtgttaatgtacttcttaaaatatgagaccatataccagatgtggcctaactcatacagaataggatattgacttcctgtattctaatcactatgtaaaatgagatcatctgtgtgaaggcactttttacaatatgaagcaacacactcatggaaggtatcgttattattataaatgtaatttgagattgtgtgagcttattcagcagccacatcacactgttggctagtgttttaaacttgtggtcagctaaccccccaaacctttttcataggaattactgcatgaaagagccccataatcatttcttccatggtcagtgaaaaatacattctttttttttttgtttgtttgcctctgagaaaataggcttaatggtgtctagatttctggggctaagtaataatttaaaattcttgacaagttttaggtcctatccacctacacaaaccactttgaccaaaatcagtgctttaaaaaaaaatgcaaatgtagttagctaagcgtatttttttttgtctgcatgacaacaaatacctgatttaaaggcttttaaatcagtttgtggcattggtgtggggatggccttaaacttttgatttcctctttagtagctaatggtttcgtttcattaagtgctctctgtggttaagaactgcacatttttcttggaattttgcaaacagaatgagcaatttaaattatgcagaagcacagaaaccataaataatagcagccttaagattgtatgattagtacaattaaagcagagatatggaaaaacataacttttccatcatattattctccctctctaggaacattctggatcaattactactcaagcccataagtcaaagcaatctcttaaatccaggattagcagtccgtaatgaaaggagcagaatttttgtgaatgcagttattttcttagcctatttgtactccccaaaagttcccagttaattaactggactactttaatcagtgaatggctaccacattacacaatgtttgatttatattaatgcgctttggtcttggtagaccagaatttccagttctctaaataagagaaaaaagaaggaagctggctttcttattggacagtgaaaagtacacagcagttttgattaaactgaaataaaatatctctctaaatatttacctcaaggagacagtggtgtactctaaagaggtggatgactacaacataccctcccttaccacatccatgagtgtcctagggctgctgtaacaaagtgccacaaatgggtagcttaaaacaaatttattgtatcactgttccagaaactagaaatctgaaatcaatttgtcagcagtactgtttccttctggaggcaaaaagggagaatctgttccatgtttctcttctagcttctggtagttgccagcagtccttgatgtgccttgactggtagatgcatcactcagatcttcgtcatcacatggcattttctccttgtgtctccttttgtcttcaaatttcactcttcatgtaaggtcaccaatcattggattatagggctcaccctaatccagtatcatctcattgtaactctgcaaaggccctatttccaaataaagtcaattcacaggtatctggagtttaggtacatacattttggagggaactcagttcaagtcatagcaccatacctacttacatcaagatctgtatgacagtgaacatctggattagaagtaaaaccttcagtctcaaaataagaagtttgctgagctaaaatctgaatgcctggatatttaagttttcatatcattggagttcctggaaagatacactattagacaaacacataggcaggtttcatgcagatcttaaaagggaagtcctatataaaaataggctgtaacctgtgtattgaatctacaagtctcacttaccaagtgcaagagaggaaatccctgcatataaatgaagcttctttcaaaattgggccttatttgaagtattattattttttctttcctatcttaagtccatagggcttactcattttatgacagaaatatttactcatcatctggacaattctgagatcctgatgtgtttgtggagtttgtattgatgcagcaacatcagtttatagatcagaaaaaaaatgaataaaattctttcattataacacaataccgaggagagcaaaatctggtcaatataatcttaagggtatatgtacaaatctcagaagtggtatagtaagcaagtacaatttcagggttatatttctttcttaccttagccaaacaaattgtgaagaaaataagtagtttgggaagtagagcaaaatagctgacatgtatctattgttttcttgtacatagattatagataattataaatttagtttctagattcttcctgcataagggtgatgccaccaggatttctttaagtctatgcatataatgcaacccatgtcctcctagcatctaatccatggcagtgaagattccatgtatagtcactataaataataggcagttcagataatagacaatcaaaaaatactgaataaatcagtgtaatgttaccatgccccagtaaatagaggtgtagcatacaagtctattgtaattcctatatccttagtgctggtatggtaatgtgggatggtttagttcttgttctgtctagagccataaaatgaccctaccctcccttccttacctgagtatgctccctcatgtccacaaatatggcctttaccaatgtacactaatctccgtaaattttaaatagtacttcatacgcacagataatttaagcaaaggtccatgagatttaactgatttaacaaacacttatcaagtgctagtgatgtaccaggcaccattataaacactgaaatttaagacagacatggtttcttctctcatggtgattactgtctagcaggggagacagagattaaataaattaacctaccattttacataaatataaaattacaaattgttgttaagtgttatgaatgaaaataagagagaacatctattacattgtggatgagtagaaatgaatagttttagaaagttcataaggtaaaagttaaaagatgaggaggaggcaccatgttaaaattaagaaaaaatgtgcctcaattaggcagaatagcatatattaaggtcttgcagaaagaaaaaaatgttgagaatatttgagatacttcatttaagtccagtatagctaaacattgccatctgtgaagatggagataggagtggtgtgaagtgacatcagagaggtaaggagtagtcttatcatgccaaacatcacaggagggttctaattaaagaagtttcatgatgtaatttatgtacatttatactttctaacttttaatcttgaaataattgtagacttacagaaatgttgccaaagtaacacagagatgtcctatataccttttcacccaaccaatttttatgaggatcctggttaaaaggatactgcagtatttcaggcaaaagctgaaggcaattcagtctaaggtattggtggagatggaaagtgattgtttgagatgaagtaagattaatagtacttccctgaaattaacctactatacctcggacactctattgagagctggaaatgcagtagtgagccaaaaagacatgtttcttgtctttaagaagcttgtagtctagcagacttggcaatggattggatacaggtaggtgagaaagagagtaggtgtaagaaagtctttcaggtcactgagcaactgagtgagtaaagaacacttactaaagtggttatttcagttacctattactctataataccctctccccaaatggtggcttaaaagaacaatgatttattatttctcatgatgccatgggtgtccaggtggttctcttgctgcacatgattttgactgtggccactcatgcggttccattcagctgagagcttggctgggcctggaacaacccataactcacattcttgggccttgatgctgacctttgacagaagcagttaattttttctccatgtggcttctctctccacacaatattttattatgcactcttctggtacaagcttctttacttcatttctctcttctaagacagtgagaagattccaggcctcttaaagactaggcctggaatgagtgtcactttcactgcattctgttggtaaaagtgagtcacagtaccagcccaaatttaaggagaagtgaaattggttccacctctgaaaaggaggagataaatgcatataatggttgttggcaatttttggaaacaatacatcaccatggaaaagtctgaaaggagacggagattataagtcgtaagatcaaatgagacgtcagaatatttcaaactgaggagctcttaagagagcttctggtccatcgacattgtttttcacatgagaaaactcaagcccagagagaaaaacatgacctatttaagatcatacatctgctttgtacatagtatcccaggtacagtaatcccaaatcagctagtgtttttcagactacatttctgctccctctttatgtaacaaaatgtaatctattcttgaatttccctctttctttcaacattttcaagctaacatttcaatgaaatataactcatttccagggaacctcatgggtttcttacgcctgtagaagaataagtaaatggagcaccatcttaggaaaccaagacagaaattgggctctggctatgttttatttctagtgtctttttcccaaatagattcatgttgtgccattttatgttattcttactctgtcaagagaatgagttgtttgaatttgaatgcctcatatattctgtaaattacaaatagcaacatttggctatactattttgaccttttcgacaacgtataattttcagggtatgccattgcacgtctcttgtttacggcctcagtgaactgtggaaaagaggtggcgtggccatcaagtcaaaatatacaatactgagaaggtcaaaataatgtatcataagactatttttcaaagcaaggattaaaattaggataaatctgtcttattactcccttccccctcccatcatacacgcacaagcaaatgtgatttaaaagactgtgcataagatgatgcagaaattaataatataatggctaaagttgtactattttttttacttcattttgagaaggaattatactacgtataggcagactctagatccaccttacaaataggtttgatagtgctacatttatcaatcctactcttgaaactttctcagggatctcagggatctctgattatctctaattatccaaaattttaactgcaaatttaattttaatttattttgatgttaatattgaaaaaccacttagcatatgcttaggagaggaatggtttatatccagaaatcaaaataattgtagggtttaaactttaccaaagttaaaaatcattacctatttcagtggctttctccttttagtagtggagccatgtctacaaaagcaaattaaaaccaaagccctatatgaaaacacattgaggggaaacagctttagcgaaggagaaaatccctaatgagatccccatcctattaggccccagccactgcaatagatctcctaaagctctgcagagtggcttttgaaaacctctgttccattgcaatgtatagctgcctaaaagagcaactgaccctctaccaagtaaacctttgttattttgtcccaaggaagaatgaaacccaggatctccctgagcacaaaagagagttattattattattatttaaaatttcttctaaacccactatagcaaccttgacaatactaggcccatgggttagattccattcagtacttcagtctacttacaaacctcactcttcaatattgggatccttttaagagatcatattgctaaaattagcataaataactggtttcggaaacagtaaccaaagctcatggccataagttatagatgtatggatagattattcaaatcacttagccttaatcattaaattctttccctttttatcaaatcaatacataactgtttgaatttcacattgcctccatactgctacttgaatatcataaggtttacctcaagtagttaatatttgccagctctgaaaaaaaaatagtcctcaggtgatgcacttaaggcatcagaagttggaaagaacagttgtgaagccacccacagaaggcccttcagaagctggcagaaaagaaaaaaaaaatgaaagcttttttttttttcctgatgacttctgaaaaggaagaaatgtgaacttatccattcctctctatgttcaacactgggagccttatgcattgatcaagcattgacatttacagattcattctcaaagcagtgggggaagtattgaccagtaactatgaattaaatcacagtaaaaccacagaaaaataattagcaaattaccttcttaaagcaaagaatacttccctaagtgtcaggagacaaacaataagatccctgcttgtcacaaagagggttggtgatactggcaagtaatttacctctgtaactcagctttttctttctaatccataaaatagggattcattcatttaacagatatttattgaccacttgatatgtgttaggcacaattctaggcattggaggtatagcatttagaaagactgataaagtttgccctcacagaccttacattttacttgagagacaattattaccacaaacaaatatataaaatgttcacggactctaataaagttctatgaagaaaaagctaaattatatgatagaaaataactgggtgaggctatttcatataagatcatcagagaacatcttactaaagacatcacattgaggctgagaactagggtaggaatgagccaacattggaaaaagcttgaggaacttacgagaaaggtcgactttcattggccaataaggccaatattacagactaggacaaatgtgggcataaacttgagagaagatgattggcctttataacaactggacccatgaaattggcttcattggtagcctctggctaccagaaaataaacagaagcttaccacgagttaaaatgttttaaaatttaaaaattatgttcagtttcataaggcaagagatgttaagtgcatatatgtatgctaggtccttcccatagtgagcattgagcaagtaaccagtgaaaaacattgcaaaggggagatcaatgattagatgtaggttgtagccacagaatagaccaattggactattatccacttgaccttattagcactggtctctaaaagcaaccaaaactaggtggcaaaaaccttagggtagtgtttccctctaatccagcaagacacacttagaagcaagagttttattatcaactaaatttaggaaagggcttacaccctctcttcatcttagacatttatattgaatgttggtccatccaaatctctgcagccaggcatggtggttcatgcctgtaatcctagcattttgggaggccaagatggaggatcatttaaggccaggagttggagaacagtttgggcaaattagtaagacccctatctctacaaaaaaaaataaataaataaaattagcttggtgtcatgatgtgtacctgtagtttcagctacttgggaggctgaggaggggaatgcttaagcccaggagtttgaggctgcagtcagctgtgatggtgccactctagcctgggtgacagaatgagaccctgtctctaaaaaaatttaaatttaaatttaaaacagcctccgcaatatcatataataaagaaactggttgaacattgtttaattcatcatttctgtatttcaacatggaatactttacatggtaatgtgtatgtgtgtgtgtgtgtgtacatgtgcttgtgtatatgtgtctgtaggggtggcatgcatgtatgtatgtactgtatccatgtttgttatattcaccaacatctcactgagcacactgtatgaaaagctaggtatgagttttggtaatgtgtgtgaaaaccaaatggattctgtctttggtagcactgaactttaccccatgtggtggatacagtaatgcctcctcaaaaaatgtccacagtctaatccctggaacctgtgagtatatcaccttcacggcaaaggtgaattaacattgcagctggaattaccttgtgttatctgagtgggcatggattataagggtacttaaaagtgaaagagagaggcagaagaataggtcagagtgatatgatgtcatgtcagaaggactgaacttactgatgctgactttgaagatggtggaaggggtcactagccaaggattgtggcagctaccggaagctggataaaacaagaaaacagattgttacctagagtatcgagaaagggatacagtcctgccaacacttgattttcgccccagacttgtgacgtacagaactgtgaaacaataaacttgtgttgttttgccacaaactttgtgataacttgcacagcaatagataactaatagacttcatcttatgagtaggaatgcactgcactgaaagaggaaccaacaccatatagagagtccatttagtggattactttgttgatatgacaaaggaaatgtagtttcctcagctacattgactgagatacactagtgaagttgaccactcacatttacattatgaatgcaaatcaagatctaactaagctttattaggcaggcaaatcatttcacttatcaggattttcatattttttactgattctgtttaaccagctcttatgattcgagaaaaggtcattggtcatgttgacataacaattttcctatcacatcagttttggagctccacaaggacatcataagtatgaataatgtctatttttactcatttcatttctgcagcaagtattcttgggtcctgcttcttgaaagctggaaggaattttctaggaagtctctttcctgtaggctattttgtgctgtcctatatatatatacaaaaagagctcttatagacctagccccagtatgacatgtactttgagtttttttctagccacaaagaattttctctgatttacccacccacccacatgtgtcctctccataataaatagctggcatttcattggtcagcataagatgacagactgggacaatgactttggccatggaccagaaagaagctgaatggcctttataacaactggacccgtgaacttggcctcattagtagccagatgaactaagaggaaaaacaaatatttctactttaactttgagaatgactgtcttagcatcttctagttagcacaatattgagcaggagactatctctcccatttatcaaacatcttgaaataaacaccaagtggatgagactctgttaatatctaatgctcaactgaatgttttaaaaagaaaatattttgtgttttttaaattgaacacctctctatttatatattaggaactacgtttatacaggtccttttacaagtggttggctccttgagtaatacctaagagagactaaaaacttgagtaagccaaacttaaaatactttgtgtgatacgaatacttaacgactcgaatttcaaactgttaatgtcttttctctctaatttcagtcctctctaatttcagttctctctaatttcacccagaaatatggcatttctgggtgaaaaactgtcacaagcagcttttgtttttatggattattaatatgttccaattgaacaataattaaaataggtattgtaattggacacaggcccttcaactctcctccggggtttcttattgaactctggtcagtggtgagaactagctctagaatctattggtgaattctgttccaacagagctggctctctgagtcataagatgacatttctctggtgttttcctgtagataggaaacctttttctatatcttttggaaacatggagaacaaagtggtacttcaactgtggcttttcttttatttgcctcataaaatcccatgaagtattagtaaccatatttcttgaactaaaaattagaatgattacctaaattgtcttttccctaatttgtgaatttatttgtctagaaatcttacaaaggtgtaaaaattaaatcgcattttgttatatatttaacatatcacatttactgaaaagaaaaaattcatgagatgagggcagttcaagaaaaattcaagtaataagagtaattaattcttcaaaggagtgtcagacaatatctgcaaataattacgagagaaataatccagcaatgccagatttctttttctgtataataacatatagtcaaaagaaccagatgactatatatatttttatactttaagttctggggtacaagtgcagaacatgcagttttttttacataggtatacatgtgccatggtggtttgctgcacacatcaacccatcacctacattaggtatttctcctaatgctacccctcccctaggcccccaacccccaacatgccctggtgtgtgatgttccttccctgcatccatgtgttctcattgttcaactcccacttacgagtgagatcatgcagcatttggttttctgttcttgtgatagtttgctgggaatcatgatttccagcttgatccatgtccctgcaaaggacatgaactcatccttttttatggctgcatagtattccatggtgtatatgtgccacattttctttatccagtctatcattgatggacatttgggttggttccaagtctttgctattgtgaataatgccgcaataaacatacgtgtgcatgtgtctttatagtagaattatttataatcctttgggtatatacccagtaatgggattgctgggtcaaatggtatttctagttctagatccttgaggaattgccacactgtcttccacaatgattgaactaatttacactcccaccaacagcataaaagcgttcctatttctccacatcctctctagcatctgttgtttcctgactttttaatgatcggcattctaactggcgtgagatggtacctcattgtagttttgatttgcatttctctaacgaccagtgatgatgagcagtttttcatatgtttgttggctgtataaatgtcttcttttgagaagtgtctgttcatatcttttgcccagtttttgatggggttgtttgtttttttcttgtaaatttgtataagttctttgtagattcaggatattagccctttgtcagatggatagattgcaaaaattttatctcattctatgggctgcctgttcactctgatactagtttcttttgctgtgcagaagctttttagtttaattagatcccatttgtcaattttggcttttgttgtcattgcttttggtgttttagacatgaaatatttgcccgtgcctatgtcctgaatggtatttcctaggttttcttctaggatttttatggttttaagtcttacgtttaagtcttcaatccatcttgagttgattttcgtacaaggtgtaatgaaggggtcttgtttcagttttctgcaaactaatttagtttttctatcaaatcatgtgaaatggcagcagaatggggaaggcttgtgttcactaagtacaagtctgtgtgttgtcagaaaaatgatgagtcaaaaacagcctgcttttaacaaatgtcagtctactattaatgggtattttctaagaaaaattggtgtctggctaattttctaccttcagtgtttggccaactaaccaaagactgtctcactagattacaacctgaaaagctacctatcccagtttcagatttacaagcaataagcgttggaaccctgatgttgagtttatcaagtacaggagaagcagcatgatccaatgtaatctagacatgggtggggcatcaagaaactgcatgtttctcaccctgctgaatcttcagcaagttgccacatccttctgtgtcttagtttatacttttaccaaatgggggcaggaggaatgcctgttagggcatggctaaaaacaagcaaacaaacaaaacaaaacaaaaaataaaaaactaaaaccttatatgtggtagaatactttgaagcagatacaacaaaagtccagagacatagactgttatttataaataagcattacgttacaactcacgatactaagtgtagctaagatatatgagcagaaatttcccagaggtatacaggtagcccaagaagcaaaagcggacagtaaaaggaggcacatgaggagaaactactgtggcccagtgggatggagacagcaacaaagggaagcaaagagttaatagaggttttgctttacagttctacttaaccaactttctaaggaccagcagcatcagtaagccactgtaaacaaaggttctactttctttaatttgtttaaaacattaacttttgtcagccttcagggctgatccagctagatcaaatcaattgaatcagggttgaaaaggggagctgagagaggaaaaaaaacaacaaaaaacattaaaacaggaataaaggtggtgcgtaagaagaactttgtaaattgtctagcactatgaacatgtcaggaagaaaataaatagtaatgataataatgctactcctaggctctgatcacagagtttcttttctttagggacatccatgagtttgtagccatttccatcttcacagcccctgggaagtcagagaggaagtgtgttcactgatcacaacatctatttgctgaagacagaaccacagaccaagacttttctgataaggtcaaaagacactcatactacagttcttaatcatctggcaatcacagatccttttgagaatctaatggtaactaaagaaactctgtagataaaataaaatccataaactgaaaactgcatgtaatttcgggtgattcatgatatcttgaatctcaggctgcaaacctgtttatcactgccctatgctcatatcttcttatatgctaatttcccagcttcaccattgaggaggaggatcagtgaagatactaaagttttgtactttttttttctgacatagacacttagaccttaaaaaaaaaatttaccaactgtcaggtcagggattggcaacataggacacaactggaatgcaactgatgataagtgttttgggagctcactgggggctaaagtggttgaggaattttcagtgagtctcaaggatctgagctgggctcctaatatttgaatcagaagagatggaagacaatactttctcattttattacataagactatcttgactaggcaaagataggggtgtggtgggaaagaaaaccacgaacctgtgactagggagtgttgagggtggaacagctatgacctgaatcccttgacatctgctttgtggctttgcagcaggaaaatagatctagattatgagtaaaattaaaagagaaaatactgtataaacctgtaagaagtgcacctttatccttgtgacttgcttcaatatgtaatgagaagattctgggctgtgcttgaattcacagaaaatttattcctgaagaagttgtatggctgtcagaagggtttagaagtttgtaaggtgcaaaaatgggtttctgagagaagaacaaaggcaacaagtcaggagaaggaaggagaaggggatatgaataaataaaagaccagctcaaacatttccttttgaatgtataattcagtctctggaaacagctggttgtgatggttttccccagccaaccatgttttcaccaggtgcatattgttttcttagacagcaaataaacctgcacagcagtaattcagcaaaaaggaactttattcttcttgcattggacagggaattttcatttaatccatcattctgaacttgctgcactgttttaaaaagtcacagcaagttattcagggttgcctttgacagcagcctcaaaacacagggaagaatttgcccatgattacaagatggcatgacatctggagaaatcaggtgtcatccaggtattgggtatccaggatgtcaaacacgtggatgcaatgaactacttttagaaggtcagtgaaagcacctgcttagaaatggtttggttgaccttttcagtttgcatatatatttttgtgcaggtcacatccctaataaatgaaaatctctttgaaaacagaatccatttgataccccactataccaattagagtgtcatgcacataggagacaacaaataaatacaagagtgagtggtgatatttaggacagactttgaaacaatcattcctacagtcactaaaacactttttatcacctactgtgtgccagccacatgccttgggttacacaaataaatttcatagacgttttttgcaaggagctcacatccaagtagatgatacagacaaataaataaagtgcatagtgagtaactgtgtgataaggatgtgcactgtcctaaacgattttagaggaggagcagctaacttggattggaggactgaacaggagtgaaggcagagatcagatgttgtgggactagctaggatagtattagtaagaaacttaaaatcaggccccagattttgagaacagggtgtgtttccactagatgcaaggatatgttgtgtaagtttatagaaatcaaaagacaggtgtgttttgaaaggcaatgttgccagtaattaagtaggcattatttgttcctttattgactccaaggtaccacactaagtggaatggagtagataatcaacatgaagtgtccacagatcattctctcaagaaactcactgtctagtgttagtagaaaagacaatcatacaaataacaattagatatgctactgtaaacacagtgatgaagtttttccctaatttcaaatttatgtatgcagctccttactggatgtttaaacttggtggtcctgctagtatctctagttcaagtatagtcaaaattctcatggctagcactcagaacctcccaaaatctcattgaacattgctactactcttttcaggcatttattcattctataatgcaaatttgaatgcttgctgttttctgcacttgctctatcatttcacaccaatgtgtctgtgttcatcctgtttcctctattaggacaccttttctaccatttctacatatccaaatcctatcccagacttcaaggaaccactaaaaagccaggacatttctgattcccactctgtcattcaaaaaaaacaaaaacaaaaacaaacaaacctggaagtgactgctacttcactcgagctttcatagcatttttttctgtacttctctcatactagaaagacaaatttgggtctcattcatacagagataacaactgaaaccttacactaaaattaaattgctaaaaggcaagatagagagatataacagaagaatcaaagtcagaggttaggaaaacacacttagggggttgaggagaaaaggagccagggaagaggacagatagatagcaaagaactgaaaaataaagaacaaggagaaagggatgcctaatggtgatgaataaggcagaaacatcaagaaagagaaatgcacaaataatgaatatctgttgaatgaatgaaataatgaagaaggaatgaacaagtgaaagaagtcatgaatggagaggccattggatttatcggataggaggtctttggtggggaaagagtgttgacttggagaaattttgagggtagaagaaaatatagagaattagaatctgaacatatagactagactcctgggtcttctactgtgtagctttaagcaaataacctctatgaaactctttttctgttctaaaaatgagagaaacacctacaattacctccttcacctatatcctggggataagaatacaagcaaaagaccctagcaaaaataaagtgctatacaaatgtaaaatagtataattagcaacatttaaaagagctccacaaatgagaaggcattcaatcatcagtccaaagaaatattagtaacaatgagtttgcagagatccagtttacagatgtcatgacttgctgtgcatctgctggaattgagctcagtaccaggtatcattatgtattggattttgttttcagctagtatcccattagacagctttgcagcatatcttgctttagaaactcaattattacatttagtaaaagaagaaaagagatttatcttctgcgagtctctttaggattggtgtagcttttctcaccactacttgtagaaatcatagtcatagaaccaaagtgtttcagaccagcatttctcagcttccaggttaccatatactaatgacacatttcaagtacttggttactagtaaaaagttgtaagtagattcaagtataaccctatgataacatcatccactggcttatatttttatctaaattcttgaatgggagagaaaggttagtatgtcaggaatcatttataacttgccttacctatgctaccacccaagcatctatacaactttcaccatgagtgccctggtagaaaaaagataaagaatcaactgtatcttcagagatcatctagtcttatactatcatttataggtgaggaaagtaaggcccagaaaaagggagggattttcccaagaacccacaagtagttagaagcaggggcagagttggaacacagatcttctcatcctagtccaaagtcctttccaccatataaccttttctcaaagtgtgtgaatgtgcaaggtgctatacacacatacacatattcatgtatgcatatatacacgtgtatattggggaataatcaaataaatctagaccataaaagatcctataccatcctcttgaagattctgtcaagaagtctccccagatatctccaacacaacttgtagataagacaaagcagagtttattgcttcaccacctcctcgaagctttgacagtgcttcagaggggggatggtaagaatataatttattaagaattggaaatttgatgtaaggcaggtgtttcagtgcagggtctggactgggattgggtggcaatcatgataaaatagctcaggactgatggaagcagcaaagtgaggattttgaagggtggattcaaagaatcttagggctcaagcagtctgtgaacactctccattgaagagttgatgggtcttttgggaatctcctgtaatgagcaatgaaaccattggtttgggtaggacagtttgggaagagtaaagaaacgctaatgaaagcagggaaatagcaaagtcatgttagtatagacactaaggtatggttttggttctcagtgtccaggctgagtgtagaagttgacaatgtggggactcaattcacaatgtatattaaagccttagagaagtcctatattagttacatttgtttaactctatttaactcaggcattttcaacacctatctgactacagaaccctattttttactttaaacacagtctgaaaaactctgcattctattttgttctctttataagaggtagttctttggaacctattcagaagttgatcagttgtgaattatctaaaaacattaaatggaagctaccaaacattaaattggaagctacccaacgacagtagctgttctgatgactgccctaactagtctgacaaggctcttttgattgtatgctatgtaagtgttacttgacctgataagaacggctcaagttgtgaagcttttagttgagaacccattaatcccattagtgctgcaagaattaagtgttgggaatggatcattccaattaccttcctatcactttatacccagagtaatctttctttgtatctatattgcttatacctaatttgtcaataaactggtgccatcatttgcattttgagatacacatactcaggtgattttcaaatatttcttttctgctatgttttaaaatactttttgaaattgtttttcaaagcattttaattacgacttatcatagattaatcacctgtcaaatttaatttataaaaatgagatcattttaagttctgtcagctgcataagaaaactatcccaagccttaattcctttttatccagttttaaactacacagtcaagactgtgaatttttcctcttcttgacttaaaattgtgccatatatttttttcttcttcaagcaaccgtttatggcccacccaatttcaaaaattcttcatttatatatagatagtgagttaccaagtcatgcagaactttaactgagaaaagacttaatgagtccaaaggtaattgtgtatgcataaatgaattaaagggaaactcacaagtcagggatatggctgtgatacgtggcttgctaaaactgcaactgcttatactcctccattagattagatttagttgatttcatgatgttaagccagatattttttctattatagctatttttacacctgatcttagccaaaaggcttagaagcaatattatagctatttctttctttctttttttttttttttttttttttttttttgtgagacagagtcttgctatggcgcccaggctggagtgcagtgccgcgattttggcactgcaagctccacctccttggttcacgccattctcctgcctcagcctcccgagtagctgggactacaggcgcctgccaccaagcccggctaattttttttttttttttgtatttttagtagagacggggtttcaccgtgtgaaccaggatggtcacgatctcctgacctcgtgatctgcctgcctcagcctgccaaagtgctgagattacaggcatgagccaccgcgcccggcctgctatagctatttctaagaacatggggattcaagtttggggcatctgaattttgcaagctgcattaaatgggtcatgtactcacatggggatctggagagaaaaacaacaacagtgacaatgaaatgagatcagggtaaaacaaatagattgtgacttttattaatgtcattttcaagcaatctctaagtaaaattatatgacaccaagacattcagagaaaacagccagtcatctgatgtttagatatatgtgataaagctacacttgtcttggtgattgatatggtttggctctgttttcccacccaaatttcaccatgaattttaataatccccatgtttcatgggagggacctggtgagaggtaattgaatcatgggggcttccccctttgtttggcacttctctctcctgccaccatgtgaagaaggacatgtgtgctttcccttccaccatgattgtacatttcctgaggcttccccagccctgcggaactgtgagtcatttaaacctctgtcctttataaattacctagtcttgggcagttctttataccagtatgagaatggactaataccgtgatgtaaataatccttaccgccaagaaacataagagaccctgtctgtataactactacccactggtccacagaatacatacatggcttgggaaaattttattaaatctattttaatttttaatgttttctggcattatgaaccagcaattccatatatattattttggttgatcctctcaataactctgtcacttggttgttacatacagccttccctaacatatattaaagcagatgtcaataatttggtacacgttgagccatcagtgaattttaattgaatccaaccctggacctcaagagttggaggctttattctgtgactatggtaagcttataggcagcattatcaaacttttaccctttggaattatttagtttgagggaggtgatttgacataaagtatatctgcatcaatataatgataaatttcatggctatgttagtacttttatgtatcagcacagctaagaaaaaaatcacattttatttagttatcagaatgaatttcctgtatgagatctatcatctagatgttgagaaccatgtatcaatgaaatttagccccatctgggatttgtcattatttagaaacaagtaaaatgacatgcttgtgcatgtacattattgtaacatttaaagttgagaccagtaattacattcctgtagtttcaaacccaccccagcttctttgatactttctctgcctacatagggacctataaagatttcaagttgttctgtgacttggtgtctagttcagtggttctaaattttggctacacattataatcaatggggagctttaaaaggtattcttgacttgatcttacatccataggttctgatgtaattggtttggaatataacctggacatcaggatattttaaaagtttacgtattttatttctagtgtgaaggcaaagttaagaaccatgatcttgttgatttacctgctggtacaatgctgcccatggtatctcagtgcttcttcaataatcagtatcctgtttgggaaacattccccagaggttttcaatgactgggtccctgaaacttatttctctcatatcaatcaccttcctacttggattcctaccaattttttgttcttaaaactcaatcacttgcttcatctgaccctgcttggctagaaacagcaggacttagaatctgattctttgttttccagtctgctattttccagaataccatatcttttcaccatgttctaatctctgtctttgaccaaatctagggttctaactagactttcagtcctgatcttgtttagtcttccccaacctaccacttaaaacttcatgtacaacatcagtatctagatgattgtggattgcttttttcttattccacaaatattttggcatcctgcttctaaaaatgattagcatggtagttagcattgcaagttctgttagtgtgtctgaattgaaatcctggttccaccatttactagttttgtgaccttggatcacataagtaacctctctcagcctcagttttcacatctataaaatggaggtaaagatgataatttttagggctatgagcattaagtgaaataattcctgtagcatgtttttcacagagcctggtacatactaagtgttcaaatccacattagaaacacatctgtgtttaaataataataaatttggcaggtaataattggtatttgttttaaaatcaacaaacaatgatttgacaattgaaacaaattgtttcatccatcccatttgctattcatacaccagacctcctcatatttacatatcttttgaacagtgaatttgccttggaaatactaaatttcttcagagaaaagtctataggggtccaccactgatgcataagaaggccattgcgtttgatatcatagataaacgctaggatacatattttataattgctttattgccaggagttttcaatgaagccataaaagaaaaaaaaatgatcagcctaattgcctcgagatggatatgtaatgcataagtctcttgttaaatggatctagtaataggccacctgtttcccctgcctcctacccagttcagtatatgaatgaacagtgctttctgaaatgagcaaaccaagacttttaagtgcagttatgttgtaatttaatgacagctcatctcaggtttgaatcttacctaatcagataattctagagtttaagaacagatttgtatcttgcttatcatttttattgcacagtcattgagatatcctctaggtagaagttctcggctcaaaggcctcacttaaaagatgagcaagaaatagaggaaaggagatataggtaggcaggtgctggggcatttggttgatttattcaagaccaaattcatggtatgttaccataactgaatttaatattcggtcaagctgctcatcattcatttcccaccatttgacttcattattcaatctatcacaacatttgaagtctgcaatacatgatattatccaaaataagtataaattaagtctaaatgagcctagccactttgtacatgtcagagatttaggctccaataattcagaatttgtgacgactcatattactctgaaaaaagctgggggtgcagttattctcggcagattaacaggtttagcagatataggaaggtgtgtttaagctacttaaaacacatcattttcaagcacctaagaacttatttactgcaaatactagatatgataattacaaaacatcatgactagcctaatgaaacctgtcactgtgtttacagtgaagatgtttttttgaggatgttgttcattatttgctctacaaaaacctatggaatatatattttcttctggtctcattattttaaaatgttgcacttaccaggaaaagagacaatattaattagagatttaaatgtggtttttttaatcaggactacctgtggttaaattccaattctgtcacttcctggctatgtggcctttggcaagtcagttacttaccttctatgaatgtcagttttttcacctgtaaattgagggtaaagtagtccctgtggtgagaatccagtgaatttatatatgaaaagtgcttagaaatatgcctgaaacacttgataaatgcttagcaaatattagctgtaatagtatcatgagttttttccttgtaattagtttatttttttccaaataaacattctaggatattttcttgttgctgctagtttgggttcacattgtgacccacttgatacaagggcaaagactttatcacttgcatgttgtgattctctcttatgcttctattatttttaattttatttgattttgttaattgtctgaatgtatcaatcctttttagagtaagggatatattagtcaaccaaacaaatgatacaatataaggcaaaactagtttagtttcagctgctatgaaggatcaaaggtaaaaatagttcatttcaaaatatgttgtttttcagatttttttctgatttaaattagcgttttctcattactctgaattggtaaaaaaaaaatctaaccttttagtataaggctttgaaaatatacagaaaaacaaaaagaataatataatgaatgtccaaatatctagtacctagattgtacaactgtgaacattttgccgtgtttactccctctttatttttccagatttacgttaaggtaattacaaataacatgatgtttcacccctaaatacttcagcgtttatgtctaaaagatagcaacattttcttttgtaatcacagtattaattaaggataatgactcatttcactctttatataaatgattggcacagatatgggtatatgtgcttggtgcatctttgtgagttgactagtcagttaattacttgatgcagttttattgtatttgcttagttcttccccctggagcacaaaagatagaaaacacttctctccttctcttattccctcttccctgcctcttcccaagttagcaagagggaaaagaatataaggaaattaatttcctctactttgtaaactcatacaagttgcccctgtcccatggcaccctgcatctgcaggcaagttaataactttctttctctactggcaaaaactgctgactttactcctctcacaaaaggtagataatgtttgttagacattttgagattcatacatggaagctgcactttatactcaaagctttcttaatcccacagttgaaatggattgtattaatagtaattaaaataactactgtatcaactctatcagcagctgtggttctaaaagaagtaatattaaatactagccccaatcttttctcaattttcccacagagtaactttatctgtttcctttgtgttttcttatttttcatagttttagaaaatgtttaataattctgaatatgatatgtaacttccttgaatttttatcaggtatgatcagtgtgttgcccatttaaggcttggctattgtttttaagaaatacatgatttaatcacctcaatctcctctgggagaactcagattaaaactctgccattgagaagatcagacttgtcaaattgttttaccatacagaaaatgcacctaattatttaataacagctttcatcaacatttctcccaatttgttcttccttgattgtgttctcccatgtatcaaagatcaaatcttgagtcaaatatttaatattgaacaaagcatcacatttagaaatagtatgaattccatcatgcctagacaagcactgttcctgtgttggtggttattgacaggactgctgtcactgtttgctattatgggcttcattaatgctgccaggaaaaaaggactctggcattttggcagttactctttgccaggctctaaatttaattttcttctaagctttacaacttggctacacagaaattttaggagtgcgattagacatcttggctgttgatttagtcataaatgaaaaatacactaagttgtctttgtattgtctggttctttttctggtttagtgctttctgggcaggagacatgtatttcgtgtatatcaaagtttgatgcaaaataataatgtttacattttatactatggattatcttgaatgaatttctggatttgattaccataataacaataaggttgagcaagatgtattaggttcattttacagataaggaagctaagaaaattattattttaattttctaagttcacaaagtccaggaagaaaactctcttgaattctggacaagtgcaatatgctgcctcctagtctgtttaacgtggttattctattaacgagaatttgacaaagagcacctaaccacaatccaaaagactagtttctagagtgagttgtaagaattgaatgaatgaatgacagaagacataatttaaaataagattgatcagtagccattatttgtaagatggtacaattgaatggacctatatttctaggtctctactatttatgtctctatgtgaatcagtgtctctaccaagtaaataatggccagttgtggatcataagtcacaaatgtggcttgctcctcaaagcctacaggataaaaaggacatgcagtatatgtgagagtgtgttgtgtgtgtgtgtgtgtgtgtgtgtgtgtgtgtgtttcctttccgaaatagtttagggattttaatgttgttgttgttttaccaaaagttacccttagggcaactatggtacaatttgtgtgccaaggatatgaaatcaataattgagtcttgccccatgctatgattattgaaacagaattgatttgtgtatttccaaatactgtatatgagatatcgacctttgaatcatttttttaccactaaatacatggcaaattggtagcagtggttctagtgaaaaatcagaacacctcaagaagatagatatctttaggtgacagtggcaggactttctggtcctctcccttaaaatgtatcaagtagtatctttgtgaccctgccacctttccttcctctttccttctacaagcctccctttgcccaccatcttctctgattacacttgatttaacaagaactcctaccactgattcaaatggaaaatatgcagaactgctgcccagaaagcaggcatgtaggagaatcctcttggacgccactggtctcattcattgctaatgatagcctgcaagggctatcaatcatttcagggaatacccatgtcataggatacaggaattacagaagcaaaggggtgaatttataccattgaaaatgtgcaaatcaatacttgtgagtttccaacaatggatttggtagtggccattgtaaaagtattctaagattgataataacaatataagtgttctgaatttgaatagcacttttccccttgtcagtgtacttttttatctgttatctcatttaatccctacaacagccccataaagtaaacatggcaaggaggtattatcaccccttatttgacccatgagaaaactcaaataaaatgacaagttaatgatagaacttggactagaatttagagcatttgactccaagctatttatctagccatccagccattcctttcttccttcaaatatatcagcttcagtcccagaatattagatgcctttaggtgagactgaatatttttaaagatttttattttatttttcacaacattattttatttggaaaaattttaaacccacagaataattgcaagaaaattacaatgaacacttatatgccttttacctagattaaccagttgttaacattataccacatttgtactatgtctacatacacgggtatgtctgtatttttttctaaaccacttgagagtctgttgcagatatgataattcacccctaaattagttagcatgtgtttcataagaatcaagaccttctcctacataaccaaaatataactatcatgttcaaaaagtttaacattgataagatactatgtctaacacatatactatattgaaattttcccaattatcccagtgatatccttaataatatttttctgatccggaatccaagcaaagatcatgcattccatttattttcacattatattttcatgttgcctttaattagaacagtttccaagcccttttattttatttgtacttattttttccagctttattgaggacaattaacaaataaaaatttgtataaattcaaggtaatttaagtttattttaaattgatttcatgacattgacatttttgaaataaccagactagttattgtgtaaaattatcttcaatttgaattcatctgtttgctcataattagattcacattatacatttttgacaggaatatgatttgggtgatcctgtgtctttttcagtgaggcacatgatttctgttttttccttttattggttattcttagtttgactatttgcttaatgagatatctgacagattaaatcactataaaagcatttttttatcctttataaataaaattaataatctgttggcaatgctttgagactatttgaatactctgttcctcaaaatatttcactgatgcttctttccagaaccagtgattatgatgatggttgcaacctggtcattttaaactcattccacacatataagttggtattcttatatgaaaaggaattaccccctccttcattagtattactatagactcctagactctttctttttcatcaaatgtgtccattttgaaatgtacaaatcttaagtgtacagctcagtgaattattaccattttaaccattttaagtatacaattcagtggcattaaaaacattcacatttttgtgcaaccatcactaccatccatctctagaatttttcttcccaaactgaaactgtaccaattaaacagtaaagcttcattccgcctgtctctattccatggaaaccaccattctactttctatctttatactttttgacaattctagatatggaaccatacaacatgtccttttgtggctgattttacttaggatgtcttcaaggttcatccacattgcagcatgtgtgagaatttccttcccttttaaggctgaattgtgtggatataccacatattgtttatccattcattcttcagtggacacttggaatgcttccatgttttagctatggtaaatagtgctgctatgaacatggaaagctgttatgaacattggtgtgcaaatatctattctagtccctgcttttaattctcttgggtatatacatgaaaatggaatgggggaacatatggtacatatatatttattttttgaagaaccacttaactgttttccacagtggctgaactgttataatccttaccagcaatgcacatgggtgccaatttattcacatcctcacaaatacttgttatttacttttttaaatttttgttcctaatggtaagaatgtgtatgaagtgggtgtgtcattgtgattttgctttccatttatctaattattagtgatgttaagcatcttttcatgtgattattggccatttgtataccttctttgtagaaatatctattcaactcctttctccattttattttttatttatatttatttacttttaattttttaatttttaatttttgtgtggatacatagtaggtgtatacatctatggggtacatgagatgctttgatacaggaatgtaatatgtaataatcacatcatggataatgggttgtccatttcctcaagcatttatcctttgtgtcataaacaatttatttacactcttagatattttaaaatatacaattaagttattgactatagtcaccttgttatgctatcatatagtaggtcttattcattctttctatcttttgtacacattagccatcccttcccccccgcccccaccccactacccttcccagcctctggtaactatccttgtactctctatgtacatgagtgcaattgcttgaatttttagatcccacaaataagtgagaacatgggatgtttgtcgttctgtgtctggcttatttcacttaacataatgatattcagttccatccatgttgttacaaatgacaggatctcattctttttgatggctgaatagttctctattgtttatatgtaccatattttctttatccattcatctgttgatggatacttcttccaaatcttagctattgtgaacagtgctgcaacaagcacgggagtgcagatatctcttcaatatactggtttcctttcttttgagtttattcccagcagtgggattgctggatcatatggtagcttgagttttagttttttgaggtgcctaatttacgttaccaccaacactgtatgagggttcccttttctccaaatcattgccaacatttcctattatctgtattttggatataagccattttaactggggtcagatgacatctcattgcagttttgatttgcatttctctgataatcaatgatgttgagcaccttttcatatacctgttttccatttgtatgtcttcttttgagtaatgtccattcaaatattctgcccattttttgattgaattaataggtttttccccatagaattgtttgagctccctgtatattttggttattaatcccttgccagatgggtagcatgtaaatattttctcccattctatgggttgtctcttcactttgttggttatattttttttggccatgcagaagctttttaacttgatgtgatcccacttgtccatttttgcattggttgcctgtgcttgtggggtattgctcaagaaatttttaactataccaatgtcctggtgatttttcccaattttttcttgaagtagtttcatagtttgaggtcttagatttaaatacttaatccattttgattttatttttgtatatggtgacagatagggatctaatttcattctcctacatatggatatccagttttcccagcacgatttattgaagacactggcttttccccagtgtttgttcttggcatcttttccagcaacaggttcactgtaggtgtctagattgctttctgggttctctattctgttccattggacaatgtgtctgtttttgtgccagtaccatgctgtttgggtgactatagctctgtagtataatttaaagacaggtatgtgattcctccagttttttgaaattcctccattagttgttgaacactttcttactttctggaacacagtgtttcagactcactgtgtactctacttgtctcagccctggaaggagctctggctcattttagtggaaaacagtattttgaaaccatgggatatgggcaacagctttgctcattgctaatttggtgtcattgattctagactttttcagcaggtaaatgagtttatattgatacttctaaatctaatctaacaccacaatttgtttctctcttcctgcattttatatttgcacctcccttcacccaaagtgtgaaccctgaatctctaaagcaccaatatatctaattgttcactcctacatatagacaaaacagttttggaatttctgtacccataccaatatcaacaacaaactgtttaaagttaaaattttattatcatttacctttatccttagaatatactcacagagtatgttgtttaaaatttactttgattttttttttcatttgtggggttatctatttgatgtacagttagatatatgagtttctgattgtattcaattttaaagtttcccccattttttaaatgtatgtatttaaatatgtaaaataacataatttaaaaaatcaatactttgtaaaatagtaaattcagaaaagttttatacctttccttatccctttcacctcatgcctgtctacttcctttatataaacaatttcatttatttctctgccttactattgctttgttacattttgaaaaaaataaacatgtgttacatatttttccaatttcttactttttgtttcatgaaaggtattacaaggtatttcatatatacatacacctctagatatacatatatatattagattaattcttttttgtacccttttaaatttgctaccaggtgcggtggctcacacctgtaatcccagcactttgggaggccgaggcgggtggatcacgaggtcaggatttcgagaccagcctggccaatatggtgaaactccatctctactaaaaatacaaaaattagccaggcgtggtggtgcgtgcctgtagtcccagctacttgggaggctgaggcagaagaattgcttgaacctgggaggcggaggttgcagtgagcagagagcatgccactgcactccagcctgggcgacagcgcaagactccatctcaaaaaaataaaaaaataaaaaataaataaatttgccaatatttctgggaaatcaccacagataaattcatggagaacctaattgtttaaatttttattttgaaatcattatagatttatagaaggttgcaaagaaatgtataagaaagtcctatgtaccctttccccagcctcctctaaggttaatatcttacacaaccacagtacaatataaatcccaggaaatttgacattggaacaatccgcagaattattctgactttaccagttgtgtgtgtaccatttgtgttcatgtgtgtgcagcttttgccattttatcacatgtatagccttgtgtaactaccaccacaatcaaggtattcaactatagcatcaacacgaggctccctcaaagaccctctttatagccatactcatcttctccttcactatccctaatccgtgacaaccactgttatgttctttgtatctataattatttgacaaatgttacatacatggagtcacacagtatgtatacctttgagataagatttttttcactcagaaaattttttgaggtttatctaaattgttgcatatattaatagtttgttcctttttgttactgagcagtattctgtggaatggatgtgctacagtttatttaaccattcacccactggaagacatttaggtagtttctggttttcagccaaaaagaataaagctgctatgacaagttcctccatcctcattcatttttacagccacatagaacttcattgtgcagttttcctatgtatagagatatagattatggctaacattttgttattagtaaaaattattcagtgatcatttgtttatatgtatttttgtattatcaaagatataccttcaaagtaaattcccaaaagtgaaagtgttgggtcggaataaacatgtatttagtttttcagctatttcagtggcgtgctaaagctgactcatactggctttcaaaattcaattgttacactcttaggaattttgcaagctggttgttatacataaccattagtaagaattaaatcacataaacttacaatttaaaaatttatatttctaattaaggtaatgccaaaaagcagaaagaatgaataatacttagtaattgatagcataagggggtcattatagtcaaaataatttaactgtatattttaaaataactaaaagagtattattgtattgtttaagacaaaggataaatgcttgagtggatggatacctcattttctatgatgtaattgttacacattgcatgcctgtatcaaaatatctcatgtacctcataaatatatacacccaccatgtaccccacaaaaattaaaaataaaaaaatacccaaaatttttgaaaaaatgggaagaatcacgctactgaactttaagacttactctacagcaatagttatcaagacggtgttgtattggcaaagggatacatagatcaattaacggagtcaaaagtctggaaatagactatataattatggctagctgatttttgataaaagtgcaaaggcaattctatgtagaaaggataatatttttcacatatggccttgggacagttggacatccatatgcaaaaaacaacaacaataaaaaatgaaccttgacctaaacctcataccttatacagtagttaattcaaaatggatcatagacctaaatataaaaacaaaaacataaaagtgtcaaaattttagaagaaacataggagaaaatattcatgacctgggaataggcaaagagttcttaaacatgccatcagaagcacaatctataaaaggaaaaatagacaagttgacgtcatcaaaattcatgtttgctctgcaaaagacactgttaagagaataaaaggacaggctataaactgtatgaaaatattcacaaatcacatcccacaaaggactttatccagaaagacttctcagaattcaacaataagaaaacgacataaagaaggcataaagaagagttcaatatgttcactataattagccatcagggaaatgcacattaaagtgatcgcgagacccacgactcacctagtagaatggcaagactgaaaaagaaaactgacaatactgagtgctagtgagaatgcagcaggactagaaccctcatttattgcagatggacatgcaaaatgttacagccattctggaaaaaagtttggcagattctcttaaagttaaacatacacttgtcataggactctaccatcccactgtgaggtatttactgtagagaaataaaaccttaggttcacacataaacacacatgaatgttcatagcagctctattcataatctccgaaaactggaaatgtccttcaacaggtgaatggataaataaaccatggtacatccatactacttggcaacgaaaaggagcaaaatatagaaacaagcaacaacctgcattcatcttataggcactagactgagtgaaagaagccagtctcaaaaagttatgtacttccatttccacggcattctcaaaaatataaattgatggtgataaaaagcagacaagccactgccagaggttaggagtgaggggagggtgtgactacaaagcagtagcatgaaggaatgtttttaaggtgatagaactcttcttatcctgattgtggtggtggttatgctaatttttatgtgttaaaattcatacaactttacaccaaaaaaggcagcttactgtattttaattcagtaaattaaaaaatttacagtaaattaaaaattcacttaatttaaaaacaaaattaaaaaatacaaaaccctaaaaagatcagtgtagaatagtaatagctaccaatatatagttctttttttacaaatatatagttctgataagaacttaatatgtgaggtttttaaataaaaatatttcccttattataaaaacatgttcattataaaaaattaaaccagtttcccagagataaccactgctgttatcttggtgaatataacttcagacctctatcttgccttgttttcagaaagaatggcattctgtacttataatctgggaatctgctttttcatgttacaatatgtcattaaatagtcttcttaaaataataaaagttacaaaattaaggtaagaaataaaatcattacttcttaattctttttatctacatttttctattatctgttttcttgaagttattaatgttaattgattttatatggtaaaaaaaaaaaaaaaggaaaaaacctatacaatagtgtgctaatgtgcatctcttcccaaaatgtgttcagtgacttcaccttcgtagcttgaaattggccatggtggtactatttcacaaagaaaatcagtaaatgccacacatcaggactttttgggtgtggttttgattttttcttttctggagaaccagttgtcaaacatttaccagcacaacatagtacatttttaaattccccttgaaggaatcatattattttgcactcttaccagcaacacatgagagtttctatttcaccacagcctcagcaacagtgtattagcaaacttttaagtgttttcaaactgatgtatgaaaaatcatatttcagtgcagttttgatttgcatttatcttataagtaaagttgtacatcttttttaacatatgtaaggagtaactgcatatatttttaaactatctgttcatgtgtttcacctatttttctaacacagttttgatcttttattttccctgtattttgaagagtatagatctatatatattagggatattagcccttttatgatacacgttgcaaataacatttttgtttatcatgttgtgactttttgctttgcttatggtagattttttttgccatgtagaaatttttaggcagtcaaatgtatcaatcttttattgcatctaaagtttgaatcatagttagaaggtcttttcctttagagaatgaatatttttaacaagcctctctcatatgattttatttgggaacaatagatcaaacaaatgcagttaaacagacattaggtgcctattatttgtagaatgctctggtgaatacacagacaagagctggtgtatctatctttcatttccaggaacccataatttaatggggaacgttgacctatacatggcttttctgaaccttctgctaatcacagctgactggcttctgtttcaattaaggtctcaaaactaaaataggaatgaaacactacccagtaattctactatattcctctttaggctcaccttccgacttataaaaatgattattctatatgttttctttcctcatccaagtttttctacctttgcttatatctgattaccatacctcatcaaataagcagtgtatgtttagaagtatgaacattcaatcaatactgcttgagtgtgaattccagctcaactacctaccagcagtaggacctttagcaaatttctcaacctttatgtgtttcagtttcttaatttgtaaaatggagataatagcatttacctgatagttttgagtaaattttgtgtatgtgtatgtgtaatgggtgacaaataataagtagttttaagtgttttctatcatcatcatcattgtcatctagaaactcctctatctccctgtcctcaaatctacaatcctatctttatctgcatacatattcttcccctttcttacagtttccaaaggagggtatatccatctccccttttattaaaggaaaacccttcatctactcacaatttgcatcctctttctcctcttcaaaaattgtgcctcttcagttagcttctcccttttctgcaatgctaattttcccttcttttttttttttttttttttttgagacggagtctggctctgtcgcccaggctggagtgcagtggcgcaatctcggctcactgcaagctccgcctcctgggttcacgccattctcctgcctcagtctcccgagtagctgggactacgggcacccgccaccacgcccggctaattttttgtatttttagtagagacagggtttcaccgtgttaaccaggatgatctcgatctcctgacctcgtgatctgcccacctcggcctcccaaagtgctgggattacaggcatgagccactgcgcccggccaattttcccttgtttattggatcattcccatcaacattaacctgccttagtattttccagtcacccattttataaaaagaaaaaaaaaacctttctgttacttttctaatacattttacagaaagacacaaactttctacaaccacatctactgcaatgatcactccacttctctgctgaaaagaaaatttgaaaggcaagttcattttaagatatattcacattaccttctttcctttgtgagcttccatttacccttcaaacctcttcaggctgatttcattttcctgaacttaactgaaaatattgcagataaagttaacaacaacttccatgatgggaagtcctagccagagtaatcaggcaagagaaagaaatactaggcgccgaaataggaaaagaagaagtgaaactctctctcttcactgacaatataattttattcccagaaaaccctaaagactccaccaaaagacttctggaactgataaacagcttcagtaaactttcagaatacaaaatcaatgtacaaaaatcagtagcattactacacaccaataatgttgaagttgagagccaaatcaagaactcaatcccatttacaatatccataaaaagaataaaatacctaggaatacagataaccaaggaggtgaaagatctctataagaactacagaacactgctgaaaaaaaatcagagatgacacaaacaaatggaaaaatattccatgctcatggactggaagaatcattatcattaaaacagccatactccccagagcaaagtacagatgcagtgctattcctatcaaactaccaatgttatttttcacagaaaaatgttccaaaattcatatggaaccaaaaaagagcccaaacatccaaagcaatcctaaacaaaaagaacaaaccctgaggcgtcacattacctgacttcaaactatactgtatggctacagtaacaaaaataggatggtataggtacaaaaacagacccatagaccaatgcaacagaatagagaacccagaaaatcatactgacagcatctgatattcgacaaagtagacaaaaataagcaatggggaaaggacctcttattcaataaatggcgctgggatagctggctagccacatacagaagaatgaaactggataccttccttacaccatatacaaaaattaactcaagatggattaaagatttaaatttaagaccttaaacagtaagaatcgtagaagaaaacctaggaaataccattctggacataggtcctggcaaagattttatgacaaaggttccaaaagcaattgcaacaaaaccaaaaattgacaagtggtatctaattaaactaaagagctctgcacagcaaaagaaactattaacagtaaacagaaaatctacacaatgggagaaaatatttgcaaactatacctctgaaaaagttctaatatccagaatgtgtgatgaacttaaacaattgtacaagcaaaaaacaaaaaatcccattaaaaagtggacaaaagacatgaacagacacttctcaaaagaagacacacaagcagtcaacaaacatgaaaacatgctcagcatcactaatcattagagaaatgcaaatcaaaaccacaataccactgtgagataccatctcacactagtcagaatggctattattatagtcattctgccagccaaaaaacaacagatgctggcaaggccacagagaaaagggaatgcttatatactgttagttggaatgtaaattaatttagccactgtggaaagcaattttgaatttctcaataaacttaaaacagaactaccatttgacccagcaatcctgttatcaggtatatattcaaaagaaaataaatcattctaccaaaaagacacatgcactcataggtaatcacagcattatttacaatagcaatgacatggaatccacctaggtgcctatcaacagtggatcgaataaataaaatgtggcatatatacgccatggaatagtatgcagccataaagaatgaaatcatgtcatttgcagcaacattgatgcagctggaggccattatcctaagtgaaagcaggagcagaaaaccaattactgcatgttctcacaagtgggagctgaatattgggtactcgtggacataaagatggcaagaatagacactggggactactagagggaagagggagattctctctctaagcaatctcatgtagtcccatgactttgattatcattttattccattgattccaaaatatttttctccacctcattctgctccgttgaatttctgactcatatctaactgcccactaacatcttcattttgtgtataaataggtatctcaaaataaaaattaaactccttacctttgcttttccaaatctacctcctacatgagtagtctgcttcttggaatatatatatatatatataatataaatatattagttatataatatatacatatattatatatgatatataatacatacatatattatatatgatatataatacatacatatattatatatgatatataatacatacatatattatatatgatatataatatatacatatattatatatgatatataaatatagattatatgttagattatatatatatatataaaatcagccctcttttcttcatatatattgccatttgcttagtcaggtcaccatcatctcttgcttgaactagggcaatagcttcctacctggtcttgattcaacattcctatacctagtttacccaaagagcaatagaaatggttgtttaaaaatgtaaatcaaatcatattactctgctgcttaaaagtcttaagtggatttctactgaacttggagaaaaagctgaagtatttaccatgtcccacaaagcgtaagtggatgaacagaggagcgagaagttaattatggctggaggagagtcaggaacatttgatggaagagatggcacttgaggtggacttttaagggtaggttagatttgtatatttggagataaggagagtaagtggaaaagtacagatagattatccttgaagaaaaggagagtaagtggaaaagtacagattgtctttgaagaaaagaatgtgatccagtgcagtttggagaatgaggcatatgacatgcttagggaaaggtaaatctggacaaagtagttggggcagattgtagagagcattgaatactgagctgtgtcctagcctgagaagaggagggatgtaagagattatcaaatcctcctttctgcttcctcctgaaatttctcttgggtctgcccctactttgcattccccacttcctcttccctggttctagcccaagttacctcttgcctggacgattaaacaacctcctaattagtcttttctttcccttcccttctctcaacctttttctacaccagcttaatctttctaaagcacagctctgatcacaccatatccttctccaaaaaccttcagtcattctgttacccacaggatgaaatccaaactttatagtagggtagttcaagccactatcattcccaccacccccacaccaggaaatttaacctgcgtttgctgtctttgtatcctttagctccctcttgatgagtcatacctccctgcacactctttcctctgcacatccactgattcttctttctctttgccgttgtacattcagttgcctcctcttgtactactttcacccagcttcatatctctccaactggacatgtctcaatgctgcacagttccaccatcttctctaccaagcttcaatgcttttccacctgctcaagttgttagtaatttctctcctctgaatttccgtaatattgtatctgtacttctcttgtggagagcattgtaagagagcattgtattagccactgaggatagaaaggtgaataacacacagctttatactattttatatatgatgctacatttaaagatcaataatgtagggctgtgtggcacaatcaataactgtagactgtgtgacacagcctgttgtagtcagccagactagttatctctcttcaaagaacgtagaataaacccccctcttggcttctatggaaaacagactatacaaattgctttcaatgtttagttttaagaagctagactatataccatctctataccaccaataacactgtgaaaatctctttgcagttttttgtcctttcttcccctttcccagaggtgtagtggaagagaaagggtgggatcactaacatttgtttaacatttcctatttgtcatttaatcctcacaacaatcctataaaatagattctcttttttttttattttttatattttttatttatttatttatttatttatttatttatttatttaatttattattttttttttttgagacggagtctcgctctgtcgcccaggctggagtgcagtggcgggatctcggctcactgcaagctccgcctcccgggttcacgccataaaatagattctcttatatgcctcttttataaatgaggtaactgaagcatagagtgagtagagaactcaggatttaaattcaatctaggaattggagaagttgagattaaaatgcatgcaatctggctccatagtatcctctatttaactactatactacactacataactaccactgtttaatgaaataagtatattagttcactggggagagaaacatcttcagacttctgagaagaatttgtaacactgctctctctgtaagtaaatactgcccttttatagaaccatggcacagtagctccttttgtatatatgtttccaaggaagtggcctggcatcttatctcatgtaaaacctgtgaaaactcacctataaagttcaatcagtcaattaactactaaatcttgagtacatactgtatggcccagccctgtaagaaaccagagaaaataaatatggtcatttaaaaatatctacaactcaaaagcagtgcatcaaataggttgaaaaagtatttaaatgattcctatggagttggagaataaatctgaatatgaatgctgcttgtttttccctatacctcacacagtggcttcctcatccattcatagaacattggagtggtgaaatgcactgaatgtgagatacaatgaggtcctttacaagttcttttctagatggcattggttttcacataacctggagggctggctgaggctgtgaacttttctgcataatcagcctgagacatctgaagccaagaaagaccacagcagtgacagaacacctactgtgagttaagcaaagaatgggagattaacttttacacatgtctatagttcattttgagtgaatttttgtgcttcttgtggtaccttaatcaaaaattcactaaacataaatgtaaaggtttatttctggactctcatttctgttccattaaatctatgttttttcttgtgataatgccacactagggctttatagtaagttttgaaatcagaaagtgtgagtcctccaaaagtattctttttcaagattgttttggctattctgggtctctttcatttccgtataaattttagaatagacatgtcaatttctattaaaaagctcactgggattttgataaaggttgcgttgactttttaaatcattttggggaaaattgccattttgaaaatgttgagtcttctaattcatgagcatggagtgtgtttccatttgtatatattttctttaatttctctcaacaacattttgtagttttctaagtcatgtactacttttgatagatttatacctgagtattttattcttttgataatattatgaatggaattgttttcttaattttaattttggcttattcattgctattatttagatatacatttttctgtatattaatttttgcatcttacaacttaaaatgtatttattagttatagatatttttgtagattccatatctctttttagatttgtttatttgcagatgaaagacaaatttacctcttccttttcaatctgaatgtcttaagttttttccttctttctttcttttgattcttctctttttttttctttcttcttattgccttagctaggatctcttgtacagtgttcaatagaagtggcgaaagcagacaactttgcactgttctgtatctcagagtcagtatggttactggctgcatggtgtaccttttcagatccttttatattcaatctatttatgtctttgcatctaaggtgtcactcttgtaaacagcagatcattctatcttgcttttaaaaaacctaatatgataatatctgccttttaatttgggaatttagctaattcatgtttaagataatttctgatttggttggattaacatttcttattttactgtttttttatatgtctccttcctctttctttctttcttttttgattgttgtttctgtttcccttcactgcattcttttcagttaaatattttttgtgtgtgcaccaatttaattcccctgtagatatttagctaatttttagttattttcttaatggttgctctagggattacaatatgaatcttaattaacgagaacctccttcagattaatactaacataatttcagaaaaatatagcaatttagcaacagtaagttctccctcttttttgtattgttgctgtcatatatattgtatctatatatgaccaacctagaaatgctgtgttgtaattattgcttcatgtaatcttaatctttaaaaaaagtatagagtgttttattattaacctacgtatttaccttttccgttgctctacatttcttcccgtagttctggatctggtgtcatttcctttcagcattgaaggtcttcctttagtatttcttagaaggtagatttgctaacagcaaattctctcagtctttattaatctgggaacatccttatttagccttcatttttgaaggatagtttcactggatatagaattctgttttggtagttttgtaatgaaatgcaggtccagatgcttaccacttgcagagtgcaattaacaagagcaacatctggtagaaagaaagtgactattaaccaaaactagtaaacgggaagtagccagattcttatccaaattaatcactttgattttttgtgggagaggcaggggttttaaaaggaaaactttttaaggaagccatgcgagaattgggctgagtgcaatgtctatgtgtcttcttctgttggctaatttttttcttttatcgctttgaatatgtaattctagccttcattgtttattatgaagtcagccttaattatattgatgctcacctatatgttatgagtttttttctttctcttgttgcttttaagattttctctttgtattttgttttcagtgattggcttatgatatatctagatgtggattcctttttcttcaaagtgcaggctgtgcagactttactttcttctgggccctttcacatcttatcaaaatctgcttctgagaagtatgttaccatgtgtgcagcctcagggtttgccagaagtgtgtagctagcttgggcctccattccagagttatgtttatcccaaccatgactgcagcctctagttagtaaagctgttagattttcttactcaccttgtgtccaagatgatcacttccactgacaacacggttgggcatgggtgttgccagtgctcacttttccaaatcaggtgagccccctttgatagtggcagaacagcttccagttctcacggccttccacaccctaataaaatttatgccttggctgagatggggttgggggcgcagtgggaaagaataagaatggaagaagcaataccacagattcctactgcttttcatgtggtatttgttgaatgtaaagataatgatctaattaacatagtagtttacatttattccttcattcgggtaatttcttcagaacctaatatgtaccatctttcgatctaatatcccaagtaacattattcatacatcctcgagaattccatatttatttaggaaaacagacatgcaaataaacacaaacaatacaatgagatcattaaaatggagagaaggaggaaggaaaataagaaaggtatcactaggggttcctgctgtttaaagaaatcctatggtgatggtgatttttttaaagaaaataataatcaccacctattaatatatctatgggacaagtacagaattgggtgggcataatgggagggaggaatctggatgaattgtagtatatctaggaggatctgctgaaaactacaggtttgttgcctgacctttgaaggaggaaagactttagttatggcaaaaagaggagaaacatgccccatgagtaatggaattcatctttatcagatgcctagttatcgctagttacaaactacgtttgctatatattcataagattttcaaattatttgaagtctaacacccaatataatgagcaggattatactctcaccacttctattttctgaaatatattagttgattattgtcagtgaagttgaacgtatggtcctaaaatggctttaaatgattttatacattttctcttttattattatccatctgatactttgaaagaggcagcatacggcagttaattttctcctccagtccctcgtgcacaataataaaacaattcaaagcagtgcatatttcagctgccttttatagatgaattatacctcctgcagtctgtacatgaagacatagaacaggccatgaggcagattttagcataaatgttattttgcttgctaggaaggatttagagaatgtatttaaaataatgtgagctttaagtacaaatcaaatgctgaaatgcatctttaattcggaaatgtatagtaaatccaaacaaatgggtgaataacctctatcgtacatttttaatacaaagggacttgttagccatttcaaatgtcatttgagtgtttgaaaaagatgtgaattacaatcatagattctgaagattaaaagagccatttaagatcacctagtaaacccctttacttgttactagaagacccactacagcatcccctaattcagctgttactatctaaccaactttccaaaaatatagggcttaaaacatccagcacagttttgctcatgattctgtgggtcaccaatttgggccaagcttagctaggcagttcttctggattcacctgggctcactcatgtgactgcagtgatttggtggctctaccatcgagtaattgtctaatctgggctcattcatatgtcctgtggctagtactgactgttggctgcatcccttcccaagtggttctcattctcaaagaggttatttcaaacttcagatggtgggactgtgtttcaagagagggcaagtttcaatgtgcacatactttgtaagtctctacttgtcatgtttgttaatatctctttgcaaaacaaatcgcatgaccaagcctagcttcaagatggagaaacagattctatctcttgatgagagaagtggaaaagtcacaatgcatgcaaggatagggaaaatttgtggctattaagtaatctgtcacattctgttattgtggctatccatcttttgtttgaacatctctgatgaaaagaagtttagtgccttctaaattagcctattttatcagagttcaactctggcttctggtaacttgcattcattggtgacagtttttcatccaagcacacagctgtctacctggctagccagcaaacaagcacctactatgttaagcaccaaatagcatagaaaaacatagtgaataaaacagatgtgatccttgctgtcatgaaattcataatttactgtagggagacagacaataaataagaaaacaaacaaatacattttgaatatatatatattgaaattatatatatatgccttgaaggagtcaagggaaccatgaacacttataccaggaacatccaaactagtctggaggaggtaggtcagggaatgcttacttgaagaagtggcataaagattagacaggtgaagagtgaggaaaagaacatttcaggcagagtaaacagcatagacaaaagccttgaggtggaaagaactttatttgttccaagccagtatagctggagcaaagtgaacaaagtggaaggcattataaaatagtgttggagaaataggcagcaaaaagattgtgtaaggccttctggagttttgtcattttatttcttgaagtcatagagagcaaatccaaatccctctttgatgtgatagcagtataggatgtagctaagactgtaggctctggaatcagagcacctggataagtatccacactctaccacttactgtttgatctcggtcctgcttcttcataggtaaagtggggataataattgctacttcataggttgctatgtgagttatatagaataacatatgtaaatggattaacacggtcttagacacatagtaaatggcaaataaatggtagctattagcattatcaatcttttttacgtctcttcaccttattgtatcattcttttccaaatatattctaaacatatgggttttaactgagcgtcctcttttgatgatccagaatgattcaaatatgttgttaggaagatcatccataaattcaacttgagtttttcatgccgttatgtaaaataaactcaatgccttagatttggtcctttctgtgtatggtaaacacgcagttagtgtgctgtcttccaaatcccagtatgaagtatcatattatttatttcctgatgtgcacagatgaggtgtgtgtatgtgtatatgtgtttatcactaattgaatcatagtccccaagttaatagcaatgactggaatatttttatctgtcatatggcagttattctttcagcaacaaagattaattctttaaatgacccaatttgttatgaaatttgttatatgtcattattcttaaatcaacaagttgttaggaattatagaaaccttaaccttcatctaatttttccccctcatttccctgttgctgtgggcagagagatgtgctgcccagaaacctcttaaaggtagaacttgttggaccgtatatggaatgttgtgagcagacagcctcctgttgtcacctcccttcacggtttgtcttggctacagagaactgttgtacccatgggcttatccttcctatccaatgactaagtgtaatggtggtatagaggcccatccatctgagtccaatatgaaatgtgctgatgagccatatatactctagaactccatatgtggtttatctgcatggtagtttttctcaacttgttcactcctgctccctcccactacctttcataggtataaacatcctaaaaacccaggatgccaaatttcttcacagtatctactccacagaacctaacctgcaacatttcttaactcccgaagcccagaattactcagagacctgaacctagaatccgtctctaattctaaatcttaggctgcagtcattccggccaacttctttattaaatctttcttcataggttcagttttccatttcttcaattatttttattgcttttctagatgcttccctaaaatgtgggattctcttagtttccaaagtttgtgaaacttgccaggctttatactgagatatatttatatgttaggagtgattactgggtgtgggaatggcactgctttacaaagcaaaggctttttcactgcaccttctttccaggagataggacccgagaactctgaaattgccattaataaagagggagaggcaggtgaataggcagtagtcaggaagatgagcagataattccctggggtctgccttcctgagtgtcctccaccacaattagcttagccgttataaattccctcatgtcttatgttctgtattgtcacctggatcttcttcagtgtaatcttttctcagtgccacttattaaaaatgctgactttcaaagagctcaataaatttttttaaacatcccctgactcaataaaaagggatggaattgaacactaagtctatattccactgtctatctcccaagagtgttgagataaactatgaaataaatctttctgtcccatccaggtcatttcactagctttaatattatttacagccctatccatacaatccctgtcccttaccctgaagtcatcagtgtgttctctttctttttgttgcaaactcacagagtctttcaaactgaaaatagctgatgcctctagtactgataatgaaagaaatactcctctggttgcttgtaggtcgtttcccaaaatggaatgtaatttcaatgagcagaaaagagattttttaaatgcagatatggtcacagggcatactaaattgtcaaagattctaagagttagtatttaccatgggacaaaatgtctgggaggatataccacaaagagtggttgtctctataatgggattacagataatttttatttggcatcaccatattctatatattaaacatatcaattttgtgataaattttatactaaaagaagtaacatatgcattctagaaaaccctcatactacatttccatacatacataaatacatacatacatacatatgtgactaacatgattcagtatacttttcacattccgaaaccagagtgaagccagatgaaattaagtggcatgctgtccaggtttttacagtgaatagtggtagaacaggtctataataatttttctcctgatacccagcctaatgttctttctacaactctaaggtagttttaaagggcagcggagaaattgcctgaaggaagatttttactcaaaatttcaggatcccattatgtcttgaacatacttaccattaaaagtatcactgatgctaatggaatggaagagaatccatgcactttaccaaaaaaaaaaaaaacaacaacaacaaaaaaaacacattagtacccagtcttcacatacgcctcattcctttataatgaaggtaaatgaggcctttaactttaagaacctcagatgttccattcttgataagaacgattttattaaacttatgatgttatttttctttcacctgtggacatttcagtagaacaacttcccacccctagctgcctccatgtctctcaaagcagcagcctgaaaaaatctattcaggagctaatataaatttttattaaatgtacttaaaaatattgataaggcatataaagcagaatgttcagtgaatgttaaataagcaagaatttagtcctataaagtatataaagctgctgggctgcaaataaaaatgaccacaatgcagcaagaaagtgataaacattataagttatcttccccctaattatccaggttacatttcattaatatgcaatgaaaaatgttaactctcctgggctaaagcatagggaaatagtaaattagaagatttccctttggatgccaggagcggtggctcacgcctgtaatcccagcactttgggaggccgaggcgggcggatcacaaggtcaggagatcgagaccatcctggctaacacggtgaaaccccgtctctactaaaaatacaaaaaaattagctgggcgtggtggcgggcgcctgcagtcccagctactcgcgaggctgaggcaggagaatggcatgaacctgggaggcggagcttgtagtgagccgagatcgcgccactgcactccagcctgggcgacagagccagactccatttcaaaaaaaaaaaaaaaagatttccctttggagacaagattttgattccctatacttaactctcttgtaatatttatcattctgaatggcaaaaatcagcttatgtgtattttccttcattgtaccatgaaaagatgaaagatagtagattctagtttctctctaatttaatgcttaacaaactgcctggctcatagtaggcatttaataaatatatgttaagtcgtattcttaaacgtataacaagcatttcttggtaactaaccacacttgcattttccccaccaaaattataccttgtggcagagagagtctaattacacatcaaactctgttccctttttgcgttcgcaaatctagaatacacataactagaatgcactcttgagtctcccttaaacttaggtgtggccatatgactaatttttggccagtggaatgtgagtggaaatgatgtaagctacttccaggcatgacacataaaaacctcccacctaatcctgtcctctctgtcttcctccatctgctggctatatgctgaatcccagagtattcttggaacccatatgctgaaggtggcacagcctgggtctctgaataagtgcgaaatgcatttctattgtgttaagccgttgagatttcatgttttaacagctaccacagatacagttactttaacagatacgtgtctataatacttaatatcaacatattattgcacttgttcaataacaaaaaaaatttcaattacagttcacacaatttatttggaacatcatttaatttaaaagtcattttaagtttaaattgtgttaagtattctttatactctaataagttttattttccaatatcatattatcataatgctttgatatatgccaaattgttttctgaaaagttaacagtaagaaaaaaattgtaagaagaagttttaactagaatttcctagtagattttcctagactgtctgtggcagagcttagtgaataagtgatctttagctattgtgtgaaaaggaactctcactcaatctagagtctccttagagagggaataaaccatagtggggtggttgtaaagatagaaaaaatagataatcatagaaaaacatggcccaaaggattatgagtgactgcatgtttcaggagtttctttgtgattagttggcagcggctttgaagcagagagccatctatattaggccccagaaaccacctgaaggagggcatgttgggatctgcagtaagcaatcaagaggaaactcactaggacaactaacactgggaaaaggagaaagtagctaaaaggaattttaactctacaagtacaaatgactgacttagagtgggctgagctaatgcccagtgcttttttaaagttatgtattttcttcctggtatataaaagaaagtccaattaatcaaggtgattagtaatcactgtgtgtttaaatagcaaacgtagacaacatttgtctctaggtatatatatttattttaaaattaccttacatgatatctttacttaaattaagagttcagttaattaatatttatgctattatcttaataatttatttttataaaacaaaacgtttcatgtacagtatagagaaattcatttttttattgctctcttagtcttgaatacttgtagcagccccaaccagatggtttatattccataacccaaggtaccactgattacttgggggcaagatttggaaattttaggcttagtgcctaagggcaaataagcttatttttcctcaataggactgaccttacaaatctaactctgtaattgtacaggtcctttcccaattttgaaaagcattatcttcaacattgagccacccaaccaggacccctagcctaagataccacagtcattctgagtccagtcttaatagttgatacaacatgtctggtgttatgtcttacctctcctctttgtaacacattacttggagctgccccacactccagggcctattcatatttctgtaatctgtgccccactccatagggccctgccctacatcagatggcctatttctaaggaatcctgaaactcctccacaggacagtttgtactatataatgtgttctctcctcaagagtatttacattttaaccaaggattctagaaatacaatgcccctgcaggcaaggaaacttatttatccctctggctactataaaatttttctttttgctttttgcttataattttgattacaataatttttaatttatataattttgcttataattttgattataatatatcttggtgtggtattctttgtggttattctacatgggattcactgactctcaaatttgtgtttgatgcttttaatcaaatttggaaaactttaagccaatatgtcttcacataatttttcagtgttcccaccctccacatttttggagcttcaatgacatgtatattaagctgctggatattgttccacgggtcgctgataatctgtttaatttttttcagcttttttttcctcaatatctttcagttgtgatagtctgtattactcaatcttaaagttcattgttctcttcttctgccatattgaaatttatattgaccatccagtgaatttttaatcttttaaggtctagatatatttaatttttatatcttctatttatgtatctgttatgttcatattttcccttaaatccttgaacatagttataatagctgtttggaagttcttacatgataattctgtcatctctatcagatttctacatctgtttctattgactgattttttttcctaggtaagcatgacatttattactaagcatagacccttctacattctctactcattgccctgggcattcaaggaggcctctccactctggatgatcataactcaaacattttcaagccttgtgtaaagctttggggattgctcagtttacagctctctggtagttgtttttttttttttttttcttgccttgtagatttttaccctatgcaagtgcagtttaatattaagacaaagattaaggagtttcccaggcagatttatttctatttctctgagtaacttcgttttctccaccactctgctttgcatatctcaggtacctcagcctccccaaactttaatctctgtctcttcaagtcagcaaggcgaacatgctctatttgggttctcctgcactgctctgaagttcaaaaatgactccaggtggaaagctaaggtaactatcagggttgccttgcttatttcccttctttcagggatcaaagtcctgtgttgtctattgttcagtttgaaaaccattatttcatatctttcatccacttccctagttggttatggtgagagtccagtaccagttactctttcgtggctgtaagtggaagttctaagaagtccttctgaaaggtctcagtcattcctcagagttggcttccccctatgtcttaggataaaaatctagtttcttagcagtctcattttgatcaaagagaattccagacaataattgttccttgttagttgaaatccagataaactccaagtgtcttgcaatgtctttttgtacacaccaacccacatcattctatgaggttacctcagagctttagttttggagaaaagcttttgagattacagcttcaaatgagaggtatgttaggttgtcatcactgggcaactaaacatttgtgagttgtccttttgtctgaaagattattgggagtttcagacagagaacaagacctttttctccccttttaaagagcatgcctcagccctttgtgaacttgaaatgcaggtcttattttattcatctctcatttgcatgttgtgcctttagttgtcagtgatcagtaaaatcatttggacttcagaagcctttgaaaaagtgattaaacaggccaagattatgttagtcatttagtttatccttctttaatccagaggcattatttactgtccactctcaccctaatttaggattgtgccttacatgaaagagctaatgaaataaatgactatcactgtcaaattttgctgtgtcatagggggacagtacgagaagctttgtatacctcctattcccttggcctttctaaaattattttgtaaggcttttgatgcatacttgcaaagttttattttagtaattttattaaatgacttatttacccacaactacttggtagtaccaccatttaatgttattttcccacagggaaactgagatccaagaaataagacatttattcagagtcatccatcaaccacaaaatggaattagaacacaaaactccatcttttgagcctttaagccaaactgcttttttctcctgagattcttcatgaaaataacacagcctatactcaacaccatcataccatccccaacaccatcataccactgtcaataccatcataccatgtaagttgaatataaattactacattgccttagactcccttattacactggttaaatagtagtctctattgataaacactgtggcatacaaaaataattttaagtattaataataatctcaactgtggtttaaaattgaggacacatatgtgactggcttagtaatcagcattttctaggaaaggttctgtttttagttttaatttgctcaccacattttattaatgtttagtggaagatttaccctgttcttttatagatatcaaaaatatgtttgaaataatttagtcagtaactgaatattatagaaacaaatacaaaaaataaactaatataaggaaacatgagacagcaaaaatccttatttactagtaaatcattccttactttagaaaatctggaaaatacacaacatagtggtctgcttcatatggcttttctgctatattgctacaaagcatagggctataaatttccttttgatctctcatatggaaataagtttgtctattgtctggttgtttgaagtcgaaagtcttttcataacattttagaaaagcgaattatatcatactgtgcactatgggttagagaagattcagagagccatcctgcagatgttataactttggatccctctgttcacaatccccctctttctctgcatttctattagtggtgagatgtcatatttctcgaaagattagagaccattgccccaaagtctattaaatgaaataaagagagacacaggaataacacaatgtaatcctagccagtaactttttgtgtgtgtgtggagaatctaaaagaagtaatggtctttgacacaaatattacattctgccacaccctgaaagaaatacctcgaatctacatatttccaaataaaaacaaatgatagtagttttagagggaatgaaagcaagttcttgatacttatgtctccattaattcaaaaattatgtcttgtgagtaccatttaatttgggcaacaaattatactgttccttttcagtcttcatgcaattcactttccttgaaatagaaggggaccaatacaaaaaaatctcccttccttattccatcctggagcacaactccaaacattaacagtaattgcctctacttccatgtcattgaagcttatttaaattgtagctcgatgctgagtaagagggagagtcgccctccccaatccagagacaaaaaattctaattggcaattcatataattttgaatagttcatgacagtagaaaaaaaatgtgttatgttttcataggaaattgctgtgcattctagaaaactgttgacttgctaaaaatctgcactcctttattttgtcatttgtctcagaagttaagaatgaagcacgcataacaccttctttgggatgctttatattttatttaatacatatacttagtaaagggatttgctccttcaaaccggttaaaaaaaaaggcatttgctcattcaaactggtaattctgaatatttaagaactcatagcccaagtatacttgggtatattgaaagacagtatagtgtggtggtaaaatgtggattctggggtcaaactggctagattcaaggcacagttctttctatcacttgttggtcctgtgatcttaggcaagtaatgtgactttttgtgtctcaaaatcttttcgtgtctcaaaatcttttcgtgtaaaatggagataatagtagtacatatctttcagggttgttgtaacaagtaaacacattcaaagtccttagcatgagtggcacataagcgctactcagatgtaagcaatatactagaagtgccccacagcagaaggcacatatctcacaatcttcttttcctactatcttcattcccaaatgttgtttatgtgaagcaacttcttgattgtccagaagggaaggacttcctttagtccactctcatcttttagccccttttgttctttaaggcaaggaccaacttggttaaataattatttttctattctgaattctgtgaccatgtagacactcaataaatatttatctatctgaataaaaaggacaagctcaatttggtttcatgattttccagaaagtgacccaacttttgactcaaactttgtgtactttctaaaatctaaattaaaattttccttgcaaatcaagtaggaagtagttagcagtatctttcagaaattttctaatcatggtcttctatatactgaacacattttacatgtgtaatgagatttgtgtattagtgacatctgctactgcttaatcagctcctaagaataataacaaataatcacacaaaatagatttgggaagtttgtgttttaattaaatctgtttacctcaagttttgttacatttttcattcccttggcatagattccactctatgtcttggtacagttttaatccctgcccagagcagaaatttatctttaatttacattgcctcctctaagcctagggccattgactcagaaagtcttctaatttttattcgtaaaccaacttatttttatcatgttactgagacttttgggtttctagagttcagaaggaaactatttcccaggattatggccagttaattcagatggttggaacatattaatgaggccaatgctgcaggtgtgattctttatgtttttccactaggatagccacaaatgtatacttttgaccaaaagggagattcattgagagtttgtggatttttaatcagaaagccatctctattgctaaacaaacaaaaacatacaataaaataaacccactcatatacatatctgacaagttctgaatcaggagacttaacctttgttatacagtatgaatacctcagacttcctcaggctgtggttacaaataaggtcacattagctgtaaaaatgccaatatcactgtcttcttatttctactcatgttatttccactcacatatttcaagatcattttactctcttcccccaaagtgtcacccagttatataggggaatctctggaggtaccccacatgtgctcacaaacagtattcttatattcatctactttgggcctttgctgatgtcagtccacaagaagacacttgaaactatcacttggctgctgtcactgctgccatgccattttgggggactataatttcttgcttggggtaatcttttattgtactcttcaaagtaacataccttgtaaggagccaaaacaacacgatctttttaggtttcactgtgtcagtgccactctgggtaaaaatggggaggatgccattctgccccctatttatagcattttgtcacctgggcactgaagcagcattgcttgtgtcattgtctttctctattgctcttgtaaaaatagcttctttggcttctgccttcaactttgctctccatagggcttagatcccaatctttgagactgggtggagcaccagacaccgtcttgacctctccatctccctttattgcctcaggaacctttgaaaaaattagacaaaaacctctctcttccttcagccatcatgcaaactaactctaccaatgcaccatagccatcccaacttgcctgaactctagcagtggacataacaaggtgcaagctgagatctttactacacctttaaagaaggtaacctcctcaagggtctgtgtgaagactctgttgttctgagctaggccaacttagaagctcaaataagatatattctatggcaagatttcaagggaacagagagaatactaatgcctacttgtgggcgacatcttgcacccctctctttctttaactgttggctagatgcctggactttactcccaaagatatctcttttcatgtagggtttttatttatttatttatttttgtttagagggagtttcactcttgtcacccaggctgtagtgcagtggcgcaatcttggctcactggaacctctgccacccgggttcaagtgattctcctgactcagactcctgagtagctgggattacaggtgcctgccaccacgcccggctaactttttgtatttctagtagagatggggtttcgccatgttgggcaggctgttcccaaactcctacctcaggtgatccgcccacctcagcctcctcccaaagtgctggaattacaggcatgagtccctgtgcctgcctcatgtaggcttttataaaatttgtaattgacacataataattatacatatttatggagtacggtgacatattgtttatcaacaaatgaatggataaaaacttatatatatataatacatatatattttatatgtacattttatgtatatttaaaaatatgtttatattatatatacactggaatattttatatacatatatgtatatactggaatactattcaaccataaaaagaacaaattcctgtcgttcacagcaatgtgggtgaacatggaggatattacgttatgaaagttagtgcatcataatttgcttgagacaaagaatccatcattcctaaaccaagtcagttttagacattagaaagagattctattctttagaaaaatgtcagtagcagaatgtcttacccataaaatgacccacaacctggactcctagaacagttttggggtattgcagtactctgagagatgggacacacttataccataagttcactgagatgtggatgctaaccattaataaagatgttgccaaaaaattaatgctgacagctcaccttcagaagctagtaagtttccccttcaccttgggagctaggtctaaagtaaagaagcacttgaagaaatctttaaaaaaaaattattagcacctgtctgctgttgaactggcagaaatcttatttgatctatattttctttgaaagcccagacctagacttggtaagtgggtaagaacaggtattacctaagcagccatacatgctgagggccatgtaggctctaaataagtcacagctggtagttatcaaatctaaatgaacgtgagattcccaccagcacagaggaatcaatatttatcaacagaaaaagtgatattcattactgccatttgaaggtcatgcatataaagcatatatgagtaatgccaaacctcagagctgtttcctctcacaattaggtagatacagtgcctatgcttcattttgccactgcacaatagcctggcttattccctgagcaaatgtctaatccctccttgtctcttgacctttgctacaatatatttcttaaaaataatatggctatgcagaaaaaaagcagggaagctttgtggacagtgcagggttttgcatagaaaagggaaatagatttcacaaataccaagtggacaatacccagctaggtacaaagtcaacagaggatctcaggattagagtagaaaacaagctgactgtgaggagtagcacttcagtgttcctgtgatttacaagtagatatgggcaatgaagatacctggaggcacttggcttgaacccttcttgcttcccattcccattatacatagaattgttctgactgtcactgacccgtgttatatatgccttgatgttgattactaaaatggaacaggcaagatttgagagccagagttattgtattaaggtaataaaccacttaacaaatattttatgacctgaaaagaaaatttaaaggaagtaaaattgtaaaaaataaaaaatgcacagaaaatgctgttgcagagcatggtgactttagttaatataatacattacaatataatacattgttatgaaatacattattgtattatatatttcaaaatagctaaaagaatggacttcaaatgttctcaccacagggaaatgataagtatgtgaggtgatagatatattaactagtctgatttgatcattccaaaatgtatacacataccaaaacatcacattgtaccccatatatacaattatttgtgaattgaaaataaacacacacacacacacacacacacacacacacacacatacacacaccacataatatggaatgtcttagggaacttaattacaggtctcatagccagaatgctaggtaagcaggagtttaggcacatacttaagagaagtagtcaagtactgcagtcactcagagggcttgccagaaggcttagcttggctttcagaatgctctgcctagacagaggatcaatagacagtagggaggctcccatactcaagtaataacttccctcaatctgaaagatctgaagttctcctcccactggaatactttacacatagttaattcatccagtcaattaatatatatttagtgcctactttgtttcagattctattctgggtgttggggattatagaaaataaaagttcttgctttcatggaagtactgttctagtggtagaggaagcaagacaaaaataaccaagtacagataaatacacattttgtcagacagtagtaatcgttaagaataaaaatgaagcagggtaaggtaaaagacagtaagggtgatgactactgcttttaaatagggtagtcgtgggagatctctctgagaaggtaacatttgatttttaacaatacacatttattgagcgcctatcatgtgccagccatgtgaattaattcattttatcttcaccaaaatcctgtgaggtaggatcattattatgtttgttttacaaatggggaaattgggcacaagagaagttaacttgtccaaggaaacataactagtaagggaaagagctagagtttgaactcaactagtctagcatcaaatcccatccttgtagtcactataatacttggcatttttgattctgcttacaggcagggagatatgcacattttctctttagtcctgtgaggcactaacagacctatgcaaaaagaagcaatcattgaagcagagttatggaggtacctaacagaaagcccttagaaagggggatgaaatgactaatattcaagtactttctatatgtagctatgttacacatagagtctcatttaattctcccaacaaaaatatgaggtagtcagacagatagttattttgcagatgagaaaactgaggtaacaaagtggttacatgaattgcccaaagtctcatgggaacaaaggaccaatattatgaatttgagttagtctgtcaccaaagtttatgctctttctaatatgctgtgctgtctccagggagaagaaaaagaaagacaaggaaatccagagcaaaatacatggagaaaaaaatgaaaggagagacctcaaagtaaagacttaataggttcagagggccagaggactgatagtggcttaaatggcataaagaactttcaatggcaccttcatcctcaatctattctctgacactaatagtcttagtcgatttgggctgctataacagaaataatgtaaactgaatagctaataaacaacagaaatttctttcttatagttctagaggctgggaagtccaagatcaaggcaccaacagattgtttgggtaggggttgttctctgcttcatagatggtgcattctcacttcatcctcacagggcagaagaggcaaacaagttctctcaggcctattttataaggacactaatcccattcataagggctccatatcctaaaggctcctcctcttaatactattatattgaagattaggtttcaacatgtgaatttgagggggtacataaacatttagaccatagcaccaagttaggtggattcttgagaatttctgtgattttgtgatttcaggaattggcatgtgtagtttttcagtgagacctggtgtttacatgtgaatagcccttgagtagtgcatcatcttcttataactgctactgtctttgaatcagctactacagtaaagcaaggaacataaacttcgtaaagacatgaaagaaaatttatgaaccatttagtatttgaaggctagcatgtagttgtttgataacaaggatttttccccctcagaagcatagtttaaagctgtcagccttaatgaaataactttagatatgccttgcctgccaatttttccctttttaatagtatagtagtaacactgtgggattgtcaaaataatagtctgatgagaagtgttagcaaagaaagccaaatggcgcattgcttgtcttacactgtagcctctgtgtggtgtagaaaagccaggatgtggtcagatcactgtgggatgaggttgactcacccattcattattctggatgagcagaaaatatgcctctcaccccatgcctgctctgccttgccttgcctttccttttcattcccttcctttttcttcccacacatggtcaaaggctttgattttttctgaatattagacaacaaaacaaacaaagcagcaaagacacttacctgttctgtctttaacagagtgtttggtggctccctgcaaagggaagctaagagagacccagggtgggaggctagccagctccgtcatttgtattcttcaggtaactcgtttaaacctccatttttttcagctttaaaaatgctattacagtggctattgtttcattccaactttcaagaattcagtatacatctttgagaactaggtgtttggaaattcactaggtgttgggaaaattggtgttttaaaaggaaaatgtagtcttttttttagaatgctctctagaccatagaaatcattgaaattctcctttggctctatagagccaggagatagtcttataacccaatgtcttttgaaaactgaattacaactggaagttgaatagcaacaaaatattataaataaatttgattttaagggaggttttggcaagtacctaggctttgattacctagaaaccaataaattctattctaccatggattttctaatttttctataagcaactataaggtagatcacctctatgacatctaccaccagtggcccatttgtaaaatatgtgtagtgtcattttaacaataagccttcagagccactgtcttctaggaattctaattacaatttataaccaaagtacaaaataattgagttaactttcagtggactgacaggcaatggtcgcatagctgaatgctattttctccgtatcactttcccacaccgcacctccatctttagccctgtgtacctatgtagtcagtatggacaagcctactcttccatcaaagtctatacttggcaaataatagttaattgaagcacagattctgttgttttgtattgaattggtgccagattctctttccaagacaccactgaccacctgctgtcagcaaaggaaaggaaatggggcaaagaaataaggagaagaaaaggttgtagggtagtcaggagaaaaatgtgattgtggaacatgttccatgagttaagcaatctatggagagtaatttggctggtgaagatcttcagagtgtcatgtcagcttcagaatcagagagttgccgtcctaacttggcttatagtgattcacgaggggatggagggagggggagctagtatgggtgaaggccagatataaggaaaacaaaacaaagtgctttatttacagaaatctcctcagagaaataaaaccattgctaactccacaactggaacatgtgtattcttttcttattggcagcaacccaggaaaagagagagagagaaaaagagagagagaaaaaaagaaagagagagacagtgtgtgtgagagagagtcttacaagagttggtggaagaggactgaaggacttggtttctgagatatttaggagtgtaaatggcaggacttggtaactgatggcatgtgtagcatgaaggagaggaaggagtagaggctgatatccaggtttctgattttgactaatgggcgaatggtattgctggaaatgtatacaccctcccaagccatctgctctatttcttcaccttctttttcttcatcattggctgcccttcgtctcttactcaaataattactcgacaagaagtttgcagagaggtttgtgagatttagcacacaacacattaaggacgtctgaaaacccacacagcctgaggagctgtggcttggagagtgatcgagttgatgtcttcaagtataagaaagatattttgtaggagacttttaaacttttcatttatatctaggcagaagagtaaataagcacatgggataaaattttaataaagaacatttcagtggggcataggaaggcaattttaactgttctagggaaacagactagaatgcaaaactatacagaaactgaggaaatcttcaaggagagatatgacaatcctgagacctgaataatttagacaccaaccagaagggaggggccaggattagatgatacctctgagcatctgttctgcaaatgtccttttgttctgccccagatatccccagaggaactatggtctcattgatctggctgagcagatgcatttagggaaacggtacagcaggtcattgaacttatctaaccctgatggctctagaaatggagatagagatcagaaggaaaaaaattcttattttaattttgaatgtattttttatgtctttaaggccagttcctgttagaaaaagaaatgcatctaagagctagaacttagaacatacttgtttatccatccaagataaaagaagctaccaaagggagtgatacagacagatggcaaaacaatgaatcaaacagtttactaagcatgaatccagagaagtacactccctcaaggctaaggctgtagatttatggggaaagtagcttagatttgaggcccatggactgtgaaaggcatgaatgttctccatactctgacatacaagcagggaggtatttatatacaaacagtacacatatgttaattgctaaaccatagttctagcagagaatcagaataattttaatgaatgattagagatgagccagactattagtggagaattttgtcagatgagtataagaggaccagaggacttccagctacatgaaatagcattttaacaaaggcatagatctgtgattaatgagtcatccattttccctttcttctaaagagtccatttacatttaaattcttaattccattgcaatgtcattctgaattatctggtatcttcgaccataccattatttgtgggtggatctggaagactgatatataaaatcacatttgtcaatttgtcttggattttctggcctggaaaatttacggactttattaaatataatattattggtgccttagaaatttcacatgattttttgcaggaatttttgctaaatatgtctggcctgtggcatttatctagggatttgcagagagttttcttcaaaggaatataaagccctaaaaaggaaaaaaagcccagagagttgccttcatggagtcacttctcttttagtgctttcactcatttattagattttacaaagggtaccttctgccaccaggccccagagcatactaatataatttaaataggagagataattgaactgtcaaaactctatgtgtgtgcatgcaggtgtgtgtgtgtgtgtgtaagacagagatggagacagagtcaaagacgtgaaagacagaggcatacaaataacagccatcaacacagcagccacatcattttatgttagagctgactgctcagaaagaacagtcttgctcaaaaagatcttgagtggtgatactgctcttctttcttcaagcagtatcatcccctatcactacaacttggattttgtgatactctctgcttctcctagatgtaccacataacatggatttattttaaaaatcaggtatgtgaaatatatctctatctatctatctagagttatttcaaaaagaaaagaaaatcagaagacagttaacttccctttactttaacattcttatttagaaaattgtgacacttttagaggtaacggaaagcacccctggtgtagctgatgggaaatgaagggtgtcataaaacccagattaggctgtcctggcaatggggtatgacttatatgtatttgtaacaacactttatgcaatgtatccctgaagcttaacatgttgtaaagattggtggttacttggctccttcggagaaacaaggagagggaattttttgttctttccttgttaaactcttcatcccttttccaatacatctcattgtggaaaatatcaactgggtaagtttcaaatgaggccagttttaattgtggcaattcattgaattctcactttccattaccggattatgtggaatgctggctttaaaaaataagttagctgaatgtaagagtagttgcaacctttcttgaatgcacaaaataattgacatagcatctagagctcttgcagaacatagaccctgatttctggagtaccatcactcacaccagagatacactggcaccatttttattttttatgaaaggtcaaatatcacaccatctcaagaaagtaatgtgtatatacttttttataaatagtaatttattgctgaatggttgccattttacgaatgccgtcccaaatctccacaaattgaattattacatcctgccaacaaaagaaacagccatgcccatatttttagatttaaaagttcattataaagtatggataattaaaccattaccttttatttaattaatgatttatactttcccttaattattactttgattctcacaacaaaccattgtggaatattatgaggcccactgagtttgaatgctgtaggtcacatgtctaatggtaaaattaaaactgtaaccctggtctcatgacttgcagtcttacaccctgttgtagtcaataaggtattcacaactatttcagtttcccttgcagccatatgataggattatacttccctgcccctttaaagttagaggtagtcatatggcttgctttagccattgaaatgtgaacagaagtgactcctgtaatttcttgatgggagcatttaattgccagtgctcagctccagacttttgtttgtctttctgtagtgatatggaagcatatttcaaaatggatcctccctcaacttgggtctttgagtgattaccatagacagagcctccaaaccaatatcctacactgaacatgaaaactatacaagaagtaaacctttgttgttttaagccaatgaaattcacataatttttgttgttatggcataacctagcccattctgacttatagatacactctttctatgggaacaaccagtatattatcatttaagtatgtcttcctcatagcttcatatctgtaaaccttgttcctctggagtcagtaccatttttgcacagccacattagtaatactttgtgaccactctcagactgaagcagtttgaatttggtagctatcctgaaaggagtgtcagtggcctattctgtttcttttttaaattttatttcagtagtttttggagtacaggtagtttttggttacatggataagttctttagtggtgatttctgaaattttggtgtacccttcacctgagcagtgtacactgtacccaacttgtagtcttttatccctcgctcctctcccaccttcccctgagtccccaaagttcattataacattcttatgcctttgcatcctcatagcttagctctcacttataagtgagaacatacaatgtttgcttttccattcctgagttacttcctcagaataatggcctccatctccatccaaatggctgcaaaggccattattttgttccattttatggctaggtaatattccatgatgtatatccactcgttggttaataggcacttaggttggtccatatttttacatttgtgaattgtgctgctataaatacgtatgtgtatgtgactttttcatataatgacttcttttcctttgggtagatacccactagtgggacttctggattgaatggtagttctacttttatttatttaaggaatctccatactgttttccacagtggtttttctagtttacattcccaccagcagtataaagtgttcccttttcaccacatccacaccaacatctattttttgttatttttaaattatcagtggcctattctctttaagtgtagtagtgatagactaatcatagattcaaggcttgaagcaatgtcatgagaccaaccattctacctcccacttttaagcaggttagcactttctattccccctttatacatgtttgcatcagaaaggaagatatttgatatgaaagaggaagattgtgaattgaagtagaggagaagaacatggcagtgatcacaatgccatgcatttggagatggccttgccctattgagcttaagtgcacttcaggtatcatctatgaaagaggaaaagggaggagaatgtgtaggaattggggagggagaatacttatcttcagcaccactttagaaccaaaaattcactctgacaagatagaagtaaatgcaaaacccattctttttccttgattgatcttaccaaatcattcaaatccaaaaatacagaaaagcctatagaaccttagaatcataacctttatagatggaaggagctttagaaatcatgtggtttaattccctatcttatagatgaagaaactgagacccagtaagaagaagagaactggctcagtttatacataaccatctatatttcccagacatatacatatggatatctatttaataaaatcctaaaagtatttcatagccaagtttctaaattataagtctttttgatagcttgaaacataagctaggtcctttttatattgataaatgataatgatgattataaattattccaattagttatgacataggaggttgggctgtgataacaaagaaaactaaatacctagtgtcttaaacaagattgaaacatatatttcccctcatgttagtcaatatgtaagtagtccagagctgatacagtcaatccatgttgtgaaggatctaggctccttctcttcttgtggctccactgtcctctgttgccctcatccacatgagggtaataatctcatattatggttgataatctcatactgtggttgagatatgggtgataatggcttcatatgtgatcccttcttgataataatttatttttacttgacttattcttgaagaacattgccttagttcaaatggaatgttacctaaaataattaacacactaagcctatcagatctgtttctgtacatgagagcattgagagataagagcattgatgataaaacatgtctactaattggtaatttgatggtatggtaggggaggcctggaagaggcccacaagaactaatccaaagatacctactcaaaattatgtataggattaaaaccctgctttgcctctaattttctctcttctactaaagagaaaaaaaaagccttccttaatgatcagtgtctagatcagatttcaatgtcaggtttttgtaaattttacaactattaatagaaacgaagatgttccaaatatgtccattttcacttattcttcagagtaaagacactcagtctgtgtacctaattatataataggtaatagagatttagtgacatcaatttttccccgacatgtccaatatgtattaaattctgaatacccctccatgctctggaaccacaaacacccagaaacagatagaaaattatttacaagaaactttagcatcagggaaaagaaaaggtctgcaagagtgggtgaaactgtcaaatccaatgaagcaaagaattcctagaagattgtttattttctgagtgaaagtatagatttatggaatgcatacgaaagcctaaatcagttttgtggccaggaagatagttcatggatgaaaattaattactatttggttttagatccttctgaggatggtgatgacttttatatattatcttaagtacaggtataacttattttaagtaaactcaactttgaaaaattctaattgacacaagaaccaagattagtgcttagttctataaaaggattcaaagcagaattccttaacatagcatagtcttttagttcaagagtcagcaaatgatgacctaaggaaccagtatgatcagtctttgtttttgtaaataaagttttatttgaacacagttatgcacattcatctagtttatggattatttatggccatttttgcactacaatggcagtgttgtaacagttctgtttgtatgacctgcaaagtataaattatttactatttggccctttacaaaaaaagtgtgctgacctatactacagtgcatcaaaatgttattcatattacatcaatttatttagtttgcagtaattgaacatattttgatattgttgaagaaaagtttagatgtgaagaagtggtagagatgaacctagtggagtggagagaggtcatatcatgaagagatttgtacacttagctgagtttaaactttatcctgagagtagtgagaaaccatggaaggttggtttgtttgtctatttatttgtttgttttcgagacaaggtctcactcctgtcacccaggctggagtgcaatggtgtgatcacggctcactacagcctcaacttcctgggctcaagcaatcctcccaccgcagtctcatgagtagctgggaccacaggcatgcaccaacaaacccagctaatttttgtattttttgaagaagcagggtcttgccatgcttcctaggctggtttcaaattcctgggctcaagtgattcacctgcttcagcctcccaaagtgctgggattacaggtgtgaaccactgtacctgactggagggttttttaattcagtggacttacatgattccctctgatatcagtgtggcagatggattggacagagatcaattaggaaagtattgttatgcaggaaagaaattatgaatgtctgaatttagatggtaagaataaagaaagattgaagttgaaggaaactcatgcgaatgttaccaagaaagaagaagcaatgtgattttgtgaacgggtgaatggatgttggtagggaaggggaggagtgtgagatgactttcagatttctgacttaaaaaaccaaatgggtagtggtaccattctcagagagggggaatataggaaagggggaaaaattttagggaaataagattggttcagtttcatagctattgaatatgatatgcttgtgacacatccaagtagaaatattttttaggcaagtagaatacatatatctgaaacaaaattaagagttatgaggcaaggatatagacttgaaagttatcttatataactagcaatttaggctatgttttagaataaatcattcagaagaactctatagactaagaacaatagaaggcaaggatgagcacaggaggaacaccagtatttaaacaatagcagaggaagcccatgaagaagaatgggaagaccactaaggatattgaaaaggagttgcccttgagtaagttaaaaagaaaacaagttagaatcatcacgaaagctaagagaaaataaaattttaagagggaatgtcaaatgtctaagagagatcaagttataaagaaatatcatgacagattattcatcgggtttgtaaatactgagttcactcgtgaccttagtgaaagcagtgactggggaggatggcaaaggaaacagtaaatataagctaatctttcaagtaatatttctgtcaaagactggagaaggtactagttagaggaactcttaagggagtgtttcttgaggataggaaagaattgcttgtgtttattatgctaaggggagggaatctgcaggggagaggaagaagatataggaggagacccactgcagctccaggctatcaggccaagcaagctctgtatgggacagtcccatctttagtctctcaggtcactgtcagccaggctaatccaaaaagagctgacatttggactttagatgataatcacgtctgagaatatgattcacagctcaatgacactagctttcccagagctgtctttctttagtaggatcaactaagaggaacatgttttaattttcttttccatcaggcagaaatcactggaggtccagtgggaagctagatagcaagtggttttgtggagtgttgaatggtccttttgctgtctgtgacagcacttgaatacacaatcagctctatgttaatgctgtgtttagagaagtaagataatagtgttacgtagacttggtagaaacctgacctttttttttctctatagcagatggtatgattttgtgagattgcagcagtatacattgccagatatgtggtgggaaaaagcagcattctatacaacatgctaatgggtacaatttattaaaacattttctaactcttagagatattaagcaaatcacccattagtgaaaagttagaattaaagatatgtaagtaggtgaggaatcaatcaagcattactaaatcttctgaatatatatgccaaacttattttttgcaaaattatttatttgtgtcataagtcagtatattatttcatccaaaatattgtcatcacctgaaataaacctgcagttccaacagtaaaagctgtgagtctctcttcttacttttaattttttaatttccttttttaatttttatttttaatttcaggagtacaggtttgttatataggtaaacttgtgtcatgggggcttggtgtacagattattttgtcaccctggtattaagcctagtagtcattggttattttttcgatcctctccctcctcccaccctccaccttctaatgggttccattgtgtgttgttcacctctatgtgtccatgtgttctcatcatttagcttataagtgagaacatgcagtatttggttttctgtttctgtattaatttacttaggataatggcctccagctctgtccatgctcccacaaaagacatgatctcattctcctttatggctgcatagtattccatggtgtatatgtaccacattttctttgtccagtcagtcattgatgggcatttaggttaattccatgtctttgctattgtgaatagtgctgcagtgaacatacacatgcacgtgtctttatggtacagcaatttatattaccttgggtatatacccagtaatgggattgctaggtggaatggtagttctatttttagttatttgaggaattgctacattgttttccacaatgactgaactaatttacatttccaccagcagtgtataagtgtttccttttctccacaacctgctagtatctgctatttttgactttttaataatagccattctgatttgtgtgagatggtacctcgttgtggtttttgatttgcatttttcctaacgattagtgatattaagcttttttttcatgtttgttggccacatgtatgtcttctttagaaaagtatctgttcatgtcatttgcccactttttaatggggttgttttttgcttataaatttaagttccttatacatactggatattagacctctgtgagatccatagtttgcaaatattttatcttatattgaaggttgtcagtttactctgttgatagtttcttttgctgggcagaagctcttttagatcccattgtcagtttttgcttttgttgcaattgattttggcgccttcctcatgaaatctttgctcattcctatatctagaatggtattgtgtaggttgtcttctagggtttttattattttgggttttacatttaagtctttgatccatcttgagttgatttttgtgaatggtgtaaagaaggggtccagtttcaatcttctgcatatgcctagccagttatcccagcatcatttattgtatagggagtcctttacccattgcttatttttgttatctttgtcaatgatcagagggttgtaggtgtgcatgtgctgaacttctagtaagtcaataggtcagcagtatatagtgttctcatgctctacaagcacatccccatactggtcaccttgtgggtattcagaacgctttgcccagtcattttctttgaagaacttatattcttctagggagctaagacatagttatgtgaaagaacacttatgtgcaacacctacatgaccctactacctggtcagtgttagggctaataggaaaaactgcaggaatgctgcagaagtagcagatcatgtgaaaatattgcagaatatataagccaactatatgattagagaatacaactatcaaaaattcatttattcatcaaaattctatcaggtccctagtataggcagagcatttcatgtttccctcatgtaagtgtattttaggagttgaaaaatcaccataaagtttgcacttttttcttaaaagtgaaactaaagtcattggtatgacaagactgacatgaaaagttagttgcagggaaaaaaattactctattttatcattgatattcccaaatgtcaagtgttattgcaactagggagtaggactttttcccacaattaaaagcttatccacaagacatgcaagccaagtaaaaatcagacagctgacaataccaagagtccacctctaacattattcctgggagaagcggctgaatatttcagtagctgataatggatctgaaaactaaaaatttcaccatcttttaaaaatgggcctatatgatactaccggaaaattacttccagaaataattgccagtaaaagcattcctaaaatttaccttaatattgtcattgaatattgcttgttggagcaatttgtaaaaggattgaaccagataatttcttcccttataactctaaagtcacatctttgccctcgtgctaaatgataatggcactaacacagtatgttataagatttaccaaagactgtgtatgttctgccacctcatcaaggttatagttatatcaaagagaatctatctctttggctttctttttcctcccaattaatagaccctcaataatattgttgtgattaatttgattgatagcttagtttcttttttaaatattagacatattttccctcagccaaaattgacagcatattttccagactatactgatccatgagaaagcatgccctcaccctcctacaaccctcacccattaccctatattgaagaagtgtaaagtcctggaatataatagtttgtccccttacttaccacactttgccactcacctcaccaaatcccatctctttccctttctttggtagtacttacatggtcaaaaatgtggtttctattgctctgaagttatgtgagccttgaagagttcaagatgttcccatttgtaggaaaattttcactttctttttattattatactttaagttttagggtagatgtgtacaatgtgcaggttagttacatatgtatacatgtgccatgctggtgtgctacacccattaactcgtcatttagcattaggtatatctcctaatactatccctctcccctccccccaccccacaacagtccacagagtgtgatattccccttcctgtgtccatgtgttctcattgttcaattcccatctatgagtgagaacgtgcggtgtttggttttttgtccaatgcatactttataatcatttgtaacagcaaaaaggctgtaagttcttttgactagcttccatgcacatgcttatagatcaataaatatacagtattgtctcacattggggatagtttgtaaaacaaactgcagattttggaggagggggtcacttactgtgttcaaagttaagtgatatgtcaaacataagggttatataagacaaggatcatgactgctcagcttggtttgttattttaatatttaaattgacatttttctacaagtacctttaattatgctttaaatccctttaaatcactgtgactaatattttttctgaagaaatgcctcaatgggataggattatttactttttaaatttacctcctaaaactctgaataccaaagataaggagacagagaaaccaagaaaaccctgacgcaagtgtttttggagctcagtgtatggtaagatgcctttaaagctcttggccccttgaaagtgcaccactaataattacaaagggaacagactaaactctagtgccaatacttatcacacaagctcatactgttcctatcagtaggattaataagatacactgaaaatctattagtgatttccaaagtagatagactggacccctgccttaatgcttttctaaagccatgcgatcaataaatatttgttgaataaatgaataaaataatgagtctatgttgccctcaaggtccatgttgtgaagctatcttgtaattgagatccattttatgttgacagctttctttctcttcaggaattgaatcatattggatggaaactctagctactgaagtattcagccatctcccctgggaataatgttagaggtagacttggtattgctagattcctgacttttgtttggcttgcatgtcttgtgcatgagctttcctttgctggaaaaagttctactccctacttacatttacacttgacctttgggaatatcagtgctaaatagagtgatatttttccctgcaactaaatttttctgtctgtattgtcataccagtgactttagtttcactttcaagaaaaaaatatcaaccctatggtgattttgcaacctgtaaaattaaatttacatgaggaaaacaaaactttaaataaagatcatggttaaaagttttaaaagtgtcttaaattagaaaaatatataaaaccaagcatattttcttttatatgcaacatttttctttatatgcaatatataaacatatgcaacatattttctttatatgcaacattagcaagctgtgctctaccatgggttcagtaatctgtatttagtgatcactgatttatcaggctgagaataaataatactaaatttattgttgttattaataaacaataacaattctactactgcttttaccatttacactactactaacaaccactgagactttattatgagacagatactaagctaattgccttctattatcacatttattcttcacaagaaatctgtgcaataggtattcctactccatataatagataaagaactaaggcccaaagagtaacactaacttgctcaagatcacgtaagtatgaagatatgaagccagtactcaattctggctctatataataccacctattatccattagtccatattgccccagaacatcaacaagatgataaaatgcttcaaaacaaaatgttagactccctttctaagcccaagatacatgatttgggatggctgtggtatcccaacagacattggtagctaagaggccaagatagtccttgtagcccagttcttattcttttgtcttaccatgcacaccaatgaacaggacccgtattgctgtctctctgaaacactgtagcacaaattgctttcacaacttctttattgcgagtaaattgttcaggtaaaaccatctttacactccacactcagtagatgtgttggtagataaatctgtgatattgttaaggctattcagtggagcattgataacaaatcatcttgtgtgctttcctgccccaaatcgcacatttgcatccagtgaaatcaggctcaaagaaatggaaaagagattttaaatgggcagcctccgttatatataaagaaatagacttggagaaatatattcctaggccgtgtttatgccttggtgctagtgggaggaggaaggctgaaaactgatgttaagtgaaccccccgtgttttttttttttttttttgcatactttggtgaaggccacttcctttgtgtccaccagctgaatgactgtacagctgccaacaacatgtatcccccatttaccttaaccagggacccagggcagtcaccttgactcacttatcaaccctagggacagctggggattttgctaatgcaggatcatttacaacaataacagaatagcccgaattctaagagccagcagcagatttcacattagtacctaatggctctgcaggacaggacaaacaaacaaatctgtcaaaccaaagaattatcaaaccaagaccttgaggctcctccaggaaaggatgctcagagagtacagcagagaaagaatccctaggaggcattggcagctcttttaatttgattgctttagaatgaattctgcttggcctcactgggccaattttataaaacttaaaacactgtacggaaattttaaaaaataaatttagaaaatctcttaatttcccatgctgagtaggagggagaacagtaacataatttaaaggggcttaggcataattctaagtaatttacatttggcttggaaacacattctgtaatattttttttcttctgtggactcaccttagtttttgttcagactaatatctgaagtagttggaagtccctggatacacaccaactggcatagtgaagagaacctagaagcacgggcttaacccagaatctaggatgtaccatctgctgtagataaactataaaggggattaacttcacacagttattctgggcttgactgtattgctacactcatgcaatttctctttccacagcctaaatatcacactaaaaattaggttcatttctgcactttaaaaatgatattgatagttatgtatatgctaattataaaaatcacaagtgttctttatagaaaatttagaaggtatatcaataatgaagaagaaattaaaaattacctatgcttctagaatttaaagacaggagatgttaatatttcattatatttttggacagttttcatatgtaattataaatacagatcataaacgagatttaactgtatatttaatcttttattcctatttcatttaatagtttattatgaacattttccatgtagttaaacatccttcacaagcaaactggataatgtgtgttctttaaccacttgaatataccataatttatttaatctttccacttttcttggacatttaggctgtgtctaatttttcaataacataatgattattattgtaaataaatttcaaactacatctctgctatttccttgaagtagggtctaaaatatgaatattatgataataatgagagtatatttgttaagcctcttgatgacattgttatactgctttccagaaagtctgtataatcttacaaccatccaagcagtatataaaattgtttatctcaccatataatccaagatctagaacatacatgtatgtgaatattttaaattgaaaataggattccaattattatcattttatttatttgatttgggttaagatttagtttgataggatgatactggtgttttttcttgagttatctactcagttactttgccagcttttgatttggggtgttaatttttgcattattaatttatactatttctgtatatgtcaaggatataatcccttcatctgccatatttgttgcaaattttacgccagcttctttgaggaataatttacacacaataaaattcacgtatttaagtataaacttagataagttctgataatggtcagttgtgtaaccatcactaaaatcaatattgtcttgatgtaaatatcacactgtcttgaatgctgtaactttatagtgtatcttaaaatataatattttatgtcttccaatttatttcaaaattttgttttgctcttctaagtcttttgtatttcctacaaattctagaatcagcttgtcaatttctacaattaaaaaacctacttgaaatttggctggaattgcattgaatctatagatccatttggggagaattgacctgttaacagtaactcttccactccaagaacaagatatatttctccatttatttgaataatctttaattgctctcatgttttatagttttcagtatataaaataacatgttttattaaatatatttctaattattttatatttttatgctactgaaaatatcatttcttaggggagaagccttcagctttttactgtcaagtataaggttagctgtagattttttatatatgccatttatcaggttgaggaagtttcccagtttgctgagaggtgtttttttttttaaatcattagggtattaaattgtattaaatgactttatgtatatattgattttttaatatattttggtctgttcttatagtgaatttcttattgattttcacagtgttgtaataacactgcatggcataaatcccacgtggtcatgagatatcattttaatacacttttaattcattttgttaaattctgtgtgtatgatcataagcaatattgatatgtactttttatttcttgaaatatctccttctggatttgaaattcagtgatacggacttcataagttgggaagttctcatttctcttctatttttggaagaatttgaacataattggtattatttttccttaaattttagggaaattaaccaatggagccatattaggtatgaaggtttctttgtgggaaggttttaactaagaattcaattttttttgtttttttttttttgagacggagtgtcgctctgtcgcccaggctgtagtgcagtggtgtgatctcggctctctgcaacctccgtctcccaggttcaagcgattctcctgcctcagcctcccgagtagctgggactactggcgcgtgacatcactcccggctaattttttgcatttttagtagagacggggtttcaccgtgttagccaggatggtctcgatctcctcacctcgtgatccccctgcctcggcctcccaaagtgctaagattacaggcgtgagctacggcgcccggccaagaattcaattttttaaattgatgcaaggatactcaggttatctggtttttctgcataagccttgttagtttgcatctttcagagaatttgactattttatctaagttgttatttattagcataaagttgtttataacatcccatccttttagtgcctgttgactatgtagtgatatctcctctttcttgtttcatataaatcatgtttcttcttctttttccttttcagtatgtctagagttttatgaattacatttatcttttcaaaaatttgttttactaatttattttcttgatttctgtttcatttatttctgctctttattctctcattctttgttcttacttggggtttactttatttttcttttactagtttctcaagatggaagcttaaatcattgatttgagaactctgcataatataatcgtttaatatgtaaatttcactctaagtactgcttttgctgtatcatacaaaccttgacatgtttttcattttaattcaggtcaggtgaagatactctctaatttgtcttatgatttctcctttgccccatagattatttagaagtatgttgttacagttctaaatatggtccttttggtgactattccatctgcacttgaaaagaaggtgctgctgttgtgtggagaaattttaaaatatcagctggatgaagttagttgaatacgttgttcaagtcttctattttttttctgattttttgtctacttgttctattaattatctgagagaagagtgtgaaatctccatctgaaatggtggatttgtctatctctcttttccattctgttagtttttactttctgttttgtagctctattatttagtgaatgaaggttagacttgttatgttcccttaatgaaatgattatattatcatcatgaaatgccctcctttatcgctgataatattccttgctctgaaatctattttgtgtgatactaatattatcattgcagctttttcaaaatttgtgttttatggtatgtctcgtttcatccttttatttttaagctttatttctttatgtgtaacatgtttcctgaggacagtacatagttgtttctgtttttttttttcttgtctcacttgatatgttgtcgtttctgctttgtatagtcaattgtcttcaaaagcattaaataggaggaaagaaaacctggaatttatgcaaatatttaccattttgctgactataaaattctaggttgacagcctttttatcagcagctaaaatatgctctaccatattgtgtcttgcataatttctgaatattatgtcttttttatcttcttttgagagtcttgatcactggtgttcagcaatatgattaaaggttttgagaaatgtggaaatcttcaatcatcattttttttcaatgttttttgttctctcattctttcctcttctggagctccaattaaatgaaatgtatatagcattttttatatcatcacaccaacacatttacctttttcagtctttcgtccttctgtatgattccttttagatcactatttttttttcctttggagtgtttaatctactggtaaactcatcctaaataatacaatttcatttcagatattgtatttttaattcctggagattctgcttgtatctttttacatatctcctgtctttcctcatgttcatgttttatgattttaaatatattgaatatttttataataacagctttactgtccttgtgtgttaattctataatttggattttaatatgtttctattgattgatttttcttgtggttatgctcattttttttacttcttttgatgttgttgattgtgaattttatgttcctaggtactagagtttgttgtttcttttgcatgttgtcagactcagttgagggatgcagtttttttattactttttttttttaatttaagttctggactacatgtgcaggatgtgcaggtttgttacataggtaaacgtgtgccatggtggtttgctgcacctgtcaacccatcacctaagtattaagcccagcatgtgttagctcttttcctaatgctctcccccacctgctgtcccacaacagcccccagtatgtgttgttcccctccctgtgtccatgtgttctcattgttcaactcccacttataagtgagaaatgtggtgtttggcgttccattctggcattagtttgctgaggttaatagcttccagcttcatccatgtccctgcaaaagacatgatctcattccctttttatggctgcatagtattccatggtgtatatgttaccacattttctttacccagtctatcatttatgggcattttggttgattttatgtctttgctattgtgaatagtgctgcaatgaacatatgcatgtgtgtatctttataatagtatgatttatattcctttgggtatacacccagtaatgggattgctgggtagaaaatctttgcaataccattaaggacataagcattgagcaaagattttataatgaaatcgccaaaagcaattgcaacaaaaataaaaattaataaatgggatctaattaaactaaagagcttctgcacagcaaaagaaactaccatcaaagtgaacaaacaacatacagaatgggagaaaatttttgcattctacccatatgacaaaggtctaatatccagaatatacaagaaacttaagcaaatttataagaaaaaagcaaaccaccccattaaaaagtgggcaaaggacatgaacagacatttcccaaaagaagacatttatgtggccaacaaacagaaaaaaaagctcagcatcactgatcattagagaaatgcaaatataaaccacagtgagataccatctcacaccagtcagaatggcaatttttaaaaagtcaagaagcaataaatgctggggaggttacagagaaataggaacacttttacactgttggtgagaatgtaaattagcttaaccattgttgaagacagtatggggattcctcaaagatttagaagtagagggatgcagttttaacttggagtcagtacccttcttttcaggattaatcttgaaattttggtttatgcccagagaagcttttgcctaggtttaatctgtacctgtgattaaggcaataccctcctgagaactctatctgatgatacataggtgagcaggaatttccattctggctcataggaacacacactatatccagcctagtgtatgctgcaaagacttttctgcctgctccattttggtggttggttctttttttgcttcatatagtttccttccatgcatgcatagaccagtgcttggccaaaaacttgagaggaaccgcctacaaacttctagaattctgtgcatgtgcacatgtctttgtgtgtgcagctctctcttctctggtatttaaataaaaaattatatatgccttggcctcctcaaattctgaattctggttcctcaatttagagaaagtactgatctctcttggggttccctttccttgtttctcaacctggatgctctcctcaggcaggaagctggacaattataaggctcatctaatttcacttattttcccagagatcattaccctgttctgtctcttgtaaaatatatgaaaactctcagggcatatattttctatagtcctccctgtatttaaggcaggaagttaaatctggccctattactttatcatggacaatagtagtagtcctgtattccttcttgaatcaaaattaatatatacttttctataaatttttccatttcttctaatttattgataagctaattaataattttatctttatcttttaattctgcttttctatagttaggtctacttttctatttataagaaatatatatgtgactttttgttttccttgactattctttccaaagttctgtattgtttgttagactgttcaatgaaacaaatttgctttctttgagccttttatttgttttttctgtttacttgacttttctgttattgttactattttctaatattatttttactttcttcaatttttaatagtttactatcttctgctttctcttagtttattctgttgtttcttttctactttattagttgaactttaatgttcttcctttattatttttgtaatacaagcacttacactataaatttagattgaaatagagcttttactgaaccccacaaattttggtatgtgatgttgtcattatcacccaatttttagtatttttacaattccattataatttctaacttgatcctgaaaatatgttttttaaaaatttccaggccagacgtggaggctcacacctgtaatcccagcactttgggaggctgaggtgtgaggatggcttgagtctaggagtttgagaccagcctaggcaacagaatgagactctatctctacaaaaattttaaaaaatacctgggcacagtggcgcatgcctgtagtctcagctgctcaggaggctaaggcaagaggattgcttgagctcaggaggttgaagctgcattgggccgtccttacaccactgcactccagcctgagcaacagagtgagactgtctcaaaatattaattaattacaattttaaaaaagaaaaattccatatatatggatgatgttatacttatttattttatatcttatttattattctaattaatttatttcttcattattattttaatgttctgcatcttgattgtatcaatgttaatatccttgttgtagtattgtactatagtttctgcaagatgttaccatgggaggaaactgtgtagaaagtatacaagatcaccgtgtattattccttgcaattgcatgtgaatctatatctcaaaattaaaactgtgataaaaaactttaaaagttgattcttagataaagacaaaatatattttaatttttaattttaatttttgaacttttatttgaggttcagggatggatgtgcaggtttgttatccaggcaaattgcacatcaccggggtttggtgtactgattattttatcacccagctaatgagaatagtatctgatatgctgttctttcattttcatcctcctccccaacctgcaccctaaaaaatgcccagtttctattgttccctttttgtgtccatgtgtagtcaatgtttacctcttatatgtaagtgagaacatgcagtattttgttttctgttcctgtgttaattcatttaggatgatggcatctagctccatccatgttgctgcaaatgacatgatctcattttttcttatggctgcataatattccatggtatatatgtaccacattttttaaatccagtctactattgatgagcatttaggttgattccatgtctttgctattgtgaatagtgttgcaatgaacatgcgtacatgtgtctttatagtagaacaatttatatacctttgggtattaatacccaataataggattgctgtgtcaaattgtagttctgttttaagttctttgagatatcacaaaactgctttccacagagattgaatttacattcccaccagcagtgcataagtgttcttttttctccacaaccttgccaacatctgttaatttttgactttttgataatagccattccaagtggagtgagatgatatctcattgtggttttgatttgcatttctctaattattagtgatgttgagcattttttcatatatttgttggccatatgtatgttttcttttgaaaagtatctgttcatgtcctttgctcactttttaatggggtaattttttttcttgtaaatttgtttaagttccttatagatgttagatattagacctttgtcagtttcttagttggcaaaaattttctcctatcctgtaggttgtctgtttattctattgatggtttcttttgctgtgcagaagctccttagtttaattaggcaccacttgtcaatttttgtttttgttgcaattgcttttgtcatgaaattgttgccagggcctacattcagaatggtattttttaggttttatcctagggtttttcgtagttttgggttttatatttaagtctttaatccatttttagttgaaattttttatatggtgaaaagaaggggtccagtttcaatcttttctatatggctagctaagttatcccagcagcattttttgaatagggagtttttccctattgcctgttgttgtgaactttgtcaaagatcagagagttgtaggtatgcagctttatttctgggacctctattctgttcctttggtctatatgtctgtttttgcacctgtaccatgctctgttggttattgtagccttggagtatagtttgaagatgggtaatattatgccttcagctttgctctgtttgcttaggattgctttagctatttaagctctttttggtttcatgaattttagaatactttttttctgattttgtaaaaagtgttcttggtagtttgataagaatagcagtgaatctataaattgctttgagcaatatggccactttaacaatattgattattcctatccatgagcgtgggatgtttttccatttgtctgtgtcatgtatgatttctttgagcagtgttttataattctcattgtagatatattttgactctctagttagctgtattactaggtattttattcttttgtggctattgtgaatgggattgtgttttgattttgatctcaccttggatgtttttggtttacagaaatgccactgattttgtacattgatttagtatcctgaaactttgttgttgttgtttttttatgaaatctaggatattttgggcagagaccatgtggttttctaagtataaaatcatattatctgcaaacagagatagtttgatttcctcttttcctatttggatgcatttttttttgtctgattgctctaaataggatttccagtactatattgaatatgagtgcttagagagggcatccttgtcttgttccagttctcaaggggaatgattctagcttttgcccattcaatatgatgttggctatgaatttgtcatagattacatttattatttggaggtttattcattcaatgcctagtttttaagatgaagcaatattcattttttcaaaagctttttctgcatctattgagatgaccatgtggttttttattttagttatttttatgtgatgaatcacctttattgattgtgcaggctgacccaatcttgcatcccaggtataaagcctacttgattgtggtggattagatttttcatgtgctatactggattcagtttccttgttgaaaatgtttgcatctgtttttctcaaggaaacagattggcctgaatttgtgtgtgtgtgtgtgtgtgtgtgtgtgtgtgtgtttgtgtgtgtttgtgtgtgtgtgtgtgtgtgtgtgtgtatctctgctagattttggtgtcagaatgagattggcctcatagaatgagttaggaggagtccctgatcttgaattttttggagtagtttctgtaggaattgtactaggtcttctttacacatctggtagaatttggctgtgaattcctctggtccaggactttctctggttgttaggctttttattactgattcaattttgaaacttgttactgatcttttcagggtttcaatttcttcctggttcaatcttgagagacttcaagtttccaggaatttatccatttcctgtagattttccactttatgtgcatagaggtgtttgtgatagtctccaaggttttttttttttaatttctgtagggttggtggtaatgtttcctttgtcatttctgattatgtttatttggatgttctctctttttttcttcattagtctagctcgggatctatcaatcttatttacttttttgaagagcctacttctggtgtcttcgattttttgtgtggctattgacctcttaatgtcattaagttcaggtctcattatggttgttttttatcttctgctagctgtggggttggtttcctcttgtttctctatttcctgctggtgtgatactggtcgttagcttaagatctttctaacttttttatgtgggtgtttagtgctataaactttcctcttaacgctgctttagctgtgtcccagagattctggtatgttgtaaatttattttcattagtttcaaataatttcttgatttctgccttaatttcattgttaactcaaaagtcattcaggagaaggttgtttaattttcatgtaaattgtatgattttgagcaatcttctttgtactgatttctatttttactgcactgtggtctgagattgtaggtggtatgatatcattttttaaaatttgctgagaattttttatggccatttgtgtggttgattttagagtgtgtgccatgtgcagatgagaagagtgaatattttgttgttttgggtggagagttctgtagatgtctgttatgtctctttagtcaagggtcgagttcaggtaccaaatatctttgttagttttctgccttgatgatctatataatactgtcagtggggtgttgaagtctcccactgttattgtgtggttatttaagtctcttaattggtctctaagaacttcttttatcagtctgggtgctcctgtgttggatggaaacaaatttaggatctttatgtcttcttgttgaattgaatcctttaccattatgtaatgcctttctttaatttttttgatcatttttggtttaaggtctgttttgtgtgaagttacaatagcaaccgtcaattttttgttgttgttgttttgttgtccatttactttgtagatttctctccatccttttactttgagtctatgggtgtcattgcctgtgagatacatgtcttgaagatagcataagctaggtcttgcttttttatccaacttgccactctgtgccttttgttgtggggcatttatctcattcttgttcaaggttaatattgatatgtgtggttttggtcctgtcatcatgttgttagctggttattatgcagacttgattgtgtagttgcttaatactgtgtcgatggtttatgtacttaaaagtgtttttatggtggctggtaatgatctatcctttccatatctagcactcccttaaagatctcttgtaaggcaggtctggtggtaacaaatttccttaccatttgcttgcctgaaaaggatcttatttcttcttcacttatgaagtttagtttggctggatgtggaattcttgtttggcatgtcttttctttaagaatgttgaatatagaacctcaatctcttctggctaatagggtttgtgctgaaagttctactgttagcctgatggggttccctttgtaagtgaattgccccatctctctagctgcctttaacatttttctttcatgttgaccttggagaatctgatgactatttgtcctggggatggtcctcttgtatagtatctcacaaggattctctgcatttcttgaatttaaatcttggcctctctaatgaggttggggaaattttattggatgatttcctcaaatatattttctaggttacttgctttgtctccttctctttcagggatgccaacaattcgtagatttggcctctttatataatctgatgtttattggaagtcttgttcgttctttttttgttcttttctctttatttttttctgaccgagttgattcgaagaaccagtctttgagctctgagattctttcctcatcttggtctcttctgctgttaatatttgtgactgtattatgaaattattgtagtgagtttttctatcaaatcagtttggttcttttttaaaatggctattttgtctttccactagtatcattttattggattcattccttagattgcttgaattggattttgactttctccagaattttgataattttcattcctatccagatcctgaattccatgtctgtctttccagccatttcagcctggttatgaagcattgctgaggaagttgggaacaaagaagacattctggctttctgagttgccagagttcttataatggttctgtctcatctgcctgggctgatattcctttaatctttgaagttgctgtcctttggatggatttttttttcgcttttatattctttgataccattgtgggtttgatataaggtgggttcatttgactggcttcatttctggaaaatttcaggggtccaaggctcaactcatcactcctgggctatggggtctatctttggggttctggtattgggtccccagctttgttctctggccccttatggttaggaacctgctgcactggcaggactgaggtgttcccagtctcctggcaacaatcctctgatgaggggtctagccaaagtactttcttggggcagtggctgtgcttgtgtgcacatacaagcagcagcctgttatatttgtatttattttatttgtattactaacatctaccttaattgtactatggacagagaatattgtcagtacgatacctactctttaaaatttgttacatcttgctttatggtctggcatatgatcaatattttaatataatctgtgcctgagaaaaatttaggttttttgattgcacagtgagatttttactattgatagttctaaagagagcataaaatatatttacctctttgttgtttccccattttctatgctcagaacatttgctttttatcataatttgataatattcacctttatcttttctagatttctgtgatttcctaccttcatttagcatttccaagccatctggaatttattttgttataaagcataggtttggtttagaatctaactttttgatttatgtatatctaaatggcataactccataaccattagcagaataattggcatgactgtgtcttagtattttatcatgtaacctataaaataatccagttgttaaatatgttttggtaggtttctgggttatctgtctcagctattgatacttctcatactaataccacactcttctctttgttttaccttaatagttaattttagcatctggtaggacaagtattattattcttatttttttaatggtgtgaactattccttgtagtttattcctataaatgaaatatagaatgattttcaagttaaaaaaatttatgcttaactattcataatagcaaagacatggaatcagggtaggtgtccattgacagtgaattggataaaggaaatccatgaaatcatgttctttgcagcaacatggatgcagctgaaggccattatcctaagtgaattaacactggagcagaaaatcaggtatcacacattttcacttataaatgggaactaagcattgggtacacatggatgtaaaaatgggaacagtagacacagcagaatacaagaggggagagagaaggtggggagtatgggctgaaacactacctaaagggtactatgctcactacctgcgtgacaggatcatttacaccccaaaccttagcatcacacaatatacccatgtaacacactcattctgagattgataattaattgggtaaaattaggtgaataattcttcttcatatcatgttacttctttaccattttaacaccattttaacaatagcacagagtttttgattaccttgtagaagaaaggacttttttgatcactgaaaacttcaaattatatcccagattttatcttcctttccatttcccctacaactattttaatttcccgttatcttcaaagttttgtaggatgtatttagttgaaacactaatgtagacggaagtttattaataaaaaatatttcttccaccaaacaagtttgtaagagtctgggttaaacaatattaaataagaattttaccactggaatttctctgaaactttaatatactaatgatcatattattgaggctgcccaatataggaataaagtcagcagcccttcccaaatttttgccctgacaaccagggttttccatggccttaacataatgtcatagagttgctttgaaaaataagtgagttaaaacccataaaatattttattgaggatttttacgtctattttcatcggaggtattggcctgtagtgttttttgttgttgttgtttgtttgtttgtttgtttgtttttcttgcagtgtctttttctagctttgctaagagggtgatgctgtccttataaaatgagtttggaagtgttccctctagttgtatcttctcaaagagtttagggagaattggtattaattctttgaatgcttgataaaattcagccataaagccatcttagtcctgggattttctttgttgggatatttttaattactacttcaatctccttatatattattggtctgttaaggatttctatttcttcttgatgcaattttggtaggttgtatgtttctaggaatttatccatttcctctagctcactcaatttgtttatgatagtctttccgatcctttttcttttcatacgcaaccattttaatatctccactttcatctctttatttatttgagtcttctcttttttagttagtctagctaagggcctgttgattttatattttaaaaaactcggttttcttgatttgtttgtattgtttttgtatttttcgttggtttatttcttctctgatttttaatattgccttccttctgctaactttgggtgtagttggttcttttacttttgctattctttttctagttccttgaggggtaatatttgtttttttatttgaaatatttgtttttttaatgtaggtatgcatcactataaaatgctttcttaaaactgggtctgctgtatcccaaacatgttggtacgttatttttttttgtcttgtctcaagatttttgtttgtctcaagatattttttaatttcccttttgatttcttttttgaccattggttgttcagaagcattttgtttaatttacatgtaattgtgaattttccagttttcctcttgttattgatttctagtttcataccacagtggtcagaaaagatacttgatactatttcaatcttcttaaattagttaagacatgttttgtggcctaaaatgtgatctgttctggagaatgctccacatgtgcttgagaagaatgttcattctactgctgctggatggaatgttatgtatatgcctgttaggttcatttggcataactacataactaatgtagctcaagttgaatgttcaagtccagagaatggatattctgtctggatgatccacccattgttgaagggaggtattaatgaactggacccttatcttacaccatacacaaaaataaactcaaaatgcattaaagacctaaaagtaagtcctgagattataaaattcctggaagaaaacataagagaaaagccctttgacattgatcttggcaatgattttttggataggacaccaaaagcacaggcaataaaagcaaaagtaagcaagtggaactacatcaaactaaaaagcttctgcacaaaaaagggacaaatcaacaaaatgcaaaagtagcctatggattaagagcacagatttgtgaattatatatctgataagaggttgatatcaaaaatatattagtaactaacacaatggcaaaaacacaaataatcagaataaaaatgggcagtgtacctgaatagacatttctacaaagaagacataaaaatgggcagtgtacctgaatagacatttctacaaagaagacataaaaatggcaaacacatatgtgaagaaaatgctcaaaatcacgaatcatcaggaaatgcaaatcaaaatcacaatgaagtatcacctcacacctgttaggatggagttttagtcctttctcgcattgctgtaaagaaatacctgagactaggtaattataaagagaaaagatttaattggctcacagttcttcagactgtacaggaagaatgatggtagcatctgcttggctgcttggggaagcctcaggaaacttacaatcatggcaaaaggtaaagggggagtaggcatgtcacatagtgaaagcaagagccagagagcgaggaggggggaggtgctacacacttttaagtgaccagatctcatgagaacttacttttttaaatgaccagacgtcatgaggatagtaccaagagggatgatgctaaaccatatatgagaaatccacccctatgattcaatcacctcccaccagaccccacctccaacactggggattacagttgaagatgtgatttgggtgaggacacagatccaaaccatatcagatggctaatgccaaaaaggcaagacatcaagtgttggtgagggtgtggagaaaaggaatccttcatacactgttgcagaaatgtaaattggtatagcaatcagggaacagtatggacattttttttcaaaaaaattaaaaatagaactaccatatgacccaacaattcctcttctgggtatacacctgaggaaatgaaatcagcacctcataaacatacatgtacccccatgttcattgaaacattatttacaatagccaagatataaaaacaaactaaatgtccattggcaaatggctgaataaagataaatatatagatatggagatcataatagcatttaactttaaaaagaagaagaacaaaatcctgccatttacaagctagatgcagctagaggacattatattaagcaaaataagccacagaaagaaaaatgctgcatgataaatcttataagtgaaaacacacacacacaaaaaaagtcaaacacatagaaacagaagagggcagtggtcactagatggaagtggggaaatgggaagatgtaggtcaaaggttgcaaaatagcagctagtaggatgaataaatctagagatctaaagtacagcatgaggactataattaataatatattgtatactggaaactttctaaggggtagattttaggtgctcttattgaaaaaaggaaactatgtgaggtgatggatatgctaaattgttaacctgtaccaagcatttcactgtgtatatatctatgaaaacatcattttatacaccttaactttacatggtaaaataatagtaacaaaactataaaacacttatagcagtgcctggaacatagtgaatagtcagtgcatatgagttgtttttgttattttctcaagttcttctctctgcctgaaatgcctttctccccatacccaaacatgcaaaagacctacctgcaatgtaacctcctccacaaaatcgttcctgattccccacatctcctcacctaatcatcatcagagatatattttctctcttctttgaaattatgtcaaataatccctttgaacttattatggacaaccaaagcatccacacacatttccaaattcccctgtgggggatctactgctctttgttaagaaccactgagaagagaactaagtgagtgttcagtaaatacatgttcattgattgttgcccagagtaggcatgaaaattcacaataagcaatcattgatttaccttttaagtaccactttgtcaaaatgaggtgaaaccaataagtctacattcaagtctacacaggtttatgattcttaccttgaagagtatgggtcaagccacttatgtcctacataattcatatattatttctaattagattttttccatatttcactggcagatagtgagcaatgcaaagtacaaagcacttccacaaattttgtggcaagacagactgaattgcctaatagggtgtgaagcacagctacatagaagatatatgaagcatattatcattgggagtaagcacagctccattgatttcatgaaacaaaacaaaattaaattgcatagaaactcaaagacatggtaaatatgggttttgagtctaatagacctgagtttgaaacctggctctattatttactagttttctagctgtgtggccttagactaacttcctcacctgtgaattgagtgtaatataccagactcaaagtgttacacaaagcttgcactgtgaagtgtgtggaatattaaccttgggtgcacaatataggaggcaccaaagaacttagtaatcaagacaaataatattatatttcaatctttttttaaaaaaaaatcaaatttaatgcagaactccacaaagcagaaaacatcaatttttaaaataaagacaagatcaaattctgcatgtggatgacttggcttcccttggccctctctaatcctggccctgaatgttaaggaagttaaacaaggtaataagtgaagtaactttggcgtagtccttgccttgaatattcagttataaactatgacattgaggaaatggccctttagtcttggtaaaaaaaaatccatagtgaataatgttcaaatacaaagaaacctaatctatttattgctctttgtttttaattcttaattacatacatagtatataagtatattattggtaaggttagcacccctttaaaactagaatttttctaagcatttatatgcataggtatatatgtatagaatacatatgatagtaatttttttctttttttatgaaactggtatcttgatatacaaacatatctacaagttggcttttgtttcattcaacactatgccttatcaatgcctcatcattgtaaattattgcatagagtttcataatatggatatactgcagtttgttcatttagtccccccgttgatatttatttagagttgtttacagtttatcaatattatacacagtgcttcagtgaacatttttatacctgcacgtagttttttttctaatttagctactgagaagtagaattgctgaattttataggatatgaaccctgatttcatttaaattgttaatgtttaactgccttagtggccattccaattgatggtcccactagaagggcatgacagtacttgttttaccacaccaccattgacatattatatcaaacgaattcattatttattaatcttaactatcaattaataatgagtatttaataatttaattaataatgaataatatttaatgaaataattataattaatcatttttataaataaatttataaaaacaccaataaacttcttataaataattttataaatattttataaagaatttataatttagttaatttgattaataatatttgataatagaatatttaattaatttaattgataatgaataatatttatataggtatatctacacatagttttagccattttctaatttagctactaagaagtagaattgctggattttataggatatgaacactgatttcatttaaatttttagtgtttaattgccttaatgaccattccaattgatggttccactagaagggtaagacagtacatgttttaccactctcattaacatatgatatcatcaaactaattcattatttgccaatctgaatgaaatctgatggtttaaaatgttatttcattgctgttcttttcgcattttcttacttgagaatgggcatctttttaatatatttatggggcatttgtatatcctgttctatgaagtgcattttcatatattttgtccatatgtacattaggtaattttgttttttttaaattgaattccaggagttagttatgtattatggatactaatatgttatctggtatattgcaaataatttaacttactatacctagtctactgctttttgtttagagtatcttgtcatagaggagtttaaaattttgaggaagttaaatttaacgatctgaatacatcatcaatatatttgtccagaagtgcccaatgctcacctccttcacaaagaaggaccaaaacaagtagataacagcaaattgagtagaatgtctgtgagagtacactggaattcagcaagaaaatgacagactctctgagacacaaaagcttgagatggcagcatacagacagaaatgaagcacccagccaggattcgcttggagccatgatagactcccctccctattatagggaaaaagtaagcaagaggctctcagcagcgcctattgccgctgtggatgcctgcaatcctagctaaaggggaactccacaatcctccaagctgtgaggtaagtataggcagctgccttaagtccatgtagctacattgcttcagggaaggacttcacattaagtcccctctcagccccttgggagctaggctactatggcatggcaccattttgagagaggagccactaccagaccacattcttccctgtactttaatagcccatgcatcaccacatcctgtgacccctcaattatcacactgagcccacacagaaggctgcaacaccacaacaccacctggacccagcagtacagccataattctggcacacaagcccacatagcatcctataccccaagtagaacgtaatccagcatagcagggaggctgcccacagtaccaagggagcccatgtgtgcactccctagaagctgagggcttgcctgccaggtgcctgcttccatcaccactccccctcctccagcgcagagctgctgtgtgccacatgagctccctagtgaccaatgactggctcatccaatgtccactactgctactgaacctagcacctccagtggtaaagtttctgcatactgcacaaactccccaaggaccaataattgatccttctgacctaccactactggcaaccccaccccctacagcagcagagacactgcacctaccaccactggcaaccccaccccctacagcagcagagacactgcactctgtgcatgtcccccagtgaccaagcactagctcacatggcaccctgtagaaagactttctgaatttaaaattaggtcttttaaaataaaccagtaagaaaaaaaaaaagaataagaaagaattaagaaagcctcctggacagataggacaccattaagtgcacaaatttttgcattatgaaaagtccagaagatgaagacatggggaaaggcataaaaaacccattcaatgaaatgatagtttaatacatgataagtctaaggcaagatgtgaatattcagatcaagggggctcaaaaattcccaaatagattcaaccaaaacaggtcttctaagcactttatactcaaatgtcaaaaatcagagacaaagagagaaatataaaaagagcaagagaaaagtgtcaagtcatatataaggaaattcccatcagactaactagaaattttttagcagaaaacttggaggccagaagagaaaggggtgatatatttaaagtaccaaaagaaaaaaaaaaaaacctgttagccagtagcactatacccagcaaagctatcctgcaaaaattaagaaataaagtatttctcagacaagcaaaaaatgagggaattcatcaccactatactaggcctacaagaaatgctttaaagacccctacatctggaagcaaaatgatgagaactaccattatgaaagcatgtgaacatatacaactcactgatagagcagatacacatatgagaaagaaaaaaaggaataaaaaattatcactaaagaaaaccaccaatccacaaagataaataagagagtaagaaaggaacgaaagaaatgcaaaacaaccagaaaaaagtagcaaaatggcaagagtaaatcatcacttattaataataacactgaatgtaaatatattaaatccccaattaaaagatgtagactgactgaatggatccaaaaaaaaaaaaaagacaagacccagtcatatgacacctataagaaattcacttaaccagtaaaggcacacatacactgaaagtgaagggatgtaacatgatattttacaaaaatggaaaccaaaaatgagcaggagtagctatatttacataagataaaatagactttaagtcaaaaactgttaaaacaaccatacaaggtcattacataatgaaaaaaggatcaattcagcaagaatgtatcacaattataagtatgtatgccctcaacaccagagcacccagatatcaaaagcaaatattattagatataaagagagaggcagaacccaatataataatagttgaggacttcaacaacccattctgagcattggacagatctagatagaaaatcaacaaagagacatcagtcttaaattacaatatagaccaaatggatctaacagacatttacagaacattaacagatacagaatacatattcttcttatcagaacatgtaacattatccagtatagaccatatgttagaccacaatacaaattttttaaaattgaaatcacaagtttcttttcaggccacaatggaataaagctagaaataactaacaagaaaaactttggaaattgtataaacaaatagaaattaaacagtattctacttaacaacattgagtcaatgaaaatatttagaaggatgtaaaaatgcattgaaacaaatataaatagaaacacagcatattaaaacctatgggatatagtgaaaactactaagagggaagttcataagaataaacacctacatgaaaaaaaagtagaaagatttcaaataaacaaccctacaatgcacctcaaggaaccagacaagcaataacaaacacaattcaaaattagtagaagaaaataaataatatcagaacagaaataaacaaaatagatacgtaaaaaacaatacaaaatattaacaacctgaaaagtttttctttcaaaacatgaacaaaatcaacaaaccattagctagactaagaaaaaaagagagaagacacaaataaataaaaaatgaaaaataaggcattaaaacttataccacacaaatgcaaaagattattagcaacaattatcaacagcaatatgtcaacaagttgacaaacctagaggacatggattaattcctggacacatacaacatactaagattgaaccaggaagaaataggaaacctgaacagaacaataaagagcaaaaagaccaaatcagtgattaaaaagaagtatgccaaaaaaaaaagaaaagcccagaaccaggtggctttactgctgaattttaccaaactttcatagaggaacatctgttcttctcaaactattccaaagcatttaagggaattattccaaactcattttatgaagccagcattactctgaaaccaaaaccagacaaggacgcatgcacacacacacaaagaaaaccacaagccaatactacagatgagcatacaagcaaaaatccccaaatacaagcacaccaaatccaatagcacatcaaaaagcctataaagaagacatggtcacaaagatggttcagcataacaattcaataaatgttatatgttcctttgacagaatgaagaacaaaaaccatatgatcacctcagtaggtgcagaaaaagcatttgataaaatttgacatgtcttcatgataaaaaaaaacactccctacaaagtatgcatagaaagaatgcacctcaatacaataaaggccatatatgacaaacctacccctaacatcataaatgagacaaggatatccactttcaacactcttattcagtatatttttggaagtcctacccagagcaattaggcaagagaaagaaagaaagggcatccaaataggaaaggagcaaaatcaaattgtaccagtttgcagttgacatgatcttatacatatataaatacctaaggactccaccaaaaaaaacttttagaattgatagacaaattcagtaaaattgcaggatacaatatcaacttacaaaaatcaatatcatttctatacaccaataatgaactagcaggaaaagaaattaagaaagcaattcaatttacaagagctaaaaaataaaacacttgggaataaatttaacaaaggaggtgaaagttctctgcaataaaaccttcaaaacactgatgaatgaaatcgaagaatacacaaaaaatgaaaagtcatcttatattcatggaattagaagaatcaatactgttaaaataatgtactacccaaaataatctatagattcaatacaatccctatcaaaataccaatgaagttcttcacagaaatattttttaaaattgtaacatttgtttggaaccagaaaagaccccaaatagccaaagcaatcttgaacaaaaagaacaaagttggaggcagtgcactacctgaattcaaattatgccacaaagctatagtaaccaaaacagcatggtgccagcataaaaacagacacatagacaaatagaacagaatggagaacttagaagcaaatccatgtatttacagccaaatgattttcaatagaggtgccaaggaacatacattggggaaagacagtctcttcaataaatggtgatggaaaaactgtatattcatatgcagaaagatgaaactcaacctctatctttcaccaaatacaaaaataatctcaaaatagattaaagacaaacatcaaacttcaaaccataaaacgactagaaaaatgcatagaggaaatacctcaggacattggtctgagaacaaaagcaaaattaggtaaatgagattataccaaattaaaaagctgcacagcaaatgaaacaattaatagaatgaagagacaacttgcaaaatggggagaaatatttgcacaccattaacctgacaagtaattaatatgcagaatatacaaagaactcaaaacttagcacagaaaccaataattccattaaaaatgggctaatgatctgaatagacatttctcaaaagaagacacacaaatggccagccagtatatgaaaaagcgctcaacatcactgatcatcaagggaatgcgaagcaaaaccacaataagatatcatctcactctagttggaatggctattatcaaaaagagtaaaagaataaatgcttgtgaggatgtggagaaaaaggaacactatacactgagggtgggaatctaattagtaaagccattatggagaacagtatggaggttcctcagaaaaattaaaaatagaaccactatataattcatcaattcccctacaggatatatatccaaaggaaaggaaatcaatgtatcaaagagatatttacacccccatgtttattgcagcacaattcacaataaccaagatattgcatcaacgttaagtgtccaacaacatatgaatagataatatcacatatatacagaaaagaatctattctgccataaaaagaattatatcttgtcatttgcggctacatggatgtaactggagataaatatgtcaagtgaaataagccaggcacagaaatataaatacagtatgttctcactcatatgtggaagttaaaataattgatttcctacaagtagagagtagaatagtagttactagaggcttggaagggtataagggagagctgaatagggaaaggttggttaaagcatacaaacctacaactatataggagaaataaagttctaatgtttcatatttttgaaatagctgtgtatttactccatattttgaaatagctagaaaagaggagtttgaatgtttctagcacaaaaaatgataaaagtttgaggtgatggatatgctaattatcctgatttgatcattgcacattgtgtgtaccaaaatatcactctgtactccataaatgtacaattatttgtcaatttaaaaaagtgatcaatatttttattgaagtattttttcacttgttttaaaaaaagctttgtcccctactaaaaagccatacagatagtttaatcagttctatttttatgcaataatattttatgattcatttttaagaatcagtttggctttttttaatggtacgtggtatggattgtttttgctttttttcatttatttcataacaaatggtcaattgtatcagcattctttaattgaaatttctgctttccaatacattaaattctaatgtatatatgtgtctgttttggaactctgttatgtttcattgatatatttgtctatttctatgccagcaccatgttcttttaattatgataactttatagtatgttagttttgcttatgagcgtcagatagtttttcacaaagaaagtgactcttgaccaggtattaaaagatgcatggacattcagcagacaaaaaaaaaaaaaaaaaaaaaaaaaaaaggaaataaggcattccagttagaagaaacatgggccaatacacagaggtatgaaatcaattgtatggcatatttaaggactctcagctgtgttgtatcactagaggacagttcttatagtagtccagggtgggttttgagggcagagaagaagattggggcatattatataagggtctttcattgctttgtttaaaagattctggaattattcttgaagcagaggagagttactgaaggcttttgagtaggggaataatataatcagctgtctttggcagaagtgtgaagatggtataaagagcttatggaactgctgtaggtattcagagaaagaagagagctctgcaatctggattagtcagaagaagctttataagggaactgctaaactgtgaaggaatgataggatgggttaatttaagggaatactctgattcatgggttcaggaggagaaacctcttatatgtttatttaatttatatttgtattattttttatcttatattttttaagaatcaggtgagttaaaataaatccgatattcattaggtgcagatatcttcccatgtaatttaattcaagccaaggtagtctttgttacaaaatggtgcaatgtggctcttttaagtaatcaagctttaaaatgtcaaataaagatttttcattcaccaaaagaaagcaattctgagagaatttttaaaaccattaaggacagacatacctttagtttaaaaggcagcttggaaactcatagtgaaggaaagagtaagtgggcaagcaaagcagaacttcaagttaaaacctaggcagaaattaaatattttatccaacaaaaaagcagagagtatatgtttgtgacttcactgttactcacttttagtaaagagcaagaaagtgtcaatggaacattttaaaccatgaaatgtaattgttttaaaactgtgattaatctgggatagataaaaccagagttctttttaaaatgattggacagcctgttgagagaaataggatacataaagcacaaattagaaaaccttcacagatatctgttgtttcccacttgttctatgtggaattgcatggctaacctaattatttactaactttaagtaatttattatacttaaaataactttaaagataaatattagtgagcatatagtgtggactgtaccagttttttcttggtttgtctatgtctaagaaaatccaaactgccatgcctgctattctagcttgatgattcaccacaaattacacggtggcaacttccggaaataaaggcagagttcagtagggacaaactcaactcctctctaggatctgttcttaaacttcatcccctgaaacatgggagaatttcacaccccttgtgccataatctctttgtgagtaaactgctattttgagccactgcttaaaatgggttggttctttatgctcaaaatattttaaagattttagaaagaaaaaaaaatatgggaaagaagcctgatggtgaactctcttttaaatcagttaattgtagggagcaaatagcttatgcagaaattacaagtttttaagcaaggagataaatattgggtaatattattcattaaaagaggtatttggggatgaagaaaacattctggaaatggatagtgatgatagtcatacaacattgtgaatgtacttaatgggcgctgaattgtacacttaaaatggttacaatggtaaattttgtgttatctatattttacaattaaaaaaatagtgcatgagagagagagagagagttggggtaattatagagagtttcctcaaaggagatattttcctcatagaaaaatacatcctatatatttccatctttgttaagttttagtttttcctttttaagtgcatggaacctgagtatggcgaagatgtttctgtcccatcctcagtccaggaaaaataccagaagtttaaactgaagtgaaaaagcctgtgagtcaggaatagatacggttttatcagagaataattatagttagcgagtgagtgatgaagaggtttcagtgcctaaagtgaccagcctcatgccaagctctgatgccccacactctcaatcagagccaacagatcaggcaggcaacaaacagcacttgtgcccaggccaagacctagggcaaattttcaaagctggtatgattcaaagtgagttccaattagattggggatctgattaagctaattagaatagataacagtctaatttattgcagtaggtgttcattttacttcaggtattttttgccttatgatgttttctttgatagattcattccatctagccatcaaattcatggagttatttttaatagagaatatatgtgaacagaaaagaggctgtctgcttgcctgtgtctcccatttgagaatatctcttactgggaaatgtaaagctaccatccgtaggtgtaacagccaagaatgcatatccatctttatgcattaagtacttccctagttggcgggttggatttggtttttaggatagaagattgattcttggaaaccatttcaataacagtgacttattttgttcacttattttactgagccagagtttccttcaatcagggtatcttttaaagccattttctctttacaaaatttgtaaagtcattcattaatgaagtatactttatatacaaggaaatatacattttaagtgtacagattgatgaggttggacaaatgtaactcataaaactaccaaccaaattaaggttgaaacatttcctttgtgcccctctgtaggcaatccccagcacctcccccatccttgccccaggcaaccactgagttttttcttgctatctttttaaaatatagatttgttttgtatataagtcatgcactatataacaatgattcaatcagtgacagaccacatgtacaacagttgttccataagattataacaaagctgaaaaattcctattgcctagtcacatcacagccatcgtaaaatcatagcataacatattactcatatgtttgtggtgatactgttgtaaacaaaccgactgtgctaccagtcatataaaaatatagcatatacaatcatgtatagtatatactacttgataatgataataaacaactatgttactgtttcttgtatttacttattctatacttttaattgttattttggcgtgtactcctaatacacaaaaaacggttaattgtaaaaacagcctcaggcaggtctttctggaggtatttcataagaaggcattgttatcataagaagtgaaatcttcacatgtgttgttgcacttgaagaccttccagtgggataagatgtggaggtggaaggcagtaatattgattatcctgaccataatcctgtgtagacctaggctaatatgtgtgtttgtgtcttcgtttttaacaaaaaagtttaaaagttaaaaaacaactaaaaatttgaaaacagaaagaagcttatagaatgaggatataaacaatgaaaatatttttgtacagctatacaatgtgtttacattttaagctaagtgttattacaaaaaagtcaaataatttaaaaattttataaaataaaaaagttatagtaagctatggttaatttactgttaaataatttttttaatgaatttagtgtaccctaagtatacagtgttcataaagtctatagaagtatacaataatgttgtaggctttcacatttactgaccactctgtgacacatccaagacaacttgctctatttaagctctattcatggtaaatgccctatacaggtgtaccattttttatcttttatgtcatatttttactttaccttttctgtttatatatacaaatatttgcaattggtgttacaattgcctacagtattcagtacagtaatatgctgtataggtttgtagcttaggagcaataggctgtacagtatggcttaggtatatagtagtctatacaatctaggtgtgtgtaagtaccctctgaaattcccagacaaaatcacctaacaactcatttctcagaacatatccccatcattaagcaacacataactgtattttagaccttcatgtacatggaatcttgtagaatattctccttagtgtttggcttattttgctcagcataaagtctgaactttatccatgtttttgtgtgtatcagcagcttttctttttttatcatggtgtgactataacacagattttatcagtttaacagcttatgggcatttgggtattctctagtttgggtctattataattatgtggctatgagcctttgcatacaagtctttctgtgggcatatgttattatatttcttgggtaaataccaagagtggaatttcttggtcatataggtatagttacctttataagaaacaaccaaacattgttttttgtttgtttgtttgtttgtttgttttttgtttttaagacagggtctcgctctgtcacccaggctggaatgtgatgttgtgatcatggctctctgcagcctcaaccacccagactcaattgattctcctcccttaggctctgagtcgttgggactacaggtgcatgccaccatgcttagctaattttttttattttttggagagacagagttttgccaagttgcctaggctggttttgaactcctggtctcaagtgatccactgctttggcctcccaaagtgctgggattacaggtgcaagccactgtgcctggcctaaccaaactgttttaaaacatagttgtggaaggggtggagcaaggtagccaaatagatggctccaccaattgtccctccttcaaggacactaatttaacatttgtctacacacagaaaaagcaccttcataaaaaacaaaaatcaagtgagtacttacagtacctgcttttaacttcatatctctgaaagaggcgctggaagaaggcaggaaagacggtcttgaatcattgatgccacccctcccccatcccctgacagcagtcatgtggcatgcacttgaaagtgcaggaattgtgagacattggattgaactcagtgctgccctgtctcggcagaaagcaaaacgaggctgaactctgctaatgccctcccatggagggaacatttaaaccagcctttgctagaggggaatcacccatcccagtggttagaacttgagctttggcaagcctcgccaccatgggctaaagtgctctggggctctaaataagcttaaaaggcagtctaggccacctggactgcaactcgtaggcaagttctagtgctgaatggagctcagatctaggcatcttgggggccaggagagctattgagataccagccaaggtggctaagagagtgcttataccacccctacccaaaccccaggctgaacagcttgtggctccaaaaaagataccttttgactacttgaggagaggagaaggaagagtgaagaggactttgtcttccatcttggataccggctcagccacagcagggtagggcccatttccaggccatctctcctggacaacatttctagacacactctgagccagaagagaacccagtgccttgaagggaaggacacggtccaggtaggacctatcactggctgactaaaaagccgttaggccctgaataatcagcagcgatatccagttagtatgccatgggccttcagtgagactctgagactagctggcttcaagtgagattcagcatattcgcagctggggtggttatgggaagagactctttatgcttggaaaaagttgaggaaaagtaaagggcactttgtcttgcaccttagataccacctcagccacagtgggatagagcaccaagtgggcacttagggttcctggtttatggttccagaccttggctcttggatggcattgctagacctgctgtgggccagaggggagaccaaggccctaaagggagagtcccaggccaggccccatccaccacaagctcattaaagagtcctcgggccttaagggaacattggcagtagcctcgtagtactctccatgggcctgtggtggtggtagccatggggtgaaactcctttgcctgcagaaaggggagggaagagtaggaaggactgtgtctcaaggtttgagtgcgacctcatctgcagtaaatagaacaacagacagacttctgaggttttttactccggttcctggcttctgaatgacacctctgggcatgcatggggcctgggagagctttgccaccctgacaggaataacaaaagcctggctaccttgaccacctttctgataatcaaattcagtcaagttgcaggatacaaaatcaacatgcaaaaatcagtagcatttctacataccaacagcaaataatctgaaaaagaaaccaagaaagtaatcccatttacaatagcaaacaataaaactaaatacctaggagtaaatttaacaaaagaatgaaatatctctgtaatggaaactataaaacattgatgcaagaagttgaagaggacacacaaaaaaagaaggatattccatgtttatggattgaaagactcgatgttgttaaaatgtctatactacccaaagcaatctacaaatttaacacaaactctttgaaaataccaatgacattcttcacagaaatagaaaagaaaattataaaatgtatataaaaccataaaaggtccagaatagtcaaaactatcataatgcaggagtcacattatctgattttaatttataattcagaactatagtaatcaaaacaggatggtactggcataaaaacggacccatagatcagtggaccagaatagaggacccagaaatttacatccacacatctaaatccatacatctacagtgaactcaatttggacttaggtgccaagaacctaccatggggaaagggcagtctcttcaataaatgatactgggaaacataaatgttcatatgcagaaggaagaaactggacccatatctctctccttatacaaaaatcaaataaaactggattaaagacttaaatcgaaggtctcaactttaaaactactaaaaggaaacattagagaaactctaggacatgggaataggcaaagatttcttgagtaataccccacaaacacaggcaactaaagcaaaaatggacaaatggtatcacatcaagttaaaaaacttcggcacagcaaaagaaacaatcaacaaagtgaagagacagcacgtagaatgggagaaaatatttgcaaactacccatctgacaagggattaataaccataatatataaggagcccaaacaattctatagaaaaaaaatctaataatctgactaaaattggacaaaagatatgaatacacatttctcaaaagaagatatacaaatggcacatgggtatatgaaaagctgcttagcatcattgattatcagaggaatgcatatcagaactacaataagatatcatctcaccccagttaaaatgacttttatccaaaagacagccaataacaaatgctggcgaggacacggaggaaaaggaactctcgtccactgttggtgggaatgtacattagtacaaccactatgaagaacagtttgggggtttctcaataagctaaaaatagagctaccatatgatccaacaatcccactgctgtgtacagaaccaagagaaataaaatcagtatatcaaagaggtatctgcactcccatgtttataatagcactattcacaatggccaagatttggaagcaacctaagtgtccatcaacagataaattaataaagaaaatgtggtacatatatacaatgaaatactcttcagccatcaaaaataatgagatcttgttatttgcaccaacatagatataactggatgtcattatgttaagtgaaataagccaggcacaaaaagattcactttgcatgtgttcacttatttgtgggagctaaacatcaaaacagctggacttatagagctagagggtggaaggatggtcaccagagtctgagaaacgtagtgaggggttggagggatggctaatggatacaaaaatagtttaaaataataaataagacctagtatttgctagcacaacagggtgactgtagtaaaaaaataatttagttgtatatttaaaaataactaaaagagtatcgttggattgtttgtaatgcaaaggataaatgcttgaggggatggataccccattctccatgatgtgattattatgcattgcatgcctgtatcaaaacatctcatgtagtccaaaatatatgcacctactatgtacccacaaaaattaaaattaaattaaaagtgaaaaaagcacatgaaacactttaaaaagcacaactggaatacaaatggaagattatataactatatcttatcaatgttaaattcaatgaagttgataacagtactgcaatcacataagagaatattctcattcttaagaaatacatactaaagtctttaggagctaaaagccttggtgaatgaaatattctcaaatggttcaggcaaaaataatatgcatgagcaagagtgcgaatgatgaagcaaaaaggataaaatgctagcaatagattaatatggatcaggagtatatgggtgttcttggtactatttttattattttcaacttatttgtaaagtttaaaattatttctaaatagaaagtaaaaataattcacataattttaccattttataattccaccagcagtggatgagaattacagttgctctacttccctaccaacacttggtatgatcaatgttttaaattttagccattataaatgtgtaaagtggtatgtcattgtggttttaatttgcatttctctgatgactaatgaagttgagcatctttcatgtgcttcttaggcatccctatatcttcttttgtaaaatatacatacaagtcttttttcccatttttattgggtgattttctttttattatgttgaaggggtttgttatgtatacttaatgacagttttttgtcaaatatgggtgtggcagatattttgtcctgatctacggctttccttttcatcttcacaatattgtcttttgaataatagaaatttttactttcgataaagtccagtttatcaattttctttttatgatccaaattttttggctctaagaaattatgttaagaaataataatgtcattattattattatgttgagttattaagagaatggacttgagagttactcagatctgagttctagtgacacaaccacttaatctagtggcactaccgtgaccctgggcaagtgacctaacatctttgtttctcagtttccccatacataaaatggggataattttattacctaccttccagaactgctttgaggaacaaactagataacatacatacaatacttaatgatgttcttggtacatagcaaacacttattaaacagtagctgctgttacttgcaaatgtttgtctttgggaccttatctttctaaaatctcctctctttttagctctcccaacttactcaggcaaccaagaaaatttctctacagatattgaatggccaactcgatgagggaattgtaacgaaatgattctaacatactttgaattttaacgagctactcaagatgatactcccctgaaaagaagggagagcatatgggccagtgaacagagccctgagtggccactgacaacctcaagcagcagctactcaattctggggacttgcttctttggtcccagggcatcacataactcataggataccatcaagccccatttcttcagacatggtttcctgtatttgattttgggtcttattctactctaagacattttccttattatttttaatatcctctcaaattcagaaagctcttactttcctgaccttgtcataattaacaatagctatttcttgcttatgagttgttacctacaatttcacataatttttctgacaggctgacaggctgactaattaacaaggtttgaccaccctctcaaatcagttggcaaggctttgggctttgacactgaaaaagttctttgaagcttagttaccattcttacctgctatatgtgaataataaatgcagagttgctgcatgtagaagtttgtcttcatcatgtgcttcagcattcaaagatatcttgacgctctctttaagggattatctgacagggattagatgcaattttaactcctgtcccatagataaacacctacttagagcattatcattaaataattttcacaaagaacaagtaatttttaaaagatactattcaaaacatattattaaccagagaagtctttccaagaaggccttaacctgattatttggagaccacattttcttaatgtatgtgtccattttacccacacttccagtaataaagatactcgctctctgtatctctctctctctcactcacacacacacacacacacacacacaatcacatgcacacattatacacccttaggcagaaagaacaagcagagggaaaaaagagtatatgagtcttcagttctcatcatttagctcccacacagaggggaacaacagacactggggtatattgcagggtggagtgtaggaggagggagaacatcaggaaaaataactaatgggcactaggcttaaaacctgtgtgatgaaataatctgtacaacaaacccccatgacacaagtttacctatataacaaacctgtgcatgtacccctaaacttaaaataaaagttaaatttaaaaaaaaaaaggtttcagttaagaagtatggttggaaatgaagttttctgctcaactcaactatctggttagggaggtagtgaagcatagcagaaagaatactggagtttagagtcaaaacagaggattaagttccctttacaccagttactatatgtgtgaccttgagtcataatctctctgattcacaatttcctcatgtgaaaaatcagtatagaaatgcttatgttacagagccattgaaataattggaataaaaccataaaatctttgtaaaatctaagtgtcctgtgacatttaaatattctataattctgtaagggaatatcagagaattataaatttatgtcctggaactacccaggtaagagctttcaattaggatatctgttgttatgagcacagagttgcgcgatccagattccccttcaacaaaagacttattgtccctgttactggaagtgtggtaagcagatagccttcagctttaacctcctgagactgcttcacctgcacaagagctgccttatgctcttcccatggaggtataagggaggaaaaataattttctctttaccctctagagttcttagtcgggacagactcctgtaatgaaagacagattaacaaaaggaaagcaaacacaagtttattaacttatacatttcatgtatacatgagaaaaaaaaagcagagaaattagtaaattttaaagagttgtcttagacctaaggcttaaatacagcagttctctgaaacagggaaaaaagggtatggaaaaggcctggttaagaccagaaggccaaataaaaaaaaaaaaaaagcactgttaaataaaggtaagattgattatgcggatttgagtccatgccttctccactgatcaagagtctctagtgatttggtcatccctttcttcttggcacaaagagggagacaccattacaaaataagatttcctttatagatgtaaatttctcttacaaaatggtaactttgcagagcttctcctgtgtctgcagtttctgaaaataaccagctcaataatccttatgcaaaagaggcataatttggagtggcatattctggtctccaacagttatattttgggatggcatgtccttaaccctatcagaggcccacatttaatacgtgattgaggccaagatatgaaggcccagcataaaagcagggagaaaagttaaggtgctccagtagttgtccaggagagagatgatggacacttggcctagaatagtgccagttgagacagagaaaaataggtacatatattgagaatatgctttggatgtagattcaataggactctaggatgagagaaagaatggagtaaatgatatgccataggtttttggcaaggtatgtagtgaagattttttttaggccatattaattttgagatgcctaatagacatctaggtagaaatttaaaggagataggtagatatatgaggttggaactcagaggagaaataagggcaaaaatgtagatttaggaataatctgtatgaggacatgggactagatgagatcatgtccctagaatatgggaagccagttctttgtcacttagttatggagaacagtgtttgttaatttcactcctataatagtgtaggagtcaacacttcattgactgtatgacttaaatccagcaaccagaccatttagaaagagtcctcattaaaatgaagggatttttggttgtgctattgcatactttaacctaataattacagagttcctactatgtgctaaggaatttgtatgcattatattatctttaatccttaacacatgtaaatgaacactactattatcctgatgtcacagatgaagaaaccaaggttcagggaagtgaagcaattttctccagattacacagttagtaaattatggagttgatttcctccacgtttaacctccacttgcagtgcatgataatacccagtaatagcagccattaatggatcacctagtaggtccaagtcctgagataaagtgctttatatggcttatctcattctaataaaaatctacttattatccctattttacagatgataaaacctgtccttagagatgctaagtaacttagccaaaatcttatagctcgtgagtgacagagtggggtttcaaatacacatttgtctgaatcaagaactttcatctcctctggccttagctgagtagaaaaggaaaaaaaattcccctagaaggtgatataaatctccccaaatgacaagcagatggaaagcataacattaaaaatgattggtattaagaaaataaatttcattggaaataagaagttcaaggtgattattaaaaatcaacaagacattgggaaagcatcttttgaattactttttaaagcggtcatctttaaataagcaatggtaaaaatatgaatctaatcttgcttctaaatctaaatgttttgtgaccatgaagcagagtgaacatcaccaaccaacataagattggacccatggccttggcttctgaggacagaattctcaagcacttagtggacttgaagattcttctcttagtcatgagaagcccaggagatgttctaaagctgaggagatttatttgattggttcctatatccctcaacataacatcaacatataagtatacctgtagtttctcttcttctatcactcattctttcggctcccaaggaagaggtttataaacatgtcataaatatatctaatcttaacaggcattatccacaacatgttaacagttgctctggagacaccaaattgtttttggacattttgaaagaggcttgtgtgtagaacttactgtggacaaatttatctctggaggtttttaagatatttaattgatctgcttgattttctccaacacttagcacagagtctgaaacttactagacacaattatttgttgatttaataaatgagacttcaatatctcaaggcaaaacagtgttcagtagtgtgaattttaaggcattgcgacaagcttgttgtttttaaaccagatatttctccttgatgtagtgaggccgtcctctggaataaggctcaagcccaaggtaaaacaaatcttattgcctgtgatcctttcaaaaacacagttctgaaaggctcagtacagaatttggtgaatattgaatagatgaaaataaagtctaaagcttttcacaaggcaggcatgtgttagtcaaaagggaagggggatatgtatagaatctgtatctacttggttttgttattttaagctgttgccagtcactgattttaggtgtttgacttaaaatattttaagggagtgtgaatactgagctatgattatttccccagagaggagaaagcctttattctctgtagctattactgtacacctcaggtactagtgatggggacattaagctgacccatgtgtgtagctcaccacattccctcagggtaatgctacgaagatacatctaaatattacttctcacctaaatgtgtgtgtgtgtatatggggggatggggaagtaacgatggttcagttcagtggcacttactcctcttctgtcatcactatcaagtaaattgaaatgctcctagtatgtatactttgagagtgctccagattggaagatgccatttgactcatttcaagtcacctgcctttttaatcatacgacaattataccaaatttgacattagcatgacaattaaatgttttaaagtatttaggagctttatatttatattaaatatgtattcagtagaagcacaataaataaggttcatttttataagctgaattaaaagtcaataaaaataataataataataataataataataataatagaagcatcagagactgcctaggattttcaaactaccagttcagccaaacatcatgtcctgtcggcaagtgtacatctaagtacataggagttgtcagacaggagctagaatgtgtttctcagcaggaatttttctgtcttctgtcattttcattctgggtgttataaatggtatgtgttgttgtatttcagttattatctttcaattatagagtctgagagtacataggattctttgaggttatctcttccagcttctctcccaataaagttatccttttaataatattcacagcagccatttagactgaatgtgtccagtgacaggaacctcattcttaaaaagcagactgttctgttgttgaaaagtgctgagtttcagaaaaggtgtttgacttaaagtatttctgtgttaggtaaaatctctttccttataattaaccatcgctaatgtatttactctcttgagtcatattgggtaaatctaatccttttctacatgatgactatagacatttttgaatacatctaccactgtccacccaccaatgaccaacctcacccccactaatctcttctcaagttttaaaacctctagttccctcatctgtttgtctgtccctcatgtgagtctgttttaaaaccttctgtctttgtgactacatagacctagttcaagtactggttgcttatgatgtgacctgtaaaatgggggaagttatttcaacctcatgagatcttatgagaattaaattgacagataatcctttttttaatattattggtcaaacattattctatgtgtcttacacatattaactcatttaattttaataacagtcctatgaggtagttgctattattattttcccaatttatacacaagaatattgaggcaataaacatttattcaaggtcacataactaattggtggcagagtaaggatttgaacccaggcagtctggctctagagtcttgacctttaatcactatgctgtactacctttattaagtgaggtaacacacacacacacgtatatatatatacatatataaatgcatatatttggaaaatggaaaaactgttttaaaaaatcctaaatttttaatttaggcctgatactacagatgtaatcaaataatcttagaggggcagtttttttcagttctgggaccaggtttcatttggacactttgtagactagatgaatctaagtaaatccttctgtctgtgatgcccacatgaagatcctcccctaagatatagtgacccattcatttatccaacatttattgagcactactacaaattaggcacagtgtcatctgttgtggactagatgtatgcaagtaaatcctcttgtctttgatggccacatgaaggaccttccctaagttatagtgacccattcatttatccaacatttatttgagcactgctaaaaattaggcatggtgtcatctgttgtggatacaatagatcatgaccaaacagatatagctcctgtcttcatggagcctagaatccaggtgaaagacagacattaaacaaataaacacaacaatacacgtatgattactaatagtaaggcattttgaaggaaaataataggatgtaataagaaacaatagcacagggaagttattctaaaattgggccagtgggtggctaaggaaaagcttgtccatggaaataaatcagagactcaaagggtgaattgaagttagccaaggaaaatgttgggatacagcattcgagaaggatttaaaaatattttgaaggccctgaagagaagaagaactttacctggtcaaggacctaaaagaaaaagaaggccattgtggctgagaaatagtgaaggggaaccagaatgactctaaatgaagttggaagattaggctggagctacatagcaccaggcgattgtgctgaactgatgctgctattaggagtcagcagaacaatgttgcagaattgtagttggtgttttggatggtatcttgagaggaggcagctcaaaagcatacagcaaggagactccagagactccaccagttgctgttataactcacctgaggcttatatactaacatgcaattagcctataaatactgataaaaccttcttattaatatcaccactaacctgttatctacatctacaactcccacctcaggttaccattttgtgcctagtttgtgccctcgcatcttccccagatattgtttataatcagagatcatctatacataagtattgaagaaaaggctattcagtgtgatttgcacaagtagcattcacccctagatatgggactggaatctatatactgagagtagggttggtaattattatagccacgtgccgccttttttctgccagtaacgataacatcaagcctcaaagttgagctctggagtcacactgacatggcatgatttcataactatggattaactctgctactaattatctgtgaccttaaacaaataagttaacctctcagccttagtttctgcatttgaaatgtgaaactaatgatacttatctaaaaagatggttgtgagaattaaattaagatacttaatatgtgggaaagaacctgacacaatgcctgatgggcagtagatactaaataaatgataaatttatttctttatgatatacaacagagtgtttcttttctacaaagtcaccatagggtgatccttcacatccaaatttatttcatttatgttatattatacttggacatagatatattgtttgggttttactaacctcaattctacagtatttttatggaaccatagtactagcatctgaaaggagccttagaaaactatttttatcctcatccttttagtagaaatagtgataaaggttcctaatcctgaaacatatacaacacatgcagacattcattcatacaggtagcaaaatgctaattaatctctttgtgccacgttctgtgctaggtcctggagatacagatattactaagcataatccatatccgcaagaagttcattgcccaaagggtatgacagatatgtgtggaactaactatattaaaagacaggctcaggtgtttggtgggagcacagaggaagaaatgaaatctgcctgtggatgtggtcacaacaactagcccttttattatgtgtatctgactttagtatgtatgctaacatttccagactcacttgcttcacagcaacttaaaacttgcattttatcttctaactgctgaactcattcttatttggagcttatttttctcagaacaatcaatcaagtctttccttactatccactctgtgctagggcttgtgagggataaaggagaagcagattatttgtccccaccctcaaggtgcctgaagtccagacagttgagagtgaaaagacccccaacaataaactactatttactacagagctgcctctgaatatgttcagagaagagagctcagggtgagttggaagaattagaaaaaaaaaaatcaatgttccggcagattcaaacagcagttcaggcttttaaaaactgcctacatacaaatatttagagattcatttaaatattctccactgcataataactcaaaagagaaaaacaagttcagtgtaacagtatctctcccaatgcttgttaatctgaatttatagcacattgatctaggagtgccttatttaaattctgttaaaaatcttagttgtaatattcctagctggtccaaagacagggtaggctaagcatgtattagtgaagacaatagacaaacagattctcaaagctgtatacatttcagcataggaggaacctgacataagaaaaaaacagggatgcaatgaaattctttgaagccttgctttttgttagatgaacctttgaaaagggtgttttgaatttttgaggtgcacacacattttatgtcagagaaatatcacaggaaggtatgtttggaaagaagctgatggggagtgagaaatgaggattgctgctgtaaggcattaatgagttggaagaaggtcaacaacccattttgaagtaaatctattatctgagttcagaatggtcccaggaggaacttgtactgacacacccaaaattccctctctagcctagagagatggaaaacagaggaagataaatctgatggtggttttccgggtacttcttactcctaagtatgatgaatggaagttttagaccctttggtttgtatggaagattttaaatataaacatggtcaatggcaaatgtgcttagaggtgataagtttatttttaaaatttttatagatttagtgggtacaagtgcaattttgttacatggatatattgtgtaatggtgaagtctgggattttagtgtaaccatcacccaaatagtgtacatcgtaaaaaggtgataatttttattagatttcaaaaaaacataaataattgaaaagttatccaagctagtcatttaaaatccattgagatattattttctacctttccttaaaattagtcctatctccttggcctagcatttctccaacttcagtgtacatcagaaacacctggagaaattgtatagcctgcagattcttgctcccccctcagagattctgattcagttggtatgtggtgtggcccagggatctgcaggtcaggaaaacctagtgcaataataacaggaaaaaagcttttcatttcatcttaaaaactgtatttattattgtctgtaatggaattgaattaaaaagcaaactggtcctatattttaaaaggctttctttctttagtaggagcttacatggcctttggaaaatcttataactgcaatttgggccagacttgcatttattgctttatcaaacaacaaaacaataactaattattatatagttcataatggcttatatttaaatattatcttctaatgaatatccttcttttattatgattatagatttatttcccaattcagaaaaagcgttatccattttacaaatataactctattacaagtagaattaaaaaatacagagaagttaagtgattagcctaaagtcacacaggaaccaccaaagagagaaggtgagaatctatattttcggaatcacaatgcagtattctgttaggcaacgctgctttcaaactagaaaatatagatgggagtttttaggaattgacatttgagccacagatactaaactgtttccctacctcactctgccaactttcatttccccttatccctacctaccctacctcatctacttcatcctgaagttcctttcccatagttacatatgttccttaagaatttatgttgttactaaaaatttgtgaaatgtcagaaagttgatctcttaatgccatgaagttgtgctgatcaccatttgatatcagatctattcctggccctaatgaatacagttttatcttatcattttgtgacttgggtgtgaataggcccaaaggtgtgcactgagcactgagcatgcatcccaggatcccactcataattaaagaagctaggtggcttcacaaagtcagctttctttggccattctacatatggcaggttcaggaatggcacctaaattgctgaaaccatcgagtacagaatctctgtgaaagtttactttctctgttcaggccagaccatgtcagcagaattcctttattttgctgcagtttgtgtgtctggggagggaggaggtgggatgaggtggggatgggaggagtattctccaggtgctaagtgtgccttttgctccttttgcaaatagacttgcaggctgccctgggggagctgcttttatgccatggtgcattggtattgtacccatttcattttttttctttttctttttttattatactttaagttttagggtacatgtgcacaacgtgcaggttagttaaatatgttcaaaaatgaagagacccagcttgcttaccatagctcaaaaaagagattagtcaatgaagcttgggaaaatcatgacttgccaaatccttcctaacttttacagtctgctgtctgctgtgtatgttgtctagataccaaatagacaggggcctttgtatccttggcatggctgttgttaaaagataattttacaaaaaaaaattgtaaaattaagactgtcatacagatataaaaatgaacaaacactaaagattttgtttaactcaataatgaggaaacgtgtggggtgttataaacagtcaaagggagaattcccaagaaaaaagaaagacacatttataaattagaaagattgaaatgaatgtggaaatggaagcacactggcttctttcaaagttgagcaggggaccacgcatggtggctcacgcctgtaatcccagtactttgggaggccaaggcaggtggatcacttgaggtcaggagttcaggagttcaaaactagcctggccaacatggcaaatccccatctctgctaaaaatagaaaaattagttgggcgtggtggcacactcttgtagtcccagctacttgggaggctgtagcaggtgaatcacttgtacccaggaggcaaaggatgcagtgagctgagattgtgccactgcactccagcctgggcaacagaatgagacttcatctcaaaaaaaaaaaaaagttgagcaggggtttgaacatttactggaagtttacatgtctgtggacaagaatcactctgcattgctctcagttttccacagtttagagagttgtaaaattgctcaaacacagtgaaagactagaatcagataacttgaagggttgtgatctaaaccatgtatagctttccattcaattttttttttctctacactacatttgggaaaacagcccaggtcttgatgagactaaccagtgggcttagaagcagtaggttccctgttgccaggtctccttgatccttgtatgcctgaactggccaacttagaaaaatgtttcttgagtcatgttttaggatgccttcagcctcctgtcaggctcttgtttttgtctttgatcctttgaaatggccatttggttctatgacagttgcaatgtgatggcaaggagacagaagaagagattagtgatgtagagatttcaaaaaaactccagaagttaaaaagtcccttcatctcattcagtttccactgcctattccctttcctcaaagaaagggagtaatccaaggtgctactctctcccattccatgaagccaacttgccacaacagtttgcttttgagttgatgaacttgctttcagtcttctatttgatatggtttcaatttttctcttctgtacatttcattcactgagcatgtacacagggatacacacaaaaaaacccacataaacacatgcatcatacacacaccacttaagaattaaatcttcatgttttcccccaaattatgtatccatctgttaaattattcatgctaaagaaacggagcagaggaatggctaatccaaaatgctagataatgcccaaatgatgtagtggactttggagtatgttttgtgtgtgtgctgatgtttgaaattagatgtgccttataaaagcaggcattggagtactggagaggaatgctttgagactgaaattatggtcctacttcaactaggtttgtgaccaagttgaattcagtttacctttcagcctcattttccaattctgtaaaatgagagatttgaacaaagtgatctctaaagcccccttcagctctgacaattccagaatattccagagattggctttaagccaacagtaaatcaaataagcaatccaaactcaaactcaaactcaaactcaaacccaaacccaaagggattttgggaagctattcagtttcccctcttggccctctgtttacctcttccctgtgaccttcctattgagagtaaatctctctaacattcaagtattcactcacacttttattcagtaatataaatggccaccatttattgagtacttactagtgcaggcaccctactaggcactgtatatgtattacttcaattatcacaacaaccccagaggtagataccattattcattcaattttatagatgcagaagtgaggctccaacatggcaaagagtttactcaaggaaacatagctagtaagcatcagtgctaagatgcaaattgagtctgtctggcttcaaattcagagcttttttttttttttttaactaaagggtgttgcttctccatataattatcagagttatgtgcaaacagtgaaaggcgctagggagaataaaatgttgaagattcgatctgtgcccttaaaggttttcaacaaagtggagaatggattattcatctgggtgttagggaaaaaaaatgaaaatggtctgaaaagtaagaattaattgtcaattgagtgaattaagtgtcaaaaaattgaaaggtgaagtatgagaagaataaatcacctaaaaaaaagaacagagatatcaagtatgacccattttattatcctatttattcacttctgttcaagtcagaggccctacttctgccataaattgctatgtgattttgggcaaaacctatttcttctctgggtctaggtttcctcattttttaagtgatgaggataactaaatggttgcaagttccctcgctgcgattccatgattatataataacttgaggctattttacattcaccactggaatttaagaatggaatctgaatgggaggatttcatgcaaggatctgatccaattgtggggtagaattccttaaagaaatgtgaatctccagaaaatcagccagggaatttgcatagcccttttgcacataaatctaattgtgatagggagaaaaaaaaatggtgcattccacaactatcctttgaaatgtgtctacggtatcctttaaaatgacacattataagttagggaacgttttcaggcaaataggagatgccagagaagtaaagatagatttagtcagtacatctggtacatctggtgaaatgaatagcccagccaaagggttaaagctgaatagcactaattgccgagaattcagattaggcatatttaatagatataaacaccccaaccatccatcatcccatctggtccttcttcatagaaaatggagagaaatggtgagggcatgctgccccgacagactctacttttctcagaacacaacccatctttctaccaggatcccctccattttcagaaacgaataaacaaacaaacccagactttgcgtctgcaaggggcaatatagtagcccagacacctattgactggaaatgtagcctctttataaaaggcaagatggcctggcaccattcaagcttcaatgccttatgaaatgagaaggtaagatccggtctcagtgcaagatttggcacttccatggccttcacattgtgataggcaggagtgataggaaagaattcaagcatatcaaaaatccttgtcctttttccttccttcagttgccttagcacgaaaccacaactaatctacctgtggactctggcttttgacttaacgaatccagcagttttaaaatcagtgtggatattaattaaagaagggagacaacccaaagtttaggtccccagaacagtcttccctcttcctcattagtgctccctcaccccctcctcttttgtatcttactcttctctttgattctcatacaatctttcctttgtcttcccttactctccccagtcctctcttattcctttcccttttttttttcttttctgcctatgccttaagcctgtctgaactcactatggcttaactcggctgacagccacaaaaaactaaagaagacaccggaccctgaccttcaggatggtcccatgtgatcctcataaactctctgagatgaaagtccctgcaacatgcttttatattctccactgaatctagggctggatactgtgcaaatggtcaataaactctttttagttaaatgtaatgggtgaatcactcttctaggcttccatatgtttctgggaataagacattttgtctttcgacagctgacagagtttgacattgacatggggactcagaatttggcctgcttgagagaccatagattttttaaatgttcctcttctatcagtattgaatgagatttgttgacagcatcaagaggaaagtcaaagttgtcattttttattgaaggtggtggagcaagaagttggaggaacttattctattaacaattcttggcagcaatcactcttctcttttgcccccatacagacgcctcacttttgggaaatgatttcaaatcttaaacaagatgttagctcagttttatttctgctgaatagaacagaagttttaatactagagttctgataggctgtgggctcttctaccctttcattataatgtactttcactgaggccatataatctaacttgtgtaaaacttgtcattattggggaattgactccaaatataacaaatcaagatggtcaacttgctcaactgggaaagtcaacatttaagacaaatctaatcatgcatgccagttctcaacgaggtgagtttcagccatacccagttgtgcaagttttacacaaaacccagtttatcttctttgctgcctagaggaaaggaatttggtaaagaactttttcttagtgctcatgtgtgaaggtacaccgtcaacacattaattcatttcactttcctcccagttagggaaacttcctctcccgcctctcagagagaaaagagaaatatgggctgtaggccaagcatgaagatagatcaagtgcattgagccttgagatgctgcttctacattcccatttttattgtttcattcgttggtaaacatttctttactgttatatagtcgtttagatcaagagatcttttagataaagggggcaaccaaaaactaatttagctaggttatgcagcatgttatgaacctattagagaatgaccatccataattccataagttcttacttaaggtgatttttgataatcgttctttgctctattttttcccaagggagatacaataaacccaaagtgataaaataattatcatctttgttgagtttgtctaattgcatactgatttcccacccttgtttattgatcttcaaagaatataaatacagaaacaactgcttgagtctcgaaaatttaaaaatgaaaggtcaacactaatagttctgttattgagccttatacctacttgacaacaggtttactagggtagaccttttatgtaggcagagcagttgacctatgcgatgtggacttaaaagccctaggaaagcttctttatcacttaagggttctcgcaccacttccactattggctaatgcttaaaatctcaccattaaagttttgattagtgtttatataatgtaatgcacatatatatacacacactcatgcacccactaaaactccctaagctgttcttagtgatttattccctaagtgtgaatgagaggtagatacttggttttggatttgagcctagggagaaaatatttggtgcccagcacctgaagaggctcacagaaggggttacatggagagatcagggggcaagtatatgaatacataaccaatacctttattttatgattttgcctagatttcactctaagaatgccaccaacagaagtcttttttactctgattttatttcctttccttcatcttctaatgttctccctgagagctaaggaaaaagactatgggcctcaactgagctcattttagggttgagagtgcgtcttctacttcccttatttgcctttcagtgtctacgtgtctgtacactgaaataaatcaattaatcatattgactgactttcctagttcaaaaagagaaagataagtgatagtatctgaaaagagtacaaaaaggaaaggtacattttcccattctaataatcaggcctacaattgctctcattaactctaagactaagccccctgcccacttacctccagtcaccacaatccctaagtaaacaatttgccatgagaaaccacacaaagaaatgccagaatctattcaaatgtagagagaaaatgttacaatgaagtaccttacattcttacactaatcactactgcttccttgggaaccaaataaaaaaggaaaaaaacaaagaaaaatgccaaaagggacaagcaggattgtccctttgtcaaataggatttgatgtacttaaattcaacaaaaacatattgagtccatacacagtcagataaagcagaaatggttcttgccctcatattctaatagttggagggggttaatgacagatgtcaagtatgtacataataatccttacaaaagttagagttgaaaatgcaataaaagaggcagaacttaattgctctggagttccaagtgaagaagttatgtcactagtagtcataatagtagtaacaacaacagtaattattactattatctattgaggcttatcatatgtcagatgccatgcaaagcacttttgtaagaattttcttatttaatttaatcctcatacaaacttgatccattagggatcatgattatcctcatgttctttatgaggaaactgaagctgagaaatttagtaactttcccatggtcacacagctagaaagtagtggaactagaattattccagagcttgtgttgataaagacttcacaaaagagacaacatttaagatggtctttgaagaatgtgttggattttaacaggaaaataaaaggaccaataccagcaaaaccgtataggttgtaaagcatatgtggcatgtttagaggattgcaaatggtatagtttccctggagcaaagcaaaatttgtggtgctagtgacagaaagagccaagtaaggaggaaaaccagtgtagaaggaaagacgatgagcatggctgacacatgcgataaccttgctcctgaatttcacaccaatattttcatcttcattgagaaagaacgaataggccaagaacagaattttaggacatgatcacactgatggggtaggaagaggaagagccatcagttatgtaaatgtaaacaaagcagttagaatattaagaagaccagaggttgacagtatggtgggtgccacggaaggtcagggtgccagaagaaggtgtttagttcctactttagtcaatgctataaaaattgaagagaatcaggatttatagtagattagcttgctaccagttattgatcactttctatgcttctggtactatgctaagcactttacaacagcaattgtctacctaaacttcagaaccacttgtgaggtagggactgttattttcccgattttaaagatgaggaaactgaaatttatagaacttaaaaaacttgatcaagacctcatagctagttaagaggcacagcctggacttaaacctaaatctgtttaactctgaagcttatgttcttaatctctaagatctatttccatttcatttttatttaccaggagttcacccttgagagagaggtttttggcagagtaataagggtaagagtcagagagcacagattgactagaagggagaggacagatattagaatgattgtgaaatgagtgggtggtaagacagtggaggttatggctatcaacttattctgtctatagtttagagggagtggcaaagaaaggtaaacaatgggagtgggtagcctgaggggacagaagagtcaagggaagtttcttttaataggggaggaatgaacctattgttgactgaagagtagccagtggagagggagaaagggcataatttatggaacaggaatgtggcagagaaaggaggaataagattcagaggacaagggggaaggttcaaattagaaagaagaaagacatttattaggtaacccatgttcttaaccttttctcctctccctgatctcatcaaaatgtgtctgattcagtaagcaccttagttgcctaagtataattacttattatacttggtatatattacatggactgttactcataaaaatataatatttaaaatgtgagatgactgaaacactaaatataattaattaggaattataagtaatgaatgaattaaggtgccagcgtattagataatgatataataaatatgttttatctctctgatagttgaattttcacagaaatgttggaaacagagaaaaaatttacaaccccccaccccaggtgacccttagatacagacagatgttagtgtgaaactgtcattcactcagcaaacatttactgaaagtcagctatatgccaggttctgtgctacacactggggatacagaaataaaggacagagttcacatccccaaagatctcacagcctagtggatgaggcagagaaatcaacacagtataatacagcttgatgaatgctgtgattgaggtaaaaaccatgaaacactgttgaactacataaggaggcagtgggcggggttcagggaaggcttcccaaaggaggtgatatttgagatgagttttgaccttctactgttgcttttatagggatctgcaaaaagggccaggaattcccccaggtgtcacattacaggcaacagctgcaactcactatcctggcttcatcctcagtgtctgacatcaaggtcactgagccaaaagtcttaggtgggggggagtatacaatggcactaagtctaacctctgggctattgggtcataggagaagatgagggctataggttccagattacaatctgaataaatagccttctcttttccagggttgggaaagtaagaaagtggaaagggaaagtggagaggagctagaagaaggaaggaaggaatagctacctctttattagatctttctgcctgctaggaagaaagccttctctctgcatatacaccactcatattgttttgtttcaatctttattcttgggtgtttttccacatgaaaagggcagtgaatatatctcacctcagtgcagagacatttagaaatgaaaaacaacttcaaccaagctctatttctccttctttgaaactggaagactgattgtaggtcagtttctattttatctgagccacttggcccatctggaatagtcactctaggaaatcgaaaactaaatttaaattttacagaggaaattttgaagtgactccctcaatctggtcagacacattctgttgcattcctctgtccaggcataacactgagcctctgacgaaaatctgaatgacaattgtctgttcttagtattaaattatttgccccccccatttccattaatttgcagactcaggcatactatagcaaagactcaacttgaactaattgccttttaaatttacctctcatgttcctttccttagcaaatgagaataaccatacattgaagcaggaaagactatggttagacataaggaaaaacaacctcaaccaagcgctatttctccttcccttgaagctggaagactgattgtaggtcagtttctattttatctgagccacttggcccatctggaatagtcactctaagaaatcaaaaactaaatttaaattttacagaggaaattttgaagtgactccctcaatctgatcagacacattctgttgcattcctctgtccaggcataacactgagcctctgacgaaaatctgaatgacagttgtctgttcttaatattaaattatttgccacaccccctcctcatttccattcatttgcagactcagacatactatagcaaagactcaacttgaacaaattgccttttaaatttacctctcatattcctttccttagcaaatgggaataaccatacattgaagcaggaaagactgcagttagacataaggaagagcatcatatagctacaacattgagactggcagtactagaagacattatggaacatttttaaagtttcttcttttctttttttttcttttttctttttttacttgtttgtttgatgttattcttgctgtttgggcagatgggttgttcataaaagaccacatgattattaaagacaatttgaaggggtaaagagaaagccatttatcctggatggtttaccagtctgaaggaggaagacaaccttttacctcaaaaattatatgattttactctctgattttcaggtgacctcaggtccacattagccctgcaatgcggaaagttttttcttgtaccagggacggactccttttagagattcctttaatggtgtggaagaatcataattctaatcaacatgaaagcatttgaaaggaaccactgcttcaaatatggctattcaagagaaaaggaaaaagaaggcattaaaattctaagaaattaaaactgttggagaaaattaaattgcaattgagttaaatcttgtgaaaaaaatgaaagaatttcagttttggtatcaggaattttgtacatttgtgggcaccatgtatggtgcagggtagatgttattctgaaaagaacagatttctttaattcatatgctgggattcacttgatccatctcaggcttttatgttgacctgggttatatttttttcttattcttttcccagaatcatccaggagttacgcccagtggaaaaagaatagagaaaaaattacattaatgatcaaattggtatttcatctctaaatcttaactggcacatagaatgtgtaataatttagccatagaggaactctaagtagaaatataagttctattaggggagccttaattttgttttttatgcgagtatttcccagttagtattaagttataaccactttggtattacatactaagacctagtatggatgttgtcaggtttgtgctgaggagaaaagtcagtaaatatttcaaatttaagtcactctgcatatctccatgccttatcaatttactatttgaaatcatttatttcttaaattgatcttataccattattgtataatttttaatccttacctaagagccatcaggaactcaccatattgcatgggacacaacctgctataactctccactgggcattttctgtacagagccaagctaaatcttgctctcgtgaaatcaggcacaagtaagatgtgaacatcggtgcagcattcagaatgtcaccattaaggtgatactgaaaagaaattctaaaagggtaagtaatagatgatctagtacacatctgaaagcagaggagctctgtgcttcgaattaaatataatactttataaaaatggagagcctaaaaaatgatgaacccttgtagaaaactggaattaattactctccataaaaggttttaattttataatttcatttacctttacagaaataatcgtcactcctcatctttattttagaataaccatccattctcaactttatttttactaactaaaatccccttattaggctactctccttacctttcctttcctccctgcaccaaaaaaagaaagaaaggaaaaaggaaacaaaaaacacattcacacaaaaaagccaaaagccatgcattttaaatacccaagacatgaagcctattggcagaaatgacaagtaccgtatggtctcctatttttcatggtcctctgtgaggtcattggtttctcattacagccagtcaagtcatgtcaaacttggagtctgcctcttaccattatttatattaatatctactaaagctccaaagatattctgtgaaaatccaaaactctacctatctgcatatctatctatctatctatctatttattattttttctatctaactgaagactataggaattgcttgtgttttttgaaatatataggagggaaatttagtagctgttactgttgctataactcatatctaaactcatttaggtttgtgttgggaatttgaattagagacaattcacttgaaaaaaaaatgaattagcaaaaaagttagtggcctggcttctcaggaatgcctaccatcagcagggaccagtcacacatttacttccaaacacctaccctaggacccttcttccatctctgtatgagccatgacaaaaattttcttgctatttcagtctattttctttcgtgtgggagctacaaataatgttgcaacaggctcaaaatacccacagccattgaggcccagttgcaagaggatcctctaggacagagttttgtgtttgaatattaaactgttgagatcgtttgttttcactgtgcacagatatgaccaaaaagactggggttgattaacaagctatttgcctaaaagtcccaaaagtttttaaaaactagtgcaagcattgatcattaaagtacacaaattatgtatgtgtgtgtatatatatatatatatatatatatatatatatatatacacacacatatacatatatatacacacacatatctatatatatagatatagatagatatagatatagatatagatatagatatagatatagatatagatatagatagagagagagaccgagagagagtgccaaacaggtttgcccatttgtgggttttcctctcctccagtaagtccaggctcttgtgtttcccaactaatctattaatggctggaactgattgacaactgcaacaaagccagtgtaagcactgtgggagtcctaattgggtagttctttataaagggaattgatgactgagtaaatatggtattgaaagtagatggtaaacatacaaaaaattaagcacaaattagctagatttagagtataaatacttacgattggaggacctgagaaaggttttgaaatttattcagcaaataaaaacgtgaggccattgggaaaatagattttcttgagttgatatgtcaacccacaaaagtacttaatttgtgcttgagggctttttattttattttattttatttttgcctggttagaatatgggatctaacaattcatttctaagtaaaatctatgagtttatttgttcattcatttattcactcagcaaattttctctatgccaggcactctgctaggtaaggggtacagagaagaataagatgtagcccttgtctggggagctcacatctattaatagtagaaaccagaaacatgactagacaatcttgatattcaacaatgactataactgacagcagatcctccataacacggggaaaggctggatacaggcagatttgttgggaggctacttcagtaatctagacaataagcaaagtgaatgtgaactaaggtaatgacagagataatggagagaggagtaacaaatatttgaattattatttaaaagaaataaaacctctagaatctaaggacttgatgatagaggtggagtgatgaggaaaaggaaagactccagaaggacttctgttgactgactgggacagcaaggtaattagaagatagttacatcaaccaagatgatatgtacagaaggaatatatttatacatattggtaatacctgattatttgttcatattttggttttgaggtgcttggtggatcacccatatatggacatccagtatgtaattgaaaacatgggtgtggagctcaagagaaaggcatggaccttgatgtttgactgtgatcctataactgatgtttacaaagcctatgcctctgctttcactttctgaccctttttgagtattgtccctttttaacctcgcaaggtttcttcaagttccttattccctcacggtattcactgactgcctagggatccctactgacgaagaagggcaaaacgtgttaccagatctctactcctaaatagcccccaatggtctggatccttttcccccatattccctgcacagccccccactcctgccctcactcctgccccatcaacatttacctatcctgcaactcattccctcacagccctgctaggtggttggctaatctaaataaattagtttatactcagacctaagtgaccaattctggttttgtgcatcatacttcccaagtaatatacagatgcaaagaatgtaggaattgcaagtggaattgtagaatatcagagaagcacttggtgtcaattgggttccttcagtgtttcttaaacaacatcattaaacatcattacacacatataattcagttatttaacaaccctacttttagacttttaatcaacctgaagtcttcgtttcaaatgaattatccctcaccaactgcatttccttccctcagacccacaacacataaccagcatttaattcctgatctctcttattcagctttgtaatttattgctattatttcccagtaaaaccctcattggcaatcaggcttcagggcgtccacaaagacgaatttctactctattcacttgtaactgcctgttaagcaatcagtgaatcctagaagatgagaaatggaattgaccacagaaggttatttaacccataccttcttgttagaaaagaaaaccaaaacccagagagatgacaggactgacccaagctcacacaactattcgtagctgattatagctggaacccaagtctcctgacacctaagccagttttcttcttactatgtaacaattgcttctgtgggcatgctgccatcatatgctttgctcaaaacatagtctccttacataccttagaattaattatcttgactgacaaagctctgtcctccataatttccctttgggcttttagaagcctcagcgtgcaaccaaatacaacttttgtgtttttcaaactgacttttcaatggataaatattcctctatgccaggtgtctcatctcttatcttggcaaggattccatgtaagctggcataactggtgtgggccctacagggctgaggtgggtgataggactgtctatcacctacagctgcaggtgtttgtaacggtgatggtgtgtacaaagttgaaagttgaaaattgtatacagagagctgaggtaaataaaccagagaaataagtctaaatagattgttgaataaaaaagtgcctaaggcaagcattagaaccagagtttagaaccatttggatctgaaagtcagaaaagagatctggttgaaacgggcaagcaggagagcaaagacccaaggcagaattctgttcctgaacctgggcttttgcatgttgcctttagcatattacagagatgatccagatccatttaaaggactagtgacagggacagaaacaataccacaggctgacagaaaacaagtcaaatgagtaccctccctggatcatgcttttggccctctgcttctttgcaagaatcagatgcaagctgatggtcccagaattttatctgctcaggcctagaataagtttcacaactggacaaagttttacacagtgtcagcggctgggcaagctcctgttggcactgttcatttgccacctttcatgtccagtcagtccttggcacctctgttgaaacccctcaagagagtgccatgtatgctggtgatctgatcccacccagtgggaacactttctgatgatgacttgtctgtctcatattgacattgttgtcttatggttcaatagcacatattaaagcaagcttttttttctttctttctttctttatttttgagacagagtctcactctgtccctcaggctggagtgcagtggcacgatctcggctcactgcaacctccgcctcccaggttcaagcgattctcatgcctcagcctcctgagtagctgggactacaggggcgtgccatcacgcctggctaattttttgtatttttagtagagacagggtttcaccgtgttagccaggatggtctcgatctcctgaccttatgatctgcctgcctcggtctcccaaattgctgggattacaggcgtgagccactgagtctggccaagagcacatgattttaaaatgtcagaactctcattacttgggttttggtgtttattttgatgagaaaatcaatattaagggtgtgtcaggcattagcaaggggaaaaaggtcatgaggatggcagctcagaagttgatctctctgatatcagagataagatttttaagacaatcaagatttccttttctcccaaacccccataaaattaaaagtaaaaattgataaataacatcataaggtttgtcaagcaagccacagcaacctcattcaggaatcgtttctgctaaattttctggtaaagaagtagggacaaaatgcccactaacttctaagtgaaagcaagaccctcatattgttctgtctgaactcctttttggctagtttctactgttattcttcaagttcttgttattttcttattttttttaattatactttaagttctggggtacatgtgcagaacgcgcaggtttgttacataggtatatatgtaccatggtggtttgctgcacccatcaacccatcatctacattaggtatttctcctaatgctatcccttccccagcctcccatgcccccccaacaggcctcggtgtgtgatgttcccctccctatgtccatgtgttctcattgttcaactcccacttatgagtgagaacatgcagcgtttggttttctgttcttgttttagtttgctgagaatgatggtttccagcttcatgttcctgcaaaggacatgaactcactgtttttttatggctgcatagtattccatggtgtatatgtgccacattttctttatccagtctatcattgatgggcatttgggttggttccaagtctttgctattgtgaacagtgcctcaagcaagcttttccatcacacctgtagcttcagaaacaattctcaggtttgatgtttgtgttttcagcactccttttctaggcagccatgcagcaagtcctgtgtcatttattctcatgacatgctggcaaatttctgtcctaaacgtcccatcatgctgtattttttccctctttgattgtgtagttcaaggctgccatatccctaggaagctttgtccaatgggcccagcctccaacctgccataacaatttccttctcccaatacactgtcattttgtattcctgggttgcttttgtgtatattttgaggagttgagtgtacttcctctaatcaaatagtaaaatctgtagtctttgatagcagggaccatgtctaatcttagctacgggccaaaagtctcaaatgcaatgtgatcagacaatatatgtaaataagtaatatgaatagtcttgataggtatggaaacaaaatagtgtggaggataaatgcatctgacagtatttggttcccatttgagttctgccatttattagctgtgtgaccttcctcaaggtagttgatatctctgaaggtttggttgcttcatctgaaaatggggtatatctattgctaccccacacagttttattaaacaagtttttaaaggtatctcaggtaaagtgcttttcacagtgcctgacacataatgagtattcaatacatggtagctaatattatggttggcatttatcaggttaattgcccaaacatgtgaattattatgtctgcggtcgctggcatgggtaatctgtggccttggcctgactcatcactcccaagatcattattacagttgtgctactatctccagcatatgttcaactttattctctctccccttgtgctctcccttgcccttctttacttcaagtttcccagacaccttgtctcccactccagattttttttcctatcatgcccatgacatggacctgatcccatactcggtacccagaagctttcctaagctgttctttttgctttagtggtgaacctggggttgaaggaagctcttcgttgtgttcagagctgcttagcactccagggtaaaggcagggttgtattacatgaagctgaaattacatcatagcaattggcgggagggcaagtgtgtgtgcatatgtgtgtctctgtctggatttgtgtgcattgatttgtcagtgattttgtgtagctttgtccaatagttcaaaccctgaggcttttcattctctgaagaggggctggattaggaagggcaaaggcttataattaatattctttttcttaatggttgtaatagcaattggctgtatttgccagttttgcttttttagagatagccgttttaggagccatttaaagaaattatcccatttttataaagtgtcatcaaaccatttatattactttgtgggaaggcagactgctgttggtcaagcctattgagtcaacatcaatcactgaatacctatttttttacctaatcaatcaggtgcagtggaagatataaaaacaggtaaggcaaaagccctaccttcaaaatagtttggttagtacaacgtggataagtgtactttctgaattaggtcaaaagcctcaaacccttaatctatcccagcctatatccccatgacagcaatgaaaatctgcctctcagttctcttactgtgaggagtgtacttgagtgacagccccagctgctaagttctgaatctgccactgcattaggggccatacttttcacagactgctcccagccagtgactaaggacactaggacaggcccatttctgggagatgcagtgttaccagccagcctttgctcccaaagctcccaagatggtggtgggccgctcccaagatggcggcaagccttttgttctctgacttggggttcttggcctcagggattccaaggaatggaaccttgggccatgcggtgagtgttatagctctattagaagccgtggctcacggaagagaactgtggaacccagcgactagtgtttagctcccgggcacttagctgcacaggaacaatagcaagcctctagcctgatcgggagtggcaatgagtgcctcgctggatcagaagcgtagcggacaccctgccagatccggaggggtggaagccagcgatgggtctgtgacaacagtgatcagcagtggtggacagcgagcgaaagctcagctggagccagaaaaaaacaaggaccagaagagtatgcagtttcaagatttaatagagtggaaacagagctcccatacaacgggaggggacctaaagggggttccctctaccggctcgaaatgcctgggtttatatcccgatcattgtccctccccctgtactctcaggcttagatgatttgattatttctttacctcctgcttttagcctaattggtattttagtgagctccctttactacctgatgcgtcaggtgtcagctgagttacaaaccccgtgtttaaaggtgggtgcagtcaccttcagcagctaggcttaggaattcttagcctaggaaatccagctagtcctgtctctcagcaggactcctctgatggatggcttttactctaggacttcccattggctttgccaaaactttttaagaattgttctgcagtttaagactcattaactaactctccattcttccctttctcctcaatagtcacaacagtatcacaatattttggctctgccaggctcctttgtctctctccccattttccctcacgggttctttagccctcagcaaatctcttgcaggtatgatcttgccatgacatctgcttgttagtggacttgaaccaatatatcatacaactctatactttgacttgccaatgttgcttggtcacaagttaaacctgatgagcagtccaatgactcagtagccatagcacaatgtaagaaaaagaacttgcaattattacttcagttctctaagcctttgctatatcttgcagtgttgttgggaagaattatgataatgtaggcaaaatctcaataacatggtaagaacttgatacgttcattcatattaatgagaagataactgtcctactaatggcagttcttatgaagcagcttcttaaatgaatgacagccttttctcattaagaaaactgctagataatatacaaaagggaatcaggaatttttctagtacccagaattgtattgttcttttatgatagaaatcatgagcagtagaacatgttcaatacaggggtctgggctcctggaaattctgcctgtggcttaacttgctaggaatatgtccagtttcttttctgcaggttgtctcaggctgatatggaattagaatttttaaaaacaagataaaaactgaaatagagagaaagaatgaatttcaagttctagatgcaacttaataatcaaatggatatgcttaactaccctcaacaacttcaccaggtctgtgatactacaagtaatcagcagagcacttcacaaagtgaagtgctttcttcacaaaaatagaaaagaaaggacagattctccttccctcagggctgcatcactattgcattgtagagtttgctatactaaggaagaagctgttaggtgtttaacgtagttggcactgagctattgtaatgtattctgttttccaaggcaacaaaactgtgattcttcctttggcaaaaggcacaggcaagctgatcactaatttcacttacttgccctagtgtagggaatttctgtgaagccactgaaaaggtcagggaaggaataacagggcaaggttaccagtgcactcaatcccaagtgtcagtgtggtcgcagagccctaggctgaaggcaaagaagaatacagtacacctagtggtccctgagggtaagaagagtctgtaggctatttaaagctggggttaaagcctttcagattgcctaagtaccattttctgtgttaatggtagatgataataggaagctacaactgaaagttagtgtacatccaatatgcaactgagggcactatatcattatttttaactttgtgctttgcatattttctatgtttctagataaaaagaaatgtgtcaagatttcgacaataaatttccataacatggtcacctttatcctctttctttagtctgccaatatattcactcagggcccaattctgttttccagaatttgttaattgaactaaatcctttagccagcatcagtcaagcaaaaagaggcaaatagagaaagactgctaaccatgacccacaggcaataaaagatcctaatgagccatttaaattgtcaagtaaagattacatgatgttcgctatagttttagcatttagtgtatttggtttctttccaacttcttgataaaacagttagtctattatggtatttctaatgactcacagttaactagagactttgattaaccagaatgactctattatttccaatactaaataatagtcactacaaacttgaaaacatattggccaggctcaaatcacaatgtaggtaacttctcaacaaatacttgagttgagtgcatatggaagctacagagaggcagaggtcagacccaaggagtgtaggaaatctgcctgtgggtagaaatggaaatgtttaaggagtggggcaaagaagctttgtcctctgtaaactacagaggaacattcctgtcatgtcaagggaaaggtcatatgctttctctggaatttcccataagacaagagattgaaagacatgtaacaggaaatataccgcacttaggggtgcaattgggcattgtcttcccaaggaggagagaaaagatatctcaagtcttctgaggtctttccatccttcagaaagtaaggaggaggagagaggtagtagggccaagcacgcagaacactggtaaaagaccagcattccgagtacagcagattatgatataggggctaataggagctgtcctcccctaattagtggtgttggtcaaggggcactctttaggccaagatttcttaacctcagcgctcttgacatttcaggctggacaattctttgctgtggagggccatcttgtgcactataggttgttttgcagcatcccaagctttgacccactgaatgctagtaacaccaatatccccagttatgacaaccaaaaatgactccagacattgccaaatggtctctggaagtcaaaattgcccctaacagagagccactggtttatagggacatttgaagacatacccttatggtaatggaggacgatggcactttcacagcgtggttgagttccagctattactctactagggaataagaccaaagttctttatgtgtttttgtttgtttgcttgtgaccagggttcctgggactcatattcttcaaatttttaccaaatcaaattggtggggctggggaaaatgcttgatattttttgaaaaatgtgacatttccccaaatcttctctttctagatatagcactgtacttctcttcttaaagaaacatggcattttaccttgaattggttatgactttctaaaccctctgacagttagtctttgtcccttacattttgggaaaatgttactttatcatttgaaggcctgggatttttccctctatcattagctctatttgggttactgaggagagctaggaaaggcaggttcagagttcaggaacataacctttgcctgaggctatgtaagttggtaaagcttcctgtgtcagtgacactttgagtaaattctccctttatgtaactatgcaatttacccatgaagacagaaaaaaaggttgatttttgtccacgtcagaaataattcttctgcacagttcaactccttagagaaatactgttttttaggttaagtaagattttccactggcatttgtcattgagaaaaggaaaagaagctagtttttaaaatattcttggccttaggaacctaggcggatatatgctcttttttaaaacagttagagctttaattgtgtgactatttggcatgaaagacagcaaggctgtttttcttattataaagctatcccacacagacatgataaacagcaggaaaatcagccgaagaatgaaaaccaaggggaattaagattgttcagcccatagaagagctggctaagaggtgacttagtaatggtcttctaggacctgaaagacaatcattaggaccagatgctccacatctgcagagagggtggagacacaggaaatgacactatagcaggagaaagcttaaggaagaatttcctggcaatgaaggatgtcaaacatcaagaatacattactttagagattatacaattacctctgggctgttttacattttggtttcaaacaggatagattctgtcttgtgtgagatggctgaggtgaggttttgcatgaagatcaagagaatggacaaaatgatatctcaagattcttcttagttctataattctgtgaaatctgtatctttatatattatttgcactatgtcccccaaggtgctcattttacaatgtgctatttgcattatattttcacttaatggggtttcaatttctgttattcctagttatggaaatttattatgtgacttttgtaccctcttggattgttgaaaactgcaactctgcctcactgttcttctattttccaatactgtattttctccttttgttaattctctcacttttcagtcatgtgtttactcccctgtgaagacctcctgaaagcaggtgcacgctttgcacagtatttagcacaattagtgttttaagccaatttaataactaattattgttttataatttcaaaatgtaatgcagtatgagaaaatgtgatcccatacaatgatattctcatataatctataaacttttcacttgaccttcaccgagtatatgcctttagagccacatttgcagtgtctatgtcaaaataaccatttggttcagtaattttaaggcagggggtaggtggcttcagctagaaagagaaactgtcaatccacttaattggcaactttagattaaaattatcatttgattgcctgaatctttctttgtactaagttgtgttggctgacatgtaggtatgttatatgcctgtcttggtaaaagaacctacagatccatttgattctagcaagaacccatcaaatgccagaggctcctcactgcctaaacaaaattcttaattcatcaacctcacactcaaggttcttaatcttgacatgaaccttcctctgctattttgattcctcagaatgtgtcctcttttctaactaaactgttcctgtcatgttatgcttatcctaaaatccactgcttgctcagatgctttctattacctgaaaattaccatcctctccaattatccaatcttctttctcttcattttactgaaattattatcattgtcatcatagatactacttgttggtggctgaccacgttaagacactgtgataagccttcaaattcattatcgcacttagtatttgcaaggacactatgtgatacagattattgttcagagttcatttctaatagcttctcttccaagagaccttttttaaccagttgaactccagtaatgcccccttctctgaacggataatacttattatctttaccacttattaatcttacttcacagtttctctcataatattatttccatgagtaaactgtaagacttgaagggaagaactgtggcttatactaatttttatagtagtgtaaatgcaaaatatgtaataaacccacaataaacatagtactgtatggaaggatgaaaaaaaagatggacaagtggatgggaagggtgaccaggatcaggtcaagttacaccttgtggcatcaatggtatgttatcgcttcattaactaatatttattgggcatctactgtatacaaatactgtgctgtaatctatgagggataaaagagaaggggaaaatactgcttttgttcacaatatagataggaagacaaaacaaaagccaaacaaaccaaaagaaacaataccaacatggtgctgaactgagcagcatgatatagtaatggaatacggaaaatatagcttctgaaatccctaaaatatatcctcctttttcagtttccttaggaaatttcagttttcttcagaaacttgaatttcctcctttaattctgcacataaaaatgcatgagaatgtgacacatcaaaataagagaaagaatttgtgatgctgaaaaatggaacctcgacccattgtttggcatagtaatggcatcacagatgtattataaaattgaacatttctgaaactcaattagtgtaagaatccaggcaaagaaatttaaactatatctgatatagcaatgatattttatgcatctgagactgtgtggtcatttttcctccctcccttcttccctcccttcctccttccctcctttccttccttccttcctcccttcctttttttcttcctttcttccttcttgctgagactttttcttttaatgcagtagacagtagtgttattttttccctgtaagtagaacaattttaaaccctaggaaaaaagtgaaaaacatgttcccttcctcacactcaagcaagtattactcatatgaagtttaacttgaaggtatatctttaaaatttctcaagataaatactccttcctctcagagattaaattgttttgacttaaaagaaccagggccatccactgttttttgtgtatgtgtttttgcttgtacatatatttggcaggaggatcagtgaggaggctgagtatcagtcttctttataaactggttttgagtctcctttgtgattgtcaaagtatgtatacaaagtgtggttgtgtgtgtgtgtctgtgtatgtgcacacacacaaacacacacacacacgcacacaccctttatgttagagaattgaattgctacaagtaacatacttcaaaagtgcccaacttgatccaaggatgaaaaagaagccacagaaatctcaaaagcaagccctggagattccagcggcttggctgtgagttactcatactttgacctttgaggtgatggctgaaactgaatgcttaaatcttttaaactccacactccagaagaactttgtgaaatattgtaaactcctgtcaatatttctggaggccagcagaagatagaaattaggtctccctctcctctacccaaatggaggaataagagctaatttttcttttaggccacttagctcctctctaggtcaacactccataggctcaacttctacttttcttttatcccctttaatctcttaccttagcctgtgaaacatgaaggtttaaatctggattgatgagatgtttctttgatattttgaataaagtttataatcaatattcagtaataatatggattatggctatagtaatttgagaagttgctaagtggcttgccttcaaaactgtatcaaatatggtcctatttgactattttcagtcagaatattttaaattaaatatttaaaagtcctcagccttcctttctagtcctccattgcttgtgtgccagtatctattaccaaacaggctaaaaacatcttattttatttgcttttctgcaaataagctccattttaatactgcaaccaaagtcatgtttctggcatttattgacttcctgttttagaatagtttcccttctttgcttttcagaacacaccactatggctttcagatacacatcaacttgttctcctgtcatcagaatttgggctgaaagaaaatgaatttggaaaatctgtgagacctaggtacagatcactctccagtttaattctccctccctgctcttcccacttatcccattgacagacaatccctggagcaagggtaggcagaagcccccgggaagtgtgaatttttcaagaaattttagatttggttgaaatggtggaaaatcctcttgtggttctgagagtgaagattcttcaatatggccatgctggcttacaccttttcatttggtactttaaaactttggatgtttctttctgccgtaagcctaacataagtgatattaggtcatacacttgatctgttcctaaaaagtgtccaagtatcacttttctgtgctggaagcaaacatctatttgggctctaaatcaggacccaggcacaaagtaccaatctttagtctgtgacagtggaaacttatggggcaccccatctctcccaccatataacatctcatcccatctcatcccaacccatctcattctgtatacatatataatttctttaattacaaaataatcatttctatttctgaaattgttttctgtatttccaattatttagtgacttttggcttattaagctctgtaatctgttgctcttcttatgttccaatggacttgtttggctgcaaaaatgttataaacagtcttagcctattttgcaattatctgtattacttgaatgtcagagtacaagtaaaacacatttttgatgaagagaattcatttaacattttagccataaacctggatctttgaaaaagcatgaatcagacagtagaatgggtcacaattatatcactcttcattttggttttcagtccttctaaaagtgatattttgttgattaaggaattagaccattggcatcaacatggtatatctgacagcacccttcctttatcattgcagttatcaggttttcttgtctttgcttttatacattttttgtttaatttttgtgggtacataggaggtatgtatatttatggagtaaatgagatgtttttatacaggcatgcaatgtgaaataagtacatcatggaaaatgaggtatccatccccttatgcacttatcctttgagttacaaataatccaattacactctgtaagttattttaaaatgtatggttaaattattattgactatattcaccctattgtgttatcaaacagtaggccttattcattctattttttggtacccatcaaccatccctacctccctcccaaccccccactactattctcagcctctggtaaccaaccttccattctctatgtccatgagttcgattgttttagttaacaggttcttgtcggaattgaaatattgggagattgtcatgtaccttttaattttaatttcccattttaaaaatcttttattgttgtagaggttagcaggtgatgggagaaaagagaagcaagtgagttctacatatgcatacccccattatttgtattatctttgttttggagtagatacatgaaaggaaaataattgccattgcataatagcaagtcttcatatcacaacctgtttggttatttttttttactactattcaacaagaaagaacatatttattgagcacgtattttgtgagaagtactacataatgtgctctaggagaccaaaaataactgagatacagactatatccctccaaagaatgtattgtccagtagttgtatcattttttagtacacactttacctttgttttattttcctgcaaagcaagagaccataagccctaaccaatcactcatttgggtacctgtcaagaagtggtatggtttctggaggactttgtggcaatatcttttgctcgagaggtcttttggttctcttctctcttttcacagggtgtacagttgacaaattttgcaaagaatatcacaggttcctctgtctctcaaatcaagagtcttggttttagctgcacaagaagcacatattctctgttctaaagaaagcaataactcattgttcagaatattgtttattctacttctgactttctctagactcatggatcacacataggttacatataactttccattaatatctttgaccatgacaaactattttagatttcttttacctttgcaaatagagtccatttcctccgtgtcacatttataggccctacaaaatctatgatcacactactactatgactctgactctgactactcctattactactactacatacacacgcatgaacacataccctgcacactcatgctattcctgaaaagagcatgaagatatatagtggtagaatgatgttatctgtgatgtcaaaataaaaaattgaggacatccctatatattcctagccatctttaatttattatgagcctgtcatttagaaatttattctaaattctccttgaacctaattgtacttgtactttcagccatttccatcagttggtatatcaaactctgtgtgtctactacctacagtgggaagtataagtgttctgtttaattttcataacattatttctaaggaaattcatctctttgggatgtctcagataatttggtgaccaactttgtgttttctcatccatctgtatcttgatattgtgaacatgtaccttactcagagctatactttcttagacttgagaggtatgtcttactttgcttctatctcccactagagagttcagcatgtagtggtgtactaaaagacctgaatcaacacagtcattatcattcttcttttgttgagatggagtttcgcccttgttgcccaggctggagtgcaatggcacgatcttggctcactgcaacctccgcctcccggttcaagcgattcttgtgcctcagcctcctgactacctgggattacaggcgcccacctccacacccggctaattttttgtatttttagtagagatggggtttcaccatgttggccaggctggtcttgaactcctgacctcaggtgatccacccacctcggcctcccaaagtgctgggattagaggcatcagccaccgcaaccagcctatcctcgttaatccaatggcctattatagtagctatctatcatgtttggaagcaccaaattaaaaaaaaaaaggactttctaaaatctacttaaatagatcacattctgattaataagattattataacatggctggccgactggaccttagagtataatactattagtctatgtgaactattaaagtacattaataatgtataagacccatccttctcacagaaagctgcatagactaagaagttagaaaaaaaaaataattaactcgcccctcctccagttacacacagttcagtgtggagagagtgactccatttgtttaggggaaagtaagggaagagaacaagagtctctgcttggtgatccagggaaatgcccaagaccacaaaagcaatacctccacaagtacgcaagagccacagtataactgggctttgggtgccccctaaagcagatatgactatagttacaaaaatcttgcattgcaacacccacatcctttaaatgcctggaaagctttctcaagaagggtggacacaaacaagctaagattgcaaacactaaaataaataactctttaatatccagacactgactaacatccacaagcatcaagaacccccagaggataggcacagtggctcacacctgtaatcccagcaatttgggaggccaaagcaggtggatcacttgaggccaggagttcaagaccagactggccaacagggtgaaacctgtctctactaaaaatacaaaaaaattgccgaggtgtggtgcctcacgcctgtaaccccagcactttgggaggtgggcagatcatgaggtcaggagttcgagaccagcctggccagcatggtgaaaccccatctgtactaaaaatacaaaaaaaaaaaaaattagccaggcatggtggcacgtgcctttagtcccagctacttgggaggctgaggcaggagaattgcttgaacttggcaggcggaggttgcagtgagccaaggtcacgccattgcactccagcctgggtgacagagcaagactccgtctcaaaaaaaaaaaaaaaaaaaattaggtgtggtggcacgtgcctatagtcccagctatgtgggcggctgaggcacgagaatcacatgaacctggtaagtagaggttgcggtgagctgagatcatgccattgtgctccagccggggcaacagagtgagactctgtctcaaaaaacaaaacaaaaagaaaacaaacaacagcaacaacaaaaaaccaccaacaccacccgggaacacataaactcaacaaatgcactaaataaggcaccaaagaccaatccaggagagacatagatagagacctttcagacggagaattcaaaataactgttttttgaatccaagataacacagagaaggaatgcagagtcctatcagataaacataacaaagagattgaagtaattaaaaagaatagggacgggcgcggtggctcaggcctgtaatcccagcactttgggaggccgaggcgggcggatcacgaggtcagcagatcgagaccatcctggctaaaacggtgaaaccccgtctctactaaaaatacaaaaaattagctgggcgtggtggcgggcgcctgtagtcccagccactcgggaggctgaggcaggagaatggcgtgaacccgggaggcagagcttgcagtgagccgagattgcaccactgcactccagcctgggcgacagagtgagactctgtctcaaaaaaaataaataaaataaaaaaaaataaataaaagaataaaaaaaattctggagctgaaaaatgtaattgacatacagaagaatgtatcacattctcttaacagcagagctgatcaagcagaagaaagatttagtgagcttgaagacaggctattcgaaaataaatactcaaaggagacaaaagaaaaagaataaaaaacaatgaagcatacctgcaagatgtagaaaatatcctcaaagggtaaatctaagacttattggccctaaagaggaaagagagagagatattggggtagaaagtttattcaaagatttaatgacagagaacttcccaaacctagaagaagatataaatattcaattacaaaaaggttatagaacaccaggtaggttgaacccaaagaagacacctcaaggcatttattaatcaaactcccaaaggtcaaggatgaagaaatgatcctaagagcagcaagagaaaagaaataacatgtaaaagagcttcagtatgttctggaatcagattctcagtggaaaccttacaggccaggagagagtggtatgatatatttcaagtgctaaagaaaaaaaactgtatcctagaatagtatatccagtgcaaatgtccttcaaacatgaaggattaatactttcccagacaaacaaaagctgagggatttcatcaccaccagacctatcctacaagaaatgctaaagagagttatttaatctgaaaggaaaggacattaacaagcaataaaaaatcatctgagggtacaaaactcactgctaatagtaagtacccagaaaaacacagaatattacaatgctggaattgtggtatgttaactactcatatcttgagtaggaagatgaaaagatgaagaaataaaaaaataataaccataacaactttccaagacatagtacagtaagatataaatagaaatttaaaaaagttaagaagcagagggacacagttaaagtgtagagtttttagtagttttcattttgcatgtttgtttatgcaaccagtgttaaatttttatcagttttaaataacagggtataagatatcatttgtgagactcatggtaacctcaaaacaacataaaacagatatataaaaaataaaaagcaataaattaaaacacatcactgaagaaaattgccttcactaaaaggaagacagaaaggaaggaaaaaaggaagagaagaccacgaaacaataaaaagacaaataacaaaatggcaggagtaaatccttacttatcaataataacattgaatgtaaatggactaaactctccaatcaaaagatgttcagtggttggatagatttaaaaaaaaacaagatccagtgatatattgcctacaagaaacacactttagctataaaaacacacaaagactaaaaataaagggatggagaaagatatttcatgccaatggaaaacaaaaaagagcaggagtagctatctttatatcagaaaaaatagatttcaagcaaaaattgtaagaagagacaagatcattatataatgataaaggagtcaattcagcaaggggatataacaattatatttgaacacaacaatggatatcccagatatgcaaagcaaatattactagagataaacagagatacagcctcatgcaataatatctggagacttcgacacatcactgtcagccttggacaggccttccagagagaaaatcaacaaagaaacattgaatttaatctgtactatagaccaaatgagtttactggatatttacagaacatttcatccaatggctgcagaatacaatttattatctgcagcacatagaccattctcaaggatagaccatatgttgagccaaaaaacaagtcttaaaacattcaaaaaagttgaaattatattcagaatcttttctgaccataatgggataaaactagaaatcaataacaagaggaatttggggaactataaaaatacatggaggctggtctgagaatctcaaatattgtagctgtctaatacttatcagtttctaatttctgtccgctgattcacagagtagcttactactttcaaaagagaaagagcttgaaagccattctgcattctttttctacttcccagttgacactggagttgctgcagagggttccctttaaaactagttaaaaagtattccataaaataaatgcaatatttttcatcttttctttcttttatttactaaagatacggacttactttcaaagtctattttcttctttactgcaaagtagatttggcaatcctgagctagatccattccattacaaacttcagataaaatggcagcaatagaaatagattattaaatcattagccagttgtctaattacactgtgaaatctaaagcatacctcctttattgtcactcacagaaactttccctatcttagcaaaatcttcaatcagtgtttatctctcattccttttcttctacactcttcctactttatcttccaccaaagccagaattttcactgctctcatgcttttttgtttctgtacatcagaagctcttccagtgatacttacagaatgctcatgcttatgagtgggaatagcatctgaaaagctttgttagcatgacatctctttatgagctgattccacatcttagacagaactctcagaatctccctttgtaaaatcttagatttttacactgacctttatgttatatggcttgtgttttgtgtacccaatctcttattggatgtgtgactaatgtgagtatcatcaactgatacaaggaaagatgcccaaaataaacaagttagccatggtagtgcttttgaaaaatatacacacattatttgaaactcctcccctcaagaagtggagactagttcctctctcttagagtatgggctgaccttaatgcacttctaacaaatagagtaaaacaaaggcaggtgtgtgtcaccttggcgattcgatcataaaaggtactgtgtcttcctcctcactggctctctctcaggtcgtttgcgcagagggaaatttacagccatgtcatgaggacatttaggtatcctatggagaggcctaccatggtgagaaactgaggcttcctgctaacagccatgtaagtgagccatcttgaagtggatcttgaagacctagtcaagacttcaacctcctaggagatactgaacagaaccagctaagccatacacaaatatctgacaaacagaaactgtgaaataataaatgttgattattttaagtcactaagttttagggtaatttgttacatagaaataggtaacaggatattcataggtttaacaattagcctatcacatctctcaaaaatggtaaaggggattttctatatgatacttacctatatagttgacccttaaaacaacatgtgtttgaactctgttggttcacttacatgtgggtctttctccacaaatatatcagaaaatttttggagagttgtgacaatttgtaaaaactaggagatgaattgcttaacctagaaatatcaaaacaataagaaaaagttatgtaatgaatgcacaaaatatatgtacatcctagtctactttatcatttacacaaatataatatacaaaagtatattacgaaaagttaaaattaaagacactgtatcaaaaaagtttaaatttatcaaaacttatacaaacacagatcatacatggtgccattcccagttgagagaaatgtaaacaaatataaatatgcagtatcaaactataactgcataaaattaactgtagtccatactatactactataataattttgtagctacctcctgttgttattgcagtgagctcaggtattgcgaatatccacttaaaatgctgtgtgctgccaatcatcttcatgtgagcaattcctctctcccgtaaattgagtatcacagaaaaaagtgacctctggtgttattcatgtagttttcattgattttagggcaataccataagctttggataataccatgagaacccatatgaattgccacaagtgatgctggaagtgtccccaagaagcagagaaaagtcttgacatgacaggaaaaagctgaattgcttgttatgtacgatagattgaggtctgcagctgcagttgcctgccatttcaaggtaaaagaatccagcttgaagattattgtaaaaaagaaaagaaaagaaaagaaaatttgtgaagccattgctgcagttaccaaaaatgttgcactttttgaaaaatgcctttttatttagtattgaaaatgcagcttttaggtaagtgcaggattgctataagaaaggcatacctataaaatctaacatgatttaagcaaaagtcaagtcaatatatgataacttaaaacaaaaggaagcatacaaagttgaagaatttaatgccagcaaaggatggtttggtaattttagaaagaggtttggctttaaaaatgtcaagataacaggagaagcagcttttgacaaccaaagaggcagcacaagtttccagatgccattaagaaaatcattgaggagaaaggatatcttcctgaacaggtttttaatgcaaatgaaagtgccatattctggggaaaagtgccacaaagaacatttgttggtaaggaagagaagcaagcaccaggattaaaggcaggaagagataggcgaattctactcttttgtgtaaatgcagtcaggtttatgataggattgctcctatttataaagctggtaacccctgaacctttaaaggaaaagataaacaccagttgccagtctgttgattgtacaacaagaaggcctggacaatcaatgagaacccttttcctggattgcttccatcgatgctgaagtcaagaagcaccttgtcagtaagagactgccttttaaagttcttttgatattgaacaatgcccctgactacccagatgcccctgtgagttcaacaccacaggcatcatagtggtctactttccccaaaacagaatgtctctaatctagcctctggatcagagggccataacaacctttaaggctgattacatacaatactctgtggaaaagattgtcaatgctatggaagaaaacctcctcaataaagagggtgtcagggaaatctggaaggatcacaccatttaagatgctgtctttgttatagaaaaaaccatgaaaacaatcaagcccaaaacaataaactcctgctggagaaaactgtgtccagatattgtgcataacttcacagaatttgtgagagaaccaatcaaggaaatgatgaacaagatttctctttcttatgattttcttaataacattttttctctagcttaaattatcagaatacagtatataatgcatgtagcatataaaatatgtgctaactgaataagtatgctactgataagggaccaggcaacagtaggctattagaagtaagttttagatgagtcaaaattatatgtggatttctacctgcgtgtgggcgggggattagcggccctaacccctgcattgttcaagggccaactgtagttgataatcagtcaagccatcaagcatagtggattttcatactttcacccttgtcttgaatagttatagcccaaggagctcagccttacataaaaggaaattttatgagcctttattttatgcgcgtgcgtgtgtgtgtgtgtgtgtgtgtgtgtgtgtgtgtaatttaagccaccttaacaaagcatcttattgtactgtttttcctcctatcatttgggaggacaaaaagacaacttacaggagaaaacctgttacctctttatggatggaattttaaaacacttgatcttttgaaaactatattcaccataatattatttaacattacttgtttttctgaaaaagacaaataacaagatattttctttcattttgacagattagaagagattaaatttcactgtaaattgtttgctgagtgactgaaataaaatattaattcactagctgagtatgtgtttattgaactggatttatctttttgtcctttcaatagtttttatttttgtttttttgtttttttgtttttttttttttgttgttgttgttgttgttgttttccgagatggagtctcgctctgtcgcccaggctggagtgcagtggtgcgatctcggctcactgcaagctctgtctcctgagttcatgccattctcctgcctcagcctcccgagtagctgggactacaggcgcccgccaccacgcccggctaattttttgtattttttgtagagacggggtttcaccgtcttaaccaggatggtctcgatctcctgacctcgtgatccgcctgtctcagcctcccaaagtgctgggattacaggcgtgagccaccgcgcccggccgtaatagtttttaaaaatgggtttttttttttttttgctgttttgagcaaacatgaagtacaaaatacagaaatttttactttccccaactcaaaaactaataaaaaacccacatagctttataatctattgcgggatctggccagcagcccacaatgcaacagggctctctctttgttcccaggtggataggcaggtcgagaaataatagacacacacaagatagtgaaagctgggtccaggggggtcactgccttctggtcccgtggtgccaacaatgcactgaatataccagcatttattattaagtttagtgagggcgggggtaggttagtgagggatttagtgtcatttgattatgaggtgagatggtcacatggggatgaagtaattctttaacataacatctgtatgcagaagtacagtatacagagaaaggaatttacaatatagtgtgtgcatcggtaatttctaacagagccgtaaaacagaaacacagtctttccataacctattattagcaagatattaatcagcagtaacagttgcagcaaaagctggttacaaacaatccatagaaacaggacttgaagctagacaaccagttagaccagaaattctcagaaggcagtatgccttaaccctaaagaagcctagaagagccgtggcaagatgagggcatttatagtcctatcttatccatatggacaggcgcccctcatgtgtccatttataggctctccacaagggtcgcattccattcccagagctatgaacatctgcttttctgggataggaatcttggtgatgtgaaacctccctgactgcacgtccattcataggctctctgtagggggaagcacatcacgcgctgttggctcattctggcagtccagcctggcattgtctttacacaatcctgcatgcaactttgtatttacaataatcaggagcatttcatcttttattccatagcaatagtttcagggggtctccctacatctcccccttttctctgatttaaatgaaccatagcaatcatagcttggcactgatcacgactggattgaagaatatttttttccaattttacatatgaacaataaaccaatagcacaaattatacacagaacaaaattaacgatagtggatcctcccaaagattttacccattgaatggggttgaggttagataacccctcagagataccgtctaaaacttcaggaccgggtaaagcagttaagtgtgcttgagaggcctcaaaaatctgttgttttagcttgcttatgtctaaacttaaattgtcttcacttctttgtaaatggcgttttactgattcccaattgtgaacagactcattatattgaaacagagttatacaaaaatcagaattattccaatcacattgcatttataatctatgttctaaactcaattctatctcccatccatataacagtttgtcttagatcattaatttgattggccaatttttgatcaatacctgactgagaattccacatccaagtagaatttttttgccatttatccacaaaatgaacagtttgaatagattgatgtaatgcaactccagcagtagcagcagtcacagtaacagcaatcaagcccattattactgcaattaatgtaaaaataaatcgtttactccttttaagagttttccgtagaatattattaataacatggatagaaggggaagattcccaaggcctgtgtaaggctacggggagccaaataccgtctctggctctgactattaaaatactatgatattgattaaaggatgagtcaatacaagtatacaagtaacaattaacacaggtaattatgttggtttttgaactaacatgcatctttcctataataacatatatggtgatttaacacaacttttaagtggtatagttttgttggactccatatagatagtatatatattttgggatggtactcctttttgtgaatatggggtggggggaatgggttgtatgagaggtggtggggggacattagaacgagggggtataagtccttataatctttactgtcccatctttgaattgaccttttgacaattgccatagtgatatttttggctgtatggaaatagtagtgtaaatcaatctgttgtcttagtttttgaggtgacaaggtggatttacttataacactttctccagcccaaactctcataccagtcatagctatggttaatctccataattctgaatgttcaggtcctaagtggggaacaacgagccttggctttggaggggcaacccctgcccctttccacttaagaggaaaaaaggagttaaatctacaatataataggggagggttgtcactacttttttgataagtaatatcatagagaaaatgttgacaatctctatgaccttgagagcaatcattagtaatatgacctttgggagcccaatcaacaatggtgtagtgagaagaattaaataacacagttccttctgaactaacacaatccttccatattaatttgccagcatttgaagacaagttgagaggacatgcaggtcctaaaggcttatattgggatgtgtgaatataatcagtgattcctgttttgatctgccttagaggttttaatgagagccctgataccaagtgtcctaaaggagggacagagtgaccagacggtagtgtgaccacccatgtttgaatatctaataagagacatccattagtgggtcccaggcacaaaggtggatacctaaaacctaaagcgatattgaaaggggttccttcttctgaaggttgggcaggacaaggatcatctacagaaccaggcatccaaataccgtcattaacatagacctcaaaaggagcatccatccatgtcatggctcgagtaagaggaggaaaaggaatataggcccaatatgtatagttttaacagtctgtggggttaaagagggtggaaggatctcattttaaaattatctaacattattttaatagcaagctgcagctcacaattagttgatctctttgtgatctttaccatgttttcaacaatatttaaataaaaataagattacttatttttgtgagttatgtggattccaaaataagttagagtaaaaagcagggtgggtgtttcttaaccttgtacaaaaaagcaataaaagatttcccatgttgattatttctcattcattacgctttctgggattcattggttcaagttttctccgtcttctgcacatgtgcttaatatccccaaaggatgtgaaaggggtaaacattttatattaattatgtatagaaaatcctggcttgtcccacccacaatttcaccttggtaccccatagccaaatacctgagacttcatttcttagaagataaactcaagcatcacattgtcctggtcttgcggcattcttctcttctttttccacccaaagcaatttttctaattaatttttaaattttgagatgaccattttacaatcacatgcaggtgtaataaataattcagaaagatcccatatactctttacccagttttccccagtggtaaactcttctggaactatagcacaatctgacaaccaagatactaacattgatacagtatcataacacagaacagttctatcctgacagaaatccttcatgttgcacttctatagtaacacccatttccctcccaccactatcccctatttaacttctggcaaccactaaacttctctccatttctgtaattacgttactttgagaatgttgaatttgtttatttttctaaaacttttacagtgctacattttacatttaagtcctcagtccattttgaattatttttattatataacttgtgagacttagttcacggttcattattttttgcctatggatgtccagtttttctagcaccatttgttgaaaagcctgtctttcctccattgaagtacttgaagtacttttacatttttgtaaaaaatcagctgggaatatttgtgtggctctatttctgggtttcctgtatatatatatatatatatatatatatatatatatatatatatctccaccagaccacacagtcttgatgactaaagctatataataaatcttgaaatcaaatggactgatttttcctacttttttttttttgcaatactgttttagctattctaagttctttgacttttcacataaatttagtgtaatcttgtctatatctttttttttttttgagacggagtctcgctctgtcacccaggctggagttcagtggcacgatctcggctcactgcaagctctgcctctcgggttcatgccattttcctgcctcagcctcctggtagctgggactgcaggagcccgccaccgcgcctggcaaattttttgtattttcagtagagacggggtttcacagtgttagccaggatggtctcgatctcctgatctcgtgatgcccccgcctcagcctcccaaagtgctgggattacaggcgtgagccaccgcgcccggccaatcttgtctatatctaaaaaaaaaaaatctaactggaatgttgatagtaatgcattaaaccattataacaatttggggtaaattgacatctgtactatgatgagtcatccaattcacgaacacactgtgtctatttatttagatcctttatgattcatttattcagtgttccatatttttgacatacaagtccagcacatgttttgttagatttacacctaagtactttattttttcaatgattgtaaatgacactatatttaaaatattttttggtgtgtgtgtgtgcgtgtatatatattatatatatataccatacatatatacataatatataatatataatatttattatttatttattttgagagagagtttcactctttcacccaggctggagtgcaactgtgtgatctcagctcactgcaacctccgcctcccaggttcaagtgattctcctgcctcagctcccgagtagctgggattacaggcacccaccaccacgccctgctaatttttgtatttttagtagagatggtgtttcgccatgtgggccaaggtgctctcaaactcctgacctcaggtgatccaccggccttggcctcccaaagggctaggattaaaggcatgagccaccacgcctggctggtttttatatttttaattggtgtctatgaattgattgcttagtttataaaaatacagttgattcttgtatgtttatattatatcctgaaacattgctaaacaactctcttattctaggagttgctttttatttttttatagattccctaggattttcaacatagacattatgtcatctggaaatagaggcagttttatttctttatttccagtttgcatgtcttttattttattgttttgctttattgcactggctagaacttccagcaacgtattgactaagagcagtgattttcagctgttgataaggggtcatttggctctgtctgctttcaaaaatttgtctttgtgtttagtttctagaagtttaaatataatgtgtcttggtatggatttctttgtgtttaccctgttagaggtacacccaactttttaaatctataggtttatatttataccatatatgggacatttttaggcattatttatttgagtaccaacatcatttccttttctccccaggactccaatggcttgaatgtgaaaccttttgttatagtcacacaggtcctagactatctattcatttttttttctagtctattttttctctactgtccagaatgagtaattactgttctattttcagttcgatggtttatttcatctatcccctccattctgtttttgagcccatctattgagctttctatttcaattattgtactttttaattctggaattttcatttcgttctttatatttctaattctttgctgggactttctattactatactgaggctttagacttgattcatgtatcttcataattgtttgctggagtttttttattatgactgtttaaataattgccacataattttaacatgtctgtcatcttggtgttggtatccgttatctttgttcatttttttttgagattttcctatttttggtataactactagcttccaatgtaaacctagacgttttgtactatgttcttatttaaatcttctattttagctgtctttctctaatactgctccatcagggaaaatagggaaattagctcattgttgctaggtgaaggtagaagcccaggttccccactcagcttccactgacagccaaagtgagagtctcctaactactactacataggtgagagttccaggttcttccatggtctccactgataccttggtggaggtggctttattattacttggcaattgtgaaaggcctcctccgacagaacccctgtagggggtagagggatgtctcattacagctgagtcggggtagaagtccagacttctcacatggtgtctcacatagatactgcaaaggggcaagaggagtgtgattctcattaacaacaggcagggattaagtcttagctttctatttggccatctctgataccatcccaatggcatgctagacaacttgttacagcatcctaagagtgaatgtctaggctctctagttatcctttgctggcatgggcagggatggtaccatatttttttctgtgatgtttggttggactataataattattatccaaaggctttctatctttctaggcttccccttttttagtcttttagataggaagagcagatctttgctgggctttttatgtctgcgactgttgccatttctgggtttctggcttgttcagtaacaagtctggtgtatatgagacacaaagaagacccagggacctaaccactgtgtcatcccttgtgtcctgtagtccttagcctgtctgccttcttctccctgtttttcagcatcatcttatgtttgctttacacataatatccagacagcttagttgtacctcgtgggaaaaataggagatattatagcgactctatcttcccagaagcataaggctttatttctatttttagttttagttctggggtacatatgcagtatgtgaaggtttgtaacataggtaaacgtgtgccatgatggtttgctggacctatcaacccatcacctaggtattaagcccagcatgcattagctatttgtcctaatactctccctacccccatcccactcgctgacaggccccagtgtgttgttcccctccctgtgtccatgtgttctcattgttctgctactacttataaatgagaacatttggtgtttggttttctgttcctgcattagtttgctgaggattatggcttccagcttcatccaagtccctgcaaaggacatgatctcattcctttttatggctgcatagtattccatggtatatatataccacaatttctttatccagtctaccattgatggacatttgggttgatttcatgtctttgttattgtgaatagtgctgcaatgaacatacacatgcatgtatctttgtaatagaatcatttttatttctttgggtatctacccagtaatgggattgctgggtcaaatggtatttctggttctagatctttgaggaattgccacaccgtcttccacaatggttgaactaatttacattcccaccaacagtgtaaaagtgttcctctttctctgcagcctcgccagtatctgttgtttcttgactttttaataatggctgttctgactggtgtgagatgatatctcattgtggttttgatttgtatttctctaatgatcagtgatgttgatctttttttcatatgtttgtgggctgtatgaatgtcttcttttgagaagtgtctgttcatgttctttgcctgctttttaatggggttgtttgtttttacctcaaaaatgtgtttgagttccttgtagattctggatattagatctttgtcaaactgataaattgaaaaaattttctcccactgtgtaggttgcctgttcattctaatgatagtttctttttctgtgcaaagctccttagtttaattagatcccatttatcaatttttgcttttattgcaatcgcttatggttatttcatcatgacatctttgcccatacctatgtcctgaatgttattgtgtagattttcttctagggtttttatagttttgggttttacatttaagcctttaagccatcttgagttaattttttaataaggtatgaggaaggggtccagtctcaattttgaacaaatggatagccagttctcccagcaccatttattaaatgagggattatttccccattgcttcttttggtgaaatttgtcaaagatcagatggttgtacatgcgcaatcttatttctgagttctcttctgttccattggtctgtgtgtgtttttgcaccattaccatgctgttttggttattgtagccttatggtatagtttaaagtctggtagcatgatgcctccagcattgttctttttgcttgggattgtcatggctatatgggctctttttggttccataaaaaaattagtttttttctaattctgtgaagaatgtcaatggtagtttaatgggaatagcattgaatctataaattactttgggcaatatggtcattttcatgatattggttcttcctatccatgagcatggaatattttttcatttgtttgtgtcctctctggtttccttgaacagtggtttgtagttctccttgaaaaggaacttcatttcccttgttagctgtattcctaggtattttattctctttgtagcaattgcgaagggggggttccttcatgatttggctctctgcttgcctgttgttgttgtataggagtgcttgtgacttctgcacattgactttgtatcctgagactttgctgaagttgcttatcagcttaagaagctttggcgctgagacgatggggttttctagatataggatcatgtcatctgcaaacaaggacattttgatttcctcccttccgatttgaataccctttatttatttctcctgcctggttgcctggccagaacttacaatactatgttgaatagcagtggtgagaaagggcatctttgtcttgtgccagttttcaagaggaatgtttccaggttttgcccattcaatatgatattggctgtgggtttgtcataagtggctcttatgattttgaagtatgttccttcaatacctagtttactgagagtttttgacatgaagggatgttggattttattgaagaccttttctgcatctattgagataatcatgtggtttttgtctttagatctatttatgtgatgaattacgtttattgatttgcatatattgaacaagacttgcatcctgggaatgaagccaatttgatcgtggtggataagtttcatgatgcgctgctgcattcggtttgccgtattttattgagaatttttgcatcaatgttcatcagggatattggcctgaagttttctttttttgttgtatctctcccaggttttggtatcaggatgatgctggcctcatagaatgagttagggaggagtccttccttttcaagtatttggagtagtttcagaagaaatggtatcagctcctctttatatttatggtagaattcagttgtaaatccaactggtcttgggctttctttggttggtaagctatttatgattgctttaattttggaacttattattggtctattgagggattcaacctattcctggttcagtcttggagggtgtatgtgtccaggaatatatctgttttctttagattttttactttatttgcatagatctatttgtagtattatctgatggttgtttatatttctgtggatcagtggtgatatccactttttcattctttattgtgtctgtttgattcttctctgttttcttctttattagtctagctaaaaatatggaacacttcatgaatttgcgtgacatccttgtgcaggggccatgctaatcttctctgtattgtaccaattttattatatgtgctatcaaagtgagcacagcataaggcttctaaaacgatttttaaaaataagaattgtgtccacctgggtacctcttccactggtagaaagtaatgagctcatttaagatcactgaaacatcacaggccagactagagctcattcacagtagcttccatctcatcgtagtttgatgcagtctgttggtaatgataaatatttttctagacacaatttctccttgattggttagctggaaggcaggagagcttttcagtctccctaggtggactgagctgattatgaagagaccacagaaaacttgtcttttccttgatggcatcagactcaatagaatccgcttagggactatacacaggaaagcaagatggggctaactaaaataatgtaggaaaaaggtattctcttgtacctgatgatccccctttggcaaaagggaatctctgtcacttgaacatctatgtctctaaaggaacctgctaaaggttactgctacaaatattgggaaattggttttaccattagattttgcttgataccacattgcatgggctgcttcccaaggtgcaaaagtgttagataaatgtcttcttcaataattacatagtaacaactgaatgtgtaactacatgacaccttgtcaaaactcaattacatagtatttttgttttcctcaactagtgctattatatcagagaaacagttatactaaatcataatgctttagtgatgacatatttatttactaaatgatcaggtatgacatgaaatttcttcttaaattatatttaacaagatacatagtaatttcatcattttctgctgtttgctatgtgaagtaaacctccaattttttaaagtttccagtgtctcttgtggttgttattattcttgtttttgtttattaaaagtgtttattaacacttctgttacatttaaaagacatgttactctttcattggataatgtaaataatttagtttagttttgtcttcctgtttccagctgtgtgttgaagatattttcaagttgataacttagattacaagggaaaattgtcattgaacactgccagatcaaagaaaatgtcactagttctaacagttgctgagaaattgaccctctttgaatgaaatgtaagcattggatcccacagtacaagtaaaacttctttaacttgaagattttattcaataagcatctatatatactgcacattctaaagctcacattacttttctcattctgtgttatttaaaattctgtaatttcctctactcctaatcaccaggctctatagaacaaacaaagagaaatacttgcattaagttgcagacaactttaacaatctgattttacaaaagtcagaaagtatttttttcttggtaatccttatttgaaatgaagcatttcaatagcaggcaaacagcattgttgacacactaatccaagctctctcaatctcagtactgttgacatttaggatctgaaagattttttttggtggaagaaggggctgtcctctgctgtttagtagtacaccactggcctttaccagctaaatgtcagtagcatttcccaccagttgtgacaacccaaaatggctccagacattaccaaatgtaccctagggggccaaaattgtccctagtatgtatcctctaaaaaaagattaaatggaagttaaataatgttctgatggagattgcagtgtagtcaaattctaccacatattagcctattaatgaagtgaagctattcgagaagaacatttcctgagaagaaagctgtatcccctgcccatttgtagttaagtgccaatagggagtttatgtgacctcctgaagctccaattctttgcctgatatcaaaagtatggttacgttatcctgtgcctagtaactaaaaccaagagatgttgacaaatgtatagagaatagaggtgaataataaaaaaagagagaaaacacaaacaatacataaatattagtctgtaagattcagtactgacataaaatatgagtaacacatgagcaataaactttttaaaaaaatcttgtgagtacataggaggtgttgtattatggggtacattagatgttttgatacaggcatgcaatgcctaataatcaaatcatcaaaaatggggtattcatcccctcgagcatatttcctttgtgttacaaacaatccagttatactcatttagttatttttaaatgtacaataaattatttttgtttgtaatcaccctgttgtgttatcaaatactaggtcttatctattatttctaactactttttgtatccattaaccatccccatcccccccaaccctcattacccttcctagcctctgtaaaccacccttctgctcagatgaacagtaaatttaatggaacatatagacactcacaatgcattttataggagacctggtgctcatagctgttcttcaggttatgaagtctattgccactgattttttttgtcttttcctgacttctgaatagttgatactaggagtcaatagggtaatagccaaagtttaagatcaaaagtctctgatacttgaaattgcaacccccacccaatccctgtggagagccctaaggagataccaggtcttatcagagagcaacaattctcttgtctttctttggcaaactagagagtaacaaaggctaatttatattgcatataactaaaacatattataattttctataacaagcagaaacattagttttaaaatatgtatgcacaataaaaaaatgcataaatgaaaaaggcaagatattatttggttaggggatggattacagcctccaaatatgtcaaggaatggcttgcagaaaagtttctcttttttttttttttttactatcatgtgatagacaaagtcatttcttaattacttttcacagcttctaatcccctagacttgtttgctatatggaatcataatgaaagatgcatgaacaacaagctatgatactataatgacacttgaggctctacttaagttataatccaagttatatgtcatggcagatcaagcacttcttttgtaaatactttttgttaaatcataaagttccttactagggggaacataactagctctatgatttaaactcagaaaggtaaccaggaattaaatatcttgttaaaagttcactttcagaaagttcactttcagaacaaggtaaaatcatgactttcatacagacacaaaaattgattaaggatttattttattcatatggtatgagggaaccaggcagatattataactggttcaaaataaaagtcaaaagagctaaaatttttatggagtaaaggaatgttgacaaatggagacaaaactggtttttccaaggtgaagtggatgaaccaaatgtctaacagacagagtagaatttatatatcagttaccttcaacttacaagaagttgcaaaataattcagacaaggaacaatgaacaatgaacagaacaatgattttgcttaaatcaggcctaaaggctagagatgatgtatcatttcccaccaaaacatatcaatttttactaaaattcccctcctttttgatcaaaaaagcctgaaaaattatcttgatcaaaaaataagacatatcatcagactggacctaattatttatgaaagtgcagcaagtgtgctaatttgccatatggaccttcttaagtttattttgatggatgttttcataaagaatctcagattggacttttaaaagctctttattatgtgtggacctgaggctaggaaacaaggattttgccaatagtatctacaaatgtgggtgaatttctttctttctttttttaattttttgagacagagtctcgctctgtcacccatgctggagtgcagtggtgcgatctcggctcactgcaacctccgcctcccaggttcaagcgattctcctcctcagcctcccaagtaactgggactacaggcataagccaccatgcccggctaactttttctattttaagtagagacggtgtttcaccatgttagccaggatggtctagatctcctgaccttgtggtccgcccgcctcgtcctcccaaagtgttgggattacaggcatgagccaccgcacctggcctgaatttctttctttttaaggttctcaaaacgtcctaaagtccctggcttgccaggaagtgaccttccttactcatctgtaagtctgagaaccctggaagccagataccatgccagttttcccaagtttactttgtaagcattggctttataaagtcagctttggtgccttaaaagtatctgttcatatctaattgaataagcataattttcacatataacatcctaggcaagtccttggttgtataaccaatgtttccaattattctccagttaaaggagaataaattcttactgcaactatgcaaatcactacattgctatgaaaataaaaatgttcgataagagtttctgaattctgaaggggtcaacaaggagaataaaatatcatttataaatatttcatttcagtttataaaagcagagtctactaaattattataagttgtagatagtgtaaaagtacaaaagtgtgatacctttcctcaccaatcataagggtaacagccaagactcctataacaaaagataggttaacaagagacaagcatgacaaatttatttaatcaaaatttcacatgacacagcagccttcggaaatgaggacccccaaaacctagaggaaaccatctatatacttaggttcaataaagaatggatagccacgtagaaatgtgattagacaaaagagtatgacctaatggtaatagattgcgtggggggatccagcaaggcctatctgttcagagactggttgacttctctgtgtagcattccttcttcctcagtatgatacacgacctctctggaatgaaggtcttcaagggaaaggggaacagggagagagttacctttctaggtttaatggcttgcttttggggagaggggttctagttttcatgaccctctttggagaagaggaattctggtttccatgacttgctttgggggagaacaaggaggaggagacaggagaatgtaagaaagatcagaaagaccttgcttctgaggcctttctagtttccttcagttcgaagtattcagtatgccaaggtgccatacttcggggtatcatgttctgagccccaacaatagcataaaagacaaaggacttccttatacatcttgaaaagaaaacattaaaacatcaacaatattatttaaaaatttacatcataggccaggcacagtggtgcacgcctataatcctagcactttgggaggccaaggcgggtagatcacctgaggtcaggggttccagactagcctggccaatgtgacgaaaccctgtctctactaaaaatacaaaaattagttgggtgtggtggcaggtgcctataatcccaactactcaagaggctgaggccggataattgcttgaacccagggggcagaggttgcagtgagccaagatggcaccattttactccagcctgggcgaaagagcgaaactctgtctcaaaaaaaaaaaattatatcatatcattcagtcttatataattattcttgctccataagatcttgtattagcagaagcctatacccaaaagtacctgttgtaatccttttccatgaggctctgagacagtcatccttttttaatgacgaagcactgaggactgtagttgattgcatatgctttcaagaaaggatcagagtaaaacaaacaaaaaaaatatctaagacaaaagactatggttagttattactgatagctttcaaaagtgaaaggtctaatgagcatttgttgtaagaaaaatgcagctgacaataaaatttggttttttctttgacatgcaatacaagatagttaagcctgccgaaaaaagttttagacaaaataattataaacagtgattaaatctattattaaagaagatagtgaagattacatctaaattataaaaatagatgaatatatcctttacagagaaaaaatcttgagatatataagtctgaaataatatgcaataaatatactaagcatatagtaagaatatgccaaaaatatgtcaatattaagtaaaaagattcagtaagtatggaatacaccacaaacatctgtatattaataaaactccatagttaagtgatgtgaattcctatttgaaatctagtggcctagaagatgccattttcaatttaaagtagcaaagttgtaaccaagttaatattttttaaaataactgaaattatgactgataacactatactgctgtcatctaatatcagacaaaacaccactagcactctgataaataaaaatatatatcatggacagcaagggctttgacaaatttcttgaaatttccctagcagtataccatttctgaaatatttataccaataatattttagccacacaaatttaacttacagaaggctcagcatcttttctgatttgaaaactattctcatagaactcatcagcagtaacatatcaataaacctaattatttttaacacctctcattttactagatgaaggaaaaaatctttgtgccattgcacagggcctaaaaaggtaattttagttgtaaaagataaggtgaaagctttattttatttttttatatgcaggattagacttggggaaggcaaaaataaaaaacgtcatggtatttgaacatttaagatacaaattggatcataggtgcctgagaaataatacttaattattcatttcaaaatgtcaataaaacattaaaagaaaacttagaagataacgtgattgtaatgaatgtttgtttttgtgaggaaactttgttttcttgaatgaccaaggacattatacagacaacataaaccatagaatcttattgtggtatgacacaaatctttgttatctaagcagattaacgggaaacaacaacaattacaacaataaaaaataacctttcttatagtaggtgaaggcaatgaaccaaggagacaggcctatcaatttaagcaaactctgctaaggtttttaacacagttcataacttttcaaactcaggtattataaagcaagggaagtaaaatgtatttctaccttttgtctatcattatactccttcatcttctggaataaactgacactttactctaggacccatatcaggatgtccacaaggtcagaattaatttcataatattattagtaacattcaatgtgttcattgttgctatctttgaattcatcaataagtgtgcattttaaaaattccccagtttcaatttccaatatagtaagtatcaatagaacctacaaaaaaaaaagctctatgtggtcctcaataagctttaagtgcacaaagagatttgaagagtaaaaaaacagaataaaaaaaaactcctttaggaagaaactactcctttccatggaaaataaaaatacatcaaacacagttgtaattctctgaaactattactcctacatagtctcattcacatatattaattttaaccaaagcaatttctacttcacagagtaaacttccttgcagtgcatccttgcaatctagcagagctcatgaatacacataatacaactttctacagtcatactttatatgatttctcaaagttgcaaaatgaacatgttcattaacagacccaaatatatcatctctctgtagcatatacaaataagaagcaaaagtatataagcttaatattatgattagtaatcaatattttggcattctatcctacttagaaatgatctagatatccaatgactatctattaattaacccaaaaggatatcaactggggtgatcattccaagatggccgaataggaacagctccagtctgcagctcccagcatgatcgacacagaatatgggtggtttgtgcatttccaactgaggtacttggttcatctcattgggactggttggacagtgggtgcagcctacagagggcgagctgaagcagggcggggcgtcgcctcacccggggaagcacaaggggttgggggatttccctttcctagccaagggaagctgtgacagattacctggaaaaatgggacattcctgcccaaatactgcacttttcccaaggtcttagcaactggcagacaaggagattctctcctgtgcctggctcagtgggtcccatgcccatggagccttgctcactgctagtgcagcagtctgagtttgaactacgaggcagcagcctggctcggggaggggcgtctgccgttgctgaggcttgagtaggtgaacaaagcggccgggaagctcgaactgggtggagcccaccacagctcaacaaggcctactgcctctagactccacctctgtgggcagggcatagctgaacaaaaggcagcagacaacttctgcagacttaaacatccctgtctgacagctctgtagagagcagtggttcccccagcatggcatttgagctctgagaacggacagactgcctcctcaagtgggtccctgacccacgagtagcctaactgggagacacctcccagtaggggctgacagacacctcatataggcagctgccctctgggatgaagcttccagaggaaggatcaggcagcaatatttgctgttgtgcaatatttgctgttctgcagcctctgctggtgatacccaggcaaacagggtctggagtggaactccagcaaactccaacagacctgcagctgagggacctgactgttagaaggaaaactaacaaacagaaaggaatagcgtcaacatcaacaaaaaggtcatctacaccaaaaccccatctgtaggtcaccaacatcaaagaccaaaggtatataaaaccacaaagattgggagaaaccagaggagaaaagctgaaaattcaaaaaatcagagcgcctcttctcctccaaaggatcgcagctcctcaccagcaacagaacaaagctggatggagaatgactttgacgagttgacagaagtaggcttcagaaggtcggtaataacaaacatctccaagtgaaagtaggatgtttgaacccattgtaaggaagctaaaaaccttgaaaaaagattagaggaatggctaattagaataaacagtgtagagaagatcttaaatgacctgatggagctgaaaaccgtggcatgaggatttcatgatgcatgcggaagtttcaatagccgattcaattagaagaaaggttatcagtgattgaagatcaaattaatgaaataaaatgagaagacagggttagagaaaaagagtaaaaagaaatgaacaaaacctccaagaaatatggatctatgtgaagagaccaaatctacatttgattggtgtacctgaacgtgatggggagaatggaaccaagttggaaaacactcttcaggatattatccaggagaacttccccaacctagcaaggcaggccaacattcaaattcaggaaatacagacaactccacaaagatactcctcgagaagagcaaccccaagacacataattgtcagattaaccaaggttgaaatgagggaaaaagtgttaagggcagccagagaggaaggtcgagttagccacagagggaagcccatcagactaacagcgaatctctcagcagaaaccctacaagccagaagagagtgggggccaatattcaacattcttaaaataaaagaattttcaacccaaaatttcatatccagccaaactaaggttcataagtgaaggagaaacaaaatcctttacagacaagcaaatgctgagagattttgtcaccaccaggcctgccttacaagagcttctgaaggaagcactaaacatggaaagaagcaaccagtaccagacactgcaaaaacatgacaaattgtaaagaccatcgatgctatgaagaaactgcatcaattaacgggcaaaataaccagcaaacatcataatgacaggatcaaattcacacataacaatattaaccttaaatgtaaattggctaaatgccccaattaaaagacaccaactggcaaatttgataaagagtcaagacccatcagtatgctgtattcaggagacccatctcacatgcaaagacacacataggctcaaaataaagggatggaggaagatctaccaagcaaatggaaagcaaaaaaaaaaaaaaaaaaaaaaaaagcaggggctgcaatcctagtctctgataaaacagactttaaaccaacaaagatcaaaagagacaaagaaggccattacataatggtaaagggatcaattcaacaagaagagctaactatcctaaatatatatatgcacccaatacaggagcacccagattcataaagcaagtccttagatacttacaaagagacttagatgcccacacaataataatgggagactttaacaccccactgtctgtattagacagatcaacgagacagaatgttaacaaggatatccaggacctgaactcagctctgcaacaagcagacctaatagacatctacagaactctccaccccaaatcaacagaatatacattcttttcagcacctcattgcacttattctaaaattgactgcataattggaagtaaagcactcctcagcaaatgtaaaagaacagaaatcacaacaaacagtctctcagaccacagtgcaatcaaattagaactcaagattaagaaactcactcaaaaccactcaactacatggaaactgaacaacctgctcctgagtgactactgggaaaataacaaaatgaaggcagaaataaagatgttctttgaaaccagtgagaacaaagacacaatgtaccagaatctctgggacacatttaaagcagtatgtagagggaaatttatagcactaaatgcccacaagagaaagcaggaaagatctaaaattgacaccctaacatcacaatcaaaagaactagagaagcaaaagcaaacaaattcaaaagctagcagaaggcaagaaataactaagatcagagcagaaatgaaagagatagagacacaaaaaaaaaacccttcaaaaaatcaatgaatccaggagctggttttttggaaagatcaacaaaattgatagaccgctagcaagacaaataaagaagaaaagagagaagaatcaaatagatgcaataaaaaatgataaaggggatatcaccaccgatcccgcagatatgaaaactaccatcagagaataatataaatacctctatgcaaataaactagaaaatctagaagaaatggataaattccttgacacatacaccctcccaagactaaacaaggaagaatttgcatctctgaatagaccaataataggctcagaaattgaaataataatagcctaccaaccaaaaaaagtccaggaccagacggattcacagccaaatactaccagagttacaaagaggagctggtatcattccttctgaaactattccaatcaatagaaaaagagggaatcctccctaactcagtttatgaggccaacatcatcctgataccaaagcctggcagagacacaacaaaaaaagagaatttagaccagtatccctgatgaacattgatgcgaaaatcctcaataaaaactggcaaaccgaatcccgcagcacatcaaaaagcatatccaccacaatgaaataggcctcatccctgggatgcaaggctggttcaacatatgccaacaaataaatgtaatccatcacatacacagaaccaacaacaaaaaccacatgattatctcaatagatgcagaaaggccttcaacaaaattcagcagcccttcatgctaaaaactctcaataaactaggtattgatggaacctatctcaaaataataagagctatttatgacaaacccatagccaatatcatactgaatgcgcaaaaactagaagcattccctttgaaaaccggcacaagacaaggatgccctctctcaccactcctattcaacatagtgttggaagttctggcaagggcaatcaggcaagagaaagaaataaagggcattcaattaggaaatgaggaagtcaaattgtccctgtttgcagatgacatgattttgtatttagaaaaccccatcgtcacagcccaaaatctccttaagctgataagcaacttcagcaaagtctcaggatacaaaatcaatgtgcaaaaatcacaagctttcctatacaccaataacagacaaacagagagccaaattatgtgtgaactcccattcacaattgcttcaaagagaataaaataccaaggaatccaacttacaagggatgtgaaggacctcttcaaggagaactactaaccactgctcaacgaaataaaagaggacacaaacaaatggaagaacattccatgctcatgaagaggaagaatcaatatcatgaaaatggccatgctgcccaaagtaatttatagattcaatgccaaccccatcaagctaccaatgactttcttcacagaattggaaaaaactactttaaagttcatatggaaccaaaaaagagcctgcattgccaggacaatcctaagcaaaaagaacaaaactggaggtatcacgctacctgacttcaaactgtactacaaggctacagtaaccaaaacagcatagtactggtaccaaaacagatttatagaccagtggagcagaacagaggcctcagaaataacatcacacatctataacaatctgatctttgacaaacctgacaaaaacaagaaagggggaaatgattccctgtgtaataaatggtgctgggaaaactggctagtcatatgtagaaagctgaaactggatcccttccttaaaccttatacaaaaattaattcaagatggattaaagacttaaatgttagacctaaaaccataaaaaccctagaagaaaacctaagcaataccattcaggacataggcatggggagaacttcatgactaaaacaacaaaagcaatggcaacaaaaggcaaaattgacaaatgggatctaattaaactaaagagcttctgcatggcaaaagaaactaccatcagagtgaacaggcaacctataaaatgggagaaaatttttgcaatctacccatctgacaaagggctaatatccagaatctacaaagaactcaaacaaatttacaagaaaaacaaaaccccatcaaaaagtggacaaaggatatgaacagacacttctcaaaaaagacatttatgcagccaacagacgcatgaaaaactgctcatcatcactggtcatcagagaaatgcaaatcaaaaccacagtgaggtaccatctcacgccagttagaatggtaatcattaaaaagacaggaaacaacagatactgaagaggatgtggagaaatagaaacacttttacactgttggtgggagtgtaaactagttcaaccattgtggaagatagtgtggcaattcctctaggatctagaactagaattaccatttgacccagcaatcccattactgggtatatacccaaaggattacaaattatgctactgtaaagacacatgcacacgtatgtttacttcggcactattcacaatagcaaagacttgaaaccaacccaaatgtccatcaatgatagactggattaagaaaatgtggcacatatacaccatggaatattatgcagccataaaaagggatgagtttatgtcctttgcagggacatggatgaagctggaaaccctcattctcagcaaactgttacaaggacagaaaaccaaacactgcatgttctcactcgtaggtgggaattgaacaatgagatcacttggacacgggtcagggaacatgacacaccagggcctgttggaggatggggggcttggggagggatagcattaggagaaatacctaatgcaaatgatgagtcgataggtgcagcaaaccaacatggcacatgtatacctatgtatcgaacctgcatgttgtgcacatgtaccctagaacttaaagtataataacaaaaatttttttaataaaaataaaaaaatttaaaaaatgttatcaacttaacgttttaagttatctaaagatcttggaaattatcttcaagctgacatactataaaacataattactggttaaataaagtttgccagaataattattctgtttgattaaacacaaatttacattcttcataatcttcaaccttaagtagatgcaatattagcttattccctcagtaaatctgtacaactttaggaagaacatgccgaagtataataaaatctacacttctacttaataatgataaatcagaaaagacataggtcttttattaagccaaaatattaagctagtctcattcaccaagcacttacctacattatgtgaactcgaattcttaaaatgttttgaattggtttctgaattctgtgagaatacttttaaaatctaacataccaaaaacattagaaattcaatttccttattttctgagaattttaggaatattctaattacataagaatttaaccatctctataagcgaatcctctaagatactttatattctaatttattaatatcacccaaacatagcaaaatattataccctgtcttagtttactcaggctatcaacaaagcaccataaactgggtggcttaatcaacaaaaattttttcctcacagttctggaggctgagaagtccaagatcaaggtgccagcaagataggttttattctgaaggtctcttctcttgacttgtaggtagctgccatcttgctgtggtgcacatgacctcttctttggtcacagtcctatcagatcagggccccacccatatgaccttatttaaccttaattgcctccaaaagagcctatctctaatgcagtcacattgagggttagggcttcaacatatgaattttggtgggacacaattcagtccatggcatatccttacaaaaaaagaagtaaagttccttatgaagtacagacacttagacatgcagacacagtaagagcttatggcatcaattctaaaatatcagccaggagccaagagtaaactcagaagtatataactcattggtccaaatcaatcagatggtctcttcccattcttcaattcttaattgaacttgagcttaaaatagacaaacaaacaagcagaaaagactaacaaatcggattttctattgtccctcagccaacaaagatcactaaaaaccattaatccacttacagagatcactaaatagtcataccacaagaccaaattctcaatgggaagcaacttattggccataaaccaaaacaaaattagtagagtgcaaaataaatattacaaaaacagtgtcagcatagttctattgccactttggattcaccttcttagagccaagtaaagacatgcttggattaaactgttaaaagataattttcagaaaaaggtaaaatcatggctctcatacagatataaaaataaacatatcctaaagattttactcatatattattaaagaagccagacatatgttttaactggtttttaaagtcaaaaaatcacaaatgtatatagaataaagtagtaatgagatgaaatgcaaatggaaacaaaactgatttttttttatgaagaagggtggcatagggtgaagaaaagtcaattaattctccacccagtagcacagactttaaaaattccagttataacatagctgaaagaaaatgagcagatctagaattaaacagggcacaagttttccactgaaaaatagatttctactgaaacacagtatttttttctacaaatagaaataatttggaactattttagaatatattttataatgagttttattgggaatatttcagattccattcctaatatggttttgtacaggttaatcttcaactgagttaacataccctcatagatagtagagttaacaaacatcaccattactatgaccactaccacaacaatcgttacaacgattcttagtctgcatagcactttacatacattaattcacttattccccacaactctgagataggcactaatattatctccatgttacaggcaaataaacgaagacacagataactgaaataatctgtccatgcttacagagctagcaaatgttgatagctagtccactgagatgtcagctagctatttggagactctcacctgtattttaataagttgattaatatgatctacaaaatgcagaagctaaatttcctgaaattgttaactgaggaacattatagcccaggtgctgtgctaagcacctgaagtatatatgtaaatgaagcaacatccttggctttgagttcccagtctagggatggagacagacatgtactcagataattacaaagcaatattcaataacaaaagctagaattaaatgatgcaggggcacacatttcaaagaaatgaatgctgaatgaaaaaaaaaaaaaggtgggagagatgggcaggattgaggttggtgagggccttgaataccatgctaagcaactttgactttatcctgaaggccagagggggctatcgtagggtattaagcaaggaagtgacataatcaggattccattttagatagattgctctagtagcagtatggaaaaagaattagacagtaagcctatatcccaagagaacaatatatcagttatctgataataaaaatacaaaaccctcaaaacgtagtgaactatttatttaagattcttctgtggatcagcaatttgggctgtgctcagctggactattcctctgctgttctctcctgggcctcatccagaagtctgatcatttgtgctagctctttcctggtcctctctatacccatgggttttcaccttaaaagggtagcgtattcttctttacatggtatggcaaacagaataatggctccgcaaaggtgttcatgtcctaatccccagaatttgggaatatattattttatgtggtaaaagagacattgcaaatgtgattaagataaggatcttgatatgatttagatttttgtcccctccaaatctcatgttgaaatgtgattgccaatgttggaggtgggcctggtggcaggtacttgggtcatgggggcgaatccctcgtgacggtcttggtgccatcctcatagtaatgagtgagttgttgctctattagttcacaagagtgctggttgtttaaaagagcttgacatctctcttacttccttctctcttgctccttctctcaccatgtgatatgcctgttccctcttcatcttccctgacgaatgaaagcttcctgaggcccacatcagaagcagatgctggtccatgcttgtacagttggcagaaccatgagccaaataaacctcttttcttcataaattacccagcctcaggtatttctttatagcaacataaaacagactaacacagaccttgagttgaagagattattctagattatctgggtgggcccaatccaatcacaacagtccttataagagagaggcagaaggatcagagtcataaaaggagatgggatgacagaagcagaggtgaaagagttggagagagatttaaatatgctacaatgatggctttgaagctcgaggaagctgggccatgaaccaaggaaccgaggcagcctactgaagctggaaaatgtaaggaaacattctccccctaagcttccaggaggaaagcagccctcatgacactttgacgaatccactgaaagcagttttgggcttctgacttttagaactataagataaatttgtgttattttaacctactaagtttgtggcttttgtcttttataacagcaataggaaactaatacacatggcattctcagggcaacaagagattaaataaaagcagaagctacaagcctcctgaggccttgctcagtagttgcacagtgttacttttgccctgttctgttggtcaaagcaagtcataaggccagcccagattcagggataggaaaatagaattcatctcttgactggaagacctataaagaagttgttgcctcttaaaatgcactgcaacaagttagggggcaattagagtaacgcaggtaagacatgaaaaggactttaaggtgctataggatggatggtaaggaatggagaatttcaaaacatacttagtaggtaaaaccatcaaaatttgatgattaattgaatgcagagggtgaggaagatgaaacatatttgatcctcacatcaaacctgtgaagttaagtaaacattatcatctacctttagcagaagaggaaactgaagcccagagaggttaaatcatttgcttgatgtcccatagcttgaactagaacataaaattcctgacccatgatcttttcttctggttggactatgttgcttacatatcccttccccttcctcatcccctcctgagatctcatattaatggacatatgccgccacttactcttccatctggaatgggtacccttgttcacttctattcttgtgactttatgtaactggtacagcaacatcaacaccttccatgtcagctaatatagaaaaatcaaaggagaaactaataataaaaaggcagatccaaataagccactttttagtaatcacatcaatagaacactacacataatatgatgaattgattaagatttcatttgggaggctgtgatttgtaaaggaaaaatgacctttaaggcatttttcccctggaaatgagactagttcctctttatctccttgtgaatcattagtgagctgaggaatcaacgaacactgaaagttgaggaaggttagcttcatttcttaagagctattatatcatgtagctagtttccttagcaacagtgtacatatctccccacatggtatcttgaaaattgcaaagacaaatatggtaggtgccattcttaaagttatcaaaaaactgcttctaaatgatcctactttgaatttccatgtaaaaaacttattctaattttttgtctaatcattgtagacaaggactgtaacattttataaatcaatggatacatgaggtagttaagcaacaaaaagaggtatcgtattttcagggaaaaatgtgtcagatccaaaggaaactttcagattggaaatcctcatgccaccaaatacagaagatcatgtcttttagagcatgaatattatttgcatgaggcttacagctagatgatattagcctatggactttttcctacggtaggaaatctagccaatataggataagtgttcaataaatgctggttgctattattattataattggaaatttacagaaaataatctaaaaatagaattgcagctgcttccttggtatgtattatccatgcatagaaactcatggtgtgtttaggcctcaagttacaaaaaagtagctatagtaacaacataaaagctaccctttatggagcattactatgactcagacattgtgttaggcatcttaacgtaccatatcatttagtcatcacaaaacattgtacaatagatactactaccttcacaattgtataaatgaagaaattaaggtgaatagaataagtgtcttgaccaaatacccacaactagaaagtgagaaagctggaaattgaatccagagatcaaatccttttctgcctaactcaaatgccatgttcttagtcaattgctctttcacctgtgctgcaatgtctgcatacaatattctctaatgatgtttcatctaaggccaggaggacagttagaggactgggaaatagattcccacttaactgtgacttctctcccaatccttttaattccccacctcatgtatcctgactctgctctggaaaatttaaatgcagcctgctaatattcagtatgtactaggaatgtgcaaagatgtaagaacaggaaatggttcccttcttgaaggagttcataatctaggtagagacattaaggataacacattaaataacgagaatcatagatgactgaataaaaacagtatcaaattggtcattttaaaattttgagacatgtggcgctttagccacataaatcagtaaaacagaaaggataggtcagcccaggactagggtgagggggcctggcacagctggagggcatgattctggatggttagcgatcattccagtgtgtcttatttaaagagatgtgctatctgaagggatgtggttgatctggactatggtaaatagccaaggagcaccaatctggtgtttaggactggtaatacttcaaagcagatgaagtgctaacaatgtgtttattgacgatgaataaatataggacaccacatccaccccccccacaaaagtaataaaatcgagggactagaaaaaattagagtgtcatggtcctggccaaatggactggagttcaaatccatccatgagggaatttgtaagaattttgtaaacatggcagggagaagactgtgacttagggcacatgtgaatacctagggctcaccttaaggataacataggctagccctgttatctggtttcctctccggggaccaggaaaaacctagccaggtacccctggatacgggtttctgggagccaggtgtagctaaaacagggtatttactttaggtggctatgttagtccactttgcattactataaaggactacctgagactaagtaatttattgagaaaataagtttatttggctcatggttctgcaggctgtaaaagcatagcacccacatctactaggctcctgatgaggacttaggaagcttttactcatggaggaaggtgaaggggaagtaggggagtaggtttgtcctgtggtgagagaggaagtgagaaaaagggggggaaatgtcaggctctttaaatagccagttcttacatgaactaatagagctctcgagagctcattaccacgagaatggcaccaagcccttcataagggttctgtcctcatgacacaagcaactcccactaggccccactttcaaccttggggttcacatatcaacatgagatttagaggggacaaacatccaaactatatcagtggcctaaaccaacatagctcaaaaaaaaaaaaaaaacaccaaaatttcagtcaaggaaggaaggcaaagttcttggtaaaaatgcattattaaatgccaatcctgaggtttgaagcaggactataagtgggagaaagaataatgagattaagtggcagaggaatcagcagttgattaggcagtgctcagagtgggtagaagcaagctatttagggctgcgatgtgtacggagagagattgattgacccttttgtttatatgatgccagctgactgcttgggaactatagcggacatggtagcttaaagaatatcaagacaggaagatgaattccagacccacccatggataggatggactgttctaatgtactgtctgctgaagtcagaattggcttagaaactgcaaaggcatattatggcacatgcatataagtacacctgaagattgaatcaatattatgtcttattcatatatacaccactggcatgtttgagttgtgtacaaatgctgttatgatgaataaaataccaatttatgttaaagcattagtgaattagtagctatttttctcattatatatttttcttcaaaattgcatagtaaaaataagagtggtaatccagggaattcttgacattgttaggaccagaatttagaggcccttttctatggaatcactacattaattatgtagttatataagccaacagtttttccctcctgcttcctgagattcagatcagacaataaggatttggttcctaccagagatgtttaagggaggggagtagacacagcatcagactgactccaagtgttgcttctcccataacttgtcatcttctacaatatttaagatcttttacattacacaatcatcatcattgttgtcattgccactatcattatcatcattattattatctgtatttgtataacactctgcactttgcaaagtgctcttatcttcagaggtcgatttgcaatgaagctaatgaggcataagccttacaaaccccctccaaacctcctagagtagctttagcaatgcttttatctgactatatgtttttgtaaagctttccgaagatattttaactaaacttaacttagacactttttctcttgtctggtagcattggagtgaccatgaaaattttagggctttagttaagtaaaatttgagttggtgaaatatttaatttgggtttagtaggacattttcagtgcacagtcacctctgtatatagttagattatgctagccaccccagtatcaaatgacttccaagaaatcatcctgccacccactgtgctgactaaaccaagggccagaggccacagaaccagaagtcatttcaggataataacatgtccttaagtgattggcaacagaagtagaagtgaatgtaagagaaataagctttgaaatatagagagctaaaatcagtctgtgaaaaaatactttatatctaaaagaaaattgagagaaaactgatttttaaaatgggtaggtgttccccaaatttgacagcaattctcaaactttacatgacattagcaataacaattataaacctgaagaaaattcctaaacttattaataaaaaacaaatctcaatcaaccatgctagaggaactattgaattccctttccattctgtttatagaaaatattacgaagttgtcatatgaagagaaaaacaaagtatatgcaatacaagtataagttataaaagttattattgaagtatgtcaggcagttaattcatgaaaatatgtagggttttttttctggattttgtgatgtttgtggcatttatcatcttttaaaatgtgttacatataccagtttattttctcatcctaaaaataatcaattttatacttaattttgtatttgtaatcttgcattcttcttaagacaatcccccttgacttgtataaactttagacacacaaaacctggattaatcccggtgcatgcattctgtcacccaactgccacaatattcctagacaaattatactttacagattagagagatgcacctcactcattcagtctttcagcaaatgtttatgagagcctactacgtgtcaattactcttccatgctctagggatgtagcgatgaacttcacacataaaaatccttgccttcctagatctacattctagtgacattataacaaggtatatagataagttgttatttattctgtgtcatatgatgtaaaatgagtaaataatcttggactagaacccaggtgttttccctccagttaaattctctttctttgattatcttaatttacatggctcttgcttcatcttccacattcctctgtgggatgggatttgtaatccatcatcttctaggcttggacacatctctgctttccctgtgaccttctcaagagtcctagtacaaagctagatgcaattcttagagaggcttatttatttttaacatggcccaattttatctcttttggatgaaacacaccctgaacataaaacttgctgtgcctttttgtccttttctctaggtcactgcttagatttttttgagtttccaagttgcagtcagctcatgttgcagagaacagattcttagccatcaatttttgccttctaggtaaaagcgaataaattactcctttcaaatgtcttcaagcagctgctgaatttttctcaggagtatctgttgttttgttttaaatatattctgagttttgttttttgtttaccaacagaatttttctggctggcaatttcttccacttttcattaattgtggaagtggttggtgttaataagaaagggtaaattctcccaaggatatagaacacagtaaaaacagcagtataaattggtgagggctaagttgttcagtaagagtcactttttctgcattactttcggctccatcactgcattcagagaaaagtgagtggtgaaatcaatttcctatataaatttggcagagaactgaatctgaaaaactgaggcaaaagaggtctattttaagcttaaattattggagataattgagtcatgtaaccacttcattctctatgtttagacagaagcttagacatcatctgattttcttcaaagatgtacattgtaaaaacaatttccctaaataacttgcctagtcttccaaactcaatcctgtaattttattcccttcattccaacatagctgtctgtcattctcccaggcaatgggggttgaaattcttgaaaagcacttaagtctcagtgggacttcatggtgacattttgctaatgtgccttggtaaacaaaacatcctaggttgtgaaaccaaagcctacttctatggcgttgtttttgttttaaacatgtcattaagaaaaaagatattactgcttcagtatttctttgatttattattggtctagaacttgtttattagactctatttagtaataacattcattattttactacccctttatttcatagagaaatatgataaagatctcttaatgatcatgttgatttgataagcagatgaaaggctaaaatttttaaatctatctcataccactaggttgacaaaatttgaaaactttattatccagatgttcttttcaatgctcccctctctactcaagtgctccccagtggtgcttcaggtttaccacccataactctcctcctgctcctctggacctcatcaatatttcctccagggtcacatgtcctatctccctttgggacttcatggcaggtgccctaatgaggatcttaaaaatgaattgaggtttgaatgatgggaaaaactatctgctattcctcttcccctgggagtttaaaaattttaataaaggacaactgaaagtaaaatgcattaacctgagaaaggaatgatagatggaattttgggcactatgcaggccaattaggtttgcagaaggaatgaagggtatggagatgtaagagtagagttcaaacctttacatcataaaacacatagatagtgatctataatgcacaaatacgtgcctacccttgagacaactcaagggtgattttaagtccactcatttagacattttccatctgtttaagaaatgaattttcactataacagctactgttcattaaacaaacaggtacaaagagtatttattttttaatatattgcgacattgaattcctgcaattcctcttaccagcttctcagttggtttaaaatgtgtatgtcattccagtctacttagatctatatcaagctaatcacttcagggcagctgtagattgatgtcccaagccagggaggaactggccacttacctacctgcctgcctgcctgccttcctgccaagtagagcaattgttactttttagctctctcatactccataatgacagttcgactccttaccaatttatttgatcattttaagagcatcttcatagatttcaaaggaaaaactatatccttgttttttgcactgatatcatgtgcattgttgtgttgttgttgatggttgtttgctttttcttttgttttgctgtgttttcctcttttcagaattttgttcttagattgcaagagtgacctctagtgtgaaacatctgtatagttattatctcaagctccagggcctcttatccagccttaatttccataggtatttgtgttatacaaaatataattagcaagacctccacaaatatggcaagttatcatctaagaataaaaactccaagtcaggttttttcttattactactcatttattttattcttaaactttggctaacaaagtacagctgcattctggggattctgggatggcaaaggcaacacttccaaaaatgtctttgcaaggaactagaagtaaattacggcattctttatgagctgggtgtatttgactgcagaaaaaaatgttttgcaggcctcttgttgcccctggcattcctgttgtgaataatcggttggtgcactcccctgttctctttcttctccagaaaaaggaagtgttttccttaccaccatactgggtagatgcaaggcacaaagaacacactgtattcttcatggggaaaattaaagtcgacttaagcatatgtcctgccctcacacaaggccagccagaaaatttgcagtatggtcacgggcattgcttattccctacacgaggtaaaatagaagctttaactgcctttcaagagctagctccccttgcaataaaaataacaacccctcatattggcatagtgctttaaaacttacaaagcacttttattcataaaattttacttcatcctctgaccacctttaggaagtaggcattattagtcccatttcagtgatgaaaagtatgaggcccactggggtgcaatgacatgtgcaaggttaaacatatttagtaaatggtggagttagaagtctttggactccaaacttagtgtacattttctcacagattcctcagagtctaacaatcagactttggcaaaataatatataagattttcaaaaataaaaacagtctgcattcatatttctatgagccttgaaaagagaaaagatgatctggttgtaaggatcaaagaaggtttttatggagcaggttatatacttcagtctttaacaaataagaaaaatgtagacagatgaggaaaaccatttcaagctaagcaaaatcagggcaataggaaagtatagcacatctataaaaaatagaaagcacttcaatcaatgtttctaagtgtgggaaggttgtaggaaataattctggaaaagaaagttaagatcaggacctgaaaatcctctaattctagaataagttttcttaatctcagcactattgacatttgggactagattattctttgttgtgggggatgtcctatgcactgtaagatggttagaagaatgcctggtctataccaccagatgcccataacaccacatccctcagttttgagaagtaaatatgtcccagatattaccaaatgctccctctggggcacaacttcaccctattgagaaccatttaaattggtagattatggggaccttttcatattttgaagcaaagttgtgtaatgaatacacctatgcttagggaaaacaaatatggcaaaagtctacagaaaaaaaatggaaaagggaagaggttgaaagccaagaaaaagcccctcaggaagatatgacaggggtctcacaatgtaagggccacagatagctgctatattggaaaaagcattaaacttagaggcaggcacttggactacattgcaagctctgccaacagtcagtgtgtgttcttggacaagtcatttaaaactgtgccctctatttctcatctagagtgagaagatgagaggatgagacgatgatctcaaagttcccttctaactgcattagagaaagatatgcaatgctgtaactaactttatctgcattcattcttctccatatgtcttttgaaagaatcttggtgggtatcaaatgtgtgtttgatttctctgtgtaaagataaacagcataacctcactgtctcagattaagttggatgaaatgacaagtcagaaatagtgaaaaatatgaattattaagtgcattttaaagacatgtagttatattactttcaagtacatgaagtacttagaacatagatgttgaagtattgcttaggcgaggtctcttggaagctagtttagttcattaatttagcatgtactgaaagcacacaatgtgcaaaacactctgctaggcttttcagaggttaccaagatggattagttatgtgacctgccaaagagcttacagtatagtaagggaagttagcaatatacacaacgataatacaaagcagaatgttgtacattccaaacaaattgtatgtgcaagtcttatatacaacaacaggctgatttttagattgcttagtcatgtagaatacagcttaaatccaggttttaaaataatcaaatatatatttaaaacacatacacaactttttcaccgagttgctaaaatatttgagtaagaaaaaatacaagctaaacaattatccatcaactcaactaagatatctgcgtaatatataactgaattgtaatggtaccatacataggctaacctcacttgccagtggagccttaacaagtagacaaaaatggttggcatcaagcaaattgcttatatttaaatggttgttttaaagaacttgtaataattctcctttttaaagtatttaaaatattaaatatactttaaaaaatcttgtctatgctattttgtcccttgctttgggaatctttgttctaaagaagcagcaattttcttttcttttaaattttatttttagttctggggtacatgtgctggatgtgcaggtttgttacataggtaaacatgtgccatggtggtttgctgcacctatcaacccatcacctaggtattaagcccagcatgcattagctatttttcctaatgttctccctcccaccaccccacccaccaacaggagaggcagcaattttaatgttaaagttttactatatacgatgtaaccaagtgcaaattctgtaagaacatttttcccgttgagctgttttctaattttaatgttaaagttttactatataccatgtaaccaagtgcaaattctgtaagaacatttttcccgttgagctgttttctatggtgttccttcttgctgtatcttcaggtgattagcagagccaaatagcaaatgtacaactttggtcaacagattatatctgagataatttttgatttacctactacatactcatgtgcacacatacactatgtaagagggctgtggtaaaaactgatgtaattaattcagggagagaatgccatgtcatttggggtgggggggatgactaataaatagatagatgatagatgaatagatagacggatacagatagatagaaaataaaatatctgtactagtagatatatatgtgtgtgtatgtgtgtgtacctgtatatgtaggccaaagataaaaaaatacagaaaaatcgcagttactcaggaatttgttgtacagtttgtacagaaaactaaactgtgagtgtctttttaacttgagagcttcaggggaaagaggctgttttttaatcagatttttgactacagaagtaaatacaagacagtgtgagaaatggaccaaagtggaagaatattgaggtccctgttggttccagtcaagtagagagatgggtgtaacagaacaattgactttgagatattttccccaactatgtcactcctggtctatttattttacaaccttcatactgtgggaaatatggaacagtataaggcacagtcctggccctaggaagtttataaaagttcagaagactgaacaaaaacaagtgataagaaaactaccaatctaagacatgctatgaagctatctttgataaattattcttagtgacacaacaatccttgaaggcagagactgacatatttaacgtatccccaaacacctaggaagggatcttgcccattgtagatacttgttatatgtttgttgaaatgaagtggcatgcttatggaacaaaatataaaagcttagaaatacaaaatagagagatcactgttttcagaagcctatatgcaagatacttatgaagtaattaatagtgtgactggaaggttgtagtgtgtgatttaattttatagcatttagtattttcatattaaaaaattacagctttatagaagcttataaaggaaagggcagggaacaacttattgaagacagaactagatccagaggagaggaagagtagggatgactgaggagacaggatagttccctgtgaatttggaagagaattttgaaggagagagagaaaggattgttgagcaactgctttgaggactttgagtcagtagatgagtagtgaggaattttagaaatctccgctgttaagcaattcttattgcttaacaattttcccactatttgagaaactgctaaagatacacattaattttcaaagaaaaaaatgcacattacatggtaaagaatggagaacttccttattagctttatcccatactggaaaatgattgggcattatttgatgagactagccaattgttttaccaaggaaggaacaaagagtagtggaaagttccagtgaggaagggttgtgtaaactagcaaggctgagtgactagaatagaggcagtcaaggatactcataggaaaggcaagaacaatgatggagttgggaatccattcctagcaggatggctggctcagttttacaggaggagtaatgtaaagacccagagctggagagtacatggctcaaggaatgcggataaagccctggaggatacaagagaacctcaccaactttgtgaattacattcaggccattcctgcctaagactcagaagctgacttctgacttttcttgtgagcaatgatgggtctttacttttttaaattatgcccttcagcagaggcagcaggagaggtgacttctttattatgatattgctaactgcaataattagctttaatatcctttattttctgtcatttatgtaacctcctgtcttcaaagaacagaacaaaaatattcaaacttattaaatggcatataactgctacactctcccatagtggatacattgaactcatttccttctctcttcaggaacttatggacatggggaaagaaagattacatacaattcaagataaaatccaaatttcaagcaaaaagagatggtgacaatcgtagattggtatcacctgaatacagcactcggaatgatttccacaggcatataaacattgaggttcttttctcccattttgttgttgactctgccttgcaagaatttttgaaaaggcaactcagatcagtttggctcctcttccctttcctttctccctcctccttctttaaaagggttagcaaatgaaagggaaaacttgaacttcaaggccattatttattatttgtaccctggttcattccaaaatggattggtgaagaccggcaaagatacatttaatgctgcaagagaaaaccgatttaaaaataagaaaaattagtcgaattgaactaagcgtttgagaatcaaacaagtactattgagcacaaccatgtgccttgcagcatgctagttcctctaaggaaatgaaagtgaaatataagatatggtttccatccttaaagactgtaacatttatttgggaagaggaggcaaacacctgtgaaatgcagtatggaggagtgtttaggatctttggctctagagtctagctgtctgcttttatatttctcccacttacaatgtttgtggcttcaaacaagttaacttctttctacttttctctgctcattgtaaactgagaataataataccttactccctgggtttctgtgatgattaatttggtcagaataccttaagcacttagcttattttgttgtaataattatataaagcaaagtgcagctaaacttttaacttcctgtgacatgtataaaaatgggattcagagaaagcagagtgtgcattaaggaagtcagggatggcttcatggtatcggtggcacttgagctatattttgatggatgaggctttaagtgagcaaaagtggagggtaaaggcatgccaatcacgtaggctacaaaatagagtataatgaatggcaagaccagagggatttgtcatcaaaggaaattaatagtctaaaagaacccttataatacttcagaaaatcaatactgtgacatgaatctgatcagtaatatgtggacagctttgcgtttcattttctcaactaggcattaaaccttgatatttccattttctaaaggattaaaggatccttgtgggattattttgaacatcatttctagagtcacggtgtgcagacagccaacaagacttatcaaagtgaatgggacctatgttaaaactacagacacatattattcatttattttttgaggatattttaaaaactttccacagctgtgttttaaatctcactataatgtccagaaaacacatcagtattttcttcagtcaccatataatacctggatcaatcttcagatatacaataagaattgccatgtttgtattgattcattttttttccaaacttgtacagcaggatttaactagcaagtcattcctagtaccaaaagttgtgatcttattagtaagggattcaaagtacttttgatgatacagaagttgggaaagtgaaaaagatttctgtttccaatcagatgttctcaaatgacaaaggtgacctcttttttgggaagtaatggttactctgtgttctatttttactactctcttgtctagctgctagaatagacctaactttgtaagctttaacacttaattccatgtagtgtagagccaagtaaataacttttgaaacaaatgaaaataacaactttaaatatgaatttaatatggactgaaaccatttttcaattgatatgattgtatagattggctactctacaaacctagatttctaaatcaatatgggaatttttagtttctttccttcacctaacacaatacaaagaatcatgtgtatttaattttaaactattaattcaatccaaatgaattattttgcaactatatgcacatttgaatacacacatacaacatatttgcttgcttcaactctcctgacatctcaatttgctgagtataatttggacttgctagtatagtgagttaatatccaaggattttgtcttttccatagggagcttttaaaaattcctttgtcaagctgagatatgaaaaacactgggtcaaagaaagcagggtcataagccaagatcagcagagccaacagaagcagccagggtcaggttaggtggagagaacctagggttcaaggcaaggtagggtttataggcaggaaacccactatgaagtaaacagaggttaagggatacacaggaactgggattccaggcacagaaagcaagctgattcaggccaaaaaccaaatggcccagggaccttgacgctaaagttaaaagctacctgaggcacagagatttacatgctttttattttgcagaaggaactaatgactggcactcgagagctaggactaaaagtgacacagttcatcccacttggaaaattctaacactctaggccagctacaaaatatgagaacatcagacctgaaagagtccttagagattctctcagttgaccctataatttttagaagaagaaagtgtggcttattagaggaatgggcttgtcaaaaaaatcaaagcagtatagtggaagggctggggctataacgttgacgtcctaacactagtactctttacatgaaatgtctttgccttgcctacatttggtacccttaaatgtgagatatgactgagaaaactaggatcttaagactctgagccacactccttgtccaaaggaaatgaaaaaggaaaaaggaagcaaagttaatgggcgggatatgtagtaacaatgggggttttattcattcaacctagataaaattcagtaacagaaacttctattgggattggggcaacttggtgacacaactatgtaagtcttataactaaacaattcctcatccagtggactttgtaactcttatctgattgagccaattgtgtaccaaaacaataacaacaataacaacaacaacaatactcctttaaccaagaaaacaatgctctgtctcatcttactttgaggtctgctgctgtgctacttccctctagcacaggcaaataactatgaacatattccccaccatccccaagaaacattacctggcttcacacatacattctttgaaaccagaaatagtagaaagtttatgggtctcagtctctctttgtctatctctttctctctcccaaatcattattctattctaaggttactcaagtattttctcctggtcttcttccttctcagattaattagctttggtagccactgtcttatctcacggtcactgttgtctgggtagaaaatcctacttttttttttttttttttttcggtttccaccatctgggataactaactcatgtctttctgcctcatcaacttttcatctcccttgtatcttactggaagaaataaattctttcttccttcctttagcttcataatagctttatctcaactataatttagaatttacctctgtgactgtttcatttaatttagaaatgatggggagagggctcttctttagaataaagaatttaaaagggctttataaaatcactctgaaatgtcaaacttcttttttttagtagattaaacactgtactacatattggaagacattaatttctgtaaaacaacatcaaagctggttcataatttgacctcagaaaagtcagttaattcctatctgagcctgtttctaaatctcaatgattcattcagtttgtttgagataataatctcagagaaagaaaggaccttggtatttttaccagtacaacattggctgcaagtgggtacttgatatattggatgactgatagaaaaggccagtgtgaggaatgatgaactaccttgtgattaaattacactgatatacatataaatatatatatatatttatatatatatgtgtgcatatgtatgtgtatatatacatacacatacatatacatatatagatatatgtgaatatataggaattttattttcaaaatgagagaatatatgtttctctccctctcagtgaagctacacccggggatcactggctttcagctttttccttcttaacatatagaacagatgatacgtactgtaagaaaaactattaatgggtctcttagtccattttctactgctgtaacagaatacaacagagtggacaatatagaaaaagatttatttggctcacagttctggagactgagaaatctaagagatggcaccaacatctagtgagggtcatcctgtaatagaaggcatcacatggcaagaacatgagtgtgcaagtcagagagatgaaatccagctgaattcatccttttactaggagtccactctctctctctcaataatggcactaatcctgtgataatggcattaattgattcgtgacagcagagcccttattacctaatcacctcttaaagatcctgcctctcaacactattacattggcaactgaatttcaacatgagctttggaggagacattctgctcttggtccctcaaaacttatatccttctcacaatgcaaaatacattccttccataccaatagccccaaagtcttaactcattacaacataatctcaaaagtctaaagtctgaagtcttatctaaatcagacatagatgagatttaaggtatgatgcatcctggggcaaattcctccatctgtgagcctgtgaaattgaagaaggtatctacttccaaaatacaatagtgggacaggcatacaatagacattcccataccaaaatggataactggtttcaagtaagtccaaaacccaaaatggaatacaacatttaatcttaaaactggagaataatttgctttgcctccctgtcccatatcctgggtacactggggtatgtggctgggtcctcaaaccctcaaaccctttggcagccctaaccctggggcttttatggattcagtctactcagcaattctcacaggttgtagtctcatgcctgtagcttttggaggctggtgttatatgcttgtggccctacagttctggggtctctgaggtgaccccactcctacagccacactaggcattcccctagtgggaactgtctgtggtagctctagccctgtggctggttttaccctagggccctaggctatcaacagcatccatgcacacacaactcttgcattttgcaagcctgcagacttaactccatcaagacttatagattataccttccattttggcaagtctagctacatctgggccctcttgagccatggctgggtggctgaggggtgctacgctgggattcagggagaagagtcctaaggtggccctgagcagtgagcctgtatcagtttattcccacactgctataaagacactacctgagactgggtaatttataatggaaagaggtttaattgactcacagttctgcttagctggggaggcctcaggaaactaacaattatggtggaaggtgaagggaaagcaaggcacatcttacatggtggcaggagatagagagtgcacagtggaaactgccacttttaaaaccatcagatttcatgaaaactccctcattatcatgagaatagcatggggaaaactgcccccatgatacaatcacctccaacctggtccctccctttcaacatgtggtgatgccttcccaatagtcccccaaagtcttaactcattccagcattaactcaaaagttcaagtccaaagtctcatctgaggaaaggcaactccgttccacctatgagtctgtaaaatcaaaagaaagttagttacttccaagatacaatgggggtacaggcattgggtaaatgttcccattccaaatgggagaaaatggccaaaacaaagaagccacaggccccaggcaagtctgaaacctggccaggccatcattaaatcttaaagctccaaaatctcctttgactccatgtctcacatccagagcatgctattacaaggggtgtgctcccatggccttgggcagctctgcccctgtggatttgcaaggtacagcccctgtggctgccttcatgggctggtgttgagtgcttttagccttttcaggtgcatgatgcaagatgtcagtggatctatatttctggggtctggaggatggtggtcctcttctcacagatccgctaggtagtggcccagtggggactctctatcagggctctgaccccacatttcccttccacactgctctaacagaggttctccatgagggttccactcctacagcagacttctgcctggacatccaggcatttccatacatcctctgaaatctaggcggagggtcccaaagctcaattcttgtgttctgtacacctgcaggcccaacaccatgtgaaagctgccaaggcttggggcttgcacactctgacacattttaaaaccatcagatctcatgagaactccctcactgtcatgagaacagcatgggggaaactgcctccatgatccaatcatcccccaccaggtgcatccctggacacatggcaattacaatttgcgatgagatttgggtggaaacacagagccaaaccatatcagagcccatggaggataccccaggcctgttaccccaaacagttctgccctgctagagcccctgagcttgtgatgggagaggctgtctcaaagatcttcaaaatgcctttggggtcttttgtcccttgtcttgatggatggcacctggcttgtttctatgcgtattaattcctttaacaaatggttgcttggccacactttttgtattctcttctaaagatgccttttcactctttaccttgccagcttgcaaattttcaaaatttttctattctgcttccctttttaagtattaattccatctttaagccatctctttgctctcatatctccctatatacaatgaaaagtagccatacagtagcctgaataccttgctgcgttgatatttcttgtaccagatgccctagtttatcacttttaagctctgcattccataagccctggacacagacacaatttcatcaccttctttgccactttataaaaaggatagcctttactccagttttcagtaccttgtttctcatttctttctgatacctcatcacagttgcctttactgtccatattcctaccaacattctggtcataaccccttaagtaatctctaaaaagatcagactttccctacagctctcctcttctcctgagcccttgtcagaattctctttatggtctgtccacatcagtacaagatttttctagccttttcctccagattcgttcagcctctgctcattacccagttccaaagccactcccacatcttcaggtatttgttatagcaacaaccccactctcggtaccaatttttctgtcttagtccattttctgctgctataacagaagaccacagatggtgcaatttgtaaggaaaagagatttatttggctctcagttctagatgctgagaagtccaagagcatcagcacctgttggcattaggtgagggtcatcccatggcagaaggcacacatatgagacagagagaggaaatccagctcaactcatccttttctcagaagcccactctcagaaaacactaacccagttccacaataacattactccattcataagggcaaagccctcatgacctaattatcttccaaaggtcttacttctcaacactgttacattggcaattgaatttcaatatgagttttggtggggacattcaaaccataacaatgaaacatgcctcatatacaagttatgactttaccccttaactcccattcaaaaagaagtatactggaatgcatatgtgtaagagtgacataatataatggtgacttcagctctcctgtaaatttttaaataactaattcgttaacttcattattaccattattagcaacaatcttcttaaaatatgtcttacaactgaaagtagcatgctccagtgttccatgtgttctgacactggcctgctagactagagcatgtggttcagggcactctcacaaatacagataaaagatttgtgccctgattgtggattatcttaaggaagaaataaacgtcttgaaaggtgaagctacaaagttaaatacataaagcgcagcaggaaggtgattagttttcacattggcatcacaactatccattcttctttttatcttatgttgaaaggccatatcaaagtgtgggcccagggaagaaaggatacattaacagtaacattaatataaactctatgtttaactccttggtaagactggtgaaattaaaattaacttgattacgtaggacaaagatacacaatttatagatttttgtggtagaatttcaggcacctagtcaataaggtagaatgaattgaaatggtaaagatcacctcttgttctaactacagagaaatgctggtcaaaataaggcaaataatttacatgcttagcccagctggaaagcaagtaagggaaattctcaggccttagtgataaatagggagctcaaagtaagagaaaggagtataaattgaaattgaagatctcctggagatatcaaaaccaaatgtggatattcagggtacatgggcttgagtttaggatctatgtgaagtatggagttagagcagatcccagcaaaaatctagaaaactgaatgatttacaaaccctgaaatctatgaaatggggcctagaaaactctgcttattgattcaggaaagtgtacagaaaattcacattcactccagggccatagctatgaatccaaggaaacatttaagagaaactggaactctaaacctgtaccaagcatgggtgtggactctaaattcacataactcatatatgacacaagcccccaagcaaagaaattgacagaaaaactggttccaaaccagtgaaacttgtagggccttggtagaagcaaccttggaacttctctaagggaattcctctataaccctcagcatgtgggactaccacagaaaacaatccctgctgtagatgaaaatacagcaatgaaattataaacctcataagaaaattaaccaccatgatgttgcttcccttgacacaatggaaaaaaaaactgcataccaagaagtagagataataggacaatttaatagagactttaaaagaggttgaaaattgtttaaagagaaaaacagaatggagaaaaattgtttgtcaagaaaagggcagtgatggttatctgtggcctttacaaaaatatctgtctcttgtgtttatttaacaagaacctgtttaatgggagagtaaaaacattcctcccaggagaaattgcagcaatagtcagtaccttatgtgtagtgccaagaaaagagcagtcattttttgatagaccacctcaaggaggccccattttacacagtgccttcattctgatttcttgttctatccaggcccacagccacttggatgcttcctactcacactgaagtggatcttgccactcagccaccaaactcaaataccaatctttcctggaaaccccagacagacatacccagaaataatgcattaccagctatctaggtattaatatttcttaatccagtcaatttgacacctaaaaataaccattatagtttatattacctaatttttcttaaaacatgtaaaaatcagaataaacaaatttctgtgtaatcttaataacagtggagagtatattatgatacgtcttctcaccaaccaaaaatttacttatacttttgattaatgttagtttcaagggcaagttcaagttagcagtgcttaatattctcaaaaataaacaaaaaagatagtcttttcatttgattttttcgtattatttcataagaaggaggcagcaaaaataaacagttttaaaacctgtgtaacaaacagctttgggaacatagggagaccctgtgtggtcccagctacttgggaggctgaggtgggaggatcacttgagccagggaggttaaggctgcagtgagctgtggttgtgccactgcactccagcctgggtgacagagtcagaccccttctcaaaaacaaacaaacagaaaactgagtaactttgtattcccacttttgattatactttgaatttaagtttttttctagaagccctcataactatttaaaatttttcccaggtacaatgataagatgactagaaaaagagttgaaaattgggtcacctctgagttttcctttggatgttaaatggtcgcttcctgtctcccactgataatcaggagtcatttgctcatttctttttctctcattctcaggtaagcctctgaacatcccctgcaaagcattcttcggattcagtggagagtctgggccaatgatctactggatgaaaggagaaaagtttattgaagaactggcaggtcacattagagaaggtgaaataaggtagagagcttgaattgcttatctttctttgctgtcttacgggattctgctcaggattttaattgcaactccaaatcattccattctctaaaagctgatcttatggagagaccaaggatgactgccttaagaaatgccaatgtgtaagcttctaacataagtaggtctttctcccatttaaagattatgtcaccagggtataatgaccctccaaaagctgcctaagcaaattcctttgagtttctaaagctaaaaccactggtactccaacagtcacagcaaaggtccagtctttgaaggtgactcctcagaccactgggcaaattgtttattttctacctgggaacagacaaccttcatatgtcataagtgtaaaactgcagtggcaatggtaagctggtcttcagccaaaataactgttaactcttgttgaatactgtttatttttcccaacatctaatacttatcctgaaaagactgatccttcaatttagtacatgtttagacctcttttcactctcctgttacacaaataattctctggtttatagataccaattctattggttttctaattctatttagtactttctcatttgtacaaaaaagatataaaaatataggtaacctttctcgcctcactcagtttgtgaggtttctctttggtttcagagatgatgatgtgtagtgtatgttcctgattctgataggaattgggattcttccctcttcactcccattaagaatcatgcagtgaaaattaatctaaaatttcagtataactaatgttaaagtttattccttcagttttcttattgaatatagagcagcataaatgagacaagtatgctttgtattatttactatgtttaaatgttatttataattactctcatgacagtttctctccatgtgtctacccaataactcttttctaggggttcataactttgaaggtctgtgaaccccttaagagtctatgcaaaatatttactataggagcatatttctaggcaaaatacacatgaaaaggtgtttgacatgtttagtaatcaaggaaatgcaaaccaaaaccacatgataccactttatactcactaggatgcactaggatggctataatttaaaaagtcagattataggctgagcacagttattcaggcctataatcccagcactttgggaggccaaggtgggtggattgcttgagctcaggagtttgagactagcctgagcaatatgataaaaccctgtctctccccgcttccctgccaagaaaaaatacatatatatgtacaaatcttagccaggcatcgtgctatgtgcctgtagtcccagctacttgctacttgggaggctgaggtgggcacatcacttgagcccaggatgttgaggtggcagtgagtcatgattgttctactacactccagcctgggtgacagagcaagaccttgtctcagaaaaaaaagtcagattataacaaatgttggtaaggatatgaagaaatgggaaacctcatatactgctggtaggaatagccctcctagggatataaacaaagtaaatcaaaacatatatctacaaaaaactggtccatgaatgttcatagcagcattgctcataatagacaaaaatgaaaacaacctaaatgtctatcaactaaggaatgaataaataaaatgtggtacattcatacagtgaatattatttaaccataaaaaacgaaatattggcatatactacaacctgagtgaaccttgaaaatgttctcagtgtaagaagccagaaacaaaaaaaacacatactatatgattcaatttatataagatgtccacaataagcaactttatagaaacagaaaatagattactgggtgcttagcgccagtggggaggaatggaatatagatgtgatagctaaagtgtatgggtgtgtttttgtgtgtgtgatagaacacaacataatataaaattcatcattttaaaattcacaatttaatggcattcagtacattcagaattcatacaaccaccaccactttatagtaccagaacattttcatcactctaaaaggaaacgttgtacccatcaagcagtctggggcttctttataagataatgaaaatattataaaattgaccatagtgatagtttcacatctgtgaatattctagaaaacaaagaattgtatacttttaatggatagattatgtggcatatacattttatctcaataaagctgtttttcttaaaaaaaaaaaaacccttgaaattaattgcctgacacagaacagattttcagaaataaataatggatatattacaaatgattctaaagtattaattgccatttgtactttgaagtttgtaattagtaacactttattaggcaattttaatttaatatttatttgaaatcaatacaactgaattcattttaaattgttatagaagatacatatttaggattactgtcaacgtatctgtgtataaaagaccttaagggtcacttttcattctacagaacaagaaactggtcccaaaatggatatgtgataggtacactagtatatagttagtagcagaagttccatcaccaaaaagctcagagatatgttttgtgatcaaaggtactaattatatgagcctaaggtaataatctccctttttgtatgtgtgactgcatgtaacttttaaaataaacagctttatcagagtataattgacatataataaatcacacaatttaaagtatgcaatttgtaagggcggattgatatatgtgtacacctgtgaaaccatcacccacaatgaagataacatattaatcacccccatgtttcctggtgcccctttgaaatccctccctcccgcccttctccaacaacagggatcttctatcactataaatcagtctgccttgtctagaattttatataagcagaatcatacaataggcacttgttttgctctggattatttcatgtagcacaattattttgagatttctcccatcttgttatatgtgtcaatagttcataccatttttattgccaaatagtattccattacgtgattatacaaaaattactcttctattcacctgttgatggacgacatttgggttgtttccagttaggactattatgaagaaatctgctaggaacattcatatacatatctttgtatgcacatatattttcttttctcttgcctgaatagctagacatggtgtgcttgaattatatagtagacataaatttaatttttagtttattctttaaataaaatttaaatcatttttaaacaaacttttttagaataatttttgatttataggaaaatcatgaggatagtatatagagttcctatataccccataccccgtttccccaattatcgacatcttaggttcttatggtacctttgtaccataagaatactgctcatgtctaggtattcaggcaagagaaaaggaaatatatgtgcatacaaagacatgtatatgaatggtcatagcagctttcttcataatcgtccaaactggaaacaatccaatgtccatcaacaggtgaatagatgagcaaattgttgtatagtcatataatggaatatacttggcaataaaaaaggaatgggccaggagcggtggctcatgactgtaatcctagcactttgggaggccgaggtgggtggatcacctgaggtcaggagttcaaggccagcctggccaacatggtgaaaccccgtctctactgaaaatacaaaaattagctgggcatggtggcaggcacctgtaatcccagctactcgggaggctaagacgggagaattgcttgaacccgggaggcaggggttgcagtaagctgagatcatgctattgcactatagcccgggtgacaagagtgaaactccatctcaaaaaaaaaaatcaaaattaatacattgttattaactaaagacatttctttacacacctttctttagtttttgcgtactatcccttttgttctgcaggattatttaactttttaagaatctgcctaactgtattccaaactggttataattttacaaaagaaaagtgaggcactgctactctctccagcagcaaatgattagagttggtgggagacaaaacatatatacatgagttggataaatcctgaacaagccaccatattaggggccaaatgagtcaaccagctaggaaatgctataggaagacaacctttcaggacttgcaaaatgacattgtttaactgattttgttacatcctgtttctccaccaaatcccccagtaaaataactatattagcagtgacggaaagttccaggaaatttattttgaaaatttcacaagaccctactagctaactaaagtcaccttcatagaagtgccaacaaaaaggcagaaattcccagcctgggactacaggcacataccaccatgcctggctaagatacagtcactcattttgtaatatagtcaggagttgcctaatgatggggatacgttctatgtaatacattattaggtgatttcattattgtgcaaacatcatcgagtgtacatatacaaacctagattatagcctactacacacctaatctatatggtatagcctattgctcctaggctacaaacctgtacagcatattattgtactgaatactgtaggcaactgtaacaccatggtaatatttgtgtatgtaaatatatctaaacaaaggaaaggtacagtaaaatacagtgttataatcttatggggctacctttgtatatgcaatatatcattgactaaaatgtcatcattccacttcatatgtcttgtgtgatccatgatctatttggaagcttgtgtggtttctataattctttcagtctagagccatttatgctaatacaggaactaattaaccatgtcttctagcctccaaagtccttgaaacaaagcatacaagattttatacagcacagcaaattggaacaaatccagcattttaatagaaaaaaattgctaatcatactatttaggtgaaccaagagaagattcacattttttcataacccatatattttctccataaggaagagttctgacggcagaatactgagaatttttaattaggggattcctctcaaaggcatttctagaaacaaaatttatttctggatgcatggcccttattcagtgctctctctgtctgtacaggacattgttaaaaaataccttagactggggtaatttataaacaacagaaatgtattagtcaaagttctggaggctgggaagtcaagatcaagatgcctgtagatccagtgtctggaaagggcctgtgatggctggggtagccctgaaaatctctagaattccttcttctatcgtcctaatgaataccctctggcttccttatatctatactaatcttatcaaacgttttcttggccacactcttggtgttccctatttaacacactctttcattctttgcaacatggctgggctgagaatgtcccaaatctttaaattctgcttcccttttgattataaattttatctttaattcattttcttctctcattttaccataggcaatccagagaagccatgccacaccctcagtactttgcttagcaatttctttcactaaatatcctattgcaccattcacacgttctaccttccacaaagcactaggacatgaagaaaattcagccaagttctttgccactttataacgaggatggccttcacttcagttttcaataacgtgtttctcatgtaagtctgagcccacataaaaatggcctttactgtccatatttctatcaatattctgatcatgaccacttaagtaatcgctgagaagattgaagcttcctctacagttctcctcttctattgaaccctcaccagaattgctccttacagttagttcatgttgatataggctttttctagcctgctcctccaaattattccagcctctgttcattacaaagttccaaagccattccacattttttggtattttttttaaccagagcaccccactgtcagcaccaatttttgtcttagtccatttgggattctataacaagataccttaaatgggtaatttaaaaacaacaaaaatttatagcccacagttctcaaggctgggaagtccaagatcaatgtgctggcagattaagtgtctggtgagggcctgttcctcgtggatggaaccttctgtgtgtcctcacatggcaacaagggcaagggaactcattcatgcttcttttataagggcactaatcccattcatgagtggggagccttcatgatttaatcacttctcaaaggccccacctcttaatactatcacgatggatattaggtgacagcatatgatttttgggagaccacaaacatttagaccatagcaagggcattgctttgggcccatttaaaaattgaatcatagctcttgtgttgtgcacacatttcaaaattgcattgtgtaatataaccaagcagtgaggatgtaaataaatagctctcaggcagttgacttgtggagaagcttccccagaagcactgggtctggcaggagaactagcccctctgcctaggttctcaatttcctgtgcagcagcttgatcctagaaatgtgtgttacaactttttatttcttagtttgccacagaggaatagaggacttaaaacaatacctagtaaaaaaaagcttagatatttactgagagcttgatgagataatgtcacttggacttcagtaagtataacatctgtactcagcatttcccctgctgcttgaatagcattttagatcaaatcctgtctaacattttggagttctcatttgtttgctctctgggtcagtttcaccactgtggtcccgagcctctcctgattttcagcccattgccaaagcacttagaccccactttgggcatacagattcccctttatctccctttaagcagagattggcacagttctcccatgcctctgatgttgctaagagactaagccacaaggaaatctgaacccaaatgtggtaaccattcacaactgctaatctatcccacacaactgcatcacaaccctttcactaactccagaagatataatttatagagatggtaaaataattttatgtgtgcagtaacataagatgtaattgtacaagtttggttatttatttctacaattttaaaatcattccaacaatctgctctctgccaagctctaccatgtttattcagagaagtcaaataattatttcgaggaaacctagtaggaatcataaggggaagacttcttactttctgtccttctgttaaagcttaatgggaactgctgcaaaggaggatcagagagtacccgcacaatgtcctttggggataatgattctaggaaggccacctcagtcctgtaccactacagaacttccttctaatcaatcttacaagaggcttgagaattttgttttaaggaatttgctagtgaggtatgtattctacatagctaatttaaaaagtcagaaaaattgaaccagtcctattaaataagaaataatagtattatagattgcctacagggttacgcattgcatctgattgtcaaaaaagactccacgaatttcaagacaattgctttgtcccaacagagagtcattttcaattataaatctcactttacaaatcgccctatcaatacctaatgttttcttcctcaggcaatactataaaacagtttaccaaatcttttctaagtcttgacctgaaaaacatattcaatttatcttaaggttttcagaaaagcttactaaaatgcaaataattttatttaccttcagttcctgaaaggctgtgagctgaatatggtctttgctggtttgttttagttttggtttcttcactgctgctttttaccactttctggtcttcggtttcattcctttaccttaacatcctctccttgcatgactgaaatgctctaataaagagggaaggtgatataagcatgaaaatttttattcttaaaataaggtgagtctatcttaaagaccaaaactaacctaataatgacccactctttttaaaaagcaatatggagctgtgaatatgttgtttgtccctaaaatacagaggaaataattggactcccaggcagtcctagggaaaatgatgagatgtattttggcaacttctcacacaatttttaatgtcttgaaggaccccacatgtccttggttttcccaaagttgagcttcaaaaaagtattttcctttcttctactctcagctcatcctactggaagaagaaatacagatcaatcactttgctttaatttaaataggtttcaaatctcatcacacctgtatgtgaatgtacacattataaacagcatagttttacctagggccgtccttaatttctagttaactaaaggtacatttttgaaggagtggtgaatactattgatgattccagggttggtcttatccttgatctatgcataaaatactaaaagcctacctaaaacatgtttgttgtttctcttcatttattgagcagattttagatgctcagtctcaactatgttgtgttgggttgtaagctactctagacaaaaacctataattagtaaataataataataataattccagttcatccttttatagtacactgcatattgcaaaagcatttcacatcttaaaacatattggatactcataataaccatctgagataaatactattagctttattttgcagataaagaaactgaagtttagagactgaggaagagctgctgccctttagtgattgagggttcctatagggctagactgaattcatcaaagctagcaagaatcctcaattgtccagaatgttttgttgtactccagatttagactataaaaagtcaaaatctgtcggggactgaaagagtgaaaatcagtgtggactgagaataagcagccctgctattaatcaggctgggaggacagacagataaagccagctgcaaagttagcagaaaacactgtttctcccaaggtcatgcagcagttgtaaaatgccataatgaccccctcctcctttgagtgactactgctttcttaccagtgatgccccaaacctgctttgctgcttacattaactaccagggatacccaactgctaagctatccttgccccataagagaacccagtccctagttaacccccattttttccaatcctgcctcagaaactccaaccaatccaggatttacccctgcttccctaaaacctcatcagaatctttcactgtaaatgtaaacattacaaaactttcttccttccttcaatcaaggattaatccatagttcctctagaatgcccctccctcaatgcattgagccaataaatctgattttgtcagactctgggcatgatgctggacttggagtaataatgctttaatggggaggggggagcaaataacaccaagaaagagatcttgtttaattgaacattttaatttttttaaacatacctcccatccttaattttatcaatcatcattcctggacaatgattactcatactcaggataatgacccagaaactctgcaagacacctagccatcaaaggaggactcagaatacttcaagggaccatttacgatgaatgaaaattggtcttagaaattttataattatttacctcaattaagaaaccaacaggactttctatttaaatttcaggtgaacagaaaattcagttagccagaatttccatccctgagcaattccactaaccaagatttcactaaaatttcattgcatttgtgttcttatctgaatgttatgttatcattcccttcagcattgcttattttagtttatgatctttaggacagcagggagcacctacatgtaaatattagtacaatgtctggtagagcagattgctgtttacaaataagtactttttgataatgaggacagcagaagtgctagtagtgatattgatgatatgggcagatattgaagagtataaactctctggtggcagttcaacatctttataaaaaattcaaagtagcatgtcccctggaagaaactggaaagtaatttggaatctgcctgctaataaagtatttacttgtttactttctccttttattgccttagttaaatttattagaggaagtcaataatgagaaataatgcacagtagtttgagacggtatttgtttattaatacttcccagcttaccacattgccaggcatatataacttttaaaacatctgtttaatggcattgaattgtactaaaatgtgttaatatagtgtcttgctagcattacacacacactgtaatttttagagcagatttaagttcacaacaaaattgagtggaaagtacagagttcccacattacccacaagactccccccactatcaatatccagcaccacagtggtgcatttgttgtaatccatgaacctatattgacacatcctgatcacccaacgtctatagtttacatttagatttcactcctaatgttgtaccatctatgggtttcaacagatgtatgatgacatgtatccaccattacagtatcatacagatgagtttcactgccctaaaaatcttctgtgttccactttatttatctctccctctcccagaactcctggcaactccttatctttttactgtctccgaaatgttgccttctccgaaatttcaatagttgaaaccacacagtacatagccttttcagagtggcttctttcacttagtaatatgcatttaaggttcctacatgtcttttcatgacaaaatactttaaaaaatgcattcatttattcaatgtgcctttactgagttttcttaatgctaccagcaccatgctagttgctagtggtacaaaaattaaagctacagcacaccataaacaagtagttccagtaaaacaccttttgaagaggcaaagaagatttatttatttaataagctttatttttcacaaatagctttagggttacaaagaagttaacagataagaggatacatttttttttgaagagttgagcagaaagtacagagaactctcatatagcccctttgcctctcccagtttcccattttgttaatgtcttgacttagtgtggcacatttattacaattaatgaaacactatacattattgttaaagtccatggttgacagtagagttcattctttgtgttatacagttctatggtttttgacaaatgtaaaatatcatggatccaccattactgtatcatacagaatagtttcactgtcctaaatatcccagagctttgtctattcatctctccctttctcctcaaaaactcttggtaaccaatgatctttttttagtctttatagtctttatagttttgccttttccaaaatgtcatacgtttggaatcctacagtatgtagccttttcagactgacttctttcacttagtatatgcatttaaggtttttccatgtagttctgtggcttgatggttaatttctttttatcaatgaataatattttattgtctggatgtaccacaattgtttacccatttacctattgattgacatattggttatttccaagttttggcaattatgaatgaagctgctataaacacttgtgcaagttttcgtgtagctataaaaagtatgattaatgcatcatactgtaagacaatgtttagctttttaagtaactgccaaaatatctttcaaagtggctgtaccattttgcattcccaccagcaatggatgataatttctattgcttcacatccttgccaaaatttgatgttgtcagtaatactgggtttcagtcattctaataggtgtgtagtgtatgtcattgtctaaatttaaaattccctaatgacatatgacattgagcatatattcagatgcttatttgttatctgtgtatcttctttgattaggtgtctgttcagaacttttgcccatttttaaattaggttgttagtttttttatggttgagttttaagaggtttttgtgaattccatgtagaagtttcttaatctgtatatgttttgcatatattttctcccattttatggcttagctatttattctttcaactgtttttcacaaaacagatgtttatgattttaataaagtccaacttatcaattgtttttttcatggactacatttttgtcgttgtgtctaaaattttatcagcaaacacacaaatgagaaagagaaagaacacaaatattaccagtacagaaaacagaaaaccaccaaaccacaatataaaaaagcaagagacgaaggaaggaaggaaagaaggaaggaaggaaggaaggaaggaaggaaggaaggaaggaaggagggagggagggagggaaggaaggaaggaaggaaggaaataatacaaaacaaccagaaagtaattacaagatgacaggaataagtccttacatattaataataaccttgaatgtaaacaaattaaatatcccacttaaaagatatagattggctgaatgaattttaaaagtaacctaaatatattctgcctaaaagaaacacatttcacctgtagagacacatatagactaaaagtaaagggatggaaaaaatattccatggaaaaggaaatgaacagtaagcaaaagtggctacatgtatatcagataaaacagactttaagtcaaaaacagtaaaaagagacaaagaaggtcattatataatgataaagtgatcaatttggtaagggatatagcaatggcaaatatttgtgcacctaacacaggagcacccagatatataaagcaaatatttttagatctaaaaggagagatagacatcaataaaataatatctggggacttcagcactccactctcaaaaataaataaattatctagacagaaaacaacaaagaaacattagatttaaactgcaccttagacctagtggatctaatagacaattgcagaatgtttcatccagcagctgcagaatatacattcttctcatcagcacatcaacattctcaagaatagaccatatgttaggacacaaaacaagtctcaacaaattttttaaaattgaaatcatatcaagtatcttctcagaccacaatggactaaaactagaaatcaataacaagaggagctttgaaatctgtaggaatacatggaaattaatcaacatgtccctgcacaacgactgagtcaatgaagaaattaagaaataaatttaaaaagtcgagaaacaaatgaaaatggaaacaaaacataccaaaacctgtgggatacagcaaaagcattacttgtttataggtataaatttgtagtaaatacagttaaaagtttatgcttacatcaaaaagtagaaagatttgaaacaaaccacctaacaatgcacctcaaggaactggaaaagcaagaacaagccaaaccccaaattagtagaatgaaagagtagagatcagagtagaactaaacaaaatagacactcaaaaactacaaaggatcaacaaaatgaaaagttattttgaaaaaataaacaaatttgataaaccactagctagactaaccaagaataaaagaaagaatacccaaataaacaaaattagaaatgaaaaaggacacattacaactgataccacagaaatacaaaagattatcagaaactactatgaacaactatgtactaatgaacccgaaaacctaggggaaatggataaactcatggataaatataacctaccacgattgaataaaaaagaaagtgaacccgaacagaccaatagcaagtaatgagattgaatcagtaacgtctcccaacaaagaaaacagtataaagacttcttaaaaaaacaaaaagagaagtaccatatgatccatcaatcccactactgggtatttatctaaagaaaatgaaattagtatctcaaaggcatacctgaacccccatgtttattgaagcactattgacaatagcaataatatggaatcaacctaagtgtccatcaatgggtgaatggataaagaaaatgtagtatatttgcacagtggaatcctattctgccataaaaagaatgaaattatgtcatttgcagcaacatggatggaactcgaagtcattatgttaagtgaaataagccctgtactcacttatatgtaggaagtaaaaaaaattgatttcatgaaggtagagattagaatgatgattaccagagcctgggaaggatgtgagtgtggggcttgggggaggaagagaggttggttaatggaaacaaacatatagttagatagaaggaataagttctgatgttcagtagtagagaagggtgactgtagttaacaacaatgaattatatgtttcaaaatagctgaaagtgaggacttgaaatattctcaacacactgaaatgataaatgctcaaggtgatggatatcctaaataccctcagttgattattgcacattctgtatatgtaacaaaatattaaatgtacaacataaattaaaaatattacgtattaatagaaaataaagtgatattgatatagctggttaaacatctactatatttataacagtttttttattcattgctcttattatttgtttccttttttgttctccatgctttttctgccttctctggttttaattgagcattttatattattctattttttcttctctcttagcatgttatatggtttgcttctttgtactcaccaaatctcatgtggaattgtaatccccattgttggaggtggggctggtgggaggtgattggatcatgggagtggtccttcatgaatggcttagcaccatccctttggtgctgttctcatgatagtgagtgagttattgtgagatctggttgtttaaagtgtgtagtgtgcacctccccacccctctcttcctcctactcctgctatgtgaggatgccttgctctgtgtttgccattccctgtgagtaaaagctgcctgagggctccccagaagcagatgcttctgtacagcctgtggaacggtgagccaataaaacttttcttattaattttacccagtctctgatatttctttataacaatgtgagaatgaactcaaacagcatatcaattatattttcaaatttttaattgtatctctagagtttgcaaaatacatttctaactaatctaagtccacttccaaataacaccataccatgtcacaagtagtgctggtgcatgataatggagtatttccaattccaccattttttaacatttctgtcattaatttgcctatttataagctataattaccaaatacatgattgctattattttgaacaaactgttgcctgttagatacggaataagaataataaaataaaatattttattttgatttatccctgctctaacactattctttatgtggatccaaatttctgatatatatcactttcattttctctgaaaatcttttaacagtttttccaacacaggttgactggtgacaaattccctgttttagtttgtctgagaaagtctttatttatccatcacttttgaaggataatttaactgaatatcacattctaggtttgtaattgttttatttcaacactttaaatatttcaccccactctcttcttgcttgcatgatttttacagagaagtctgatgaatttcctattcttgtttatctataggtgtggtgggtatttctttttacccctctggcttctttcaagattttgtctttaattttatgcagttagaaaatgatatgcctaggtgtaggttttttggtatttattctgctttgtgttcttggagcttccttgatttgtagtttggtgtctgttaataattttagaaaattttccaagcttattaattaaatatttctactgttcctttcttctatttctggtatttattatatgcatattacttctttcgtaattgttcctaaactcttggacattttttacattattttttgtccttttttctctttgaatttcagtttaggaggtttctattgacatatcttcaaatgcattgattctttcgttggctgtcaacatattttgatttctagagtttccttttgatttttttcttagagtttccatctctggttaccttactaatttgttgatatatgttgtccactattttcattggagcccttaatatattaatcatagttatcttatatttccagtttggtaatttcaaaatctctgccatatctgagtctggttctgaatgtttgctttgtctcttcaaactgtggggattttttgttttgttttgctttgctttgatttttaatatgccttgttacttttttgttgaaagccagatatgatgtattgggtaaaagtaactgaagtaaataggcttttaatgtgagattttatgtttatctgactaaaagttagactgtgtttactctttggtatagctataggtgtcagaggctgaaattccctctagtgtttttgttcttgtctccactgtcttgtttgaattttcctcgagattacttcttaaatagggcctgagctttgcaggttttttttttgcaaataaaatcccttattattatacaggagcctgattgatgttgtggaacatatttcaaaattctatgatgtcactgcctttagtgagcttgtgcccctggtatgttaccttcataagtgtttcttagcttcccccatccctttaggtgagaggaaagctagagtagtcatttcccttctcccaggtgggctaggctttggtaaaacctaagtagtttaggtcatgataaagtggtttcccttgagagcaagcttttaaaaaaagaaaagaaaagaaacaggatcttgctctgtcacccaggctggtatacagtggcacaatcatagctcactgcaaactctaactccaaggttcaagtgattctcccacctcagcctcactgggaatacaggtgcacaccatcaagcctggctaattttttaaaattattatttgtagatatggggtcttgctatgtttcccaggctggtcttgaactcctggcctcaagtgatcctctagccttggctcccaaggctagaattataggcatgaaccactacactgagtcaacaagcatttttaaaaggaggacaaagtgctctgggctcattttaaaatggtcacttttccctttccccctgccagaagcataagggaacctttttccaatcttcacagtaagaacttagtagcgcttatgtaggcaaaactcacaaaattgtggggtccccctaaatataggtctcatggtgtttttaactctcaagatagttcatggtgggtctccaggaatttatctattacattataagtgtttgtggtggtactggctttgctcctggggatctcattccagtatgctgtgattctctgcatttgcctttctctcaactttctggggcagaagtttgccctgtgacttgttatttgagggatttaagaaaagttgataattttcagtttgttcacttttttctttttgtgagaatgagaggaacaatttccaaactctttatagtattaatttgtactaatagtaccaatctaaataaaattttggaatatagtgatgtctgtcacctgaactggttactttctattgtatcagtgttcactgctactataacttgcctttaatgttaatatttagacccctctggttactacccctccctcacttgccatggatgcatgcatatgtgcaaactcatcaaattgtatatattaaataagtgagtttttttgtatatctattgtttcaataatcagtttaaaatgtatgtggttcttaccctcccacataatatcaatacttggaatgagatacttctaaggtcatatgaaatatatcccaggattcctcccttataacctcgactctgaaaccagtctctttaatacctctctttcacacattctgcaaaaacctactcttgtcttctattctggaaaaccctcccttcttttcatttagtgagaattttcttaagcattttttggataacttagtcaacagacatactgttgtaagcatgagtgtaccaccctgctttgccttattctttctgtaattttctgcaactgtgtacatcgtgtctcctcatttaaattttaaagtttaatggaagaagggaccacatcttttaatgtttctatttcttgtatgccaaatatatagcccagagccaggcacttactaaatattggaaaagaatcatttatggattgttatactcttcacggaattagaaaaaactatttaaaaatgtatatggaatcaaaaaagagcccgaatagccaaggcaatcctaagcaaaaagaacaaagcctgagacatcacattacctgacttcaaactatactacaagaatatagtagccaaaatagcatggtactggtacaaaaacagacacatagaccaatggaacataataagcaatgccaccaatcaacaaccatctgatctttgacaaagttgacaaaagcaagcaatgaggaaaggactccctattaaataaatggtgctgggattattgggtagccatacacggaagattgaaactggactccttacaccatatacaaagatcaactcaagatgaattaaatacttaagtgtaaaaccaaaaactataaaaatcctgaaagacaacctaggaaatagcattatagacatagaatctggcaaggatttcatgacaaagatgccaaaagcaattgcaacaaaaacagaattcgaaaaatgggactaattcaatgaaggagcttctgcacagaaaaaaaaaaaactatcaacagagtaaacagacaacctacagaatgggagaaaatatttgcaaactatatatctgacaaaggactaatatccagaatccataaggaacttaaaaaaattaaaaacaaaaaaaaaactccataaaaaagtgggcaaagaacatgaacagacacttttccaaagaagacatacatgcagccaaacaagcatatgtaaaaatgctcaacatcactaagcattagagaaatgataatcaaaaccacaacaagataccatctcacaccattcagaatggccattattaaaaagtcaaaaaatagcagatgttggtgaggttgcagagaaaggagagtgcttgtacactgctggtgggaatgtaaattagttcagtcattgtggaaagcagtttggcaatttctcaaacaacttaaaagagaattatcgttcaactcagtaatctcattattggattattgggtatatacccaagggaatataaattgttctaccataaagatgcatgcatggctatgttcaccacagcaatattcacaatagcaaagacatggaatcaacttaaatgcccatcagtggtagactggataaagaaaatgtgctacatatacaccatggaatagtacacagcaataaaaaaagaatgagatcatgttctttgcagcaacatggatggagctggaagccattatcctaagtgaactaacacaggaacagaaaaccaaataccacatgttctcacttataagtgggagctaaatattgagtacatttgaacacaaagaaggaaacaacaaacaccagggcctacttgagagtcttggagggtggcaggagggtactatgcttattacctaggtaataaaataatctgtacaccaaacccctgtgacaggcaatttataaaacaaacctgcacatgtacccctgaacctaaaattaaaattaaaaataatatatttgctagaaaattatgactgctctgttgagtgatttgtagtcataaacaccattttgatctttaattccaaaaaacacaagtcacctatgtttttcaggagctgataattaagacacctcatatatattaatagatgaaccaaggatcatttttcaaatcctctctccagattctttctgcagcctgtgaagagctgtttttggaaactgcattagaagaaggaaaggcttggtttggaagaacaggatcagctttccaccctgtgcctggcagaggctatggctgccctccatgtgaagcttcaaattaaaatgaagttgtggtgcctacgcagcttctggaactacagggggttcttccacagcaggttacacagagctaaaataattgagtgtggtgttgtttaccaacatcagggagaaaaacagcaaaagtcaatataaaccatgaaagtagtaaattcccaattttgtcttggttaggtacatgttgggagagaagagaaaaagagaaactacaactttagtcaggaaaaataaaaacaatttatagaaaaactaaccataagatgtggtctcccaaatgcagttaagaaaattcttatacttgtctggttctgtgatggtacataaatgtaaagggcttgagattttagtatgagagactcagattttagaaactccattccaccaacccaactttaagcccttcctgctctcaaatgggaagcagaagaggttaagccaagccaatcttaaatgtcagtaaatgtaaatacaaatatttttggagtagctaaaatacaatctaccttcagataatgaaatgtttgtgtttaataacatacctttacatatgcatagtgctgtttacttttcaaatcactttaacccattttacccttacaacaaagttaaagtgcgtatggtagttattttacagtttcaggatgagttaaattaaggcaccattgagttaatgatttgtaaagaccaagctggagcttgttgtaattgggaggcgggtacttagagcccagtttttttctaagcagtcatgtttccaattttatgctgagtgccagtaagtcatagggatattccctgcatttataaccaggtgtccaaaaagaagatgagaattacttctgcttctccaatttcccatctaaaatatttcatgattgaaaaatatatgtatttaagaacctactccagagctaaactgcagggttgtcaccatgtagacccatgatttgctccttctttggccaaaggcaagagaaagaaaagagaagttgacagggtacccattttcatctcacccagaaggtagctggtcgttgttgacagtataactctccaaagaaacaggaggcgcactcttcaggaaataacccaagcaattcagcccctctgcaaagaacatctgttcctggccatacaagatcctttgcagctttaaaaaaagcaaggctaggagaaaatgttgcagagggcttctcctgtgagggcagaaagcagagggacagatggggagcagtgtctggagaaatcagggtcatgggggtgttagcatttttgggggattagggctcagagcacattactgcattggacaaaagccaggagaaaagcagagagcaggcttctcactaatgtatggagatagaaggccactaaaaatcttcaatttgcttctcataaggcaaccatattcaaggcccccttctttacacctttacctcactactgtcaaaactctaacctctaccacaaaacctatactcctacagattttttcccttaatgccatgatgcaaaaatccaattagtttccatgatcttagtttagagcttggaacccagtgtttcctccttttcaccatacaagccatgctgactttatttatcaaagcctagtggcatgttaatatttctttttttttaatgccagaaatgttttacgatttatttatttatttattatactttaagttttagggtacatgtgcacattgtgcaggttagttatatatgtatacatgtgccatgctggtgcgctgcacccactaactcgtcatctagcattaggtatatcgcccaatgctatccctcccccctccccccaccccacaacagtccccagagtgtgatattccccttcctgtgtccatgtgatctcattgttcaattcccacctatgagtgagaatatgcggtgtttggttttttgttcttgcaatagtttactgagaatgatgatttccaatttcatccatgtccctgcaaaggacgtgaactcatcattttttatggctgcatagtattccatggtgtatatgtgccacattttcttaatccagtctatcattgttggacatttgggttggttccaagtctttgctattgtgaataatgctgcagtaaacatacgtgtgcatgtggctttatagcagcatgatttatagtcctttgggtatatacccagtaatgggatggctgtgtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgggcagtttttcatgtgttttagctagcagaaggcaagaaataactaaaatcagagcagaactgaaggaaatagagacacaaaaaacccttcaaaaaattaatgaatccaggagctggtttttttgaaaggatcaacaaaattgatagaccgctagcaagactaataaagaaaaaaagagagaagaatcaaatagacgcaataatatttctttttgccaagtgaattattcacttcttttcttttccatcttatcttcatgtcaagagccactttttgtgttttcttgtagaaggtcccacccacacatacacccagccaggattctccacgcccatcatcagagacctgtgtgagctgtgtgaccatctgtagtcttggcatggctgctttctccccaaatcaagccaattcagccaagaataccgtctttatttcaggcttctcaaagagcatcttggagaaaaagaagttgaattggcactcatctttgactcagttgtggaagctgacctggcgaattatacctgccatgttgaaaaccgaaatggacggaaacatgccagtgttttgctgcgtaaaaagggtatttatttttataactataactatggtttgcttagctatcaacaactattgaagttagagatatttcctggctttattttatcatgtagtgtaaacctttattaaccattttgtcttttcaaggaaagatatttctcttgctctgcatattagcataaaatacctatgatcttcaataccattaggaagtggataaatgaaatgaagtattgtcatatgttaaatccagtgatataaattgtaccttagttataagtgttacataaaatttgatatatatttgacattcaatattttctccacattttgccttcttatatcttatattgcttaaatgaaatgcaagagattttattattggatgagaaacacagttgcttttttattccctgactaaaaaataaaaaaataataatcccatataatatgcttacaattgttatcataaaaattataaaccatattttatgatatgacttggtattaagagatctttatcaggtgcatatatttctaaatattttggcatccctttctcaagttggttccagacggggtggaaattgtatataatgaacaaagaaaagaaactctaaatttacatataaaggagataaaaaacagatatacgaacaacaaacaatctcagcagctagagtagcttctgaattggctcttaccttgctatggcttttgattgctacaaaagggtaaatactttttgtatatgtacatccggcaaaggctttgcaaatgtagcagaacaaatgttctcaatcagtgttcttgttgcccacgttttagagcaataatagaacagattcaatcagcaaggtcacttagttgtacttcctggccaggatggaatttatattttccagccagccctaatacttgacaatgacaagcagctcttgaagaagcagagaggaatcattattctgaaaataaggcgtttatatctctagcaccacttcgtactccattagacttgattttatcttaaaataaaggcatatttaagtgtaaagaagtctaaaagagaaagtaaagtcagaagacccagattcaggagatcctggttcagtaggactgacttgtcttattagactccctaaaccttagttttcttatctttaaaataggattaataatacctaccttgcagagtcactttgaggttcaaataataatgatataatgggtgtgaaatatgccatgaccaaacagtctttattattatactgaacttggataatttatcctaggtaaccacttaggaaccacatgaagggcaggtattgatcatgcccaaacaccttgtggcaaggatcactttgtttctgttcatctcagtcttatttcgggcttagagatcctccaatcagagcctgctgctatacctctgtatcctcagagatatcaacttgagcagtgtctagctagtaataagcacttagaacccattctggtcaaataaatggctaattttttcttttattaatgaagacttagctatagccagcactatgataggtgctggggaatagaatgctgaataagatagacatacccaggtcttcttggagcttatactctttggaggagtgagaatgcaaagaaagaccaagattaaacattttttaaaattccgcaaaagatacatagtgttataattaaaaacctgctatgaggaaaaataatggggggtgtcttatcaatcagcccatgtggacagaaataaccttatttgagttttaaaataaatccatttctctttaataagtaaagcaacacaaggcagcccctaaaaatttctaaaaatttgacactacaaaccaagacacactgtaatactctgctaccacccaaggcttctacaagaaaactggtctaagtcatgttaactgacaatgttaattctcatcttccaaatatttaaatattggagttccccagggttcaggtcccctcttctcactcattcagtaggtgatttcattctatctccatctcatggttttgcttaccacttatatgctaactactcccaaatttatatctagcctggacttctcacctgtatactcaattgcctactaaacaactcttcttagagatctagcaggcatatcaaatttagcttgtcccaaacaggattcctaatttctcctgcctacaaacctgatcctccagtccccttctccatctccatcaccattgttctagttgctcatgccaaaatctttggagtcattcttcactttctcttttttctactcacatcctatatctactccactagcaaatcccatggcttaactttcaaagcctatttagactctgaacacttttcccaccttcactacccacatcctcttctgagccaccagcaccaattacctggatcatggtaacagcctaactggtctccctgcttccacccttttcctctcacagtctattcttatcacaacagtcagaaggatcatttaaatatgtaagtaaggtcatgttattcccctgatcagaaccctccattcacagttccttccctttccactaagaatgaaatcccaaaactttatcatgtcctataaggcactacacaatctgttcttacatctgatctcattttctaccacaattttcctcatacattataacactagcctgctttctgtttctcatgttcaccaaacacagtcctgcctcaggtcctttgcacttgctgtttcatctgtctggaacactcttgcctccagctgtctccatgactccctccttcccttcatacagatttctacttaaatgttaccttcttcataggtattttctgtccatcctatataaaatgatattacctttcattttctttttcttctaacctgtctctacttatttttgctttgtctattactattggatattatattacatatttgtttgcttcttgttttcttcccccccactaaaatatggaatactggagaacaggaacttttcttgctgtatttactgctgtatctctagtgcataaaacataataagtgctcaaaactatttcttgaatgaaaattctcctcatagaggacaagcacaatcaggtgagcaatagataacagggattgataaaaagaagatttgatctgtgattttgtcatgactaatgtcttccctgaattagctaaatgcattttttcttttcaagtattgtttactttccagggttcgcaaactcaaaagacctcaggtcccaggaaaatactgaattttttaagaagagggctggatattagacaaaatcaaaacatagaccagagaaaacatgccttgctttaaaagggcaacaactactttgttctataagattactgctgtttttgctggaatatatgcccagggatatgagagctttgaagttttcaagtgaagctgaaagactggatatgatgtcttttaatttttaaatattagtattcatttttgaaacattgtgtgatccaacaaaaccaattttttggcccatagtataccagtttgtactctccgttctaggtagcagttaaatgatttcattgtgctttacaaaagtatgcagttaatcttccctcacttggtctccttaggagcttctgacaatatagtggaagcccaagaaagagcaagaatccttatggaactgtcataatttttttaagtcagaacaagctctggcttgttttgagaaacttaagatatttcctttggagttggaccttttaagctttatcacatcatagcctggcctcattggcagtagtattcctacttggaatactagtatggcttgttttatggaacaataacttcttgatgagctgtaagtcaaatatttaaaatgccttaagtgatcatcatggagaagaaacatgatgcatcctttcattaagtgaaaagggctattgtaaaatgaaaactcacatctaatatatccaattaacaggatcaagttttgtaacctatccatcttcttacctatctgtcttctgtctgcacctaccacttccttattctcaggtgaacaatttgccagtaagtgcaactagcatttcagtaagaagttcatcctaaattttttctttggtgagccaagagtctgaacttaggttcaagaaattctgataattatttctgtttctctgcacatacttcctttctcataaaacaggggcatatcattgaatctctctctcttcattctcagtgctgctgcttcactctgtcccaccatacctgaatagaaaactttctaagcctactcaggatgctataacaaaacaccttagactgggtaatttttaaacattacaaatttagtgctcacaatcctagaggccgggatgtccaagatcaaggcaccagcagattcatgtctggtaggggcctgttcctcatttttgtctgagatatcagaatggccttcaccattcatatttctactaatattctgatcacgactatttaggcaatctctaagatgactgaggaattctctacagctctcttcttccaagccctcaccagaattgcccttaaggctcttttcatggcaatatacctcaaatctcttctaccctctatccattacccagttccaaagctggttccacaactttaggtatttgttacagcagcaccccacttctcagtaccaatttctgtcttagtccatttgggctgctataacaagataccttagactggatagtatataaacaacagaaattgattgttcacagttctggaggctaggaagaccaagatcaaggtactaacagatttggtatctggtaaggacccattttgcatagatggcactttctttgtgtcctcacatggcagtagcagcaaacaggtttcctcaggcatctcttataacaggccccatttatgaaagttctaccctcatgatctaatcacctctcacatgcttccctcgttttttattttttatttttttagaaacagggcagggtctcagtctgttgcccaggctgaaatgcagtggctcagtcatagcacactgcagcctcaaactcctgagcccaagtaattctcccacctcagcctccagagtagctgggactacagacacaccaccatgcccgactaattgtttaaattttttgtagagacagggcttcactttgttgacctggttggtcacaaactcctggcttcaagcgaccctcctgccccggcctccccaagtgttgggattacaggcttgagccactgtgtctggccaggcctccctcttatataatcaccttgggggttaggttacaacatatgcattttgaacaaacattcagaccatgacagaagccctcaggtgggatctcctaacctgcttcccaacttgtgagtcagaggagcaagctcaaacattccctgcattccctctctccagtcccttggcttcagttgctatttgtcccattctataatgtctgatctttgtgttcacagtgaagaaataggtgggttcaaactaagaaggtaaaaagagctacacatgtactttgggtgcctagaaaaagttacaagcccataaatatttgctgttcttgctacagctctctttgtgaagcatatacaagacacagcccaactaaaataactttccattttttagtcagtaaatgtccctagaagtatagatcctgctgagattgaaaattgcaattgaaaatagaagacaaaagaaaatccaggtgtcattagggtgatggcaattctgccctctgattataggatagatgtttcccttttgatgtgactgcctgggctgaatcaaagaatctggttgagtctctgggcctaggttcacagttttcaacttgaacagccatcattacataatatctttcaaagacatttttataaaatggaccccaaaatcacaaaggtacttttttcaccatggttttcttccataaatttactgctgaaaaaatatctgctacttgagagcacaaattgttcctgctgctgaagttttccatctacctaatagcaactctactctgtaaataacatagaaattgctgaaaaacttcccattccacgacttttaaaacatttgaaagctcttctgaccagagagagagacagaaagaccaaaaaatttatagcataaagtgaacatcttaaaacaggaaaaaccttttgaatcaagtcaattaatgccccaagatgaaagagaagtcagttttcagagtaacaaagaaaactgtattgctctatttaaaattggcttttaataatgtataattgatggtgtatataagatggtgagaaaacaagtaaaaattgtgatttgcagcccacagagatttcttaagaaagcctgctttatccccaacataggcagaggcagaggaaggtagtggttcctggagagccacgttttacatagagggcaggaagcattgctaattatgtggtgaaattttttttttacctgaaattttgtggcttagttttttaaaagaccacctcctgcagcaggcatgacagacacatattccaatttcctacccctattcattgtgtgtgccctcacaatattccttgttggcatattttgtccttcacagcagccccactctcttcctttttctatccttccccctctctccatactcaaaaagagtgacatttatttgtgtttcttacatttccattctatgactctcctgattggctgttctctctctctctctctctctctctctctctctgtgtgtgtgtatgtgtgtgtgtgtgtgtgtgtgtgtatatatatatatatatatacacacacacacacacatatatacacacatatatacacacatatatatatattcttttttataaaatataaactactaaatggatcttgttatattgagcctggctaatttctcttaagcaataatcctgtatagacataagggacattcctagagaaaggttgacagtctggctttcaagagtgacagactgtcaatggtcagcaatttgattttgacagtgccccagaattgatccatccaggaagactgactgatgccaactaaactcacaaggaactgatgtacaaactagattgtctctctcttttccagtttccagttacatggtaagctgaattagtactaaaatagtcacttggtaattatgtaattacgttaaagggaggttaggtaatcttgtaggtaattttatctaattataatgagaccgataatgtccctgtggaaaatacgtctctggtctgatgtctctcagattcagtatttttcctatggacattgctgaactcacattctagattctcctctgacttcccattttctctaaatttcatgataccataccatcttttgatgatacactctttatatttattaatatcactgattaactacaggttaagtcactgttccctgagcctgggagacattatgtcttcttccattatattttgatttaattgttccaatgctcagagttctagggatgcccccctggagcagcctaagtctgctatcaggtaggctggtgttggctgaagaggccaagtgattagcctggatttctcattctgttttagctccattgggcatattatatcacatatatattattacagtcatttattcaaataagtaggggaaatggataagctaattttacctgcttaccttatattggattatgttctactggggttaaatgaaacagttaaatcctgcaaactcattagattttatttgattctgaaagtaattttatgatgttgttctgcaaaagaatagggcctgtggcctgagaagtactagatggtaatcttgctaaaccaataagataattaaacagaaataagaaaatattggccttggacccagaataaagtagctttaatagttccctgaaatacatttagagcaaaagcatatatgtgacatcttagatgcgttcaaaacgaattgagagcaactattccttttcagatagacttaccacttttaatagtaaattaatcaaattttaaatagtttattttacaaaaatttgattcatacaaatgtatcaagagcaaagctactgcattaagcaagaattttctggaaaggaaaacagaatgttagtacatcttatatactagaaatatgggaagatcccaagtgttgctgatttaattaccttttcctgtttattctgttcgctccagatttaatctataaaattgagcttgcagggggcctgggagcaatcttcctcctccttgtactgctggtggtcatttacaaatgctacaacattgaattgatgctcttctacaggcagcactttggagctgatgaaactaatgatggtaagctgtcttctattgttcaaattccattaaacggcatgcatttgtgattatgtaagagaacttccctatttttagaaagtataagctgaaatatttaggggtaaagggctatggcaagttacttacctttaaatagtttagaagacttaccaagaaaaagagaaaagaggagaatatattgacaataggtaaatctgagtaaatgctatgtatgttttttgaaatggttttatttttataatattcctatacatttgactttatttccaataaaaagtttaacaatgagacattagttgctcaggagataaaacaattgctgtcaaatccctcccccttagtaagaagcaaattaagaatcaattccaatttttttcagaaaatgcaaacttaagtacagatcatttatagccattgctgccatctacaaaacaagcaatcatgcaagaaacagattgaaagctatggagacaatccttttaaagctcaaagtacatgtatctacatattttgaatgcttatagcaccattctcaaaggtgacctgaaagaataaaaattcagagtgtagctcataattttcttatatttgctgtttatgaattttgaaaatcttatgagtgaaatatcgataaagcagtgtactgagctttgtttctttgaacatttaaaatgatttaatttttttcaagagtacaaactgccatgtttccaatcaaaatcaataagaaatcatggcatgtagcttcttatacataaagttctcatcccgaaactgctgtaagccttggaaatgtgtatagaatgccacaggtaagccaaaaattttttagaaagtagtccaatttggaaaacattagtttaaaaagacagacttaaaactgagttttcattgtaccaaaataagtaaggttgaggcttttgtttatttttttgagttggtggtcttacctcaaaaaagagaaattcacagttttgattttaattttatagtgatagatgtaatgtcaaaatttttgaggaatctgattttggtcttattgttactattatgtgaatgatcatatgggtgggttttaattgactttcatattttcatagtaaattacagaaattcttttttttttgttaactgcaaagcaatgtgtgttttttgttttgttttgttttgtctttttttttttttttgagacagagtctcactgtcacccaggctggagtgcagtggtgcaatcctggctcactgcagcctcgaactcctgtactcaagcaatcctcctgcctcagcctcctgagtagctgagattacaggtgcatgccaccatgcctggccaatttattattattattattattattattattattattattatttcttgtaaagacagggtctcaccttgttacctaggctggtctcaaattcttgcattcaagtaatcctctggacttagcctccaaaagtgctgggattacagacattagccactgcacctggcgtgaaatgctttttgatgagtacatatgcatgctcatttgctcattttcaaatctacacatttactcagcaattacagcagccagtttaaaagtactacagactcttattcagacatatcttagaaatgaaaaattaaggcctattccaataattattgtatacactgacaatatatatggaaatatgatcaattaccctcagttcttcctctatacaacagttaatattgaaaaatcttgacttcttatctgtacacagaaaaaaaaactagagagaatgtgttactgagggaaatgtccctggtttcccaggtgccagcaagtggctaaactatccaattgtgaaggtaaaagatgtattatctatgtaaaagaacataaaaggggccaggcacagtagctcacaaaatctcagcactttggaagacctaagcaggaggattgtttgagcccaggagttcaagaccagcctgagcaacatagggagacctcatctctacaaaaattagtttaaaaaatattagttgggcatggtggtgcatgcctttggtaccagatagtcgtgggggccgagtcaagagaatcgcttgaatccaggagttcagggttgcagtgagctatgatcgcaccactgcactctggcctgggcgacagagtgagaccctgtatctaaaagaaaaaagaataaaataaataaaaatatgaaagggaggcttctgtgattaatatgttttgagtcctgataatatgcagtttgttaatctctaagattatacaatttattatgttaatctacaataattaattaccttcatcactgatacccaataacctagactaactgatcagttgtagtacatatttgtaagattaattttatgctgatatgatataatttttcaggaattaaatattccactttgcatctttatctgcaatgtggctcatggtttcaaaggtgtccagtaatatagagcattttgattacataattttatgtattgattccaaattcattgtttggggggaaatgcaatatggggagagggtacttcaagtgttttcattaggaaggatggttaaaatattttatttttctgcatagaaccttggactttaagtatataacctctgtattagcttcagtggaatactaaaaagtcaacatgtatatggtgaaaatgaataaatgaattttaactgccttttggaaatctacagttacagaatgccaaatgtcatccagataatctatcaagtttttcatttcactattgaaatattttgacataacatagacacaacttaattttaaccatatgctttttcttcatgctctatgacaatatctataatagtatttcctaaaagttattataaaaatgcctgattttgtataaaataaaatccatccaacaaactttaacttcttagccatgtttaaaatttaattcattttatttcaccccaccaatgattgcttcatttatttaacctttcagtttttcagtcattaaatatttaagtgtctactaaatggcagggactatgcatgacgcatttacttatattcttcatctggatcaacactgcagtcacacacacacacacacatactatagtaggtagtaggtatataataatcaacaagattacacagtatttgctctgtagaaactaggagtttagcactctgtttagcacagctgcggaacaactgagttataaacacaaatggcttcttgatagggaacaggattcgaatcagattttaaaacagaaaaggacagacgtaacaataggaaaattcttctacaaaacgtttcgttatcttccttataacttctctctttattaggaacagcatacctatggtaaccactgtgccagccctcttccttacactgttctgtctgcattgtgctctatttcctggttcctcagatgagcttaggcagcatgatttagcacaaaggaaggctcattagccttgcctagaaaagtggtgctgctgaacagccttttggtttagaaactattttcaggccttgctgttaaccttatttgcatcatgttgttgattttgctttatctatcttgctcctctttgtgagcaacagctgcagctattcatgaggttttcttggctgtctacataaggctgaagtgcattatttaaactgtagcatccgtgtcactgctggctcactagctggtatcctagagcttttgggacatctgacatggtggctttgagagctgtcttcctgctctggccagccaccataagctcttcacctttagttcatcttaaagggacacgaatgaaaccagaagcattcattttttcaacgaatggtgtgcttctagaatgcgaggtaaaatttataatccagatgtgttgggtgttaatacgtaccaaggacatgcatgctctttgtcacatcttagaaaatgtaagtatagaagtactttctaggggtaagtctttgtagcattgaactgcaatatcagaatataggtggagccagtaaggacagaaccaagaatatgtgagtttagtatgtttggaagacaaataaccatagtacaagcaataggacaggagtctagaaggtctggtcagatgggtaaagaagtcaagtagccattgcagatgctcaacaaataattgttgaatgaattaataagtggttcaatttagggaggtttgtgaaataggaaagttatcaaagtcagagagagtaacagggtctggtctgacattatggagtttgaggcagcaacactatctatcaagaacaatgaaatatattctgctcatgtgaatggagctatttgtcctttggcctattttattcttccagctgtgtatcatcggcagccctgagtcccaggtgagtaattatagctggagaaagtcaggggcctgcaggtgtatcctgcacgtgattggaacaagggcagaggtgctaggattaccaggaggttcttacattagcattgcttatgaacattctcacttccaagcagaattttatgcacaacagtggaatgcgcccaacttgtaagcgaaatgatctcaactacccagggcagtccttcatgtacatctgcttccaggcaatcaagtaatccaaccaaggtttatggaagccttttgcagccagaaaagatgctaaagagtattaaccctttctccttccttcaggcaccatcttaatacaaataaccagaatttcttttgtttcagagtggtgaaggctaaaatcttactaaaattagaacaacataatcctacttcagagatagggaggtctcatctactcctaaaagagggtatctacagcacatcatatgtctatcatttattcctccttcagcatgtagaatgaaatcatggtgtgggttatgctggaagtaaatgagtggctgcttcattttataaattaccttttggtcaggttttagatatgttctaattaggtatgttttaatagaaaatattgatgtgtttgagaaacaaatcctgaaatttttaacagtctttcgcagttattatttgtaagtaactgggtttacgaatagttcacatgagtctgtgctcactacattaacttaaaaaaattttttttaataagggaattttgaaaatctcactataactttttcagtatggatgtggcccatctaaaaccttcagaaactaatacctcaagtagctatgttcattaacattttgcaggaaaaaaaattgtatgcatacatgcacattttctctctggagagactggctctgagccaatacagcaaaaagaggaaaaaatacacttgcaaagcacagttaactccctgactaaatgtgtggagggaaaatctaatttggcaatactggacggatgtatattttgaaacaaaggcttcttttggaagcttgtgtcatattagttggccatgaactgaacaagaataacaggtaacgcacttgtataaaacccagctgctgtctctaatatttggtaatgaactgctttttgtatatgaagatgatgacactaaccaactggaactatggcatgtgctgtgaacagtgtctccaggagcaaggctggattatttcaatcttccacactctagggcccagcccctgttggatcttttgcacatatttgtgcaaacaaggtatagtctgtggccaagtaacagagccaagccaactggaaaataaaggggttaaatccatgactttggtctatttagtcctgcattcaaacacactgagctaatcattcacacatcattgagtattacaaatgcatatagtcactgaaagtcacaaataataattctctcttttattctgttctgactataggtggcccattgcataagtttcaattcatatatgactaggttattttgaaagggattagatttcctataacatggcatgtgacttatttttttccaattattaaagacggtcactaattattgtgctattcctgcctcttagtactcaaagagaacctgttaatagttacaacccttttgttgttctttatgtttaagacaacaaggaatatgatgcctatctctcttacacaaaagtggaccaagatactttagactgtgacaatcctgaagaagagcagtttgctcttgaagtactgccagatgtcctggaaaaacactatggatataaactcttcatcccagaaagagacctgattccaagtggaagtaagtactttcaaattttgtgtttaaaacgttctgtttcttttaggatgttatgtgaaggcttcaaacatcagagccaagtatttagacagttgtttctcacagtagagtttcttaaatccaaatttttcccatatgcctgtgttctgactttctagcacctgaatatttttaaaggcattctcactaatattttgggtatgatttctaaattgtgccataatggtcatttttattatattgccttagtatcctgaaaagcattatgatcttttaaaaaaatctgtaaaagttagttaaagccttttcaatatatttcagttgcaaagctggtcttctgtcactgagggtctacttatacctacaattattgttactaatggctttgaatctatgcctttcaaccttgttattcattatgccttgtcacttatttccagatttatggaaaaatccacttaaaaaggtatatgaggccattgggtacagcactctcactgtgtacttaaattattttcaagacacttgaatgctaggcttgaatgctatttttaagttatgctacacattgaagactatattgaggctttcagaataaattcagtttcaaggcaaaatatgtagttttttcccattaacatccagagtgcatacacatacacagtaaagtataaggggaacacagagaaatctaagacatagtccctgctctcgaagagcttaaaatgccattgaggaaaatataagttctagaacttatttgcatataagtactaatatccttgagaggggaagattgaactggtaactacaaatcataacatgttactttcaacatgtgataataacaaaataaaaagcttatattaccagtacttgacagtgtataaaataatttcacatacattacttcatttcatttttacagtaaccctgtgttgcgagagagtaggtacttatatcctcatgctgaggaagcaaaccccaaaatcgtccaagatcaaacagttggcaaatggttgagctggcagtggaacctagatttatttgactttggttctcactctgctagatcatgctgctcctcaataacatttattcagattaccagcaggctgccttggtcactaagctgacaggagacaaatggaaacaaatgggttttgattgttcatctcttttcttagcgttcatttatgtctgtgtatgttgatgtgtgcacgttagtatgcacacttagaaatgcatggaaaggaacaaagaaggcaatatttactggtttattttttcctgctccacaaatgtaagaattccccaagcttcttatcatggtccttcattcttttctttctgcagttttccccatactatcctatatttattttttccccaaggaacatcctgataccccatttttacgacttgaaatactattctacatttgttgtttctccaaggaacatcctggtacctcagagtcatttttcattcttctgtgtctttctcccaaattcagtgtcccttgcatttttttcattctcatttttccatcctagtgtaggccctaattatctaactccttcaatgttaattatccctctatcttccttatctttcctcccatccattcagccccactaatatcaagtacatctcctcgatcatgtcacttctgtgttcaacaaatgaatcattcactatttactacaggataaaatttataacccttagctaaacacttatacaatcttttgccagcccagatttatctcctaaatttgtctcctaccacttcctctactcatactttccactctagccaaactgtgcctttgatatacattgtatgtccctgtaatgcatttgttcatgttagtcctctatgactttgcaaatcctacttatccttctccatatcattgcctctgtgaaaagtccataataatctctccagctgtagaattcatgatgtataatcacttatttgacagtaaatttgtactcctgtgacattttgcattttaaaataattttactagcttttcatctatttatgtcttttctagccagcaagattataaactccatgaggacagggattatatctcatttatttttgtatccctatagtcatctagcagaagacttgagctcattagatgcttcatagatgtttattgattttgtttgaaaaatgtcgtcaggatgggcagagattttatagtccatagaaaattcttttaatgctttaaaatcagactgagtaggggcttggatcttgggtcctcaatggtgcacaggaagactccttttacaagtaagccatttgggacaactatgcagtttttagatgcaaccactggagggtgtttgattttaatccttccttcctgaacgaggaaattcatgttctctgaattccgatttgcgagtgtaacctgcagaggctcttaaaaaggccctttgacaatttttcttttccatcaacattttagagttagctgagcagtcaccatgtcaggattaacgagtttttccttggcatttttagcatgcattcaggaagtcaatgaagtatatgaataatatacttgatttacacatgaatgacagagtagaacattttggacttggtgtatatgtgctattaaagaagcttctgtggtctgtattttcaaccattggtacagatttaacagcttatattatataaatacagacacattcctgttgggggggaaacctagttacagtattataagctgtgtttgtccctcacatctcatttaaaacatgttgacctaagactactccttcctctgaaaactagcaatgaggcctttgaggactatgaaagcagacttcataaaatcattcttgatccacaacaataattttctatgaatcaaattaatgacatctatgacataaacccattcatatttaatgtcttcacttttgatgtatcttcagtctttttgtactactctcacggtattccaactcaacctcatcaacacacaaacctttccaatgtacacagtttcgaaagtacatgaaaatctctctctctctctctctctctctcatataaccaagaattctcagaaaccttggttacaaagatgtcactttccaaggtgagctgggggtgtctgtaccacccatgccctaccaggaatatgttgtcctttggccattgtgaaccagcagagatggggagatttaatgcaaatatttttcctaaatgctgaaactgagtgttccgatctggacattattttcctggcagtgactacctttccattcttgagcctgtggccaggatcttccttatgttttctcaggttgggtgcctaaatatggcaagaattcttactttccagtaaaagtttggtctgtcttttcccagactagaaacatctgtccctgagaatagcgaaagcaactttgttgccaacaggcatctgaatgtcagaagtgacaggcaaccagaagaaagccagatagaaaacaccctattcaaactgcctagagacacaaacttgagaagtagagatttttctcacccatgcagctgctggtttttgtggtataaactactctacacagagcacattgtgttcatggggcctagaggatccttgaggaatgaacagatgtgctctgaagctgacatgtgaccaacagaacccagctgtgcaattgagatcctgagattggggacatttttggatgagtaccatttatgcttttgggcctatcttatctcagtgtttctgtagagattaaataaaaaccaaaaatgtaaaaagttattgaatcaggctgagggtcactggtcagatggagaaaatagcattctaaaactaaaagtagaaacaacccaatcctgtactctttgtttccctttaaaagtaagaaagtaaggtgctgaaaggtgcatatgcaatatttattaacaattataaattaaaccagttttggatgaagctttagaaaaagctacagatgtctaagtggactttgaagagaaaaaaaatccttggaaggtttttacctcaatttccccttctatttatagaaagactatgaggatccctatgtgagttgttcatgcatgattgcattcaagaaatacactagaaaactaaaaatattatcatgcttatggtttattggccacatctttttaaattatattcatgaatttagcctcatgtgtcgaattatcttttcatttgtctttatgctcaattttccatgaaggaatcctaagactttcagtaatttaagggaaaaagtataatgtctgattacattcttgcatttggtagactttcctcactaatctaatcttcaattctttaatgcttagtactagccatgtgattgtgctgacaatgaaatgacaaatgactagagaatacatctggtgtcagatgatccctagtcacttctgaagtgaggcatgcaaaaaaacatttttgtacatggatctgtaagcattcattgccactagttcctctaatagccgaacagattggacaccatttaattaagttgtctttggggagtaataaaatcgttttccagacaatctgatgtgtgtgacctaaaaagtttgagggaggggtgacatgaacaatcatggaaatttaacatattgtgtgaactttactcacatggaataaaattgaacgtgtccattatccccttcatgttaaagtcaagagagaaaaaaactgtacttcaatatgtccagcaatgtactgaggtcaatagaataatatttctcatcaaagtttgaggtagaggttagagttgattatgtagaatttcattcaggaaatctgctgtttgggtggcacaaagaacaggcatctcaaacaaacaaacaaacaaaaaaacatagtataaaaccaggataagattgtcttaagtactggaggaaacacagaaaagactgtaagtagtaagtggctttgttccatgttcattaaggctgcaccagtgagaattagttacactacaagcttttagggcttcagaagagagaaagaaagaggtggagggtattttgcaggtttgctttctttgctactctccactttatgtttctttcaatcttctctaaatgtgtcccattccctacctctactctctgtgaagaggtgaagagagaagagaaagaagacagaaatgtggacagcattcagagtggattcttcacaccgtcatgcttccccactcacccacaggtgaaatgtgaaagtacaggattcattactagcaatatagcctccaaactcagaactgtaaatacacacaattccctgtagtcatcaggtctcagcaaattcatgttagctgctgagtcaatgattaatcaaaattaattaggaccctcatactatagagaacaaaactcctgcctaagaaatttagctcagctaactgtgaattatcaagccaagaatttggaaggggagagggcaggaaaggtttttgtaggacaagtaatatcacacatatttagaaaggctcccagccaggcacggtggctcacgcctgtaatcccagcactttgggaggccgaggcaggcagatttcctgaggtcaggagttcaagagcagcctggccaatgtggtgaaaccccatctctactaaaaatgcaaaaactaactgggcgtggtggcagatgcctgtaatcccagctacttgggaggctgaggtaggagaattgcttgaacccaggagacgaaggttgcagtgagccaagatcacgccactgcactccagcctgggcaacagagcgagactccgtctcaaaaaaaaaaaaaaaagaaaaagaaaaaaaaactcttcctatacacacacacacacacacacacacacacacacacacacacacggctaacttaacattatgtagcctcagtctccatggcaaacaacagacacagaatcttacatctgtcagagacagaatcaagacctaaaatctttagcaacatcagccaagatagagtcaatgtgtgtaactatgccagtaggttagtatttagaatcattatataaaactcagatagtatttttagtgatataaggtaacccactgtaagcctctagttatagcaaatgtgtgatattttccccaactatgtagtggtgaataatatatttttctttgatatataggaaacatatgtaggcttgattttaggtcttgatatattaacctataggttttataaatattgttgatagctataaattagctaacgttcaccaaaaattaatggagtattatctgttttgatgcatcctgtctcaccctaatggtgtgtctttttaactaataatagctgctgtgcataactgtgaatttaagcatatcaaattactattatatgaatctggaaagtaataaattatgcttttgtttacaggctaagtatctgtcttttaacttcttaaaaaatatatcctatatgctgctgataatgaccttgacattagtggaggtgtcaacacaaaaataatttataaggagctaattgattgattagtttgagaaatcagatggttagtaggcaggagtaagaccacatagaaattcatgaatatagagttttttctcccatgtccttcttgcctacatctgcagtagactcaatggcctgagaattaagaaagtactgaattcttttggaaaagtgtatgtttcccattagaagcaatttcttttgtggctgccattcttcctgcttctatttcctccttcagtttgcctttttccttcgttaatgaatggcataatttgcttttaagtcacttttctagatctaattctatttctcctctaaatgcactagaattttgttttatacaatggcccttgaaagatattttaaaattgaatttgctttgtttttaataaggctttaggtagcaactttctttgctttttacaaatactggtgctactggcatgatgtttttttcatttctctaataagtacatatcccaaggagagtctagtggcaaggcattgtattccagaatattttcctaactctctgtcaactcccagcagagacaaaagaaaaagttttatttcatttgcacttataatgtgaaaaaattaattatatcaatttaagcaccctatcaaaactatgttcaaggagacttttttctttctctaattgttgaagattatgaacaggttaaatgtacttggctttgtttcatgtctgataatctgctgtggtttcgcagactggtctagagaaacagaaggctatcagacacagccccttttggtcttttctgtcatcacaagttacatcaaaccacagcttgcaaagaaatgacttagtgaccttttatttaagggatatcttatatttttatgtggaaaaagtcttttaagggattcttgctactcagttgctaaatttgccggaacaagtcaaggcaagatttagtgagtattcatatgtgctgtggatttagggatttttttttttgaaaaacgtttctttattatctcttcgtggtaacaagcttttaaaaacgttttctgaaggtttctaaaatgtctcccaaaaaaccacaaccctatgagggcaaaccccactgcctgtcagggactactactaactatgggctggcaatgtcttaacttgatacctgtttctgcttagattatttggaacttttccaaacccaaccaccctccttggtctttaattcaggggtggcaaaacttctttgtaaaggtccagatagtaaatattttaggtttcgtagattatatatggtctctgttgcatcatatcttcttattcttctcttttacaactctttaaaaatatataaatcattcttagctcacaagccatacaaaaacaggacatgggcctaatgtatcagtctccagatcacagtcattggatgcagacatacaaccccagggtgaaggggaaactggggcacttgcttgatagaagccagcaacaattccctggctaaagattagcaagtaaaaaatatgaactctacctatttgatttcttcctcatttacttttgttttctgtgatggctaggttcttatattttcccaaagacaacaaaagaaaacttaagaagagaaggaagaaggaagcagagggagataggatagagaggaagaatgggataggtaaaaagaaagagcgagaaagaaaacaagtaaaaagaaaagagaataaaagggcagaaaaagaaagggataaagacagaggtagagagggggaaatgggggagaaaaagagagaaaaacagagagcagccagaatatggaagctagggcacagtctcgccttcttttcctaagagccagtcagctcttagaggcacctccccagctgctttcaaacattgaggttgctgcccagccactgatcatcatcccaagaagtgaaatgtgggcttcacatctgaaaacttccacttggtttttcaccaagtgaaatggaatacgagattcagggcccaagcaaatggctcatgttttctttgggacactggggctgtgtctacccagggaaaattttgatatactgactgactgactctagtgcatatgattaatgtatacatagggcaaaccaggataatttagaccttttttcttctacaggaggttttcagcaggaattatctggatggttgcctcaactctccactaggctttgccagaataagcacagccagtagagtatgcaggagacagggaccactccctctctccaaggttccctttaactcccacaccccgtgtagctaagtatagtgggacctgtactgacaggcattccttctgggggcaaatgtaaattctgtctaataagtctctaagaagccccaagaaccctaaatattgcatactgctttactgtcagatggcaaaatataatagatggatgaaaggggagaaccatacttatggagggaaaatgttaccctgttcctttcctcatcccaaaaagaagctagcaaagccaaagcccatgacatcccagtcaaatgaattactacatgtgcgtacagtttctcttataagtgtggatacctgggttgtaatttcttttctttaagttgatagactcatgtatagatatagctttagtttctaaaagcatagtttaaaagtgcatttgaggctgaggacagaggattgtttaaggccaggagtttgagaccagcctgagcaacatagtgagaccccacctctataaaaaataataataaaaaattagccgagcatggtggctggcacctgtagtcctagctactgaggaggctgaggcaggaggattgcttgagatcaagaggtcgaggttgcagagagctgtgtttgtgccactgcattccagcctaggcaacacagcaagactctatctcaaaaaaataaaaaaataaaataaaagtacatttagactaaaaactaacacataaaaattatgttgttcctagaggtacactttatgtgacagagtgttactgacaaggtttgtacaaggtttaatttttttaaatggaattacaagctgtaattaattagggaacaatactactcaaagtaaccccttggtaaattattttgtgaagaatgattctataaaattaataatgaattcataattcacctggtaaaactgtatcttcattgactcctgcactgatatcatgattctgggtttgggttttgttctgttttggaggaaaggtgaaaagaataatgagaaaaatgcatgatagtttattttactgtatcttacagatccaacttctaatgatgaagcttcccacataacttctttctttttgggagcagaaagaaaggaagaaaatgaagagtcagagctgttgatacattgggaaaatatttttccactctattgaaacttcctacctttccttcccttctgtttcaccagttctctaagtgataattacagagtgataacttctcaattactatttctgtggtgtttttttgtttcattttgtttttgcagatttcactgcttattttttcccctgaatgcataatctctaaaataaaacaatcaaaattcttaaaagttccctctcttcttagacactgccttatcccgacagatacagtcattgtaactactgcatgagaaagatcctgaaatgtattaagtcaaaacccaaagaacagtaacaacaaattgttaaatgggcaattctatgtgtatctcttaaaagtttcttatttatctgtagggtataaagaaagtttgctcattttcacttgtaaaagttttcttgctgccaagtagtgaaaataaaaccttagaaaagagagagcatctgtaaaatatgcatctgtaaagtaagtttctcttttcaaattgcttgtactgagctgtttggtggccccacaatatgtgctgaatgtgactccttgaaagcagtctgtaaccttgggcagatttgtgttgacaaatgttgctatgcttctttctgtaagcactgcttctgctagagggcactgtacattagacaaggccttgtgttctgcttcgtaaagacagctctctggtgtagcacctgtgtctaagtctccatttgttaacacatgtgtgtgtttccctttttggcagataagactttgggaagcatgattccaaagggattatttcatgtgataaataaatccggagttagttgagtgtttctctaccatgtaaaagccatagataacatattcacctcactttcagaattgctccacaaagtagggcaaatactttcttttcagttggtagactccttcactgttcatttcacaccatcccccacctccgactctactcttcactcttccttggaacaaaagcagccagttccaattaaactcatgggcacaaaccacttccctatctctgggtttgaagggcataatggagaacctaagtttgcaaatgacagaaataatcggagaaacaagctatgattctaaaagagattttccaccatctctatatcacagttatctctcaagtagttagtatacatagccccctccttgtttagtagttgaaaactaggggccatacatacagttagtatttgtcaattacaataaataatattaataaaaataaaattaaagaagaaaagcaaacaaaacccataaatacagtaactctgcatttattaaaaggatccatttctcttttcatcggctccttgattagttgttcacttagagtactagcttggaagcctgacttgaattaaatgattacataaataaaaatcactgaaatacacctaagctctgaagaagtcagagtttatgttagccaacaaaacactgtaagtaatggtgagggaaaagaaaataacgattataagcagtttttttttttttcagttttaaggaggggaatgtaccatacaagaaaagaaaatgtgatggactttagtgagagactggatctttgctatactagtgtgcaaacctgatgctttagagactggcaatgtctttgttttactctttctctctttctgtgatttgtagcatacatggaagatctcacaagatatgttgaacaaagcagaagacttattatcgtgctaactccagactatattctcagacggggatggagtattttcgaactggaaagcagactccataacatgctagtcagtggagaaatcaaagtgattttgattgagtgtacagaattaaaagggaaagtgaattgccaggaagtggaatcactaaagcgtagcatcaaacttctgtccctgatcaagtggaagggatccaaaagcagcaaattaaattctaagttttggaagcacttagtatatgaaatgcccatcaagaaaaaagaaatgctacctcggtgccatgttctggactccgcagaacaaggactttttggagaactccagcctataccctctattgccatgaccagtacttcagccactctggtgtcatctcaggctgatctccctgaattccacccttcagattcaatgcaaatcaggcactgttgcagaggttataaacatgagataccagccacgaccttgccagtaccttccttaggcaaccaccatacttattgtaacctgcctctgacgctactcaacggacagctaccccttaataacaccctgaaagatacccaggaatttcacaggaacagttctttgctgcctttatcctccaaagagcttagctttaccagtgatatttggtagtgaaaaatctgaattcctctgaacagctagataagcatagagaatttctgttataccaagcataaagtacacctaataacgttgtgttaaaaaagtgtttgaagaaaaaggtacaaaaatggcttttatacttaaatatttttgtttacatttccagaatagtggggg
